United States Patent 8,781,750 (CELL-TYPE-SPECIFIC PATTERNS OF GENE EXPRESSION) - sequence listing, part 6

SEQ ID NO: 35898 - DNA, 175382 bp, Homo sapiens
caccaagggctggccgcagccactgtagctgagctcagagccttctgtgtggtttgcgggggcaaggtcagctgccccctgccctctctctggggctatttgaggaatgcggcctttttgcataagaaaggcttttctctacagtaactgtggtcgctgatcaatgacaccttcctggtaacatttcatattgcttttttggaggtgggggtgcagatatctttaaaacttgcatgcgattgtctttcttttaatcacataaacatcatttaaaaccaattcatattttgtattgtatattaatgcctttcattcctgtattttaaaatgctatcataatcatttttcgaaatacatatttaattattttcatctgttcaatcatctttctttagtaattaaatgaaaatagcactttattaagaaagacaaatgttacatattctctgttttagtgttttccagaaatttgctatgaaatacgactggttgaaaaggagagggtcagagactttcctgagagccacaggacaaaatttacttacaatcgcaggcttaaagaagctatgatagtttaaattacgtggcttagtttgttcttattgtggaaggtgcacaaggaattaatttgtgtagacagaacactgagagtcccattctgaatgcagagacagctactttgctaccgtgcaaatgagtgtcgtcatattgtttgtttttctccttacccaaaagctatagacattggcttgcatatttgagtattttcactttggttttgtaaatggctgcttgacttgccttcctacagaaaatccataatacagagatgtattattttcttactcctttatgagtgattagtttgcactgaaataaaaatgccactcaggaaatgtcatacatcttcaagcagcatatattttaatagtatcatcttgtagaaagggaattacaatctttatttcttctatatcaatgagcaaactacttttttaatttttatatgttcatttttattgacttagtcaatagtttacctactttttaggttttacgtgctccattaatgtccattgttttaggctgaacctttgacactcctcatatatcgtttgtatgagactagatggcaagtaaagataggattcctcaccctaggttaaacactaacttcctcttgaagaaacaacttaggagtccaaaaagcaggctaggaattgtttaggttctgcaatacgaattgtgcaaatgccaacaggattgaattgagagaaacacattctctaatgaaggactcattcctgcagggtggatctatgagattcaatagcaaatggctgttatacaagtaatgaaatcctcaatcttatggtctaaaagcgattctggggggcacttatttaagatacatgagatgtgaaaaagcaatggaccaagagcattgatagtttatggatatttttatttcacattattgatagagctttgtttgccaggcaatgctgcagtcaggcactcggggtttcaataccctatacagaaaatctcaagagcagaccttggttaatttttttaagtaaccctcatcttcattcttttattgtattatgacctcgcgccattgaccttaaatttcactacaaatttagaagaacctaatagtcattgcaaactagatagataatggtatttatgtaatgaaggacaagggaaagatgattcccaaatctgaaagaaactagaagttttctggggaaacaaatagaggagataagatttactggtttattcttcattgatgagagttgcgttctgttctgataaatggaaagctccattgaaattacagatggtcctcaacttaagttggggctacttcccaataaaccatattgaaaatggtttcataaattgaaaatatcaccataaattgaaatatcataaattgaaaatatcaccagtcaaaatgtgtttaacatgcctaccttactgaacatcatactttagtctagcctgtcttaagagtgctcagaacacttatatttgcctacatttgtacaaaatcatctaacagaaaccatattttataatgtgttaaatatctcatgtaacttattgaatactgcaatgaaaatgaaaagcagaatggttgtatgggtactcgaagtacaatttctactgaatgtgtattgctttctcacaattataaagttgggaaatctgaagtcatacctcagggagtgcttttattacacaatacaggtttatcagacgcatataccaacaaatcataggaaattcaggtttgggtcaagggggaggggttcaacctacttatacatatttccttcctctctgttgggctacctttatccttgggattgttgcaagatggccgtgtcatgtaaagggctgtgtcttttagcatcatgaataagatgaaagagttgaaggccaacttcattcaaatgtcttctcgatgtgtccttccctttttctcctggactgctctgtgatccatgtctctgtagaaaatggctggcataagtcaatttctgactgggagctgtcatgattactgtctcccactgttaacactgtacttggaggtcttgatggaattgggcaaacctgttctttcagaccctcagtttcatctcaacacaaaactctccaaaagtccttgctgctccacagcagggaactctcttgaagcaataacatgaggaaatagtgggcttgcatggctgcctcacattcctcaggtatcactgtgctcattgcctgatgtactgtgtcttgccaaccatcattccacgtaatttacccattcttggtttttacattggttaaggcatgtacaaaccctgttagtttttctgcagtatttggattcataccttctgaaattacttgacgattactgtgtctctggttatttgcttctagttggcaatacaaaggaacaatgtgaatgaaactcataaagaaaaacctatgatttaatgggcgtgtgtaacactagagggaaggtcagagttagtctatgcatgggtataggtaggagtctcagtgggtgtcagccattctgtgtcaacaaatcaaatatttaaggtggatctaaaagaaaggtaatatctctgccaattaaactagagtcacgcattgactaatggcaaatacagtctaagaagtgcatttttaggcaattttgtcattatgagaacaacgtagagagtacttacacaaacttagatggtatagcctactacatggctaggctatatggtaaagcatgttgcttctaggctacaaacctttactgaactgtaagcaatgataacacgatggtgtcatatcccatatatatacacatacacacacatacatatatatacatatactatagtaaaaatatgatataaaacattttttaactggtactgctgtttaaagcagatatcatgagtggattttgcaggaccggaagttcatccaggtgagtgagtgagtgagttgtgagtgaaggtgaaggtctagggcattattgtacactactgtagatttaagaaacactgtatgcagccgggcgcggtggctcacgcctgtaatcccagcactttgggaggccgaggcaggcggatcacgaggtcaggagattgagaccatcctggctaacacggtgaaacaccgtctctactaaaaatacaaaaaagttagtcgggtgcggtggcgggcgcctgtagtcccagcatactcaggaggctgaggcgggagaatggggtgaacctgggaggcagagcttccagtgagctgagatcgcgccactgcactctggcctgggtgaaagagcgagactctgtctcaaaaaaaaaaaaaaaaaaaagaaacactgtatgcttacgctatactaaatttattttaaaaacctgaagtaggccaggcgcagtagctcacgtctgtaatcccagcactttgggaggttgaggcaggaggatcacgaggtcaggagttcgagaccagcctgaccaagatggtgaaaccctgtctctactaaaaatacaaaaattagccgggcattgtggcacatgcctgtaatcccagctactcaggaggctgaggcaggagaatcacttgaacccaggaggcagaggttacagtgagccaagactgcaccactgcactccagactgggtgacaaagcgagactccatctcaaaaaaaaaaaaaaaatcctgaaatactaatgacattatgattgctacaatgtcacaagataagataaattttcaactccattgcaatcttatgggaccagcaacgtgcatattgtctgttgttgaccaaaacggcccttatgtggtacatgaccctatacacataacagcatattttatatttatggaaaaagcccttctagaattataaaatcacaagttttactcacataaaatttaacacaatattgagattaactcataaatgaaattataaaagtcttaaaattttgactatgatagttctaaacaagattttaatccagagaaatgaatgtgttcacgtaatcctctgtggcataaagagtaatggcaatgaaacatttcttaataaaacaggctgcatcattgtcagtgcgatttgcaccttcccgttgacatccattctgtaggtattgaatgcaggtgatcttacctgaaggtgacaacagaagattttattacaagatcacgcatgtgccctcaataacgccatgtcattgatgccaccagggtaacagctattgtgataaaatttgaaaaataaacatatgtggcttgaacccgggaggcggagcttgctgtgagctgagatcgcgccactgcactccagcctgggcgacagagcgagactccgtctcgaaaaaaacaagaaagaaaaaagaaagaaaaataaacatacgctaaaaatttagaaggatagtaagtaataagcatttgattgcttgagcccaggaattggaggctgctatgctctgtgatcacaactatgaatatccattgcactgcagcctgagaaatatagctaggctccatctctaaaaaagtaaataactaaataagtgtttgaaaatatttagcaaggaagccatactaatgtagctgaatcttggaaatcaagaaaaaaaattgttcgtttaaaagggcaaaattaaaaaattctttccagatagaaagaataggtgcagatgatagagcagcgtggcccaggggaggggctaagcagtggactaaggatggggaggctggagaagaggctgaggggagtcacatgttgtcctgagatgagaaagggaaaaaaagaaacatgttcatcttcaagtgcaaactctcttcagattgaaagaaagtttttagtttcttgggaagcagaaaagaatataggtgaggagtttgagagattcattaatttctttgtgaaattcaacataaaggaagatattctgtgttgctctttgttcactatatgtgtggggctcacagggaagcaatatagacaaagtttccaaattctcagatgttaaaggccaatggggattcagaaaacgcaacagaaactaaactgcaagtggaagagctgcccttgggagcccagagggcaagtttcaggcctggactgggtgggcaagggaggcctccaggaggaggagctttggaggagattgtggagagtgaggagcagtgagtccagcaaacagggcagggaaagcgaggaggaaacagtgtgtctgtggcacaggccagggcatgagaagagggtggtgggttggaaggaccactgggatgagtaatacatgaggaggcaggagaaggaagggcagaccatgcagggactgggcatgggggtgagggtgccgggcagctcagaaagtgatgcaggggccgctctctgaggactgcattctgtggggagggatttgaatgtctcagttcttttatgaaatgttatccccaatccatgaggtcttctgattcaggaaccagtcagaacaggtgagggtggccccagtccactgtgcaggaccattagcattgccaggaggggttggtgctgaggacaaaagagagtgaaaaggggcaaagaactttctttcctgtctgtcattttgcagatgtaagtgggatctgtggatctgaaaattcacagtggccagctcaccaccacctgatgaaagatacaccacagggtgagagcatcctaacagcaaactgcaaatgaggtgggtttgcagctgcacagagaagggaccccagggaagctacacgggcaaggcaggcaggggacttcagaggtggtagcagtgggtgttgatgaaattattctctgaggatatacacgtttgtcagtgtacgtgcatgaccgcttacatgttgatgttcgcatacaaaccccacaattttctcatgtttttcagagcatagcatgtattttgactttattctttctaccacacgtaaccatgccttgtatacctagcaatacttaacgtttatttttggtggattattcatggttaatgcatttcctgacttggtagccaaatgaaattaccttgctttacaggcctttggttgatcatttctgaagatttgtgtcgcctgaattcagtgggggtcacctctccatgatcttaagcaacagtcctgttgggactgttatgctatcctacttaactttggacttgtatgtcctggaaaatatgaaactatcgatactcacttgaaaattccaggtgctttaccttttactttgtttttgccgtgtttccaatgttatatattttctcccacttactttggattcaattgctctgcttccttttacagtaaaaatttagatgtttgaattttgggtttcaacttttctaatatatacacactcaatgctgtaattttcctctaagcttccctgttgtagctgacaaattttgatgaggtgtgttttcctttcaatttagttcaaattattttaaaaaatttctcttgagatttctttgacccatgtattatttggaaatgaattatataatctccacgtattttgcaattcaccagtttttaaaaattgatttctagcttaattctgttgtgttttgagtgcatacattgtattagtctgattcttttaaatggtttcaggtgtgttttatggaggagaatgtggtgcatctcgatgagtggtcctgtgggcttgagttcaatgtgtattctgcccgttgttggataaagtctgtagatgtcaattatatccaattgactgatgatactgttgagttcaactatgtccttactgattttttctgcttggtggatctgtctatttctgatagaggagtgttgaaagtctccaacgataatagcggattcatctatttcttattgtggttttaacagtttctgcctcacgtagactgatgccctgttgctctgttgttacatgcatatatattaaggatcattatattttcttggaaaatcgatccctttattatcacataaggtctttatccctgataattttcctgtatttacattacattctttctgaagctaataaagctatgcctgctttcttctggttactgttagcaaggtacattttgtttcattcatttacttttatatgtacttttactttttttacatttactcttattaattgacaaaatttgaggtattgactatgtaaaatcttcacatcatcttcaaacatgatgtttgaagaataatatatattgtgaagtgaaaaattcttgctaagaacatatgtgttacctcacacagttatttttcgtggcaagaacactttacatccactctttcttcatttttcataatgcaatttattgttaactatagttaccatgttgtacaatctcttgatctttttcttcctatctaactgaaattttgtacccattcacaatcatctacccatcctcatcccctaccacccttaggccctagtactcaccattctactttgtatttatataaatgagcttttttagattccgcttacacatgggttcatgtggtatttgtctttctcttcccggcatatttcatttaacatattgtcatgcagatacattcattctgcctccaatgacagtaattctccctttttaaggccgataatatcctgttttgcatatacactgcattctttttatccattaatctgttgatgggcacttaggttgatcccatatttggctattgtgactaattctggaatgaatgtgggagtgcagatatctatccaacacaccggatagtcaatgaaatctcccaaggcagattttattacctttggatatatacccagtaataagactgctcgatcaaagggtaattctattgtttttttttttaggatccttcacaatttttcccataattactatattgtactaatttacattcccaccgacagtacacatgttcccttttctccctatctttatcaacactaacttttgtcttttaaaatagccattctaacaagtgtgagatgatatctcattgatttaaatttgcaattgtctatgtatgtcttcatatttatacagatttccaatatacaagatataacggggacttgtttttagatctactctgacaatgtgtctttaattggtgcatttcaaccattgctactcaaagggattactgacatggttgtgagaggtgaggccagctggacttcctgggtcgagtggggacttggggaaatctcctgtcttacagaggattttaaaatgcactaatcagcgctctgtaaaatgcaccagtcagcaggattctaaaagtagccaattgaggggaggattgaaaaaagggcactctgataggacagaaatggaacatgggtggggacaataaaggaattaaagctggtaaccccagccagcagccacaatccgctggggtccctttccacgcaatggaaggtttgtctcttcgctcttcacaataagccttgctaccggtcactctttgggtccatggcatcttggactaagagtccaaggtcagttcaacttggtggagcaagctggcagttagatgaaaaatatacacagacttgctgcagctgtacagatgatgaacgtagaactcaaaagatgatggaggccgggcgcggtggctcagggcctgtaatcccagcactttgggaggccgaggcgggcggaccacgaggtcaggagatcgaggccatcctggctaacacggtgaaaccccgtctctactaaaaatacaaaaattagccaggcgtggtggcaggcgcctgcagtcccagctactcgggaggctgaggcaggagaatggcatgaacccgggaggcggagcttgcagtgagccaagattgcaccactgcattccagcctgggcgacagagcgagactctgtctcaaaaaaaaaaaaaaaaaaaaaaaaaaagatgatggaaacagagtagaaatgatgagaatgatgaatgatgcctggagcttggttcctgggttgctgtggtgttagatggtcacagagcagctttttggaagcttatgtccatgtctcctgctaacagtagatacttgattagaatggaacagaatgtttacctgatttttacttatagcacctggaatgctagtagtaaaatgtaagccctttggagacagaaaatttttcaattctgtgttttcagagcctaggataattcctctgacctcactggtgagaatacgtaggtgttaaactaatgcacggattaaactataagggcaaagaaaaaagttcccctttgtcctctgaaggttcactgaaaaatcaactggcaaaaggaagattaatagaagaaaaggtatgtaaaattttattttaaattgcatagggagggaaccacaaaagaatgatgacccagtgaggtacacacgtttatatatctgttttcatagaggaagaaggcgatgtgtaacatagactattattttaagaggcaatagaccatcaaggagaatgaacagacccaggaggcaggaagcagacattaggagaaggtgaggtgcagagctacgcaggaagagaggttgttgtttaatgcaaattaagtcctccagataatctcttggagctgacctcaaaagaacagacggtaggtgtgtctgggctggtgaggactcccagcctcttgatctttcctggttacttgatgagatccctggggaggatgttcaagaccattgcatttctttattttattttattttcagatggagtctcactctgttgcccaggctggagtgcagtggcatgatattggctcactgcaacctccacctaccagattcaagtgattctcttgcctcagcctcctgagcagctgggattacaggcgcctgccaccacacccagctaatttttgtatttttagtagagacggggtttcaccatgttggtcaggcttgtctcaaactcctgacctcgtgatccacctgccttggcctcccaaagtgctgggattacaggcgtgagccactgtgcccagcctgtaaatgcccatcccattatatttcttttgtaaagaagcttgcttggtcagataaggaaatttcagagaggctcttcctggacttgggagtgggagacaagattagagagaccttcattctgaggcaaattctaagacggctcagcatgacaaagcaccagtctttggtatatctgagccccaacaaaataaactgatttgtgtatgaagaatggagcttacagctcagacagcaaatcaatccttattgactcagttttcaacttcatctggattaccagatgcacagtgtgaaaataagtcatttgccagcctgagcaacatagcaagagcccgtctctataaaaagtgtaaaaatctagctgggcatggtagtgaccgtctgttgtcctagctactctgcagcctgagatgggagcatcacttgttacagtgagctgtgatcatgatcaggtcactgcactccaatctagctactgagtgagaccttgtctctctctctccctctctctctctctctctctctctatatatatatatatatatatatatatagccaggcgtggtggcagtcacctgtaatcccagctactcaggaggctgaggcaggagaatcgcttgaatctggtaggtggaggttaaagtgagctgagagtgccactgcactccagcctgggcaacagagcgagactccatctgaaaaaaaaaaaagaaatgcatataatatatatagtatatatagtatatatatctatatataaaatagatatatatagtatatatatctatatataaaatagatatatatagtatatatatctatatataaaaatatagatatatagtatatatatctatatataaaatatatagatatatatactatatatctatatataaaatatatagatatatatactatatataaaatatatagtatatatatgaaaataagttatttgtattcaaagcatcaaataaaattttgttttagttttctaaaaaaatacaagtaacatatataggcatgctgtttttcttcttatatgtgactacattactttagtatgtagcaaatatcatttgctagctgtagtaaatgtgcattgtcacattttgtccaattttgttcaaactttaatcaaatgcctaagaatttaaaattaccttaattttgtagaagcaaatcacagcttatcattttagatgttttacttacttatgagtctactatttcccacgttactgctgtttctggcctgcctgtggcagtattgccattcactggaacctgcttccataggaggagcatcctgatgtgtttaggaatactaaaattcagatcattccccatcagagttgtctattctgtttctccctctcatccccataatgaatgcatacattctttctgtttgtttggtaattattgggtcatttaaaatgaagactatgaaatgagaacagaaccactgaccaaaatgtacaactttttaaacgtaccatggggaagaaaggtccagaacctatgcgcggagtatgttactaatccagagagaaagtatatttaaaaacaacctgagtggtcaggaagtcaatttcttttttctttatttttttaagagagacagggtctcgctttgttgcccaggctggtctcgaactcctaggctcaagccatcttccctcttcggcctcccaaagggatcagtttctgaagtgagatgagtgagttgattccttgagcattgtcttaatatgctacggctaccataacaaagtaccagagactgggtggcttacgcaacagaagttaacgttctggaggctataacgttctagaggccggcaaggttgtattctttgtgacctctctacgtggctggcagatggccaccttctctctgtgctctcacctcttccttcccctgtgcttgcacatccctggttctctcatccaagcattctattcttatagggacaccaggcagataggatttggcccaccttaatgacctcatttaccttaatcatctaatagaaggccctatgtccaaacagtcacattctgagacactgggggtgagggctctgcaggggagaaaaataatacctttccttcacctgctgcaaggttcgtggctgagtcctcataacaaaatccagattaacaaaagaaaagtatgcaaatgcattttttttttgagacggagcctcacttctgttgcccaggctggagtgcagtggtgtgatctctgctaaccacaaactctgcgtcccgttttcaagcgattctcctgcctcagtctcccgagtagctgggactataggcgcccaccaccacacccagctaatttgtgtattttttagtaaagatggggtttcaccatgttggccaggctggtctcaaactcctgatctcaggtgatccgccctgctcggcctcccagagtgctgggattataggcgtgatccaccacgcccagccacaaatgcatttaatgtaagttttatgtgacacaggagactacggaaatgaaaactcaaacatctagggagaactgtgcatttttatggacagtcatttagaagtatgattggaggacaaaagggtatgatctaatggtaataaactgggaggaacttaccaaggcctgactgttcaggttcttcttggcctccaagtttgatattccttcccttcgggcatagggcagaatacctgtcacatgagggtcttcaggagagaagaggtgggagcaggtcatttcaaacctttctccctctggagttttctgtctcctccagcttaaaatccttagtgtgccagggtgccatacattggggtagtatttcctgtactccagtagcttcaatgtataaatcttagccacaacaagcatgaatagagatttcaagctacagaaggaagcaaaggactaccgagaggtaaagatgtccaaaggtaactctggcgaaaagaatgaactccttgtacagctgtgaatgggagtttgggcaagcgttaagtctgaacctacctataggtgggactcttaaccattttatatttatgcagagcgagtaaatggaaaaatcccgtggaaaaacactaatcatatattgcgacttgagggggctacagatttttttttttttttgaggtggagtctcactgtgtagcccaggctggagtgcagtggctgcgatcttggctcactgcaagctccgcctcctgggttcacgccattctcctgcctcagcctcccgagtagctgggactacaggcgcccaccaccatgcctggctaatttttttgtatttttggtagagacggggtttcaccgtgttagctaggatggtctcgatctcctgacttcgtgatccacccgcctcggccacccaaagtgctgggattacaggcgtgagccaccatgcccggcttggggggctactgatttaaagaaagaaagattaaaaggattttgatgcaataactctttaaattttttttttttgagttggagtctcactctgtcgcccaggccagaatgcagtggtacaatcttggctcactgcaacctccgcctcctggttcaagggattttccagcctcagccttccaagtagctgggattatagcatgcaccacaatgcccagctaatttttgtatttttagtagagacagggtttcaccatgtttgccaggctggtcttgaactcctgacctcagaagatccgcctgcctcggcctcccaaagtgctgagattacaggcatgagccactgtgcccggccaactctttatttatttatttttttttttttgagacggagtctcgctctgtcgcctaggctggagtacagtggtccaatctcggctcgctgcaagctccacctccctggttcaagtgattctccagcctcagcctcccaagtagctgggactacaggcacctgccaccacgcccaggtaaaatttttgtatttttagtagagacggggtttcaccgcgttagccaggatggtctcaatctcctgacctcgtgatccacccgcctcggcctcccaaagtgctgggattacaggcgtgagccaccatgcccggcgccaactctttaatttttaaaattgggtttctggaggtgatatccatccttttccagtacacagtttatagagtttcaacaaatacatactgtcatgaaattaccaccgtaatcaatgtttcccatagtggccacagcttgggaaatcctaacaaaggctttaggcttcctggcctctgctgccatgaccctgtagaaagaatggattacgagattcgttcccacctgcccctccctgggtctcagatcttccctatctatcagataaggattggattgagctggtgtagccagtttgtctgtccctgtgctgaggttactacttctgctggcacccaaagcacttgttatagatctaaacaagttgatttcagtcatccagtccagcaagggaggacatgtcctatataaacttgatgtgcctgataacataagccaccccactggaagtatcagatgtttcccgcactactagagggttcctagcaccctggtcctccctgatcctgtcccccaacactgtgagatcccatagaaagtgggggtcaccttggggaacactgccataaaattagagttagggggccctttctggggttttatggtggcctgaaccacaaaccacccccaagaacatgcactttgaagagaaaaggaaaaagaatggtagggaacactgaggttggaatttcacaggaacagcctaattagccagctacctggtccacctccatccacatcaagctcagtgtttcccaacatgtgctgcagtgccccatttcccatgcattggagtgtagtgtttagtgttcatactactagatagaagtaccgcctcctgagcaggccttcttgatgtcctatcttcagttgctttggctgttccattgttcagtagctccattggcttgcagatgacagggtgcatacaaagcccatcatattccatgagagcatggccattgttttgctggtcatgtagtgaaggatgcttcttggtgagactgaggtcctctggggtgttcaaaatcatgacataagttctcctcaataacagcaatggtagtatcagcatccacaagcgtgcatattttttgtcctttccaagtagcaagctgttttgatagtctttgtccccacaaagaggctctttaaatattctagtcactcaattgccattccctgatgaggtatgtaggctgtcagcaacggcccacacattggtgaaatgcaggaagacctggtggtaggggtggcctgcatggtcatcacaaatgcgtgttgtttggtccactgggcaaattgccaaggtttattctgacaaatgatgatgacaaccacagcctaacagaccccatctgctctgttgtttcactgagccatcagtaaaccatgccacaccatcagcaggcttgtcttggagccttaggctccagacagccatgggaggagccaaagcacacccagtggttctcttggtgtcttctaattagctagccatttgttcacggagcctgctggtcacatgtggtcctagctgggcctgaacttgaatgcaccacttccatttgataagtgaagtctatggagcctgtctaattttattggttgagcttgtgagccatccagagagaaatggcagttcaggttgcagagtttcatctggcattctggccacgaggtgcccagtccaaaacagtacccaatatcaagtaaggattgccatttaaaagagggatataggccgggcgtggtggctcatgcctgtaatcccagcagtttgggaggccaaggcgggtggatcacctgaggtcaggagttcgagaccagcctgaccaatgtgatgaaaccccatctctactaaaaatagaaaaattagccggacatggtggcatgcgcctgtaatcccagctattcaggaggctgagacaggagaattgcttgaacccgggaggcagaggtttcaatgagccgagattgcaccattgcactctaacctgggcaacaaaagtgaaactccatctcaaaaaaataaaataaaataaagagggatatttggtggctgcctgaggcaacttatgtgtccaagatctgagaggctggtacaccccagtgtcagttttctgttgccagagacatccatcactgtgcatcaggttgcacacaactgtgatttcatctggctagcacatttaaggtttaaaaggaagtgcctgagacacaaattgttgtaaacctgctgctgcaaagggttccattcaaagtgtgtggctttattggttaccttgactctgggtgccagaagaacccccatgtgagatgcatgttgtctccagtacccaaagcgacctaaccagctgccaggcctcctttgtatccgtgagtgcagccaggggcttgcctgtatctgggatactgttttggcttcttgctcaggtagctttggcattcattgtgcccatggcctttttgaccagctaaactgggctgttacattgtgacaggtgggttgtcacttttttctttttttcgagacggagtcttgctctgtcacccaggctgacctggtgcgatcttggctctctctaacctccgcctcccaggtttaagcacttctcctgcctcagcctcctgagtagctgggattataggcgcccaccaccatgccctgctaatttttatattttagtagagacggggtttcaccatgttggccaggctgggcttaaactcctgacctcgtgattcacccacttcagcctcccaaagtgctgggattacaggcatgagcccccacggccagccggttgtcacatttttatctgtaacaagtaaatccagaattaataaaatagtgtcattgttccatttagtatgcagtaccactttttttaatgattcagtgcggcttgggtagcttaggtaacaggcaggagtggatacggcccactattgtgtcttagttcttagctgtgagggggcataatcttccaggacatcaatgcctataatgcactcagggtgggaaccagagccacctgcataaaaagttgctcacagggctctacccacaagtacataagcattgtgtgcagataagcatcacgggccaccagtttgttcccaaacctcccaatgtcatccgtttaattattctcctaaaaggacccagaaacattgtcatgtgggttccggtatccaagcacctgagaaaaaactgaagtcttctcttttctcctcttatcataacaagggtataaggccagagggcttcagtagggacctagaggccttggccccattcttaactgtgtcaatcagaccaagacacttaggtggcagtgttcctttatcaaacactcacaatagccacactgcgtaagatttccctggtcttcctccttatcctttcgagcctgactcttcccatcttctgggctgacattgtacgtgttagttcctctcatgcctcagggaccatacaaggacctctctctagtttcttcttgggtgcctcaggggctgtctgaatactcaccattcaagctcttgggccctgacaataagggatcacataagtgcccagcacctaggggaccttgaactatgatctgctgtttccacattcctttctctctgtctcagtccatgcagccagctcacttacatctgtggggaggagagtgacatgtcccatttaccacccatccttatccataactcatccaggtacatgtccagcccctgtgctcctgggctgatgtctctgccttgggctgagtactgggtggtattgcccctcccactttgccagaaagccatgtttctctgaccgaaccttacccactgcaccaatttttcaaagcaggttcaccaattaccaatcccaagggaggactccaccacacagaggacagcaaaggtcatcactataccagccatcaggaataggagtccagacacttctacccactgcatcctccgctgcagtgctacaactgcctgagagcagtgagacagaacacattctcaggcagtaagttaaaggatgcacatttattatttacagatagggagaaagtcttccttcaaaagaagcctaggctccattctgagctcatccccaaaggctcaagaagggttcccagggcagatgaagtctggattgcaaatgcccccctttcacacagctgaggaagcccaaaaggcagcccaccctgggttacatatctcagggcagacatggcgcattgagcaaagctttaaggaaatactgctttcagggcagagaggaacaaaccccagctctcctggacagtccctccctaactaaagatgtgacattccttaggaagggccagaacaaggccagggttgttccagacagtccctccctagctcagaatattgcattccaggctgatgctacacttattcttgacaaattaaaactgagaaaatgggaataattgaatccatccaaggccacctggaggactgttttgcattttcaccccaaaagttccttgtagtagtcttcccaccatatttagttttggaaattattgatatctatctccataactttgccttttacagaatgtcatataaatgaaatcattctgtatgtaatctttcagtaacactttcgagatatgtcatgtttactgtatcaatggtttgtttctttttgaaactgacctgtgctatattcaatgaatgtaccacaatttactcaattgtttatgtttttttttaagacagagtttcgctcctgttgcccaggttggagtgcaatcctgcaacctcggctcactgcaacctccacctcctgggctcaatgattctcctgcctcagcctctggagtactcatcatttttattaatataaaatgttataaatatggataacttgatggatatttgtgttgaggtattatatggttactacaagcatatggtttcattcatcttgggaaaatagatcttagcgctgagatgctggatcatataacaaaagtatgattcagaaggctggttgtggtggctcatgcctataatcccaacactttgggaggccaagatgggaggatcacttgaggccaacagttcaagagcagcttcgccaacatagtgaaaccccatctctactaaaaatacaaaacttggccgggtgcagtggctcatgcctgtaatcccagcactttgggaggctgaggcaggcggatcacctgagatcaggagttcaagaccagcctggccaacatggtgaaaccccgtctctactaaaaatacaaaagaaaattctccaggtgtggtggtgcatgcctataatcccagctactcaggaagctgagacaggagagtcacttgaacccacgaggcagaggttgcagtgagccgagatcataccactgcactccagcctggatgacagagtgagactccatcacaaacacacacacacacacacacacacacacagaaaacttagctaggcgtggtggcacacgcctgtaatcccagctcctcatgtggctagggcatgagaatagcttgaacctgggaggcagaggttgcagtgagctgagatggtgccactgcactccagcctgggcgatagagctgactctgtcttgaaaaaaaaaaaaaacgtatgattcactttacaagaaactgccaaaatgttttccaaagtggctatcattttgcatcctaacagaaaatatgggaatccccgttactccacatccttaccagcacttggtttggactctgtgtgtttgtgtgtgtctgtagtgtgtgtgtgtgtgtgtgtttgtgtgtgcgcatgagtaaatatatgtgtatatatgtatatatatcgactcttaataattccagtagggacatagtggcaccttactgtggtttcaataatttacatcttcctgctgataatggcattgaataaaactcattaacttgttcgtcatccatatctactatttgactgtcactcttctcatttcaaaaaatgtttattgttgtattattaaatttaactatgtatatgtataattttgatatgacctacatctgttaagtaccgaaaatatttttttctgagcctgtgccatctcgtctttctcttaacagtgtctgtcaaagagcagcatttattttaattttgactaagaataatttgtccttttttgttgtttttttttgagacagagtctgtctctgtcacccaggctggagtgcaatggcacagtcttggctcactgcaacttccgcctcctgggttgaagcgactctcctgcctcagcctcttgagtagctgggattacaggcaccctctatcatgcccggctaatttttgtacttttgtagagatggggtttcaccatgttggccaggctggtcttgaactcctgacctcaggtgatccacctgcctcagcttctcaaagtgctgggattacaggcatgagccactgtgcccagccaatttatccatttttaaattttgtgcttaatatttattccctaccattatatattgcttaacacaaggtcataaagattacctacagtattttccttagaaattttatgtgttaaggatttacatttatatctgtggtattttgaattaattttatatctagtgcaaaaaagggtgaagagttttgttttgtattttggcatatgaatgctctgttgttttaggagcttttgctacaaatactctcctttcttcaattcaagaaaattgaatttccgtggcacatgagtcaaaaacctaccaaccatatatgtatatgctataatgctccagttatctaaatatttatccttatacatatccatatatgaatatgcatatgctatacatacatacatatatgtatttgctatactgttccatttatctatttatccttacaccaataccacactatcttgactaataccacattatattaaacttgaaataatggccaggtgcggtggctcacgcctgtaatctggcactttgggaggccaaggcaggcagatcacctgaggtcgggagttcgagaccagcctgaccaacatggggaaaccccatctctactaaaaatacaaaaattagccgagtgtggtggcacatgcctgtaatcccagctactcgggagtctgaggcaggagaatcccttgaacctggcagacggaagttgcagtgagccgagatcatgcagttgcactccagcctgggcgacaagagcaaaactccgtctcaaaaaaaaagaaaagaaaagaaaacgtgaaataagtagtgagtcccccaatattgtcccttttcttctaaattggtttggctatactaattatttagtttcttacataaattttggaatctacttctcagtttctaaaaaaaatataaaaaatcagctgaggattctactgaatgtatagataaatatgtaagaattgacccttggtcaggcgtggtggctcaagactgtaatcccagcactttgggaggctgaggtgggtggatcacgacgtcaggagcttgagaccagcctgaccaaggcatggtgaaaccctgtctctactaaaaatacaaaaattagccgagcgtggtggcaagcgcctgtaatcccagctactcaggaggctaaggcaggagaatctcttgaacttgggaagtggaggttgcagtaagccaagatcgtgccactgcactccagctggggtgacagaacgagactccgtctcaaaaaaaaaaaaaattgatccttaatattgagctttccaatccattaaattggtatatctttatatttatttagatttttttgaatatcaatctgatcagcattttctaattcccagagcacacattttgcacacattttgtcaggtttatctcgaagtatatcacgtttttatgctattataaaatacattttaacttctatagtcaatttttcattatcagtataaaggaagtcaaccgattttcactcactcatttttacaaactaagcaaatctagtggcagccatgtggtatatacattgctacttgtgagggatggataaatgaaaaacatttctcctttatttgaggcatttgtcaagcagagatatgaacaaataggcaatgcaaatcagaggggttgtagtagggaatgtgcattattctgtggaaatccacaaaatgcatgggcatacaaaccaaatttaaatagtcatagaaggaatcctgcaggaagtaatttatgattgaataaagtagctgaaaaccatgcaaattagaattagacaagacaaaagaaggattagtattcaggtagagaccagggtgtgtctacaagtcaacatttttgagacatcacagggagagtaacaatttcagtacactgaaggaagttagaaatctatgtcagggctagatttttaagaaattttgttctgtgtcaataagttaggatttttatagttttctaaggttctattcagctactatggggtcgactcaagaatacagctgttgtaattgttaaaatgggaatttgggagtcttttgaatttgaaagaaaaaacaaatgtgcgggattgaggctcagaccctgtacaggcaaagaaaaagttaaaagtgaggaaaatgagagacaacataaactctgggaaaagtgttcacaaaaaattttagtattttcagggtagaagctcctcttgattgagtcataccttcctgcgaaagatacaaagtcagaaaagaaatcctctacctagaaaacgacattttggcaccaagcataggttactttcatgccttaatttcaccttaccagcatttcaaaatacctgctacactgtggtttgaggaatgagactactatgctcacagcgccacctagcatcaacagaaagggaggcccatggcaaacttaataacaagaggcgggaaaaaaaaggtgaggcccaggaaccggaaacttaatttgagcaggatttttcttatatttatttaaaaactaaaatattggccgggcactgtggctcatgcctgtaatcccaacacactgggaggccgaggcgggcagatcacttgaggccaggagttcaagaccagcctgggtaacacggtgaaaccctgtctctactaaaaatacaaaaattagtgggcatggtggcgggtgcctgtaatcccaactactgggaggctgaggcaggagaattgcttgaacctaggaggtggaggttgtagtgagccgagatcgcgccactgcactccagcctgggtgatagagtgagactctccctcaaaataataaaataatattgctgcaggggtcagtggtgaaatgcaatccataaccattcccagtaaacactcagcgagtcctggcccatgcccacttttcctgtcatttaacgcaagggttaaatatcaaagtgaatcccattatgctaattgatttacaaatacggatgtataggagtgtgataccctgagcgcaatcatacttcggatataactgtaaaacgacttcagctgactttgcagtgttgcagtgtcacattaaaccctaagttgtttgtgtttccctacacatcactctccaggagcattatagttcagaagattagagtaatttcttagactaaagccttgatgggttattattacataaaacgttttccactctgatggagaagtcaggtgcattcgctcatgtctccgtggcagggccgggactcctggtcccccgcgattctgagcggtgcctcacagcctaggtcctccaacctcacagggcggcccgcagcaaatgcgccactgtccggtgcggccaaccagctcgtggtgcgctgtgggaaggtcacaggacggagctggggggcgggggcggcggtgggggcgggggcggcggcgggggcgggggcgggggcgggggcagatcctatttgcgcctgcgcgggactggaggattcggtgttgccctttccccctgctatttccgtttccgcgcttcaagcggatctcttccggttatggcgcccgctgggagtgtcttatcagccgcttataccgcggaaactttaacctgcgttttcccgtaaaattttcctctctaggtttcgtatcattgtcttgtttcttactcttgtattaactttgttttaacctaaggtttctctttcccaaaaactgtggtgtttctttacaacctctttttatagttatataaacattgcaagaaccatgattttatattcttccttttcagtattaataacttcaatgtcttttttggcatttgtctgaaaatttgaaatatttttcaatttactgaactgattatcgttttgtaaatatcggatactactttaatcatttgtgtattggccttaagattctctatttttaactcttccaccaacatacctttaatctgagaggtgttgtaggggcttcaagatcaaactttccccacagtctctattttcattataaaataccgtgttttaagaaaaaatgtacaaggttgaaagaagtttcactactacgtgttttttttttaatttttattttattttattttattttgagacggagtctcgctctgtcaccaggctggagtgcagtggtgcggtctcggctcactgcaacccccgactccctggttcaggcagttctgccgccgactccctggttcaagcaattctgcctcaacctcccgggtagctgggattaccggcacatgccaccacgcccagctaatttttgtatttttagtagagatggggtttcaccatgttggccaggatggtcttgatttcctgacttcgtgatccacccgcctcagcctcccaaagtgctgggattacaggcgtgagccaccgcgctcggcctctactatgttttaaaacagtggctaggtcatgcttttctgtgtatccttacttcccttattccatcacctcatccatcactttacaactgatcatacaattacaaaattattttactaatcagattaaatgtgtgccttccatttgaagaagaaaggtctactaaaggcttagttttccctaggacactgggagaatacaggatctggtttccagtgccacagtggtgatcacacaggaataaacgggacacaggtcagacaacagccagaaagtcatctgccagtatatgtttcctgtgagatggacacctggtcccaggtcagacacaggtgttagagtgtcagctaggtaaaagaagtaacctgaaagagacacgctgtgaacaactatgtccacctccccttcatttcctagtattggagggctgctagctgctctgttactaggacccagatttagttggggcctctcagaacaggtcagaattgacctatgcacagtacctgtgggagtctggatgagggccatccactgaaagttagtgaatcaaagatttaagattgatctaaatgcaaatagatctgtgtcaaacgactatacgcataattgccttattttatacttattgaaaaaatcctcgtaaaattataaaggcataagatttacttgttatgaaaatgaaggcaataatgaacgtaattcataagtgaatttgcaaatatcttgaaattccaattctgatttttccaaattagattttgattcagagtcatcgatgtcttcacaccaccctctgtggcatgaacagagatggtaatgaagcatttcttagaaaacaaggctggaccactgtctgtgtgatttccacctttcttgctgacaccattctgcatgttttgatgtaagtgatgttaccagaaggaaacagcagaaggttgcaaaacaagtgcaaacaatgaaagccatgtcatggctgccaacaggctaatagtgattgtaacaacacttgacaaaataatttttaaaaattattcaaatatgataactaataacgatacagaattatcaagggaggtccaatttttttttttgtctgagacggagtctctctttgttgtccaggctggagtgcagtggcacgatctcggctctctgcaacctccctgacccaggttcaagcatttctcctgcctcagcctcctgagtagctgggattacaggcggctgccaccacacccagctaatttttgcatttttagtagagacggggtttcaccatgttttttggccaggctggtctcaaactcttgacctcaggtgatccacccgccttggcctcccaatgtactggaattacaggcgtgagccactgcacccggcctaagggagctctattaatggagctgaatctatgaaacaagaacatcttccttcatcaagggagcaaaactgtccagaaaaaaagtacagatgaggtagaaggagcctggtctatgtgttcatctttgtggtggattgagaatagggaggctggagaagaggctgagggggaagtcagggctcactcctgtcctaaaagcaaaagggagcaaaagaaccatgttcatcttcagattcacacattcttcactttgaaagaaaatttaagtttattaggaaaccatatctgtgaggagtttttattttttttttgttttctttttttgaaacagggtcttattttgttgcccaggctggagtgcagtggcatatacactgttcactgcagcctctacctcctgggccctagcagttatcctacctcagcctcccatgtagctgggaccacaggcatatgccaccaagccctgcctattttatttttttgtaaagacgtgtctcactttgttgcccaggctggtggggggaagttttagagattcattaaataatttgtgaaatttaaaataaaggaaaatattctgttttgggttttgcccagtgcatgtttggggctcataggtgaacaacatggacaaaataacctctgatatttcagtccagtagtgattcaaggactgtaacccaaatctcaaatgtaggagttttgggttacaaaacttttgggagctgagagcacaggcatcagacctgaaatggaatggacaaggaaggcctctaggaggaggaacattggaggaggttctggagagcgtggagcagtgaatctggcaaacaggagaaagagaagaggaaaaaatgtgtctgtggcacaggccagggcatgagaaggggacagtggattagaaggactgctgggattagcaacatgtaaggagggcaggagcgggaagggcagaccatggagaggctgtgaaggggagagtgggcaggtcaggaagtgacacagggccggccagcccactaaggaatgcatttgttgtgctggtagttcaaatatcagtctcgttccttgcaacagtacctccaggtcaagaagagtgaggatagcctctgtgtctgaggaggtccctgtgcattatgaggaattggttctaggaagaagggagagtgaagaggaacagagaggaccctccagatccagtacgggccaactaagggaacttggatgctcctgttcatgtccctttctccatcactgagactcgccccatcccaccctgaatgcaggttcctttcccctcggttattttgtgcgtctcagatgatgacatgtattgtaactttattctatcacatatgacttttacattatatcatagaaaaagttacttacataaattacttaatggtggattagtcatagttaaaatgttgtcagcttggtaaacaaatgaaattatcacactttagtttttcttcgttgatcatttatgaagattagtgtctcctcatttcatggatgtcacaactacatgttcttaagtaaggtgtatgcttggggtgttgtgttttccctgttaatgttggatactccagtgttcagcaaactataaacctatcaacacacatttgaaaaatccagttgttttgtgttttatttcgtgtatcctgtctttacaatattatatcttttcttctgcttacttgaaatttaatttgctcttctttttctaggttcctaagatggaaacttaggcgatcattgggcatcatcatagggtctacctgccaaatcaggtcttcttcattctgcaaaagtttctcagtcaccacttatatttcatgactttgacccttgtgaaaataccagtcagatatcttgtggaatgtcccacaatgtgtatttgtctgatggtttctcataattagactagaaacaatgtgtaaattaaacatatttttccaaattagaaaacaagaaaaacagaataacatattagttagaagtattaacatagggctggacgcagtggcttatgcctataatcccaacactttgggaggtgaaggtgggcagattaattgaatccagcaattcagcaattcaagaccaatctgggcaacatggcagaacgctgtttctaaaaaaaatgcaaaaaattagctaggtgttgcagcatatgtctgcagtctcagctactcgggaggctgaggtgggaggattgggagggtggcctgagcttgggaggtcaaggttcactgagctgtgattgtgccatagcgctccaacctgggcaagagagtgagaccatatctcaacaaaaaagagagaaaagaaaaaataacagagaaaaataatttttaaaaatcaggtaatgacaaatagggaattccaaatatattgctaatggtctgttaagcttgacagtgcttttagaaaacttgttctgtttagaatagtgttagactcacagaacaaattggtaatataaagagtttacatataccacacacagttttccttattataaatcttaacattagtgtgttacgcttgttacaattaagaaccaatgttaaacattatcattcactgctatccatgctttattcacatgtccttaatttcacttaatgtccattttttgattctggaatcccatccaggatgacacatcatatttagatgtcattcctctttatgcttcataagctgttgacacttccttcaactttcctggtctttcatgacattgacatacttcattaggaagttgtctgattttttttttttttgagatgactctcgttctgttgcccaggctggagtgcagtgacgcgatctcggcttgctgcaagctccgcctcccaggttcacgccattctcctgcctcagtctcccaagtagctgggactacaggcgcccgccaccacgcccagctaatttttcgtatttttagtggagacggggtttcaccgtgttagccaggctggtctcaatctcctgacctcgtgatctgcccacctcggcctcccaaagtgctgggattacaggcgtgagccaccgtgcccagccataggttttcaaaaggaggactacacagggaaattgccattcttatcacatcataccaatgttacatactaatagcatgtcatatcatgttgaccttaatttgattacctatttgaattacttcttatcagattcttccactgttaaattgctatttgttacacttcctgtgttgtacttttgaaaagaagtcattaggcttagtaagaagtgggaagtcattcttcacctctttatgggaagagtatctgcaaaaataatttggaatccttcaacatgtgaaatgtgtcagttttcctccatttgttttatatattttttcactcatttatttatatcaatatgcaaacatggatctttattttacacttacattttactagtttattttgttgttcaaaattttctactcttggctattggaaggtcttttaattggctactatatcattttcgtatacacactcctagtataatggcatgaatccgtttatgaggctaaagccctcaaggcctaattaccttttaacagccccaccttttaatactgctacagtggcagttagtttccactaactgtaggggacaaaaattcaaaccatagcaagaacataccaaaaccatttttaaaaacaataatgcatttatttctgcaaaaaatggccataaagggccacctttatatgtgatcatgtagatcaccctctatatgataaggaagacaaatggagaacgaattagatagagaactgttgtgaattaaagtattaggtttggaatacaactttttgggttgattgctcatatttcttagaacagaaattctcagtgtacaactttaactctgaagaaagctacccatccaatgaagaagtagcaaagtgactgtttgccatttctatcttccttctcaatagatttattgaaacatagcatatacatcacctctccacatttgttgtacttttgttatttctagttcattcttgaggtttctctttaacacagcgactattaattctagcccagttggccaggagctgtggctcacacctgtaatcccagcacttgaggttgaggtgggtggaatgcttgagctcaggagttcaagacctttgggcaacatggtgaaaccccatctctactaaaaacacaaatttagctgggtgtggtgatgggcacctgcagtcccatcaccatactcgggaggctgaggcaggagaatcacttgaacttgggaagcagaggttgcagcgagccgagattgtgccactgcactccagcctgggtgacagagcgagactccgtctcaaaaaaaaaaaaaaaattctagtgctgctcaagaagcctctagaagatttgttcatggatgtttacattgtgcctttcagggtacacttttttaaatcttattttacagccaaatacataattatctgatttgtcagtggttttattctccattgtgaaatgtaaagtaatgatgcaacctataattgatgtgaataatttattttgcaattactatttatgtcagtatcagcaaatactacattcatttgtatagatgatattaatctacaggttttatggattattagttcatttcatcctcacagcatctcaagaggtcggcactagttttactcccaatcacctagtgaatttgatctaaagccctacaagaaaggaatggatgaaacttgattttgactgagtctatctttgaagtctttacttacatcacgtgttttagaatatctttttttgtatggaaaacacattctaggaccggattaagaaatgttactctagggccaggcgcagtggctcatgcctgtaataccagcattttgggaggttgaggcaggcagatcacgtgaggtcagaagtttgagaccagcctggccaatgtggcaaaataccgtctctactaaaaatacaaaaaaattatccaggcatgctggcgggcacctgtaatcccagctactcaggaagctgaggcaggagaattgcttgaactcaggaggaggaggttgcagtgagccaagattgcaccattgcactccagcctgggcaacagagcgagaatctgtctcaaaaaaaaaaaaaaaaaaaaaaaggtattctaccccggaagtcatgttcccaaattagatgtaaatcctgtgttaaattgatttaatatttaggtctaagatccacctaggaatgattttatgtgtaatgtgaggttatagatcagattttatttttccctgtggatatatttcttgaaatatttatagaaaaattcacatttccccaattaatcttataaattatttgtgtatatatgcttgtgtctgatttgctctctcctttttttttccattggtttatttctctgtgaaaatatcacactattttagtaagacacttcatttaacacagaattttctctctagggccttctcttagccaagtgtgctattatataaagaagaaagagtgaaaacctctatgccttgaacctacaccaatattctcagttgtcccttgaataaagagcagaatttagaactcactattactgatgacacttaggtctttaatgttcttgtgaatcttagacaacccccacaacatcattccctgctttatttgcttagtccattcttggtggattttatgagatgtcaacactcctcattaggattccctccttctgaagcctttgggattttctacccacccagcaaccaccagaggtggcagaaacccctgcagacatccttcttgcgcaagcgcagttgtaccatgaatgcggtcgtcctgctgcagaccacgcccaccaagggcggggccacatccactgcagctgagctcagagccttctgtggggtctgcagtggcaaggccagccgccccctgtcttccctctggagctgtttgaggaatgcagttcttttgcataagaaaggcttttctctccagtcattctgcttgctgatcaagaacacttaacagcttcaggctttcctggtaatattcattcttgcttttgtgtttttgttttaaggtccaaatatctttaatacttgtatgcagttttcttttttataatttcacataaacatcatctaaaaccaacttcgcatgttcgcattctgtattaacaactttcgtttttgtatttaaaaatacattcataatcactttttcaaaatatcttgtcagttattttcatcttttccatgatcattctttaccagtgcaatggaaatattacttttattaggaaaagcagatgtcacgcggtttttagtgttgtcgagaaatttcctatgaaacatctctggttgaaaaggagaggaacaaaattttatgtgaggcacaagatcacatatgctcagaatcgcatgctttaataaaggctgtgattatttgcattatattgtttagcttgttctaattgtaaaaggtagacaaagaattaatttgtgtagacagaacattgcgactcccattctaaatgtagagacagtcactgcactgcgcaaataggaatgtcgtcatgttgtttgcttttctccttaccccaaaactgtagacattggctagagtctttgatttttttcccaacttgcttttgtaattgtcggcatgatgtttgcacagataaccaatgatatagatatatatttttttcttactatttgatgaatgattaatattttgggttttttttatgttttcagtgaatcaaaaatatcattcagaaaatgttgtcatccatatccaggtagcatatagttttataatctgatcttgtaataaggaaattacagtccttattgattttctgttattagttagcattttttaagttttcatgcttgtgagtatttgggaattttttttttactctgtcaataatttaacacctttgtattggtcatctgggtcgatgtctattgtttaggctcaacctttgacactcctctgaggtagtttttatgtgaatttgtaaccacccaagggattcaccttgccagctgtctagacagagccgatttatcaagacaagggaactataatagagaagcaagaattcacccagagccggctgtgcaggagaccatagttttattattactcaaatcaatctccctgtagggggatcaggggtttctaagaataatttggtgggtagggggtcggaaagtggggagtgctgattggtcatgttggagatgaaatcatagggagtggaagctgtcctcttgcgctgagtcagttccccggttggggccataagatcagatgagtcagtttattgatctgggtggtatcagctgatccatcgggagcagggcctgcaatagatctcaagcactgactgagcttaggtttcacaatagtgatgttatccccaggagcagtttgaggcagtttagagtcctgcagtctccagctggatgaatcctaaaccgtaatttttaatcttgtagctgatttgttattcctacaaaggcatgatggaggggggttgttttgggaaagggctgttactgtcttcatttaaaagctaaactataaaccgaattcctcctgaagttcgcggggaatgaacaagggcagcttggaggttagaagcaagatggagtcagttaggtcagatctctttcactgtaataattttctcagttatgattttttgcaaagatggtttcaaattgatggcttagtgtcctgggtagtgaaaatggaattcctcaacctgaattgaacatggatttcctcctgaagaaacaatttagggctccaaaaagtaaaccaggagcctggcacagtggtcacacctgtaatcccagcactttgggaggctaaggcgggtggatcataaggccaggagtttgatactagcctggacaacatggtgaaaccctgtctacttaaaaaaaaaaaatacaaaaattagccgggcatgctgatatgcacctgtaatcccagctactcgggaggctgaggcaggagaattgcttgaacttgggaggctgaggttgcagtgagtcaacatcgagccactgcactccagtctgggtgacagagaaagactctgtggggtatgatgaggcttctcttcaaatagcctgatcaatcgtttattctttaattaatagtaacccccacccccttttcctttttctcttttttctttctgcctttgttgcatgcccggacatgccacagtagcaggcttatcagtaccagctcacattcctttccttatttggaaaggagactagctctctagctcattgcagacaccccttccccttttcccctctctcccttatgtgcccaccttatctaaagaaagttcaattgtctagccaaccaggattagttcagactgtgcgacctgacctccaccaatgggaaaagggtacaggggcaggacttggggcaggaataaagactcttgtgcccctttgttctggtgtgctttcatggcgactggccaaggagaagcacccctctgcgcagaagtaaaattgctttgctaagaatcctttgtttgagtgttcaatctcccttaggattttgagcattattcccaaccattcaatccaaaaaaaaaagtagaccaggattgatttagggcctgtattataaattgtacaaatgccaacaagattgtattccactagaggaacgcattctctagtgaaggaagcattcctgcaggatgagtccctgagactcactagcaaatttcatacaagtaatgaaatcctcagtctaatggaataaaaacaattccaggggcatttgttaaagatgtataagatgtgagaaaccaacagactaacagcattgatactttatggatatttttattccaaattaatagatgtgttacaggaaaagggtcctgatccagaccccaagagagggttgccgatattcagggccagtctgcagagtaaagtgaaagcaagcttactaagaaagtaaagcagaaaaagaatggttactccatagacagagcagccctgtgggctgctggattcccattttcatggttatttattgattatatgctaaaccaagggtggattatccatgcctcccctttttagaccatataaagtaactttctgatgttgccatggcatttgtaaactgtcgtggtgctggagggatgtagcactgaggacgaccagaggtcactctcgtcaccatcatggttttggtggattttagccggcctctttactgcagcctgttttatcagcaagatctttatgacctgtatcttgtgccagtctcctgatgtgacttaaaatgccttaaccatctgggaatgcagcccagtaggtctcatcctcattttacccagccctattcaagatggagttgctctggttcacatgcctctgacagatggacatttgtttgccaagcaatgctgcaatcaggggctctggatttcagtcctccatacagagaatgtcaagggcagaccttaataaaaataaataaatgaataatcaaatttttaaaattacctctttcattcttttattgtattatgatctgacaccattaactttaattttcttgcatatggagagcaacttgatacaaactggtatttatttagtgaagaaaagagataaggtgattcccaaatttaaaggaaactggaagttttgtgggaaacaaatggaggagataagacttactagtttctacttattttaatgagaattgtgttgttcatttataaatacaaagctccatttaaattacagatgcttttgatttatgatgaggttacttccagataaacccatcacaagttaaaaatgtcatcagtcgaaaatgcattgaatatacctaacttagttaaaatcacagcctagcctatcatccttaagtgtgctcaaaacacttatattagcctaacgtttgggaagatcatccacacaaagcctattttatcataaagtgttgaatatctcatgcaatttattgaatactgtactgaaacagaaaaacagaaagattggacactcaaagtatagtttccattaatgtgtattgcttttatttaatttaaaaattttaagttgaatcatagcaagtgaggaagcccatatattataaaatgtaataagtttaccagccacaaataacaacaaatcataggaaatgcagggattgggttgaggtgaggtggttcaacctattatacccatttccttcatctctaatgggctgcccttcatccttggggttgttgcagggtggctgtgcagtgcaaagggcacacaagaattgcttgaacctgggaggtggaggttgcattgagctgagattgtgccactgcactctagcctgggcaacagagtgagaccccatctcaaaagcataaataaataaaaggataatatctctgtcaaagtacagtgatgcattgcttaatcatggaaataccttctgagaaatgcattgtttggtgatttcatctctgtgcaaacatggagagcattacacaaacctagaaggcatagcctactacacatccaggctacatggtacttactattgctcccaagctataagcctataagcatgtgactgtcctgaatactataagcaattgtaacacaatgataagtatttaaacatgtaacctatctaaacatagaaaacataaaaagatggtataaaacaaaaaatattgttcagttgtatagggcagttgccatgcctggagcttgcaggactggaagttcttctgggtgagtcagtgagtgagtggtgagtgaatgtgaagacctaggacattactgtatgctactgcagactttagaaacactgtaaactaaggctacacttaatttattaaaaactaaagtaattgtgctatggcatcgtgacagctttgacatctctaggtgataggaagttctcaggtcaattataaccttatgagagtaccctcctatatgttgtctttccttgacagaataaaatatcattttgagagccatgactaataaacacataagagtcgatttaatatttattttaaaagcccttccatagttataaaagcataagttttagtcacatcaaaatataaacaatcttgaaattaattcataagtaaatcaatagatatcttgaaattgtgcttatgatagttctaaaccagactttaatgcagaatcttggatatcttaatcgcactgtgtggcaggaagactgatggcaataaaacatttcttaaaaaagaggctgcagcattttctgtgcaatttgcaccattcctgttcacacctgttctgtaagtgttgctgcaggcgatcctgtaagaaatgacagcgggttgcagcgcaagttcatgcaaacaatgaaaagcatgtcatggctaccactaggctaacgctattgtaataaaatttgaaataaaatagactagaaatgatgaaatatgagaacaacattggaaatatttatcaagggaaccatattaatgtaagcgaattttagagaacaaaatacttttcctaggtctgcaaggacaaaactgtccagaagaacagaagagggacagatgaggtagaagcagcatggcccatgagaggggctctgcagtggattgagggtggggaggctggcaaaaaggctgggcagaatcagggctcacatcctgacctgagaacagaagagagcacaagaaacaggttcatcttcaggcacaaatcctcttcagattgaaagagagatggagtgtctagggaagtaggcaagcatttggggaaggagagtcactgattcattagtgaaacacaacaaaaaaacaaaatcttctgtgttgctgtttgtccactgcatgtgtggggctcacaggggaacaacatagacaaagtttccaaattctcaggtgtttaagacgagtgaggattcagaaaacttaacagaaactaaactgcaagtgcaagagctgcccttaggaactcaggggacaggcatcaggcctgggatgggatggacaaggggggccttcaggaggaggagcattggaggagatgctgaagagtgaggggcaggggatccaccagacaggggaggtaaagggaagaggaaacagtgtgtctggcacagttcagggcatgagataagggcagtgggttggaaggatcgctgggatgaataatatatgaggaggcaggagcaggaaggacagaccataaagggcctgagcaggggagggaggacagctctggaagtgatgcagaggctgctccctgcggactgccttctgtggggaggagttcgaatgccttttcttcttttaagtgttactcacaatccatgagatctactgacaaggaagacagttggaacaagtaagaatagtccttgtttgatgggaaggagcagtagcattaccaggaggggttggtgttggggaggggcaagggtggggaagggcagagaagtttctgtcccctcagccattttgcagatgtaggttggatcactggatcacaaattcacagtggctggctcatggccaccttgcatcacagggtgagagcagcctcacaggaaactgcagataaggggggttcccagctgcacagaagaaggacagcaggtaactttcagtcaaggttggcagggggctgcagaggtggcagcaatgatggtggtgggcagtgtgcagccttgtaggccactgtctccatggacatacagatttgcacgcatctgtgtctgcgtgtcctctcggtgtgctgacattcttacaaaatcctcatgaatttctcattgttctgagaccataacatgtattttgacttttttctaccacatgtaccctttcatgtgtacctagcaaaattgaccaaaattccttattggtggattattcatagctacagtattttccaacttaataactaaatgaattgccctgctttgtatatgtttgcctaatcattcctgaagattcatgtctcctcatttcagggggagccacccctgcatgttcataagcaggagttcagtttagggtgttctgttttcctagttaactgtggacacatctgcgttctggaaactattaaactctcaatactcatttgaaaattccagttactttatcttttacttagctttcactttatttacagtactctctcttttctcctgcttactttggatttcgtttgctctacttttaagtttcctatggaggaaatttagattatcgatttttagatgttttttcttttttaaattttatttatttatttatttttattttattattatttttttttttggagagggagtctctctctgtcgcccaggctggagtgccatggcgtgaactctgcttactgcaagctccgcctcccgggttcacactattctcctgcctcagcctcccaagtagctgggactacaggcgcccaccacaacgcccggctaattttttttgtatttttagtagagacggggtttcaccatgttagccaggatggtctcgatctcctgaccttgtgatccgcccgcctcggcctcccaaagtgctaggattacaggcaagaaccgccgctcccggcccctcttcttttctttttttttttttttttttttttggtggaattttgcttttgtcacacaggctagaatacaatggcgcaatctcggctcgctgcaacctctgcctcccgggttcaagcgattctcctgccttagcctccctagtagctgggattacaggcgcccgccaccacgcccagctaatttttgtatttttagtagaaacggggtttcgccatgttggtcaggctggtctccaactcctgacctcaggtaatctgcccacctcagcctcccaaagttctgggattacaggtgtgagccactgtgcctggccaatgtttttttttgtttgtttgctttgtttttaatagatacatttcccccctatgctccctcactgcattctacaaattttgataagatgcattttaatttaaacttagttcaaaatgttgtttaattttctcttgagatttcttgcatcatgtgttatttaaaagtgtgttagttaatctccatgtattttgaagtttaccagttatgtgccttttattgatttctatcttaattttattggggttttagggtatatatttgttaacataaaaatcatgagatctataaatttggaaagaaaaagagctataaatattcttgaaggtagccctacagcatgtatactgaacaaacatgcacgtaacctatgacccatgttcaccttggtgtggagactgagcttttttttttttttttttgagacagagtcttactctgtcccccaggctggagtgccatggtaccatcgtggctcactgcaacctctgcctcccaggttcaagcgattcacctgcctcagcctcccaaataactgggattacgggcacctgccaccatgtccagctaatttttgtatttttagtagagacagggtttcaccatgttggccaggctggtcttgaactcctgacctcaggtaatccacccgccttggcctcccaaagtgctatgattacaggtgtgagccaccacgcccagctgagacttaacatttaaatgtattacagttaggccctacacacaaaagcccctttcaggacacaaaggcagacaagtacacaatctctagaaaccagtcagacccagtccatgtttggtgggctcttatcaggagaaagttactgaaatcagtctcttgtgcaatcaaggctgtagcgatggctgttggaacagaggctggagttagcgtctggcggtggatgagctgcaaattgttttaagattgtttatgtggaagtcagtgcttgcttagctgctagagaaaaagataaacctcctgtcagttagaacatagtttattcttcaactataggggtgagtgacttaacccttgcctgtcatggccttaggtcttatttataatttgatatcttattgccaccaagaagagttcattccttcattcttatgatctctattttaatatgaatgctggtcagttgttgtgtctaaactgcaaaagagacagatgataacgaggcatgtcccacttcctgtcccatcatgactggaaactcagtttgtatggtttccctgcggtcctgtctgttcagtcagttggggggcttaggattttatttttaattctcatagaggagtgttgaagtcaccgaccgtaatagtggattcatctatttttcctgttttaacggtttctgcctcgtagttttatgttctgttgctacatgttagaattattatatcttcttggaaaattgaccccactattattatgtaatgcctttctatttccctgataatttttctgactgtatagtcagctttttctgaaattaatatagctactcctgctttttctatttgcttgctatattttgttccatctatttactttcagttaatatgtctccatttttattaaataacagataaaatgagatgtatgtactatgtataacatgaggtttgaataataatgtgcattgtggaatggctaaatccagctaattaacatgtgtattacctcacatagttatcatttttgtggagagaacactttctatccactttttaagcatttttttaaatagacacaggctctcgctctgcacctaggctggagtgcagtggtttgatcacagctcactgcagtgtagacctcctgagctcaagcaatcctcctgcctcagcttcctgagtagctgggactacaggtgcacaccaccatgcccagctaatctttagcgttttaaaaataagacttatgtttttaactagagaaaccatatggtacaatagatctcttgaaattattcctcctctctgactgaaattttgtatccatccacaaaacttctgcccaaccccaccctcaaccccaggctctggtaactaccgttctacatccccacttgtatgaaatcacattttttagatttcacatgagtaagatcttgaggtatttatctttgtatgcttaacatttcagttaacataatgtactccaggttcaaccatgttgtcgcaaatgacaggatttcctttttatatgcctcagtagtattccattggggattatatatataattttctttatctgtcaacggacacataggttgattccgtatgtttgctattgtgaacaatgttaaacacttctcattgaggagtgttgaagtcaccaactataatagtggattcatctatttttcctgttttaacaatttctgcctcatagtggtttgaacactgctaaaatatacatgagtgtaggtatctcttcaacatactgatttcattttctttggatatatagccagcgttgggattgctagatcttatggtagttctatttttaattttttgaggggcctctatacttttttcgataatggctgtaccgattaacattctcatcaacagtgtgcaggggtttcctttacaacacctgttatctttactctttttaataatagccttgtaacaggtataatatctcattttgattttaatttacatttccctgtatctgtctttatatttaaataagttttttttttttgggggggacggagtctcactctgtcgcccaggctggagtgcagtggtgtgatctcggctcactgcaagctccgcctccctggttcacgccattctcctgcctcagcctcccgagtagctgggactacaggcgcccgccaccacgctcagctaattttttgtatttttagtagagacagggtttcaccatgttagccaggatggtcccgatctcctgacctcatgatccacccgcctcggcctcccaaagtgctgggattacaggcgtgagccactgcgcccggccttaaataagttttctctagagaacatatggttaagtcttgttttttgatccactccaacagtctgtgtcttttcattggtggttttgagccattgaaagtcaatgtgattattgataatagcagattgctatctaccatgtttatttctgcttttcatttgctgcccttgttctttgttcctcctcctgtcttccatttgtttgcttccctttatggttttaattgagaatttcatatgatccaattttctcttcttagcatatcattatattttctttttatttttaaatattttagtagttgccatatgaaataaaaactttttcatattttagttgatataacagataacagtttgttaaaaacaaaaattgtagccatttatttgatgaggtattcttatgtttatagtttgagtgtgtgtgcatgtatatgggtgtgtgtgtgtatatatatatatatacacacacacatatacatatgcatgaatgctcatatataaatgcaatgaatgacagcaatagtacaaattaccaaagtacaaatgactattgtttccttattataggcaactcacactacttgtgaactgatagagtgttatttgaaagggagtttgaattaactgtaaatttagggactggctattggattaagatcctccattccttggctggctgttgtccagaggctgcattcagctccttcccatgttggcttctcccacatggcagaatgctccatcaaagctacaaggggagagtttgctagcaagacagaagtaatgattttacatagcataattacccatgtgatgtaccttcagctgtgctctattctcttgtttcaaaataagtcaaggttgctgcccacacttacagggagaggattagaatgcaaggttgtgttcaccagcaggtgggaatcactgggtgccaatctagggtctgcttgctgtgtcagatcttctccaacctgcaacagtttctcagtgttcaattattttgtataacctgaattcttttgaaaagtaccagtcaggtgttttgtggaatttcctacaaaatggattagtctcatgggtctcattattacaatagagatatgcattaatttagacacatgtatgtgggtgttaagaaaaactgaacaatgtattacttagaaatacaaaaggagagaccaggtgcaatagctcacaccggtaatcccagcactttgggaggacgaggtgggaggatcacttgaggccaggagttccagactagcctaggcaacatagccagaccctatctctaaccacaacaacaaaaatttaaaattagccaggcatggtggtgcacacctgtggtccaagctactagggaggctgaggcagcaggatgtcttgagcccgggaggtcgaggctaaagtgagccatgatcacaccacagcgctccagcctgagctacagagtgataccgtgtctcaaaaaaaatggggatatgcactcaggggttttcaacaatattgacaaggtttggcttattatactgggaagggaatttataaaaaagaaacttgttaaattttagaatagtttagatatacacagcagttgccaagataatacagatcatttccttatgcttagcatatagtttcccttattattaatcccttacattagtgggtgatatttgtcacaattcataattcagtagtatacattatccttctctatgattcacattttatttagaatttttcttctaccgaatgaacactttgtgttccaggattccctccaggagaccacatcacatttagaaatcccatctcattaggttccttctgcctgtgacagtttctcagactttccttgttattgatgacattaacatccccaatttgggatttctctgacatttttctcatgattatactggagttgggtttggggaaggaagatcactgagagaaaatgtcattgtaaccacatcatatcacgggtgtctactatcaacatgattcatgcctgttgatagcaatttgattacctggacaagttagcctttgtcaaatttctttactgtaaaattatttctttctccactttccctgtttcactttttgaaaataagtcagcatacatagcacatacttaagaacaagaaagttatgctctacctccttatgaactgaggacctaaaacaagagttgagaactctttactgtatacagttggcctgttctccaccatgatttcataccatttatttatactgtattgaatatgatatgaaattagatatattcagttcacatctcccttatactcctttatttcatagctcgaattgttccattgttggccattggaaggtctctcagttggctcccatatcattttgaaatagccacattattttggttagattttgcttgtttggtggttcaattgtaatgtttcatagtttcttactttcaggcactacagggtcctccaggccaattgtgtttatttcgtgcccaagcctggtacccatcatttcttcaagggtcctagtttcttttattggaaaatggcttttaaaacaaagatacagacccaggtatattcactgatactgggtcatctgtcgatttgaggagtagtcagctgacaaaacaatgaaacgtacctgtgtatactaacccacacatatacacatatgtgtaaatatttcctcatatgttcatatataacctgattaacttaaacataaattcctactaatgtctccagcactacatgaatataatataacttgaatcaatctccccattcccactacttggttgtaacccccactctaacagtgagtgagttggccttgttaacttaatcaccaagttagaggctacatgcatagtggcttcagaattgttcatccacactctcatgaagaacaacattaccaactaaagtacagtgctcatagacaacttcttggacctttagatgcagaatcttcactttgtacccaagttacttaggtcagttctttcccccgcctcccagcttcctttagtgaggttatatcatacatttcttattcatttttcttattttctctgtattcctctatgggatccctcaacctacaaataattattttctctgtattcctctatgggatccctcaacctacaaataattttttttttttggttttttgtttgtttgtttctttgttttttgagatagagtctcactctgtcacccagcctggagtgcaatggtgtgttcttggctcactgcagcctccgcctcccaggttccagcaattatcttgcttcagcttcccaggtagctgagattacaggcacgcaccaccacgcccggctaattatttggtatttttagcagagatggggtttcactatgttggccaagctggtctcaaatacctgacctcaggtaatccacccacctcggtctcccaagtctcccaagtgctaggattacaggcgtgagccaccatgcctggcttacaaataatatttttaatttccgtacatttaggttcactgtttgtattataaagttatgcagggtttcaaaaacaatatgatgtagcgaccatgcaggaagtttttattaccctaaagaaattccatctacttcacctatttcactgtcctccttggagagtccctagttagcattaatctgtttactatctctattattttacctttcccagggtgtcatatacatggaattgcacagtctgtcatcttttcaaactggcttccttaacttaaaaatatgcctttaattttatgaagtatatcttacggtgatttagatttgcattgctgaaggactaatgatgtcaatcatctttttatgtgccctttggggatacatattctttgaagaaatgtctatttatacaatttacccatttttagttggtatttgtcttttattttttgagatgtgacaatcttttatatattctgaacagtagaccctcattacctatatgactagcaaatattttgtctcttttttttttgagacaaagtctcgctctgttgcccaggctagagtgcagtggtgcaatcttggctcactgcaagctccgcctccccggttcacaccattctcctgcctcagcctcccaagcagctgggactacaggcgcccaccaccacgcctggctaatttttttgtacttttagcagagacggggtttcaccatgttagccaggatggtctcgatctcctgacttcatgattcgcccacctcagcctcccaaagtgctaggattacaggcgtaagccaccacgcccggccttttgtcctctttttagggttgttttatacttcttgatagtatatgttgaatgacaaacattttaaaaaatagatgaatttatctatttttgcttctgttacttgtgttttttgtgttatatcttagaaaccattaatttcagaccatgaagatacatttttaaaataactttttttttgagacatgagtatcacttttgttgcccaggttggagtgcagtggcacaatctcagctcactgcaacctctgcctcctgggttcaagtgattctcctgcctcagcctcccaagaggctaggattacaggtgcctgccaccacactaggctaattttgtatttttagtagagacagggtttcaccattttggccaggctggtctcaaactcctgacctcagatgatccacccacctaccatacccagtcaaaaatacatttttttttggaaaatatagtttaggctgggcgcagtggctcacgcctgtaatcccagcactgtgggaggccaaggcgggcggatcacctgaggttgggagttcgagaccagcctgaccaacatggagaaaccccgtctctactaacaataaaaaaattagctgagtgtgatgaaacatgcctgtaatcccacctacttggcaggctgagacagcagaatcgcttgaacctgggaagcagaggttgtggtgagctgagatcccaccattacactccagcctgggcaataagagtgaaactccgtctcgaaaaaaaaaaaaaaaaaaaaagctgggtgcggtggcttacgcctgtaatcccagcactttgtgaggctgaggcgggcggatcacactgcactccagcctgggtgacagagcgagactccgtctcaaaaaaaaaaaaaaaaaaaaaaaaatagttttcctcattgaattgccttggcaacttttgcaatccatagaccataaatgtcagggttaatctttggacagtcacttatattccattgacctatatcactgtccttatgccagtaccacaatgtcctcattactatcactttatattgtttagaaatcccataatccaactttgttctgcttctcattaccagtgtggttcttttagatctcatgaatttccatatgaattttagaatcagcttaccaattactcccgccttgcccgcaaaaaaaaagcaacagggattcccatagcacaacgacatcactctgctggacagcaagagggtgtgttcaggaaccatacctagtctacaaagccatgggactacataccacagtcccagggacaaccacaaaatcaagactcttcttttgtttttgtttcttttttttttttttgaaacggagtattgctcagtcacccaggctggagtgcaatggcacgatcccgactcactgcaacctctgcctcctgggttcaagcaattctcctgcaaatattttgtctctctttttttttgagacaaagtctcgctctgttgcccaggctagagtgcagtggtgcaatcttggctcactgcaagctccgcctccccggttcacaccattctcctgcctcagcctcccaagcagctgggaccacaagtgcccaccaccacgcctgcctaattttttgtatttttagtagagacggggtttcaccgtgttagccaggatggtctcgatctcctgacctcgtgatccacctgcctcggcctctcaaagtgctgggattacagacgtgagccaccgtgcctggccaactcttctttttatggtctgaaatcacggagtatattctctacatctcattcctaccttcaatgaggaaattagttcctgggatctgatgacctggagtgagagatgcagctgatctagaccacatttctcacttctgagatcagaatagcaaatatgtatgtactagtaatttggacatttgcaattcaagaaacctcgcacctcccacagcatacttcattcactccatgagaaaaaaacaaactcacttaaatattcatcttcagaaaaaaaaaaaaaaggctgcccgctgcggtggctcacgcctgtaatccactttgggaggccaaggctggcagatcacgaggtcaggaaatcgagattatcctggctaacacagtgaaacctcgtctctactaaaaatacaaaaaattagccgggcgtggtggcaggcgcctgtagtcccagctacttgggaggctgaggcaggagaatggcatgaacccgggaggtggagcttgcagtgagccaagatcgcaccactgcactccagcctgggtgacagagtgagactctgtctcaaaaaaaaaaaaaaaaaaaaaaaaggcagagtggcagaccaaaaacgagccatatgtcaatctggagtaggagtgaccaatgtcagagtggaaaatgagggctgatgagctttggttctcaggctttagagtaaaggtggtagatgcaaaactgtctatccaccgtgggtttatactgataagtgggcagtaaatgaaagaatagtgtaatcagctgatgttagagtgcaccttttaacaacgttcaagtacagatgcatcttaaaattgacattgtaaaaacaaagtttgccagaatctagtcataatatggctgtccttgtctgcacatgcatgaacttgatctgaaaacctttgattgacgtcttctggtgatatgatcaccatcaaaacttacagagatgctgtcagtaggttgaataatctcataaataggagagtaggactctgtcaagaaatgtgatgtcaccaaagttcctgattagcaaagatgatgacaatgtggggtaaatcatggacagggtgtgttgaaggtgattcagaagagtttgatctgagtgacaggaattttaggaatgctgttgttagtgtattctgcttatattttccatctttgtcatcatagaagtgatataagactaatacctgcatttatagtagttgaaagtttttttcagtaataatataaaattgtaagtgataagatgtatttgtcctatagtctacgaatttattcctatattgtgacataaaataatgatgcattttacaattgactcaaataataactatttcaattccttagaaaacactgtatgagaaaatgctgacttcatgtttagtatagatgtgctattagtctacaggttttaagtattattagttcattcaattctcacaacatttcaagaggtaggcaatattaccactcccaagttccagttgtgaatctgagctaaagccttacaggaaaagagtagaaaaacctgagcttgactttgtctgtctccagaatctttgtttacatcaactatgttagaatatcttttctatgataaatacatcctaagtctagtttcagaaattgtgctttacacaatagtcatgaaattatttttctcaatttcaatctaaatgctacattaaatcgtttttaagttcaggtcaatgaaccatctggtgatcattttgtatgtaatgtgaggtcaaaggtgagatttttattccctcccccaccgcaacagaagaatattcaatttcctagaacattgatagaaaaatcaattttccccccattgaactttaatatgtatgtataagagttttccactgggcatggtagctcacacctgtaatcccagcaatttaagtggctgtggtgtgaggactgcttgagcccaggagtttgagaaaggcctaggcaacatagcaaaacactgtctctacagaaataaaaattttaggccgggtgcggtagttcatgcctgtaatcccagcactttgggaggctgaggcgggcagatcacctgaggtcaggtgttcgagaccagcctggccaacatagtgaaaccccatctctaccaaaaatacaaaaactagccagacatggtggcacatgcctgcagtcctagctactcgggaggctgaggcaggagaatcgcttgaacctggcaagtggaggttgcagtgagccgagactgtgccactgcactccagcttgggcagcagagtgatactttgtctcaaaaaaaaaagaaaaaaaacaaaaaaaataaaaattttaaaaataaggagtgttcaacactctttctacttgctaacacttatgcaggttcaaatcttgccttttaatatttgtttttaatttgtcttgcagactaatgtctttatcacttgtgtacattttttttcctttggccacataagtatcatctacaacccaaaatacatttctcctttatttaaagcacaagtcaagcagacgttcaacaaataggcaataaaaatcagattaaagatactgtaggtccaggagctgtggctcatgcctttaatctcaacactttgggaagctgagatggtggatcacctgaggtcaggagtttgagaccagcctggccaacatggtgaaacgtcttctctgctaaaaatacaaaaattagctgagtgtggtggcgtgcgcctgtaatccaagctactcaggaggccgaggcaggagaatcgcttgagcccaggaggcagaggttgcagtgagctgagattgctccactgcgctccagcctgggccacagagcgagactccatctcaaaaaaaaaaaaaaaaaagatgctgtagtaggaaatgtgcattactctgttgaaatccacaaaatgcatgagcatacaacccaaatttaagtggtaattgaaggtttcctcgaagaggcagtttgtgattgaatagatgaagaataagcagctgaaaaccatgtaaattagaactaataaataacaaaggatgattagtattgaggtagagaatgggaatgtatagaatgcaaaaaaaattgagacatcgcaaggagagcagcaatttcagtacacttgaaggaagctagaaatatataccagggctagatttttaagatatttaatgccgtgtcaatgtgttggtattttataattttctgtagttccagacattagctagggtgtgctcacttaggaacacagctgttgaaattgtaaaatgagaatttgggtctcatacatttgaagaaaaaaatatatggggtttaggttcagattctgtacagacaaaggaaaagtatgggtggggaaaatgtgagacagcctgaggtccaggaaaaatggccacagaaaattttcgtattttcagataaaatctactcttcaagttagacctccctacgaaagatgctagttcaataatgaattctccacctggaaaaggacatttcagctccaagtccaggttgctttcatgccttaaagtcaccttatttgtatttcagaagcacgtgctacactagctttagggaatgaagaaccatgtgctgacagtgccatctagcatcaacagaaacaggaaccaatggcaacctaaataagtacagaaaaaaaggtggggtccaggaaccaagaatgactgctgatttgagcaggatttttacaatttgttttaaaacttaaacataatgcatagatgctgtggaattaaaaaatgcaacctaggccgggcgcggtggctgacgcctgtaatcccagcactttgggaggccaaggccggcggatcacctgaggtcaggagttcaagaccagcctggccaatatggtgaaacatctctacaaaacacacacacacacacacacacacacacacacacaaacacactagccgggcgcagtggcgcgcgcctgtaatcccagctactcgggaggttggggcaggagaatcgcttgaacccgggaggaggatgttgtggtaagccaagatcgggccactgcctggcgacagagcgaaactccgtctaaaaaagaaaaaaaatgcaatctaataatgtccagcaacgatacagggaagcctggcccatgctcacttttccagtcacctgctcttaagtagtgcacgggttaaagaacgatgtgagtgctagtggctgattctttcacttacaaacatgcatgtacacgattgtgttaccatggacaaacacataaaatttgattgtaaaactagttgactcttaactgtgacacattaaatccttgagtaaatgagtgtgtgtttccatacatatattcagtaccactacagttcacaaaatgaacgggacttcttaggttaaagccttgttaagttattctttaaaacgctttccaatctgatagagagctctggcgtattcgctcaagtttccgtggcgggtctagggctcctgaagccccacgggtctcactgctacccacatggctattaccgcaaccaccgctgccacgcagcccgcaagaaatgtgccaccgttctgagcggccgacaaacccgcagtgcgctacgggaaggtcacctgacagttggggagaacggcagcccgcaggggccgatcttcggcgcgcctgcacagcgcaggcggaattggggcgccttttctccttccggtttccgtttccgtgcgccccgagggtctgttccgcttatggcgcccgccgggagtctccctttcttcgcaagcgttaacctgcgttttactcgtaaaaatttgctttctaggcttcgtataattgttctggtcttgcactttatgtgtgcattagccttgagtttgcttgttgttttcccatgaaaaattgtattgtatttctgtaacagcccctcctcttgttacataaacattgaccagtaattgtatatccttccctctcaatattaacaattttatcttttttgcgttctttgaaaaaaacgaaatccttttcaaaaatactgaacttgtcatttttaagaaatgagatactactttaatcatttctgtattgtccttaagattctttatatattctttattgtttatcttttccactaatatacctttaatatgagaggacttgtagaggcttcagggtcacactttcgaaacccagagttttagtatctccttatagaatatttgtaatttaagaaaaattatacaaggttgaattttcaaaaatatatttttaaaatatatttaaaaaagtatttttaaatatagtcctccggaatgcaaaaggacaatactactttcagctagtactttttaagtgattattttccgccacgtattcttttgaaattatgcatttaggccgggtgcggtggctcacgcctgtaatcctagcactttgggcggccgaggcaggcagattgcctgagctcgggggttcgagaccagcctgggcaacacggtgaaacctcgtctctactaaaatacaaaagaaattacccgggggtggtggtgttcgcctgtagtcctagctactcgggaggctgaggcaggagaattgcttgaacctgggaggcggtggttgcagtgagccgagatcccgccactgcactctagcctggaggacagagtgcgattctgtctctacaaaaaaaaaagaaagaaagaaattatacatttaattgaagctcagaaaatatatgtgtgatgttttctatgaaatgaaacattgtttagatgagaaaataaatgtaaaatgcatttgccttttcaaagcagcaattagtggcgaagtgtgaatacaaaaccagtcttctttctgcagagaccatgtctgtcacccttgtgctggaatgaacaacatcacatatttttttgtttgcatatggcctgagggtcaaattctgcccagcatgtttgctttcttttttaaataaatatttattggaacacagctatgctgttcatttttgtattgccgatagctgccttaatgctacaatggcagtagttgcaagagacagaatgacccataaaaccaaaattatatactctctagccttcctatcacccactgttctgtctggtgttggggcaattcagtctttggtatgctaatttggatgagattcacacttgggctgttggagaggagtgggtgaacctgttgagttaatcagcaactccaagaggtccatttcccaagcatctttccttccataacttcacagtaattttcgtttccttatgtctcctctggccaatatttttctacttctggggtaggcggtcagaggaaagagaaaaaaaggaaaatggtgaagttggacccactgtcttggacctatgacgactcctggcagagaaaggttttcccacttttcgtttttgttcttgtgaactccctgagcagccactgtcatgacaacatgatggtctgagaggtggagtagaagagattggagaaaagggcgacagagtgagaccttgcctctaaaagaggggggtggtggtggagggatgggaggaaagggggattcttcactcttgagttccgttttcaatcctcgaacttttcctggagcccgcagtctgcaccacagcctcacttctgggtttctgcctgtcttaaattcaggcctggggataagtgagtggtaaaaattaaaattcatcaccaatttagtagtacttcacagtccagtgttattccttcatttctgttactacttagtcctcaaacagctgttccatacattttatccaagttttatagctatattcagtaggagagacagggcagaaaatactttttctttcctgaaaatggaaccctaatgggagcctgatgaattttttaattgaagccaaaataaaaaaattaatatgtgctcataaattcatatttatactcataaaatatgacattcaacccaagttcttcattttaacacttacgcctttttttttgagacagagtcttgctctgttgtccaggctggagtggaatggcatgatcttggctcactgcaacctctgtcatcagcgttcaagcaattcttgtgcctcactaccgggtcttactacattgcccaggctggtctcgaacttctgggctcaagtgatcctcccgccttggcctcccgcagtgctgtgattacaggcataaacctctacaaattttaatctacaaaaaacaaaattatattcgctttacctgtgtgacatttgaataatgacggtccatgcaggctttacatttcacttttatgaactaaaaaaaaattgagcctccacagggcaagtcctctgctgtgcatggaagataggcaggtgttcaaagcatagaaaggtactgctgccccaggtaatgcagtcaagagggaattcaagcatatggaggtgattttcattgctatcaagagtgtggtttaaaaagtcacagtaagggctggatgtggtggctcatgcctgtaatctcagcactttgggacgccaaggcaggtggatcacctgaggtcaggagttcgagaccagcctggccaacatggtgaaaccttgtctctactaaaaatacaaaaaaaaaacaatgagctgggcatgggggtggacacctgtaatcccagctacttgggaggctgaggcaggagaattgcttgaacctgggaggcagaggttgcaatgtgctgagattgtgccattgcactccagcctgggcaacaagagcgaaactccgagagagagagagagagagagagagagagggagggagggagggagggagggagggagggagagagagagagagagagagagagagagagagagaaagtcacagtaaggcaccctagcagagtgaaacaaaaactaaaaaaaaatcgtgttccagcataggcctgagcatttaaaaatcgaagaaccgtggaaatattaacaattacataaagtgcatctagattttgaagtcatttcatgcaatattcatgagttctgggtttatcagttattcctcagctttatttggtgtatcagttttaggaatgtgtatgtataatcgtcaagtcttctatctgaaaggtaccagaacaaagcctggctttaggatcagatcctgggcaggcaaaagagcgctagaggcggaacaagatatccttcctatctgaagtggccatgggttttcaactgacagccttctcctcatccacttccaccttccccgatgctctcagaggtagactatgaaggcctctccctaaccactttctagctgcctcttcatatccttagtgtatcatttctccaagctgtaggtgtcctgctaattgattttgaatttttatgttcttctgtgtgcgaatgattaaatattaaatacaaaagtcggttcatttgtttgttttttccaggcttgtaatctctaactttcatttttgctacaaagcctttaaaaaaaaaattcagttactctagattcagattttaattaaaatttatttttgaaggtaaacatcttacataaaatttggctaaaagggaagaaaaaaaactacctaaagtttatgtggtcatcctacttgcaatattttagcaagcatgatttttatttaatgagtttcaaaaattttgacaatgaatactatcacagagactaagagtgtgtgatttcttccactttcatagcacagatgctcctcgacttacaatggggttatgtccccaataaacccatcataaattgaaagtatcttaagttggccaggcacggtggcttacgcctgtaattccagcactttgggaggctgaggcaggtggatcatgaggtcaggagttcgagaccagcctgaccaacatggttaaatcctgtctctactaaaaatacaaaaattagctgggcgtggtggtgcacatctgtaatcccagctactcaggaggctgaggagaagaatcgcttgaacccaggaggcagatgttgcagtgagccgagatcataccactgcactccagcttgggcgacagagcgagactccatctcaaaaaaaaaaatatatatatatatagtgagttgaaatgcatttaatatatctaatctattgaatatcattgattggcccagccttgagcacttaaatttgctcaaaacacttacattagcctacatttgggcaaaatcatcaaacacaaagtctattttataataaagtgttgaatatctcatgtaattcataaaatactggaagtgaaaaacaatggttgtgtgaattctcaaagttcagtttctactgaatgcttatcactgtcacaccatcataaagttgaaaaattgtaagttgaaccatcttaagttggggactatctgtactgtgaaattccaacttctggacagtcaagaaggaagccagtaaaatcagaaaccagcggctttgcagccaagtaagcagggaggccaagcgtattccttggatggtctgcggtgggcagtctctgccaggatgtgcccacttagcacacacagccctgtacatcagcctgcaggaaaggcaccttggccagagcctcgggctcaccctagagcactatagaaaggtcatctggctgtctgggaggacagtagcccacaggggctgaagctgggcacacccactgggtggctcagggccagttttataatccctaccccctcaacaaacacactccactcttgaccactgcactccaacctctgtccctgcatcctccaccaggctttacacctgcaattgcactttggataataacaggcatcattggcaatatcttacactctatcatttcagataaagccttgaaaaatatgtgcaattatatctgtgcttctttgtggatatatgttttattatattcactatatgattataataatattagttactactagtatttatcaagaatgtagggctgaagctgggcacagtggctcatgcctgtaattccagcattttgggaggctgaagcaggtgtatcacttgaggtcaggaatttgagactagcctggccaacatggtgaaacctgatctctactgaaaatacaaaaattaaccgggcatttatgcctgtagtctcagctactcgggaggctgaggcacgagaattgcttgagcctgggaggtggaggttgcagtgagctgagatcgtgtcactgcactccagctgggacaacagagccccactctgtctaaaaaaaaaaaaaaaaagaatgtagggctgggcatggtggctcacgcctgtaatcccagcattttgggaggctgaagcaggaagattgcttgagctcaggagttcaagaccagcctgggcaacatggcataaccctgcctctacaaaaaaaaaaaaaaaagatctatatacacacacacaaatgccaggcatggtgacacatgcctgtggtcccaactacttgaaaggttgaggtgggaggatcgcttgagcccagaaggtcaaggctgccgtgaggcatgatggatccacggcacttcagcctgggtgaaagagcgagaccctgtctcaaaacacaaacaaacaaaaagggtgtagtatattcctggtattgattgtgcttttcatagtttaaaagtaagacttggtgtaaaggtatgcattgtgtagtataaatgcacagagaggaaaggagagattgggtacaaattcaggaaggcatgaagtgttgatgtcatgacacttagcccatccttgctctgcacagaccacgtttctcaccactgtgctggtatgtagacaccagcatgatcttctgaagcctcggataatttggtgtggatagctttcttttggattcttttaaattttgttatcttaaagctttccatagtatttcatatggataggccacagttactttccatttactattatacttttatatattttttcttattttgatatgagaaacaatgttggaataatcatgcctagacataaataagccaatttcaaaatgtttgtaggggagactcatagtgttgccagaaaaaggggccctgacccagaccccaaaagagggttcttggatctctagcaggaaggaattcaaggcgagatgcagagtgcactgaaaagagagagtttattgaaagctactcagctatagagtagagcatcctcagaaagcaagaggagaaatgccttgtatttaagttttttttatgtaagtgtcttgtctatgtaaagactaaactaagctgtgtctacgtgcagatgggttgagagcatgacaaaatttactattctgttgatttaaagaaaatggtccttgacattttagtaagtacatcaaagccataactgtaagtaacttgaaagcatatattgttatgggtattgggacatctggattttgtgttgttgtaggagtgtatccttgcaccggtagcctaggtattgttaagctgtttcctcaattataaacatgactatgggttgtgaccagcaaggaatgtgccttagttaatctcaagatggagctgaacttaaaatgccattactttggctctaaccagctcctgcttccataacagtggggtcaaaaggtgttcctttaaaatcttcctagacactgccaaattgcttttggaaacttctcacctggtgagatggcatgagtatctttggctcatttttctacatagacttggaaacagttttatgtttataaaatatgtatcacctcatttataaatttgtttgaataatttaaccattttgcttttattagctattttgctactctctgttttccttgcctgagtctttcccacatctctgcaacattgtatcatttcccacacctaaaaccaaagagggacaggcaagccagtggagagagcagaggctgatgagaacgaaggattttccaggaaggaatctggggctgtgtgtgtgtgtgtgtgtgtgtgtgtgtgtgtgtgtatgtctgggtgtgtgaatattgtttttattagcctgtagcccacgtgttgcatggccatatttttactatcaggatataaaacacacttacacacagctgcatacaaatgcaatgagtttatttttcatatacatttcaaaataatagcgtgaacagaccagaactcttcttcaaagttcaagaatgtcctcatggatccagcatccgtctggtttctgtttctgcattctcagtacatagcctcacttctctttctccaattttggaggatgtgtaaaaaattttattcttaaccaaacattagtcaggctccggaacgttctcttaactccatccatgcactttcttgtaaaatgcagttttaacaagaacactgctaagttagtttagcaagacccccacaccttagacatctgatcaccttctatatcttatcaggttcctcatcctccaccatcccttaagtgatcatcccagcttgtcttcagcaagaatcctattagatcaatttagccagaatccctcttgcccctgatgttaattcttagtaattttccaaccactagtccccaccctgttccttggctataaattgccacttgcccatgctgtacttagagttacttagagttgagtctcactctctcccacactgcaaggccccattacggcggtccctaaatctattgcagtggtcccgaataaagtcttccttactatgcattaacacgtatcattgaatatgactttttctttaacagatactttgacgaaggtaattgggactcccatcaagtctccacacagctagcagccacgtggggcacttctccaggtaaggattgtccctgttccacttatgttcctgtcagtaaaatggtaggttcagtgtcaggctttaccattttcttcagggagagacccatctgatatttagtcagccatcagatgggtccagccatagcacacattagctgtgacatgacgtcgtttatgacaatgactttgagcagagttgcacacctaaaaagggactcaattaaaattatcattcattttagttatttctcagatgcatttattatttccattttccaaaactcctaatgttacatttcttcttcacatgttagatatgaacaaagtaagactaactgtggccacatcctctttacttaggaccctacccaaagtggcaggaatgggatgtaaagtgacataatcagacacagtcaaactggcttttaatcgttaagtatcattgtcatctcaaagcacttggcatagttactgaccccttaaatgtcctttctccatcttatcttctcctttgttctctgtatcatcttccggtcctatagaaatatatccccacgagcacacactgaggtctttttttttttttttttttgagacggagtcttgctctgttgcccagactggagtgcagtggcatgatctcagctcactgcaacctctgcctctcgagttcaagcgattctcctgcctcaggctcccatgtagctgggattacaggcatgcgccaccatgcctggctaatttttgtatttttagtagagacaaggtttcaccatgttggccaggctgctctcaaactcctgacctcaggttatcctccggcctcggcctcccaaagtgctgggattaccagcatgagccatcgcacctggcctcactgaggtcttaatgctgagttgaactttgtctctggccatgagcatcagtccatgtattataataggtttgggttgggtgtggtggctcacacctgtaatcccagcactttgggaggccgaggcaggctcacaggtaaacaatttagacaaagttttcacattctctgagatttgtatacattggagattcagaaaaatgtaaccgaaaattaaactataggtggaatagctgcctttgggggctgagaagacaggcatcagacctgggatagacaagggaggcctcttgttccttgaaatgataccccagcccatgaggtctgcatgccaggaagccaaatgagtgaggatggtctgtgtccgctggggaggtccctggatgttgccaagagggatagggtctgggaaagagtgaggatggagtcaggcagagaggaccccccaggctcatggatggactgacctgaggacttatattaagtcataggacagtagagaaagtaagagccaagcataatgtaatcctaacaatgtaaaaagtattaatcattttattattagttaatgtcactgaactgtacacttaaaatggctaaaaaggtaaattttaggttacatatattttaccgtaatataaaatgacaaatatattagaaatgacttttttttttttttgagatgtagtcttgctctgttgcccgggctagaatgcagtggcacaatctcggctcaccacaacctccgcctcccaggttcaagtgattctcctgcctcagcctcccaaatagctgggattacaggtgtccgccaccatgtccaactaatttttgtatttttagtagagacaggtttcactgtcttggccaggctggtctcgaactccagacctcgtgatccacccacctcgggttcccaaagtgctgagattacaggcgtgacccaccacgcctggccaggaatgactgtcaactatattttcttaacatatgtattcctacacaacatcagttttgtaatagtttatttttgttttgttttgcaatttttttcttttattgtaaggaaagaagtacattttttcagcgtgtaagaatgcaaaagtaattatcagatgtttgtcacatcttaacaaaataggaccttattttcctagatgttgctgcattcagtccctttcttggtatggtaaaagcatcaatcagccagggaggcaactataaatacagaagagcagtttcctacagatagtcaaccatgctacccctcttactgacttaattttaatattggagcctggcacaattaacctagtttcctcgtaaacacaagaacaacgtactgcaatcaatgtaggcatatacaggctcttaaagttctgagaagcagcaagtaagttcatcatttactaagatccttgacattcttctgtttctgtgaaatttatgcatctgtgagaagtttcttttctttttttatttttttttgagacagagtctcgctctgtcacccaggctggagtgctgtggcacaatcttggctcactgcaacctgaacctctggggttcatgccattctcttgcctcagcctcccgagtagctggaactacaggcacacgccaccacacctggctaatttttatatttttaatagagacagggtttcaccatgttggccaggctggtctcgaactcctgacctcaggtgatccacccaccttggccttccaaagtgctgggattacaggcgtgagccaccgtgcccagctgagaagtttcttatactagaagaaaaagaaaatttgatttattttaaaatataatggtttagtctgtagcaagtaatattaatttttttatttttttatttttgagacggagtctcattctgtcacccagactggagttcaatggcacgatctccgctcactgcaagctccgcctcccgggttcaggccattctcttgcctcagcctcctgagtagctgggactacaggcgcctgccaccacgcccagctaatttttttttgtatttttagtagagacagggtttcaccgtgttagccaggatggtcttgatctcctgacctcgtgattcacccgcctcggcctcccaaagtgctgggattacaggcatgagccaccgtgcccggccctaacacgaattcttaagagaggtgaaccagggatgggattgtggatcaatcatgcaaagaccgactcctctgggcttcatttcctccatactgaatgtgcatccctacatgttcatgttgttgtttcataggtagtgcagggggtcagaataggatacccctggctgggtgtggtggctcacgcctgtaatctcagcactttgggaggccaaggcaggtggatcacctcagatcaggagtttgaaaccagcctggccaacatggtgaaaccccttctctactaaaaatacaaaaattagccgggtgtggtggtacacgcttgtagtcccagctactcaggagactgaggcaggagaatggcttgaacccgagaggcagaggttgcagtgagctgagatcgcacctctgcactccagcctaggtgagattgaaactccatttcaaaaaaaaaaaaaaaaaaaggatatcctcaattgcggtgccctggcatactgagtattttaagctgaaggaaattgagaaaaccatggaagcaggaaggccactctctgatttgctcccacttttctcccctgaagcaggtcataaaagaattatctgccctacctgtcctgaaagtaggtcataatgggaccctcatttcagaggagttctgccctatccctggataccaacaaagatctgaacaaacaggtcttatgaatttctccccaggtaattactattagatgataccctttgttccccaaagctatttcttcaaaactgtccataaaaatacacctatccagctgggcacagtggctcacacctgtaatcccagtactttgggaggctgaggcgggtggatcacgaggtcaggagttcaagacaagcctgaccaacatggtgaaaccccacctctactaaaaatacaaaaaacaactagctgggtgtggtggcacaagcctgtagtcccagctactcaggaggctgaggcaggagaatcgcttgaacccaggaggtggaggttgcagtgagccgagatcgcgccattgcactccagcctgggcaacagagcgagactctgtctcaaaaaacaaaaacaaaaacaaaaaaacaaaaaagccccacctatcccttggcctttgcatcttgatttctgaagactcacatgtcatgtaaaacttacgttaagtaaatatattatgtttttctcttgtaaatctgtcttttgtaatcaggatctcagccatgatgcattttggcttgtcagaaataatcacaacatgtggagaaatagataaaatgccatttttaaaattattattattttttatttttttgatagagtctcgttctatcgcccaggctgcagtgcagtgtcatgatctcagctcactgcaacctccaccacccaggtccaatcagttcttgtgactcagcctccccagtagctgtgatttcaggcatgcaccaccacgcttggctaatgtttgtatttttagtagagatgggatcttgctatgttggccaggctagcctgaaactcctggcctcaagtgatctgcccgccttcgcctccttaaatgctgggaatacagttgtgtaatggtatttttttttgagacaaggtctcaaaatggcattttttttgagacagggttgttgctctatttaccaaagactatacaagattatgtgaacttaaaataatattcgggttaatttctgtatttctaagttttaggaatacttagttatgtaagcatttacttccctttaagtcaattaaatcctcttttaaggaactttataaattaatttggtagtatcattgggcccagtagagttttttttttcttttttttgagacggattctcgctgtgttgcccaggctggagtgcaatggcgcaatctcagctcactgcaacttctgcctcctgggttcaagcgattctcctgcctcaccctcccaagtagctgggattgtaggctcccgccaccatgtccagctaatttttgtatttttagtagaaatggtgtttcaccatgttgatcaggctggtttccaactcctgacctcaggttatccaccctcctcggcctcccaaagtgttgggattacagggatgagccaccacacccggcaaatttcttttaagatattttataaattaatttggtaataccatcagaggcagaaaaatttcacacagatggagagacatacataaacatacaggcaaatatcaaaagagatcttctagctatcattctaaaatcttagccatgaatcagaaacacatagtaatacaaagtcactgttttatatgtaacagttatctctcatattttctccatttcatattttttccctattgtccctggtaaatgggacaagttaaggctatgtactaaatattaggcctaatgctttttaccaatattcatggagaaggtttttaagatcttcatttgccctgtgaagcccttttgaaggctgtggactaaatgttaaatgagtcactgcaaagacatctaacagctatcgaaatgtctccaccacccatctgagtggataaaatatccagtctatttccaaatagtctttttttcctcttcagccttggtacttacttttggaggactctgagtcccttgacagcagggtggactaaagtttaagagaagaagtctgacaggggaggaagacagagagatggagaaggtaggagtttgaagggatcatatccaggactcaaaggaactgaatggaagattgaaagtggcaagagtaggaaggaggaacagaaagagggggaaggaagaggtcttaagggaaccagctgggggagatattaaattccccaaagaggctagtgaagctccaaattatccttagcaaaatcaggccgggtgtggtggatcacttgaggtcaggagtttgagaccagcctggccaacatggtgaaaccctatctctactaaaaatacaaaaattagttgggtgtggtggcacatgcctgtaatcccagctactcgggaggctgaggcaggagaatcgcttgaacctgggaggtggaagctgcagtaagccaagatagcaccactgtacttcagtctgggtggcagagtgagactccatctcaacaaataaataaataaataaataaatatccttagcaaaatcatgccaaaaagagggaggtaggcagaattgtgaaagcttatagccaacagaggttcaagaaaaggctttttgtcaatggataagtttacatgggaagatccggatcaaaaggagagaacagagaggacttaagaaaattgttcctattggctgggtgtggtggcttatgcctgtaatcccagcactttgggaggctgaggcaggcggatcacctaaggtcaggagttcaagaccagcctgatcaacatggtgaaaccccgtctctactaaaaatacaaaaattagctgggcatggaggtgcacgtctgtaatcccagttattcggaggctgaggcaggagaattgcttgaatctgggaggcagaggttgcagtgagccgaaatcgagccactgcactccagcctgggtgacagagtgagactctgtctcaaaacaaacaaacaaacaaacaaacaaaaacagaaaagaagaaaagaaagtttttcctataagtctgtaactatcagcttcccattaggccaactattgatcatagaggtcttaaaaaatcctttcaggctgggtgccgtggctcatgcctgtaatcccagcacattgggaacctaaggcggtaggattggttgagcccaggagttccacaccagcctgggcaacgtattgagacctcatctttactaaaaataaacaaaattagctgggtgtggtggcatgctcctgtagtcccagctactcgggaggctgaggtgagaggatcacctgagcccaggaggtcaaggctgcagtgagctgtgattgtgccactacactccagcctgggtgacagagcaagacactgtctcaaatatatataatttttttcaaatatcttatcaggttttggtcaagaggaaaggtaaatattcctgatagtacattcccattaaaaaaaaatgtacccgttacaagtgacttggaaccaaaatccatagattctttcatggttctttatcggtatggtgatagggttttcatattcatgtgtgagatgtgcctccctcagtccttgttatgacatcattacgtgtctgacatgacaaaaaggaaaagagaaaaaggtggagaaaggtaaaaaataggaaaagaaaaactgaaggaaaaaggaaaaaaacccaatccgtaagccttttatgacttacccatgaatgcagaggcatcttcaaagagggtgcaaaaaatgcagccctctaaagatgccaaaccactctcaaagatagccaaaagaaaggcaggcctagatactccccctgagagctggcaatagatgttagctgcaaatgggttgcaacccacatgtctgtccagctgtattcccacagccccccaacctgatggttggctgcttgcacacacaagaaccaacaacttgtacgccccatcaagtggaaaaccaagccaaattcttttttttttttttcctttgagacggagtctcgctctgtcgcccaggctggagcgcagtggtgtgatctcggctcactgcaagctctgcctcccaggttcacgccattctcccgcctcagcctcccaagtagctgggactacaggtgcccgccaccacgcctggctaattttttgtatttttagtagagacgggctttcaccatgttagccaggatgtgtcttgatctcctgacctcgtgatccgcccgcctcggcctcccaaagtgctgggattacaggcgtgagccaccgtgcccagccgaaacaaagccaaattcttgacacaaaatgacagaaacagaaaagcaatagctgctcctgggagggaaaggatcaataaccaataggcaccacaaaatcaagctacagtcacaatctagataatgaatttttataatttttttcctatccatctgcattgggaaaataagggacaaggagtttttactttcttctcttgaccaggaactactgacagagatctgggagagctgactttggtgaaaattctcaccttgcacaggcttgtgtctgttttccagaatcctacctgcagactccagaatgaagtgtcccagctgtccctttctcgttgccagaaacttctacccttctcattcctttgcttgtccccctgtaacaagagacagattaatgagagaaaatcatgcaagttgatttactgtatgttttatgtaacatgagtcttcataagaaaactaagcccaaaagaagcagttaaacctgagtgttttttttgctggtctgatgaagagcgaagagtcatggagaaatgtaatgggaccaaaaggtgtcagctaagtgtaataaactgggggaaacagcaagggctattccttcagattcctctcagtgtccctgtgtcttcagagataaagatcttttcctctgggtaaagcgtggcagctctcacatgagggttttattacttgcttcagcagaaagtcaaaaagcccttcccaggttttatgacctctttcagcgaaaggtgagaaagtccttcctacacatttggtttctgaaattccttcagcttaaaatattcattatgccaactttccatattttgggttggcatgtcctgaatatattgtcagagcattacagaaaaaatacacccaaacacacacacacacacacacacacacacacacacacacacggacaacacattccctatgactatcttaaaattgattaacctcaaacatttaattttggatgactgagtcaaaaagagaattgaaattgccatcacatatctggtcaagctgaaagatggcatttggtattggaaattgatggctgctggtcatttaacacccatgcctcagttacatatctggctcatgagataagaatgctaaacagtataaacaagacacctcagtatgaaaacgttctgccgttacaaaggtactctctttgtgttactctgcattctctcccagccctgtagcaatttatcctttgtccatatattgaagatagatttgtttacatctactcttagccttcctgaatatcctttgctccaggagagccttaagccaagggtagaaatgacaagacagactctatgtttgcagaacaccacatagtcacagcgatgcaaatggaaaggaaaatatgagaacaaggtctttcaatccagatttggcctatgtttgtattaaaggtgttattcccatgtaagaccttaagacataatattaataataattcagctatgaaaggttcatgttgagttctacttgcatgggcaagctattaggtagaagttaaagatgcacagaacacattagttctttctaggtatatccttagcagagcaaaattgcaacccaagttagaacaggaaaaacttgatgaagcatgaaattaccagctggtctgatgggagatatgatgtggccctgaggtacagtaggtggtgcctgaagcatggtgacagtagtggaaacaccttagggtgacccacaattagtcactctcattcaattccctttccttgggtgtgggaagaacctgccaatagcatgtggcaaaggatatcgttactgtgtttatgctatgttatatgtcaaaagtgaagatatagtgcagatgtaattaaagaaatcagttggctttgagttcattaaaaggcagaatagcctatgtagacctccccttatcagatgagccacttaaaatggctcctaggcagatcacaaggtcaggagatcgagacccccccgccggctaacacggtgaaacctcatctctactaaaaatacaaaaaaactagctaggtgtggtggcgggcgcctgtagttccagctactcgggagactgaggcaggagaatggtgtaaacctgggaggcggagcttgcagtgagccgagatcgtgccactgcactccagcctgggcaacagagcgagactccgtctaaaaaaaaaatggctcctaggccttccctgatgtcagggaaaatagaaaagactctgtctcttcactgttgcctttgaagaagcaagctgccatgaattctatagccattgtaaaatgaattctgccaacaagcaaatgagcttaaaaagtaacagagtctgcgcacagtggttcacgcctgtaatcccatcactttgggaggctgaggtgggtagactgcttgagcccaggagtttgagaccagcctgggcaacatggtaaaacttcatctctatagtaaaatacaaaaattacccgggcacagtggcatgcacctgtagtcctagctgctcaggaggctgaggtgaaaggatggtttgggtccaggaggcagaggttgcagtgagtcaaaatcacccctctgcactccagcctgagtgagagccagactctatctaaaataaacaaaaacaaaaacaaaaacgtaatacaggccactgacaccttgactgaatccctgtgaaatatttcacctgaaaatccagctaacctgtgcccactgacccacaggaatggagataatatatttacattgttgtaaactgctaaattgactggatgtggtggctcacacctgtaatcccagcatcttgggaaaccaaggtggggggaatcacttgaggccaggagtttgagactagcctgagcaacgtagcaagaccctgtctctacaaaattaaaaaattagccgagtgtggtggtgtgtgcttgtagtcctagctattctggaggttgaatgggaagatttctttagcccaggagttcgtggttacagtgagctatgatcacaccactgcactccagaatggatgacaacgtgagaccttgtgatatggtttggctgtgtctccacccaaatctcaccttgaattataatcccatgtgtcaagggtggggccaggtggagataattgaaacatggggggtggtttcccctatactgttctcttggtcatgaataagtctcattagatctgatgcttttataaatgggagttcccctgcacaagcgctcttgcctgccaccatgtaacatgtgcctttgcttctcctttgctttcctccatgatggtgagggcttcctagccatgtggaactgtgagtccatgaaacctctttctttataaattacccagtctcagatatgtctttattagcaggctgagaatcaactaatacaccctgtattaatgtattaatacatgaataaaaaaagttgctaaatatgtagaactacactctgtgtcttccctttagtgttaggaagatcaaataggcactacaagagcattttcttggtaaatggtatctaaattccctcttatcaatggcaattactcatttggactgctaacaccataggggcaaaaatcctgacatgtatgaatcttgtgggagaagcacttggaaaaaaaacaaaaacaaaaacaaaaaacagagacaaacatttctgagcaaaaatgcaagctttttaaaaaaaatagtttgttttgatcagttcacatcatgtaggtcatttcatccggcctcattggcatataagtagtatatattgagctaggcgtggtggcttacgcctgtaatcgcagcactttgggaggccgaggcaggcggatcacgaggtgaagagatcgagaccatcctggccaacatggtaaaaccccgtctctactaaaaatacaaaaattagctgggcatggtggcgggctcctgtagtcccagctactcgggagagtgaggcaggagaatcacttgaacccgggaggcagaggttgcaatgagcgaagatcgcaccactgcaccccatcctggcgacagagtgagatctgtctaaaaaaaaaaaaagtagtatatattgaaagtataaaggggtgaaccactttgaattgcgtatgacaaaagaagctcagagttcaggtgaaaaatgtgttattacaaactcaactatcaatttaatctgtctttaatgtatgagtcaaaattaagtgttttctgttggggtgatcggacccaacaccaggccgtgggggcgatgaagtcccacggagtcaaaggaatgagaaaagacaagttaagagagaaactgggaccaggggccaatgctagtatggaggctgcgaaggccccaagctctgggaccccatgctatttattggtgatcaaacaaagaaacaggtggcgaggctgtgggggttgaaaggaagtggtgtatcaagcaaatgagctacagctgtgatggtttagcattttctttgaaacatatggctacttgagataatgggagtgctagaagcaaggagccagcaagtctagacacattccaaaggccacaaggggttttagaccctggaccccagacacgttccaagactcttttacattatgtcagacatccaggccctgcctcaaattctctcccaacactcagcttttctcccaacactttctattacaaacatcaacggaaaaatcaatgatctgtttaaaatattgtaaataccatcactatgtttgaagatatgttttaattttttattattcctttaattaaaagaactgtatgccaattaataagctgttgccttttagatcaaaattaatcattcattgcctgctctgtgaaaattgagtcagatacccttaaaaatatattgtgttgcaatagtaagttttttcagtaattgaaggtggttggacattgtaaaaagagattttcctttctgattccactgtggtctctcagccgtttcccatagcatgcatgcctttctccagcactatatttctacagtatgcatgagcaatcctgcagcaacaatggcttttctagcatcaggctcctacaacgcatgacagtcagcagcactagtggtcagccacttcctatatcccctacccttaggtggtttctagtgtagtgcttccaataatatacctacctgtgaacacctttccctggcacctaagtgggaagatttctggaaagttccactggtgccgcacactgtgactattctgtgtagcctctaacaagctctggattgcaatccacttatagtaaataaatgtccacttcaaacattccctcctcaaattcttgtgttttgtctgcctcctgattggaccctcactgaaagaattaatgctggcattgttccaagagatatttccacagagatgaatctgggaggttgtgttggtcattcctttatgtttgggcacattccacagctccttgtcaatgtgcaatgggatactagcaacctatgacatgcagtggtatcacaattaatcaagcaatgacctgtggttgattgtggcaaagtgccaactgaaacacgtgccttgggagcccgagtgactgctgcactgaatgttatggcagtcaagataactgtaaggactgtggggtggaatggattcagttgagggtccttgagtgattacgaacagaaaataacaagcttaggttccttaattctcagttcaagccacggtttgaaaacctgagaacttccatggcgactataaaggaaattcatttgttgtagctgcagggctgatattgttaaatatcaaaaccaagaatgagatcctgaaacttggaatgggtcaggaaacttggaatgggggaatctgtttagactcagttgaaactgaccatctggaaacagaaagtcaggctgagcctttcttaccagtttaagtagcttgtctctattgtttgaagaaaatatctttcccttgcacaaaagctgggttagataccattaaaggggatgcccatttttcttaaagtcccctacaaatcatcactttttgctagtagcatgactagaccccataactaggattgaatagcaacctattcctaagggataggtacacactatgacctgtaggaaacagctacatgcaaaaggaactgtgacatatattggaagaaacctggggaatgttggaagagcattctaaggccgttatactaaggaggacaaaatataacagtagattgggttaattaatctcagtgctattactggggattcaagatttattgtgctgcaggcatgtggctcacacctataatcccagcactttggatgccaaggcaggaggataagatgagtccataaatttaagaccggtttgggcaacataaagagaccttgtatctacaaaaaataaataaataaataatccagtgagagtggtgcacctgtagtcccagctacttgggggctgagatcagaggatcacttgagccctggaggttgagggtgcagtgagctgtgatcatgcaactgcagtccagcctgggcaacagagccagaccctgtctcaaaaaattaacaaaaaaagatttattttgtagttctcctggtagagatctttcatctccttggttagatgtattccttggtattgccgtcttaggtagaggaagagggctcaaacatcttgcttatgtgataactttgccaaagacacaatgtacaatttgttttaaaggccagtgagggatgtaccagtaatcagaatgttttggcaaacagaagactttggtggtagctaactgatcacagggtccctagaatgaaatagatgagaagcatacttagagtattgtttgatctctatatcaagaaaagttccgggtctggtagtcaaatgttcaacagatgcctacctagctttcaaccctaagtcaattcacagttgcagagtgataccacacggaccatgaaaagaacacttgtttgtatgactgagacaaaaaagaatgtcatcgtgttctaccttacctgggaatatgctcaattggtgacaaaattgttgccactctgtgcatgaccacaaaagtaccgcaggtattgattttgaagttacacataaactttagtgagtgggcatatttgcaaatatgtaacctgagaataatgaagattaactatctttaaacaacataaggagtcaacatcagtttctgaagtaaaataatgactaagttaaattttcaagggcaaattcagattccaagtgcacagaacataggaagaaaaggacatgcaaatcagaaaaattcacaagtgtaatgaggcgagaagggacatggcgcaccaattacaaaggaatcagaatgatctgttcatagagttgtaaatggggttgtggaggaagaaatgaggatgaacagataggcaagacaagttcttttccttctatgtaaataagagaaactgagaaattgtaacgtaagacaagatctaatattatttttggacttcagaatggtattgcataaatgcttaattgttcctgatttcgggaggggaaaatggaaatagcatttccgttgcatttttgtgaacaaaatttgagtgatcatgttctttgttgcatgtggtagatggagaggtgaatgaaagattcagctttcttcctgtacttgaggcatctgtgaattgggaattcagacaaacagataagcaactaattctggatataaaatttgtgatttaggctatgcattctactggggaatttcagatgtataggaatgtagttgaaatttaagtggtcagggaatgctatctagaggaagaaaattatgactagagacaagaataaatagtagtaacttaaaaaaatatatatcagggaagaaaaaatggatttttgttccaggaaagaaactaagtatgaacagatgatgaactatttcaggaactgtgtctgcaattcgttccttccagtgggttcttggtcttgctgacttcaagaatgaagccgtgcaccctggcagtgagtgttacagttcttaaagatggtgtgtccagagtttgttccttcagatgctcagatgtgtccagagtttcttccttctggtgggttcgtggtcttgctgacttcaggagtgaagccacagaccttcgcagtcagtgttacagctctcagtccggagttgttccttcctccaggtgggttcatggtctcgccggcttcaggagtgaagctgcagacctttgcggtgttacaagcgttacaagctcgtaaaggtagtgtggacccaaagagtgagcagcagcaagatttattgcaaagagcaaaagaacaatgcttccacagcgtggaaagggaccccagtgggttgccactgctggctccggtggccagcttttattcccttatttggccctgcccatgtcctgctgattggttcattttacagagtgctgactggtccatttttacagagtgctgattggtgcgtttacaaacctttagctagacacagagcactgattgttgtgtttacaatcctttaggtagacagaaaagttttccaagtccccacccaacccagaagcccagctggcttcacctctcagaaccacagatacaaattattttatttacctgaatcaatctgaaagcatatgctggggctggatgttgaggatacttaatggcacattaattctttgattttgtatatgtttagatacattcattagctacagtttgcagcttcctaacagggattccacagatatgactgtaaattgagaattttggtttcccagtgtctgaaaagtggttaacccaaagttttggctttagagaaagagtctatacaggcaaaagcgtagagggtttggcagagaaaaaacaaaaacaaaaacaaaacatcctaagggccaaaggaaatggttgcaaggaaaacggtcaaaaacttgcatcattctcttcatccactcacaccactctatgcaggatcccaaatcagtccttgaatgtttcggcacaggttccattcatgctttccaatggaaacttcatttggtttataggattcaggattgtggaaccatccggtatcaagaaaataaaaggccatgaaaaagtttacagaatgttggtataagcagctgctagggatattactgagttttaatgggagagatagtcccagaaagctggaagaagaaagatcagggccaagcgcggtggctcacacttgtaatcccatcactttggaggcagagaggggcggatcacttgagtccaggagttcgagaccagcttgggcaatgtggataaaccccatctctacaaaaacatacaaaaaattgctgtgtgtggtggtgcacgcctgtggtcccaggtatttgggagactgaggtgggaagatcacctgagcccaggaggtggcagttgcagtgagcagagctgaggtctggccactgcattccagcctgggctacaaagcaaagtcctgtctcaaaaaaaaaaaaaagatcggagcaagaaaaaggaaaaagatgggtaaaaacatagaaacgactaagttcatttcagcaggaatatatttttaaatatatttcaaaactgaaacaatgctatgttttgctgcagtgtgtgagggaacacaattcaggctaatgcacagtaaaaatgcagggaagcctggccccgtaaccacttttaataccacatactacagttaacagttggtgagaaccctattaggctgatttcaattacaaacatggatgtacaggagtatgttttaatggcacacatgcatagttcatattttattagaaaatctgttcaggccggctacagtggctaacgcctgtaatcctagcactttggaaggctgaggcgggtggatcacctgaggttaggagctcaagaccggcctggccaacatggtgaaaccccgtctctactaaaaatacaaaaattagctaggcatggtgccgcgcgcctgtaatcccagctactcaggaggctgaagcaggagaatcgcatgaacccgggaggcagaggttgcagtgagccaagatcgggccactgcactccagcctgggcaacagagcaagactccctcttgggaaaaagaaaagaaaagaaaagaaagaaagaaaatccgggctgggcacagtggctcacttctgtaatcccaacattttgggaggatcacttgagatcaggagttcaagactagccttgccaacatggtgaaaccttgtctctactaaaaatacaaaaattagctgggcatcagctactcttgaggctgaggcaggagaaaggcgtgaacccgggaagtggagcttgcagtgagccgagatcgcgccactgcactccagcctgggcaacagggcaagactccgtctcaaaaaaaaaaaaaaaaaaaaattagctgggcgtggtggcatgtgcctgtaatcctagctacttgggaggctgaggcaggagaatcgcttgaacccagaattcagaggttgcagtaaactgagatcctgccactgcactccaggctgggtgagagagcaagactccgtctcaaaaaaaaaaaaaaaaaattaaaaattaaatccaccaaattagctcaagaacacttccttgactggctcagaaatcccatccgattttaagatagatgttaaaaaataacagggaggaccgggtgcggtggctcagacctgtaaacccagcactttgggaggccgaggtggggggattatgaggtcagcagttcgagaccagcctggccaatatggtaaaaccctgtctctactaaatatacaaaaattaactgggcatggtggcgtgcgcctgtagtcttagcagctcaggaggctgaggcaggagagtcgcttgaacccgggaggcggaggtggcagtgagccgagatcaagccactgcactcgagcctgggtgacagagtgagactccatctcaaaaaaaaaaaaaaaaagacacattatttcattttaataatgttagtcaattttttttgttgtcgatgagttgcgttttgttcattaagaatcagctgtaacatttgttgggacttggtagaagataactgctaggtggttgtagctgccaggcttttaatgagaggagcttagtttagcgaaaataaaagaaaaacaaagattaatatttggaataaactgtaaactcagcttctgagtccagagatcagccagtcaagattgtttagacttgagcttatctttagatggtgaagttaggaaggtagtgacagtctaatgagttttcctagtttacagtttgtatgtctttggtgattacatccagtgttctggtgaacttcctgaggggcccacccagcaacagacacaaaggtgatttatttgaaactgtaggaacgaaaaagtaatatattttcatcacccattacaaggttaacgagtgagactcctataacaaaagacatattaataagaaaaaataatatcaaatgtagttactaaaagtattatgtgacatgggagcttttagaaatgaagatcaaaagaaccagggagaatcctgggtttttttgtttttgtttttgtttttaattgagacaaggtctggctttgtcaccctggctggagttcagtgacacgatcccaggtcacttcaacctccacctccatgggctcaagccatattccacctcagcctcccgagtagctgggactacaggtgggtgccactgcacctggctaatttttgttttgttttgtttttgtagagatggggttttgccttgttgcccaggctggtcttgagctcccaagctcaactgattcacccaccttgacctcccaaagtgctgggattacagacatgagccaccgtacatggctggaaaaatctatttttacagagagctatgcaaatgtgtgattggaaaacaaatgggtatgacctagtggcaataatctgaggagaaattagccagatctgttcagattcttcttggtctctgcgtatagaaaaggactgctcctgagtgaggaatttatgacctactttccggggaggtaggtcagagaattcttttgtgacccacttcagggggaagaggtcaaagactgtgcttcctgcatctattatctcaatttctgaggtgccatatttgggggcattatttacagagactcaagggggtgtaagtgcctattatcagaggtcattcttacggaggctattaacgaaattttaggtgaatggctgagcagacatctagaagttgtcatccagtctatttctaattaggttttttcttttctgacgcaggtagttgattttgcaggatctgctgtcccttaggagaagagggccctaaagttcaagtgattgtgggactggaggagataaaaggctggcaggggagggcagagggagggaggatgaagcagttaggggcttgaagggggaaatatcaaaggaggcaagagaactgaagggtaaaataatgccaaaaaagaggtggacagagttggcaaagcatatcgtaagcagggatttgagaagaggggattcagatgacagagaacatcccaagggagaagcagaatccaatatagagaatggattggtcttaaatagagctgggagtaaaagattcgcagcccaggaagtcagggaataatacctacggaggaaggacttccaggccaagtatccagggaataatccccactgctatggttctaatgatggtgccctctcaaaaattcgtgttgaggccgggcatggtggcttatgcctgtaatcccagcactttgggaggccgaggcaggcggatcacaaggtcaggagatcgagaccatcctgactaacatggtgaaaccccgtctctactaaaaatatagaaaaattagccaggcgtggtggcggtcgcctgtagtcccagctactcgggaggctgaggcaggagaatggcatgaacccaggaggcagagcttgcagtgagccgagatcgtgccactgcactccagcctgggtgacagagcgagactccatctcaaaaaaaagaaaaaaatcatgttgaaatgtaatcttcagtgaaatagtatgttgcccaggctggtcttaaactcctgggctcaagtgatcctcccacctcggcctcccaaaatgctggcactataggcataagccaccacgcctggccaagacactaccttgaaagcacagagtaggccaggcgcggtggctcacacttgtaatcccagcactttgggaggccaaggtaggcagatcatgaggtcaggaattcgagaccagcctgtccaacacagtgaaaccctatctctactaaaaatacaaaaattagctgggcatggtggtgggcacctgtaatgccagctactcggggggctgaggcaggagaatcacttgaacccgggaggtggaggttgtggtgagccaagattgcaccactgccctccagcctgggcaacagagctagactccatctcaaaaaaaaaaaaaaaaaaaaaaaaaagaataagaaagaaagaaagcacagagcagcccttactagacacaaattatgccagtgacttgatggcgtaattggacttcctgactccagaactgtgagaaacaaatttctgttctttatagatttcctaggctcagttattatgcttagcggcacaactgactaagatagaaattggtactgagaagtggcagtgttgcaataacaaatacctaaaaatgtagaggctgctttggaactgagtaatgggtagaggctggaagagtttggaagtgcatgctagaagaaggctagtttgccatgcattaaggcgattctgacgaggcttcagaagatgaaaagccatagagaaagcctccgtctttgagattatctaggtggttgtgaacagaatgttagaaagaatatggacagtaaaggacattctgatgaagtcttagatggaaatgagggatatcttattggaaactggaggaaaagccatccttgttacaaagtggcagaggatttgttcctggaaagaacagaacaaggtctgggaaagaagggagtttatttctgcagctggttacagggagaaggccggagtaactcaccataccaactcaaagttacaagtttttttctagtgcttatatacattttaagctcccatgctaggagtggaattgcacctccaagcaggagtgtttccttcaatctatatctaaactttaactaggacctagggtctggaaatctttctctagagtcttggaaagctttttaatctttttttctttttctttttttttgctgtccataagtttattgtctgtatctgaaaaatcatcatagaaaattgtttggtttagctctcagcagcctgcttctgagctctgaggaagcttgcattcttttgagctacccaatccttcttctgagcaagggacattttgggatggttccacctcttctttttaacttctttcttgggcttattttcatagactggattctctcgtatagcagcatgagcttccttatacatttcctccatcatgtctggagttaccctgttctttatgtattgagagaactgtttcttgtaagcattttcatcttcttccattaagtagcacatgtaatcggcaacattctggcccatgatgtgcttccggtgtacttctgcattaaattccttgctttcagaaccataaccagggaattgtttggtactgtgagggatagacaagcctccatccacagctcccttcagggcaccaaaaactttattgccagtggtagttctggcaaggcctgcatccaaatagcaggtaaaggcacttggctgaccatcaatgctttccacaatgtattcatcgccagtcacctccacttggccttcatagatcttgtccatgccaaacctactgagaagcctgcgggccagcggcaggccagtacaatatgctgcagcataatttgtcgggccaaccttcacaccatattttggcagttcgtgtgcatatgctgtgcagactatcatatccccctctatatgggcataagcaatctgacaaatgatatctctgtttgttacacgaactatcatcctgtatttgagtgtgttgtatttatttttatcctgtatcaccaagcgtttccgagtatcgtaatcagttttaccctctcatcatcgtcttctaaatttcacttggtatctcttaaagtaggccttattcttaacaactttaacaaaccccatcctgcagaacagagacccgcgtccacagctcaacagagaccagcaggcacagcggcgctggggcagggagaaggggaaagctttttaatcttcagtgggtacctggaacaaggtatctgtgtaaaatgcttttattattcaaccagactttaggctaagaaagcccattttaatgggtttattttaatattccagccctcatgctcagtcacctgtttctccagttctttaatgtttaacttatacattcattagaattataatagagggtcagtggaaactgactgttctggttgctaatgggagcctgccctgccacaaacttggtggaagtatttctgtgtcttaatagttttttggagggtagaatgtaagagcgatgaactaggacatttggcagaagaaatctctaagccaagttttcagggtactgcatagcttctcttaactgcttatagtaaactgtgagaagagaaaagataggacttctaatcaaaagggaagcagattagctgggcatggtggcacacacctgtagtcccagctactctgcaggctgaggtaggagggttgcttcagcacaggaggtcgaggcggcagtgagctatgatcgtaccacagtctgggcaacagagtgagatcccatctcaaaaaaaaatgctaattattattattattatcattgagatggagtcttgctctgtcgcccaggcaggagtgcaatggtgcgatctcggctcactgcaacctctgcctcctcccgggttcaagtgattctcctgactcagcctcctgagcagctgggattacaggcgcccgccaccacacccggctaatttttgtatttttagtagagatggggtttcatcatattggccaggctggtctcgaactcctgacttcgtgttccacccacctcagcctcccaaagtgctggaactacaggcgtgaggcacctcacctggccaaagactattattatcattattttatccaaaatgtgtttattgagatggtttcccactcatcttgattcagggtgcttttagtgctgctttctcctgaaggaccatccttccataagccttgcttttcctcctgtaggctggcagaggaaagtgcagcagccaacacccaaaaccactgttggcacatggctaaagaccgtggtgattttatagcatcctgggcatttcacatccatgaagtaggaattggggctctgcaccaggtgtttcttcttgtgtttcctcttctcctcttctggagagggatgaaggagatcctttgcaagaagcatgttcttgtgggtaggtcgtcagtgctggaaagggccaaagaaaattatttttaaagggaagttgaacataaagatttggaaaattaacagcctggccttgtaaagaattttttaaataagttcaggagacaaaaccaactgtgtggccaactgaccgtttcataaggagattagtatgactagaatgccagatgctattcattaagacaatgggagaatgaccctgaagacatttcagagagcactgagaatgccacaaccatcacaggcccaaagtgccaggtccttgagggaataacaattttaaggaaggagcccaggattccagtgcaacccaagatgcctgtgggaacttggggctcactgactatgctgcctcatgtatctgctccctgaagtcaagcaaagcttccccatctgtggttcaggtgggcccaggtacagctcagatcactcctccagaaaacacaagtagtaaaacatggggcagcatgcatgtggtgctaactgcaggcatgctaaatccacagctgtgaaggcatggctttctccacctaatttccaaggaagccttgaagaatgcctcagggcccaatcagagaactgctgtaggggcagggctgccatagaaagttcccactagggcaatgtccagcagaactattgggttggggccaccacagagtgccctcactagggcaatactcagtggagccatagggacagggccacccctgagttcctagacccagacctgtagatccggtagtgcgtattccaacctgtaatagacatagacacctgactacaacctgtagaactgtggcatgggctgactccagcagtcatggcagcagggtcccctgggggcttgggaacctaagcactaccccagtgtctctgtaaggtgagaggtagaatcaaaaaagctgactctcacacctcaagattgaattttgttggccttgttgggttttgaagttatgtgggacatgttacccctatcttcttgcctatttcctccaccaaccttttgtttttgccatggggtcgagctatgtcacccaggctggtctcaaattcctgggctcaagagatcctcctgtctcagcctcctgaatagctaagactgcaggcaccatgcctggcttatttctgacttttataaagggaatgtttatcctgtgcctgtccaaccattgtattttggaaacacataatctgtttgacttcacaggttcacagctggagagccattgtctcgggattaattgtaccttgagcatcacctatatctgatttagatgatatttacatgcgactttcgacttacacttgaaagttgatgctggaatgagttaagacattttggagttactaagatggaatggacatattcttgtgggtgagaacgacatgaattctcatgtcatggcaagggtggagtgctatggtttgaataatggtgtcccttctaaaattagtgtggaaatttaatgcccaatgcaacagtattaagaggtttggcaattgcgtggtgactaagccatgagggctctgctctaatgcatgagattaacatctctataaaagtgtattaatttaaagggagtactttcttgcccttctgccccattcaccatgtgaggacatagtcatggctcctccacaggatgcagcaacaagacatcatcttggaaacagacagcagccccgtttagacctccttctgctgctttgatcttggacctctcatcctccagaaacacgacaaataagtttatgttctttataagttactcattatcaggtatttatttatttatttttttgagacagagtctcgctttgtcgcccaggctggagtacagtggtgtgatctcagctcactgcaacctccgcctcctgggttcaagtgattctcctgcctcagcctcctgagtagctgggattacaggcatgcactaccacacctggctaactttggtattttcagtagagacagggtttcaccatgtttgccagtctgatctcgaacccctgaccttaggtgatctggccccatctgcctcccaaagtgctgggattacagacgtgagccactgtgcgtggccaatatcaggtatttctaatagcagtacaacggactaagatactcaggaaaacagagccaggaggaaaaatattctatctcagggagttaaggaatcatgcccactcaagaaagagtataagggctgggcatagtggctcacgcctgtaatctcagcactttgggacgacaaggtgggcagatcacttgaggtcaggagtttgagaccagcctggccaacatggtgaaagaccacctctactaaaaatacaaaaattagccaggcgtggtggcacatgcctgtaatcccagctacttgacaggctaaggctggagaatcgcttaaacctggtgggaggcagaggctacagtgagccaagatcacgccactgcacttcagcctgggtgacatagtgagactccgtctcaaaaaaacaaaacaaaacaaaacaaaaaaaacaaagaaaaagagtgtaggggaaaaataacactcagtttattttttagtccaaacagacccctttaacaaaataaagattaacaagagaaaagcaaacaagtttattaatgtgtgtatttcatctacacatggaaaatacccagagaatgaatagttatcaaagaagtgctttgaattccagcatatatagcatcttcagcagagaaccgtacatttttagagaagtgaaaagataaagaaaaaggagattgtgtccgtaggggtgacaacttacggaaaggcaaataaattgcagataaattcagttactaagcatgttgctataaattcctttggtatcatttccaggctgaccagggtctaaagttttcttcagtggttagcctttgttctccctggtaaaagcgtgagtgtggagagtggggagggagagggtaccttttgtcttcgcaactctatatcttgcttttcggccagtaaaggaagaacaaaaaacttccctgcatctgcttcttcttaattgtcttcagctcaacaatgcttccagttttagggtggcatattctggcctcccacaagagccaggaagaacagatgtgcagcccaacggtgaggaaataattttcaccctacaaagagccaggaaaaagaccttccattccaggaagtacctttcaaaagatacctgggagtctaatccagcttcaaactatactctgaattcttaagaatcaaggccaggtgtggtggcttatgcctgtaatcccagcattttgggaggctgaggcaaggggatcgatcacttgagcccagggtttgagaccagtctgggcaacatagcgggatagtgagatcctctccacacacaaaaattaaaaataaaaataaataaaaaaaattaaaacctatccttacaagcttcagtggacacttgtccagagcaatcaatggctccagagtctaattcaccagtggatccccaatcaacttattaggaataaagacaaggtttcaaaggtgcaccctgaggtcctgggtgagaggtccaggggaccaaaaatgaataactgaaaaaattatatattcagtgatacttattaaagcatggtaaagaaaactttattcaggaccattgtgatagatacagggaccaatgcaatgggattttgcaatggaatagagagattgctctgaactccaaatagatcatgggaaaaagggacgttataaccaagaagcagggttggggtgtagtgggtgaaggaatggaaaattactaaaaggaaacatcagggataagggggattctggctaaactgacacctaacaagattcttgttaaagatgggccagagtggtcatgtatcacttggaagatggtggaagatgaacctgatcagatatcaagggtgatcagatatcaaggagaagagggttcttttttatatttatttatttatttatttttgagacagagtctcgctctgtcatccaggctggagtgtagtggcgtgatctcggctcactgtaacctccgcctcctgggttcaagtgattctcctgcctcagcctcctgagtagctgggattacaggcgtgcaccaccatacccggctaatttttgtatttttagtagagatagggtttcaccatgttggtcaggctggtctcaaactcctgacatcgtgatctgcccgcttcggccacccaaggtgctgggattatgggggtgagccaccttgcccggccgagaagagagttcttgataaacagacttccttgttaaaactagattttataatgaggtccacagatgggtggaggagaagcctgagtaaattttggttaagcagagaaactttgtcatccctcctgtatgcattatgctcccttttctccagtggagctctcttcaaccttgatgttattgtccaatcagtttgttttcccagtgttgatgttctgatttcatcctacaaaaatatagcataaacttgtatttgttgcattctacaacataagcctgacaatataacaaactgttcccaaagttataaattcctcgtctttttatttgtaatttgacttttaaaaatctatgtaattatagaagaatgttgctactataaaaattttaaggggtggcagggaataattccaaaattataaaactccttgtgacaaatttaggaatgatattcagctagttctatagttttttattccttgaataatcagcgatatacatctgattatatacacacattgtggtttttttttggccaggttgactttttttttttttttttttttgagatggagtctcactctgccacccaggctggagtgcaatggcacaatctcggctcactgtaacctctgcctcccggattcaagtgattctcctgcctcagcctcccattacaggcacccgccaccaagcctggctaacttttgtatttttagtagataatggggtttcactacgtgggccgggctagtcttgaactcctgacctcgtgatccacccacctcggcctcccaaagtgctgggattacaggcgtgagccaccgcgcccagccttggttgacttattcttttaaggagcaatgtgggttaatgtttcaaagtgaaaaaatttaaaaacttaggggaaagtggggggagagagagacaaagacagagacagaaagagagacagagtgagagatggagagagatcagataggtacataagcttagtgactcagcctgtagtcccagttacttaggaggctaaggcaggaggattgcttgagcccagaaactcaagttttcagtgagcagtgatctgcaacactgcactccagcccatgtgatagaaccagatcgtctctagaagaaaaaaaaagaagaaaaaaatacatatacatacatacattggtgtttgtttctacatatgcttcatagtatatgtgtacatggattataggtagatcatataatggtaacagtattaaattaggtgtcagcatttgttgaggaagtagtacgctcgtgtttgaaattttaattaagaattgtgtacggagttggttccttccggtgggtttgtgggtttgtggtctcactgacttcaagaatgaagccacaagccttctgaaccttcgtggtgagtgttacaactcttaaaggtggcacagacccaaggagtgagccgcagcaagatttattgtgaagatcgaaagaacaaaatttccacagcatagaagcagactgagcaggttgccactggtggctggggtggagtggccagcttttattccttatttgtccccacccatatcctgctgattggtccattttacagagtgctgactggtccattttacagggtgctgattggtccattttacaaacctctagctacagagcatcgattggtgcatttttacagagcactgattggtgcattttacaaacctgttgtaagacagaaaagttctccaaggccccacctgacctacgaagtccaggtggcttcatctctcagaatcagcttttaaaggccataaatttccaggtaagtaggaatagaagaaatgaacatttcctttgagatctatgatgtcatatttttttctccatcaacgatttagttccttctggatcaaatactttttaaatggatgtatgttttatagtagatgttatgttgtcttaattattttaaaactcctattcctggactctcctgaagaggagaatttagtaatttcgaagtattttttgaggctagggaagaaaaaccaagattactgcataaggtttcaggggatgttccatgcctgccacctggtgaaaatgagggagctttcctcctacctgccaccattacacctgcctgcaggtaataacgccatcatttcaacgcggcctggggtattctgggaaggtgacgtgtgggggcgcagtgaccgctagcaggggccaaacccgccctggtctgcgctgcagtgcgcagtgaggatgttggtgctgctcttcagggttttctttccgcagccacgggaagcccgtgttccatatttgtttttcatgttctctcgtttttatgttgtggatttagttttttaaaaaccataaatgttcctctacagtcttaacaatgtaccctgtaaaataagattttaaaagagccaacttccctattaatcttatacttttttcttttcgttctggctttaacaaatgtgacctaaagagagctcttgattttatgtagaacaatacaagaatagttttacattaatcttatggttagaaaaatcatttatgggcaaatttgttcccatgccttacttttaaaatattgtgttgtctttaattttcaaaatactttaaatatttttcagtaagtttgagggtagaatttattttaatgagactcctcttataaaaagtacgtatctgtatgtgcatatgtgtatactgaatttgctttgcttttgattctatcattctgtcacttttctatcaaaatatctctaatggacagaggccagagacaaggacttttacagcaaatttgccacagtaccacacattttatcttaaaagatggtatggattttgcataacatatatatgcaaacatatatatatataacataatatatatgtgtatatatatataacattatatatatgtgtatatatataacataatatatatgtgtatatatataacataatatatatgtgtatatataacataatatatatgtgtatatatataacataatatatatgtgtatatatataacataatatatatgtgtgtatatataacataatatatatatgtgtatatataacataatatatatgtgtgtatatataacataatatatatgtatatatataacataatatatatgtatatatataacataatatatatgtgtgtatatataacataatatatatgtgtgcatatatataacataatatatatgtgtgcatatatataacataatatatatgtgtgcatatatataacataatatatatgtgtgcatatatataacataatatatatgtgtgcatatatatataacataatatatatgtgtgcatatatatatataacaatatatatatgtgcgcatatatataatatatatatgcgcacatatatataacaatatatatatgtgcatatatatataacataatatatatatgtgcacatatatataacataatatatatatgcgcacatatatataacataatatatatgcgcgcatatatatataacataatatatatgtgcgcatatatatataacataatatatatgtgcgcatatatatataacataatatatatgtgcgcatatatatataacataatatatatgtgcgcatatatatataacatagccgtttggtttattttatgtgtgtgcgttaaaaagttattcaattgctgggcgtggtggctcacgcctgtaatcccagcactttgggaggccgaggcgggcggatcacgaggtcaggagattaagaccatcctggctaacacggtgaaaccccgtctctactaaaaatacacaaaaaattagccgggcgtcgtggcgggcacctgtagtcccagctactcgggaggctgaggcaggagaatggcgtgaacccgggaggcggagcttggagtgagccgagatagcgccactgcattccagcctgggcgacagagcgagactctgtctcaaaaaaaaaaaaaaaatattcaattatgcttgttaaagcaaggtaagggtcaccatggtgataggtacagggacctctgcagatagagattgggctaactccaaacagcgtaggcaagcggaaatttataaccaaagagcaggctgggaggtctgtgaatggaaaattaccaatgagaaacctcaaaggttagggggattctggctaaaccagcctaacaggatttttgctgaagacaggccagggtgatcaaacatcacttgggggatggtgcaggatgatgaacctggtaagatattaagggtgatcagatatcaaaggtaaggaagttcttgctaaagctggatttgacaaggaagtgcacagactggagaaggttcaggtgcctgactaatgtttgatcaagcaaagaatctttgtcagtgtacagaacgctatgtttttataaaatgttcctctgccccatttgtatctccccttttcatggaacacaaagcacgttttgcataacttctagatacatgtacttctattttgaatgacctgatatatcttttttctttacaattctcaacctcagcatatgtaagtggaactcagaaggcaacattccctgaacatactcttccaccagaatctcctctacagatttttgctgccccttttaccagtggctgaatctactttctcttatgtaagtagaaattttatatatctccagcctcttcctccttaccttccacttgcatgcacatcctgtctagtctgtgacctcctctgttataaatgcttgtaaacctttttttctgaatcagaaacgtgttgtgttgctcaagccgtgttcattttaattacgatttaactgcataatttaattatttccccattttttggatacagtgtttgcttttctccggttactttgttctagtatatccctctggcaagagcagtcatttccccacttgagtgtgcattagtatcacctgggggcttgttaaacacagcgtgcaagctccatcccagggtttctaattctcagggtttggtttgcggcagaagaatctgcatttcgaacaagtgccaggactggtctgaggaacacacgttgagagaggtgggattcgggttcactaacctgggttagagaaaattacagtaatgtgccaaatctgaggagggagcagagctgaagcccagtttcaatatgtgaatgagtgctttatacactcaaaccccctcaagggctggggagtaagggagaacgtgggcgggcagcgggcgtgtatagaggcataaactcaatcccagacctatggattcagaatcacatgttaacaattcttccagtgttttgtatgtttattatagtttgagaatgactggaccaaattgcctccaaaatcttaagtcccagcagtgaagcgaagctcagacatcatttgcatagctattgctttgtgtctgtgttttaggtcagctgctgttaaaggtttgtttcggagagttacccaggtgtagtacccttccaagtagataatgattgaaagagtatgtgctggaggtgtatgatattttccatccacttcagcccatttttctgatgggtcagtgacagtccatgatttgtctggtgtaatacaaattctggaagtggcatatatccaaggacagccataatattccacttggccaaggctcttctgacaggctcatgttcatgcaggatcagatctgacccagaatcaacagaactgaagctgcaaattcagctttgtgaaggcttcagatgtagccatggttaaagaagattgacattaagcaggtgagcagagtttgcttgaggttcacccagggaattcgtgaggatgcaggtgcgtttttttatggcctgaaaagcccagtttttgaggagttacagtccctctcagaaactgttcctgcagagtagccctggaaacatgtttgtctgcattcaagaaagatcttccttctgttcatataaaggaagccaaacttatttcccaggtaagggagtggaagcaactgtgatacggaatcctaaggcatgggggttagttgtaatccaggcaatatgtagggtcaggttctccaagtcctcctgtggttaaagggctccaccctaggaaagtgagccacccagggcttggtaaatgaccttatgatcagcccttggcctgttaacatgtcgtaactgaggcacaggactgggttcttggtttgaatttgctagtcagatggccattgcagaaagggaagagagcacagtccttcaggccaactcacttggcctattgaaactggcttttctgagcacagtctagtattgttgcgaattaaatacagcagaggatgtaagttaccagtattagtcactatcagttgagtacttattctgtatcagccactgttcctcttttccatttccacctgttatatgttagtgacgataaaaatgccatacagaccgggcacggtggctcacgcctgtaatcccagcactttgggaggccaaggcaagtggaccacctgaggtcaggagtttgagaccagcctggccaacatggtgaaacctccgtctctactaaaaaaaaaaaaaaaaaaaaaaaaaattagccgggcaccgtggcgggctcctgtaatcccagctactagggagactaaggcaggagaatcgcttgaacctgggaggcggaggttgcagtgagccaagatcgtgccattgcactctagcatgggcgacaaaagcaaaactccgtctcaaaaaagagaaaagaaaaagccatacaaaaaggctaagagccttgttcaacctcacacatgaaagtggcagggctggggtattaattcaggcattcacaatccagatcctctacacatttcactgacatgaaacccagaaatttcaggtctactaccttgaacccagaactatttttctcaaacttgttttcttgtgagctatatatagggaaaaattgcatacaatacagtactgctttacaaatatatcatctaatacccaagtcaagaaagacatgatcctgagctccctcaaaactcgtgggtatcccttctgaatcttgaccttttattctgactgagatgaatcctccatgctgctctttgtaattttattcctcgtgattacatacttaagctacaggaatacatcttacgtagttttgtttattcttaactgtatgtatttttttgtcttttccacttgatattgcattttctgtatttatccatgttgtgtgtaattccagcttcttaatttttattgatggtgttctctcattatatataatatatacagcatgtagcatgtatctttctcactgtgtatgtatacagagtgtatgcatatcactataggtatacagacatatcattatcctagtatttccatatctatgccacagtaggcagatccttttttttttttttttttttttttttgggaagacagagtctcgctctattgctcaagctggatggagtgcagtggcgcaatctcagctcactgcaacctccgccttctgcattgaagcgattctcctgcctcagacccccatgtaactgggactacaggcacctgccaccacacccagctaatttttgtatttttagcagagatggggttttaccatgttgtccaggctggtctcgaactcctgacctcgggtgatctgcctgcctcagcctcccaaagtgctgggattacaggtgtgagacaccatgcgcggctgcagatcccttctatacctgatgattgtttgggttgtgtctagtctgcagttatcaccaacactgcaatcgtaatcactgaagtatgtgtatcctgatttatataggtacacatctctcaaggatctgtaactggtagtggaattcatggatcttcaattcaaatgttgctcatggcagtgttaattataacaaccactttggtaaactacctgctattacctacaaaaccatgtgtaccttacacacgcaccatccattctactgtgtggagtaggccacggaaaagtacatgcacagttgatgaaaagacatgtatttaaatgtttatagcagcattatttgtaatagccaaaactggaaataaagcagagtgggtaagtaaatggtggtataggaattcaatggaattcaactataaataaaaaataatgaactgtatctacatgtaaaaaccttgatgaattttataaacacaaagttgagcaaaataatctaggcaaaaacatacttgtctgagcccatctctgtaacattcagaagtcagtatgacaagtcaggatggtggttacctgtgacaggagagaggctgttttgggaagggctcacttgggtcttctcagttgctggagttcactgtgataaatttaggatttgtttctttttagtgccgtgtatgtgtgtgtgtgtgtgtgtgtgtgtgtgtgtgtatataaacatttttttttttttttttttttttttgagatggagtctcactctgtcacccaggctggatgcctggctttttgtagtttagtagaaatgaggtttcagcatgtagctctggctgatctcaagctcctgaactcaggagtctttcctcctgtacaggagggaagacctttcctctactttctgagaattcaataattgagtccttgaaagaaattgacagtagtcagattaatgggagaaaaggtatacaaattagatatggacacagggacatcacatgaaagaaaagcgaatatcccagaacccagtgagattcagaagcttatgtaccctcttcttaggacagagggtataggtgattaggtaacttaggggagagtaaacagtttgggggaaagataaatggactgtcagaagaacaggtaacagccggtgacaaagtctgcgtgtgttatcaaggtctactctcctctcctgtgataggagccaatcttccctggttagtgagtttcctggggaggggattcatgacaattaagttccttttagataatctgtctttagataaggaagctcagagaaaacctctgcctgtatgagctgctccccacataacctcagttgaaagtaatcagcacaccaaagcatcatattttggggtggagatcctcccgcctcagtctctcaagtagctaggaccagaggcatgcaccatcatgcccggctactttttttttttttatttcttgcagagacagagtctcaccatgttgcctaggctggtctccaattcctgacctcaagtgatcctcctatctctgtctcccaaacagctgggattacaggcatgagttaccatgcccaggctaggggtggcatttcctgaactccttcagccctcttgggaaatgtgcaggcaggaagaaagaaaagaatacccttgtccacagccaggtcttgttgagcttatgcttggcagaatagaaccttacacccagccacgtgaaaactgggatgataaatgtctgcatgtctgacagaaggtttggcctctgattcagctgtggtgatttttccatctacttaactccaaattctattagctagtataaactctctattggactatgaacacagtaagtacacaatcatatgattattttatctattgacttaaatagaattgtgtatgaaggctgtactgaagttattcagggttgagtcaggaaaagctaaatttcaacctcttttaagaaaaatattgatgcctccaaatccatagtatatatgttgcttactagcttataaagggcccctggaagaaaggacatttccggtgttttatgtcaatcataggaaaataagctataagcttttttttaattctttgattctcaaaagtaggattgtggccaggcatggtggctcacacttgtacagcactttgggaggctgagatgggaagatcgctcaaggccaggagttcgagaccagcctgggtaacaaagcaagaccccatctctacaaaaagaaaaatgtatgattgcgtccccctaccactccccaacacttccctggctccacaccccagttcctctgctctcatttctgctgtgtcttactccatgaagctttcaaaactgcttttatagagtcctccttttcttttttataaatttattattgttgttgtttaattaaaagacaggatctcactctgttgtgcagttgtgcgatcactacagcctcaatctccaagcgatcctcccatctcagcctccccagtggctgggaccataggtgcataccaccatgcccagctaattttttttttttttgagacagagtctcgcactcttgcccaggctggagtgcagtggcgcgatctcggctcactgcaagctctgcctcccaggttcacgccattctctggcctcagcctcccgagtagcggtagcgcccgcaaccacacccggctaattttttgaatttttagtagaaatggagtttcactgtgttaggcaggatggtctcgatctcctgaccttgtgatccgcccgcctcggcctcccaaagtgctgggattacaggcctgagccaccgtgcccggcccactaatttttaaatctttttgtagagatgggatctaactatgttaaccaatctagtttcaaactcctggcatcaagcagtccttctgtccaaagtgctgagattgcaggcatgagccactgtgccaggcccctcattctttaaatagctactttagattctattgtaaggatattttaataattttccaacttttattatattgagtaggtgattcctttttaaattatatatgtaaatttttatttatatatttgaataatatgtttacatagttaaaaatcaaaatatacgaaaggcatacagtaagaagtcatctctttccacccgtaatgacaatatatccccttttgcctggcacagatgcacacataaattattgtcctgacatgattatgaataatcctgctttctctcagaagtgtgctagtttgaatgataaattatgcagacattctgcttgtatccctgcttcttcaccatgctgttatattccttccaattcagaggcaaatgtgatatcattgcctatgtgtcttccagaggaattttatttatattttgtaagtacatacatggattctggttttttttttgcactttttaacaaatagatgtatccatgctattttattttaaatttttactttgaaacaaccttaaacttacagaagttaaaagaatattagtagcaggtgtgctggctcacgggtataatcccagcaccgtgggaggctgagatgggtggattgcttgaggccaggagtttgagaccagcctgggtagcataatgagacctcctctctacagaaaaaaaaaatgtaaaagttagttgggtgtggtgttgcatgcctatcgtcccagccactcaggaggctgaggcaggaggatcgcttgggtacaggagttagaggctgcactagaccatgatcacaccactgcactccagcctgggtgacagagtgagaccctgttgcttaaaagaatattttaaaaaaaacctaccctttatccagattcacaaatactaatattttttcacattatttaatcaatttttctccttccctccctctttcatttctcccccttttctttttttttggagacatgatcttggtttgtcacccaggctggggtgcaatggcataatcatagctcaatggcatttcaaactcctgggttcaaagaaacctcctgcctgagcctccagaatagctgggactacagtcatatgctaccgtacctggctaatttttaaaattttttatagagacaggatcttgccatgttgcctaggctggtctcaaactcctaggctcaagtgatcctcccaccttgacatcccaaagtgttttgattacaggcatgagccaccaagcctggcctcctttccctcttttttttctccctctgtttcccactgcttataaagtttttaaattttttttttttttttttttttttttttttttttttttttttacttttgaccactttgagagaaggttgcagacatcatgtccctaatgcatttcctgagaaccgggatatacgtttggataatcatagtaaagatattaattcaggaaatataacatttatacaattattttatctaatctacaggccataacccagtttcttcatttgccccaataatgttttttatagctttttcatgttaaatatcttgtttggcactaagtatcttatcagtctgccataatgtttaatatctttcctctgaaatggttcctctgcctgcctttgcctttcatgtgtttgtgacttttgaagcatgcatgctaggtatgttacggaatgtcctcagcttgagtccatctgaagtgttcttaagactggattctactgatgctgttttggttggcacaacacggtgtttactattgtggtcgtcaaaatgatgttttatggctaaaccattctttcaacatttaatcatcaaggaaatataaatcaaaaccacaatgagatatcatctcatcccagttagaatttgctgttatcacaaagacataaaaataaatgctgatgaggatgcagatgacagggaactctcctatacttttggtgggaatgtgaattagtatagtcattatggaaaacagtatgcagagtcctcaaaaaactacaaatggaactaccctgtgaaccagcaattccactactgagtatttatccaaagttaaatcagtgtattgaagagagagctgcactcttgtgttcattgcagcattattcacgatagccaagatatggaatccaccgaagtgttcatcaacagacaaatggattaaaaaaatgtggtgcatatacacaatggaatactatttagccataaaaaaagaatgagatctggacattcacagcagcatggatggaactggaggacattatgttaaatgaaataagccaggcacagaaatataaatagcttaaaaagttgacctcatagaagtagagagtagaattgtgattaataatcacaattataaataatggtcagtatcaaaaaaaattgtcattctacagtgctgcagaacattagaacttgttttctctatctagctgtaattttccctcttttattttttttgaaacagggtcttgccctgtcacccaggcatggcataagcacggctcactgcagctcaaacaatcctcctgcctcagcttctggagtagctacaggcacatgccatcatgcctagctatttttttttaattttctataaaggtggggtcttgccatgttgcccaggctagtctcaaactcctggcctaaaacaatcttcctgccgtggtctcccaaagtgctaggattacaggtgtgagccatcactcccagctccaatttttagatactgaccccatttagatacatgacctcagaacacattccaagctcatgttgtatctctcttgtccccactattaaatcagctgtgttttttccaaggaatcctgatttctattgtggagaagcgtacttagaaaccaaggtcttggtgctactggtatgttattgcttttaggcccttccagatatacgggatataaagatatagctatatgtatgtgactatatgtattgtgtatatatgtatgtagctatatgtgtgtatgtgtatatatatcttcatgtatttatagtgatattttccatcccaatctacaccgcagggtttttccttgccttcctatttgtagagcttccttccacattaagaaccctctctcccagtgagtgtcaccccatttctgtttcatctctttccctactctcccccttgcctcctagggtcccctttcctctcatcagttgccagacaagaggagcatcatcatacacacatcatagatttaatattaaacttttaaaattttcagataaatgtaagcaggcttctgcagtgaaaggggccaggtctaggaagatggggaatacttgcaggcacctgggaagctcagggaagctgcaggtaccctgtcagttgggtgtcccctcatgagggtggcagactgtctccttgagttctgggtggcagaaatggcccagggccctgggctgagacccagccaactctctatggggctgccacacgacttcctaaaaaggcataaacacattttcttccaagtggagtccagcatattttattttcctgttgaatggtagacagcatgagagcagggtccatgtgatgatttttctgtcagtatcagtttctgcaagagcaaaaattacatatttttatttttcaaataaaatcaattgagacagtaacaaatttgctcaaagaatcaacctgaacacatgtacatctattatgtatcaataaaaaaatggccaggcacggtggctcacacctataatcccagcactttgggaggccaaggcgggtggatcacgaggtcaggagatcaagaccctcctggctaacgcggtgaaaccctgtctccaccaaaaatacaaaaaattctctgggcgtggtggcaggtgcctgtagtgacagggcgagcttgcagtgagccgagattgtgccactgcactccagcctgggtgacagagcgagactccatctcaaaaataaataaataaaaataataaatttttttctagataaaaaatataaaaattacaccacagtccaaaaaaaaaaaaaaaaaaactgttcaagactgatctttcatagtgattgggtctatgagtaaatgttaaatagatgatttattaggtttctttttatttcaatgatgagatggagaaatatattattttacatgagggcaaaaaatattttatgcatagatattttttattttgcctatgtccttaaattctcagaatatagattattgccttcagaaatctgtctaggttcacctataccttattagaactcagctttgctggctgtggtacacctgtaatcccagcactttgggagactgagaagggaggatcacctgagctcaggaatttgagaccggcctgggaaacatagggaaaccctgtctctacaaaaatacaaaaaaaaaaaaaaaaaaagtctgggtgcagtggctcacgcctgtaatcccagtaaatcccagtactttgggaggccgggccgggtggatcccgaggtcaggagttcaagaccagactggccaacatggtgaaaccccgtctctactaaaaataaaaaattagcagggcatggtggtgagcatctgtaagcccagctactcgggaggctgaggcaggagaattgcttgaacctgggaggtggaggttgcagcgagccaagattgtgccactgtactccagcttgggcgacaaagcaagagtctgtctcagaaaaaaaaaaaaaaaattagccaggcatggtggtgcacacctgtagtcccagctactcaagaggctgaggtggggagccctagtgggtgcagtgagccaagatcacaccactgcactccagcctgggcgacagagtgagactctgtctcaaaaaacaaaaaagtgagctttaataaattctataaaacttttttctagttgagagtacgttactacaagctaacttttaaaaaagtcatattatttgattactaggaactttgcaattagttttgcttcttctggtttttatttttgcctggcacaacatttccttccttggcccctgtctgtattaataatgctgccaggatatactgaatgattttattccagttttttctaccttaattatgttaaagaaaaacaaaagctgggtattagttatagtggtaaggacacattttaatcactaataactattgtaatcgtgaagaaagtccagcatgaactgaactcaactttggtgtgtacagaggtgactgggtattttaaaggaagaatgaagctgggtgtctactggacactggaatgaagctactgcagaggctgaggcagaaggattgcttgagccaggggtttgagaccagcctgggcaatacatcaagacctaggctgggcggggtgccacacgcttgtaatcctacactttgggaggtggaggggcggggggtgaatggcttgagttctggagttcgagaccagcctgggcaacatcgtgaaacactgtctctacaaaaatacaaaaattagcagggaatggtggcacatggctgtagtcccagctactcagggggctgaggtgggagaatcccttgaacttgaggagacagaggttgcagtgagccaagatctcaccactttactgtagcctgggtgacagagtgagaacctgtctcaaaaaaaaaaaaaaaaaaaaaaaaaaaaaagactttgcttcacccacaaagggaaaatcagggaataggagggagttgagttgtggggtagggtatgctcagttgagtcagagaagtaaaaatttaccaaaagtggtggttccatgtaaaacctacctgggattgctaactggtgctgtttgaagttagactatgaccctcgcacagaggccaggagacaggggccctatcttctgctgttggctggaacaaagagtaaattcatttgggaggcttcacttttttcaggcaggctatttaagggggatacagtcaaccaggggatatggccttgagatgctagaatctatgttagtattttgttcaaatatttataggccagggttaagactgactttgtttctttgttttttgagatggagttttgctcttgttgcccaggctgaagtgcaatggtgcgatcttggctcactgcaccctccgcctcctgggttcaagtgattctcctgcctcagcctcccgaggagctggcattacaggtgctcgccaccacgactggccaatttttgtactttagtagaaacggggtttcaccatgatgtccaggctggtcttgaactcctgacctcaggtgatccgcctgcctcagcctcctgaagtgctgggattccaggcatgagccactgtgcccagcgtaagacctagttgagaaggcagctcagaggaacctggctagagtttggtcaagaagactatctctgtcaatcataatgtgtattccaccaataagagtcattgagtctgtaaatgtttttttttttttcctttgagacagagtttcactcttgttgcccaggctggagtgcaatgacacaatctcggctcactgcaaccttggcctctcaggttcaagtggttctcttgcctcagcctccaaagtagctgggattacaggcatgtgccgccacacccagctaattttgtatttttagtagagatggggtttcacgatgttggttaggctggtctggaactcctgacctcaggtgacccacctgccgcagcctcccaaagtgctgggattacaggcgtgagcccccatgcctggccaagtctgtaatcttgattgaaagtttacttttgactgggcatggagctcatgcatgtaatcccagcgctttgggaggctggggcaggaggattacttgagtccaggagtttgagaccagcctgggcaacacagggagacctcttctctacaaaaaataaaattagccgggcttggaggtgcgtgctgatagtcctagctacttgacagactgaagtgtgaggatcacttgagcctgggaagttgaggctgcagttagccaagatccatgccactgtgctctagcctgggcgacagaatgagaccctgtctcaaaaaaacaaaaagaaaagaaaagttgactttttgccagctgttaggaaaacatctgtggctctggagggcggctggtttaaagaaaaaaaaaaacaatcagacatacctgatatctacaagaggataatgagcttagtatggtgtgtgtaggagcctagaggagagaggctgggaggggattcttggggaaaacggtggttgagttggggttcagaggcaagcccctaggtcttaggctgggcacggtggctcatgcctgtaatcccagcacttcaggatgctgaggtgggcggatcacctgaggtcaggagttcgagaccaggctggacatcatgatgaaaccctgtttctactaaaaatagaggagaatttgatggccattcacagtcaagggaactgaacacatcaaagggattgccagaagggcagaagtcctgacttacaggtataaggagaaacagaagaggagacaaggtgtggggtctaccaggtgggcaggcccattgagtagagggtacatggcattcattgaaggattttcatcaaggcagtcttctggtaagatacggggaagtccacaggctaattggaaaacagaaagaatgagatcatggagacaaatttagggactgactccgtctgtattaatttataccaggggtcagccaagtgcaacctgtggctaaatttggactgctatgcatacatgtatggcttgtgagctaacaaagttttttatggttttaaatacttgagccaggtgcggtggctcacacctgtaatcccatcactttgggaggccgaggcgggcgaatcacctgagtttgggagttcgagaccagcctggccaacatggtgaaaccccgtctctattaaaaatacaaaaattagctgggtgtggtggtgcatgcctgtagtcccagctactcaggaggctgaggcaggagaatcatttgaacctgggaggcggaggttgcagtgagccgagatcatgccattgcactctagcctgggcaacagagtgagactctgtctcaaaaaataaaataaataaatacttgaaaaaagcaaaagaatagcatttaataaaaattatataagattcaaatttcacggtccataagtgaagttttattggaatacactcatgcccacttgtttacatattgtctgtgactgctttcacacttcacactacaaaggttgagtagttgtgagtgatcgtcctcaaagcctaaaatatttactctctggctctcctctctacagaaaaaggctgctgatctctgcctgattcattgattgattattatttgaaatggggtttcactctgtcatccaggctataaagcagtggcgtcatctcagctcactgcaacctccacccgccgggctcaagcaatcctatctcagccttctgagtagctggaagcagaggcgtgtgcctccgctcccagctaatcttttgtatttttggtagagacggggtttcaccatatttcccaggctggtcttaaactcctgagctcaagtgatctgcctgcctcagcctcccaaagtgctgggattataggcatgagccaccgtgcttggctgacctctgatttatatggccagatgggggcaggtactcagttgcttgtgcatattttgttgggagatcacaagttagcaagataaaagtgctttcatcacagaggtttcagtctagtagaagttaaatttttgtgccgggttcagtggctcacacctgtaatcacagcactttgggaggccgttgcaggccggttgcctgacctcaggagttcgagaccagcctgggcaacacagtcaaaccccatctctactaaaatacaaaaatctagctgggcatggcagcatgcccgtatagtcccagctactcgtgaggctgaggcaggagaattgcctgaacccgggaggttgaggttgcagtgagccgagatcatgccgctacactccagcatgggcaacagagcgagactttgtctccaaaaaaaaaaaagttcgatttttgtttaataggtgagatcatatgaaacataaatataagtactgatgtagggattgtgctttgtgaatgggtctctgcctgcaaaacattcctgagaagctttctgaagggttcaagctgagaacagaaggatggagaaagagattctgtaagttaggaggcaagaatctgagctaagatttggatgtgacaggaccatgagtggatagggaatgttttgtttcttgagtgggaagtgggaagcattttgggaacaaggtaaggaagagagaggaggctgcagtgtttttaaggagtcctgcccacgccaagaagtctggactggaggtcatttgctttaaacatgtcatctcaagcatgtgtgatctatttggagcaaatataatcaagggaagttttaaacaggagagttttcagagcagtggagtctgaaaagttgccctaaaataaggttgagcataagaaagtccttcttgcttctggaaaaagtggactatgggtgctcactctttggggccagacagagaagaattaaaaatcatgggctgggtgcggtggctcacccctgtaatcccagtactttgggaggccaaggtgggtggatcacgaggtcagttcaagaccagcctggccaacatagtgaaaaccacgtctctactaaaaatacaaaaattagctgggcatggtagcgcatgcctgaagtcccagctacttgagaggctgaggcaggagaatcacttgaacccaggaggcggaggttgtggtaagccgagatcatgccactgcactcccgcctgggcaacagagcaagactctgtctcaaaaaaaaaaaaaaattgtgttatttctcccttttgcacctaatctcccactgaagatgactgcaactttcctgtgaattctgaacctgctgccaaaagatacttctttatattccatgattttgtgtaaaactttgtggtgagaattagagaaagcttaatttgctgcttggcatccagaattaggaggccaagttaggctcccatgttaattttcagaaagcccatgttcctgatatctggtagggatggcggtgctgaactgtgaaggtgttggaaaccagaattttggcagaaacggagtcagatttgaacatggtacaaatttggaccaagggcctagtgatagttaggtcaggaaattggggactgtattggtccattcctgcactgctataaagaactacccgagcctgggtaatttataaagaaaagaggtttaattggctaatggttctgaaggctctaaaggaatcatggctggggagtccctaagaaacttgcatcatggcagaaggcagaggggagtcaggcacatctttacatggcagaagcaggagagagagagcaaggggaggaggttccacacactttcagacaaccagatcttgtgatatatcacaagaagagcaccaaaggggaaatccacccctgtgatctagtcacatcccaccaggccccacgtccaacattggggattacaatttgacatgaaatttggatgggggcacagactcaaaccacatcagggaccaaagaaatattttacttattttcagttatcaatggaatttactgctgatgagaaataaatgtatcttgccagtaacttataaagtaataaaaccggccaggtgcgatggctcacgtgtgtaatcccagcactttgggaggctgaggtaggtggatcatgaggtcaggagatcgagacaatcctggccaacgtggtgaaactctctctactaaacatacaaaaattagctgggcatggtggtgcgtgcctctaattccagctacttgggaggctgaggcaggagaatcacttgaaccagggagccggagattgcagcaagacgagatcatgccacaccactccagcctggcgacagagcgagactccgtctaaaacaaacaaacaaacaaaaaaatcaaaacaatttccctagaaatgtataattattgacactttttagtatttaaaaaattttcagtgataccctgtatttacaaaacaaaacaaaacaaaaaaaacgaaaaagcaagacaaaaacaaaacaggcatggtgatgtgcacctgtagtcccagctactcaggaggctgaggtgggaggactgcttgagcctaagagttcaagccatgatctcaccactgtactctagcctggatgacagagcaagactgtctctaaaaatttttttaattaaaaaaaaatttcatcttgacttgcttttcatgtgaatctagtgtatttgctactttttgataatgctttgcactttttaaattgtaaaaacattacataaaattttcatcttacccgtttcaggggcactaagtgcattcacattgatgtgcaaccatcaccactgtctagctctagaactttttgtcttacaaaactgaaaattgcccattaaataataactccgtttcctcctccccacaccccatcccctggcaaccaccattctacttcctgtctccatgacatttgattagtctggatatctcgtataaatggaatcatacagtatttgtccttttgtgacaggcttatttcattctgtgtagtgtttccaaaattcatccatgttgtagcatgcatcagaatgtacttcctttttgaggttgaatgatactccattgcatgtatgcattacattttatttattaatccatcagtggatgtttaggttgcttctgccttttgggtaatgcaaataatgctgctatgaacatgggtgtgcagatacctctttgagtttctgcttctaattcgttttttttttttttgagctggagccttgctctttcgcccaggctggagtccagtgccacgccatgatctcggctcactgcaacctccacctcccaggttcaagcgattttcgcttgattctcctgcctcagcctctcaagtagctggaattacaggctcaaaccaacacaccaggcgaactttttatatttttggtagattgggggtttcaccatgttggccaggcaggtctcaaactcttgaactcaagtgatccacccaccttggcctcccaaagtgctggtattacaggtgtgagccaccatgcctggccttctgcttctaattcttttagatataaccttgaagtgacagtgctaaatctagcactgtctggtcttgaactcctgacctcaagtgatctgcctgccttggcctccgaaagtgctgggattacatgtgtgagccaccatgcctggccaattgaagatttttattacttacattttcccagaaagggggcatgccacactacaccacatcacgtgaggagcactaggttttggtcaggaggcagaagataggagtgaagggaaaaatctagggcaaagcctttactggggactccaagggaaacacagggcaggtttgagcataggatgggttagtttaaataattctggttggctttgggctacagggatggtctctagtgacttggtttgtgccctgggtatatagaatatgggaaatagtggccagcgagagttagctaaggagttggctgggctacagactgggattggttgtttggcatatgaaagacatgcttatagacaaattgttattatattcgagaattagctagctttgggaaggacattctctcccatgatttgcaaggccctcaaaagccagagcaacaaaaatacagaaaataagatatagttaatataattggcttggtgatgaacggatcccaaatagtcaaacacagaagctaagaaaacccagaacacatggtaattcttctgttgcattttttttaggaaaccacatagtgttttgcatagtggctgtaaaaattttccattcctaccaacattatacaaggttttcaattcctctggtcttcaccatgacttacgttctgtttcttctgtgttttatagtagccatccaaatgggtgtgaagtggtatctcactgtgattttgattttgattttgatttccctgatgattagtgatgctgagcatctttggatgtgcttcttggccatttgtatgtctttggagaattcttattaagacgtttgcccatttttatgtatgtatatatgtatgtatttatttattgagatggagtctctttctgttgcccaggctggtgtgcaatggcccaatctcggctcactgcaacctccgtctcctgggatcaagcaattctcctgcctcaacctcatgagtagctgagattacagatgtgcaccaccatgcctggtcaatttttgtatctttagtagagacggggtttcaccgtgttaaccacgctggtctcgaactcctgacttcgaatgatccacccacctcggcctcccaaagtactgggattacaggcgtgagccgctgcacctggcttggcccattttaaaatcaggttttttttttttttaaagttgattatagaattcttctttttttttttttctttttgatacagagtctcactctatcgctcaggctggagtacaatggtgtgatcttggctcactgcaacctccaccttccgggttcaagcaattctcttgcttcagcctcacaagtaactgggattacagacgtgtaccaccatgcccagctaatttttgtatttttattagagatgtgatttcaccatgttggccaggctggtctcaaaccattggcctcctgtgattcactcaccttggcctccccaaatgctaggcttacaggcatgagccactgtgcctggctgaggagtcttatatctattcggactattaacatcttatcaaatatatgatttgcaaatattttctcccattctgtgtgttgccttttcactctgttgattgtgtcctttgatgcacagaaggttttgattttgatatactccagtttatctatttttgtgtttccttagcttttggtgttgtagtcaagaaatcattgccaaatgcaatgttatgaagcgttttttcctgacagttttatagctttaggtcttatatttaggtctctgatccatttcaagttcatttttgtatatgatgtaaggaaagggtccaacttcattcttttgcatgtggatatccagttttcccagtaccacgtgttgaaaaggctgtcctttccccattgaaggtcttggcacaattgttgaaaatcatttgaccatatggaagagtttatttctgggatctctattctattccagttgtctatgttttgcattctttttaaaaaatatttttagtctttacatttcagaatcagtatttcaaatgtgacttgtaggactacgtgcagtgaggaagattgttaatcatcctattctgaccaggagttctgacaactttggtgctgtaggcggtgtctaaggcaggtgtcagcaaattttcctctaaaggagctgtgtgtgtgtgtgtgtgtttgtgtgtgtgagtgaaaaagaggtgagatttattttaaatttattttaagaaattggcttacatgatggtacagtcttgcaagtcaaaaatctgcagactaggctggcagtctggagacccagggaagagttgcggtgttaagtgttaagtctgaaactagtctgaaggcagaattccctctcttcctcaagagatcttaatctgttttcttttgtttttgtttttgttttgagacagagtctcacagcccaggctggagtgcagtggcacaatcttggctcgctgcaaccttcgcctcccaggttcaagcgactctcctacctcagcctcctgagtagctgagaccacaggtgcacactaccatgcctggctaatttttgtatttttagtagatacggggttttaacatgttggctaggctggtcttgaactcctgagctcaggtgatccatctgccttggcctcccaaagtgctgggattataggcgtgagccactgcacccggcctaacaatgacattttatatacacacaggcacatacacaaacctatttataaaagatgaaatactcaagacaattacagttctgatttctgtaactggtcaggtggtcacagctcatatttgtaattacctttgtctactactcattatgtatttccattgtcctcagcaagcaccacggctggttgtgattatttatctggtggggtgacccaaacctttgatttctgaagggtctaggccagtcatagtcctgcctgaatttcgttgttagagttttccatgggctttggtcacagagcttggttaatcctgaaataccctaagggatcccttgtacttcatatgtattcttccttacttcctttgtgaagcagaagtccagtttctccttggtaatcaggatgagtggcactagccagcacaacaattcccttctttgttgattcaaaggcatgaggagcctaaaagggttagatggcagttttttgtttttatttatttatttatttatttattttttagacagagtctcactctgtcacccaggctgcagtgcagtggcgcaatctcagctcactgcaacctctgctgcccggggttcaaacaattcttctgcctcagcctccccagtagttgggattacaggtgcctgccactgtgcccagctaatttttgtattttcagtagagatggggtttcaccatcttggccaggctggtcttgaactcctgacctcgtgatccacccaccttggcctcccaaagtgctgggattacaggcatgagccaccgtgcccggcctagatggcagtcctaacttctacttcagtccaattactgctatatctactgatggaaatattcctgctgttggaactaagactgccagaccagaagagtatgagatcatggggacaggaaacacaaattttgctagttggtcaactagggatatttgtggagggctgccactcccatttctatcttttggtttctagacttgtcaaccccgactatgggagaaacagcaatatattggacactgactcagacagtatacagcctcctgaaaagccttaccccagtcctgtaaagtattaccaaatagctggtactgtaactgaatcttcaaaaggcctttccaccattctatgaaatcatctgccttaggatggcggggaacatggtaagaccaccaaattccatgagcatgggcccattgctgcatttcctttgctatgaagtgagttccttggtcagaagcgatgttgtttggaatactatgatagtggttaaggcattttgtgattttacagagggaacttttgacagaagcattgcatgcagtgtaagcaaatctgtatccagagtaagcatctgttctagtcaggacaaaacactggcccttccatgatggaggggattcagtgtaatcaacctgccaccaggtagctacctgatcactgtggggaatggtaccatagtggagactcagtgttggtctctgctgagggtagattgggcactcagtggtggccatagttaggttggtcttggtgaatgggagttcatgtggccaaacccatgcgtaaccttcatccctgccatcatggccacttcgtttataatcccattgggcaatgacagaaaaatgagcctgactgtacatatgaaacaggtcaccctatccactttgtcataaaaatcctcctctgctgagtgggcattcacatggccacaaatgtctttacctttttttttttttggggctgatttagaggggtctatctataagtccatctatctcttcccaaggcttccttgtcaccaattttccaatcatgctccttccacattactgaccagccaaaccattgaccacggcctataaattggtatataattgtatatctggccatatgtccttccaaacaaaataaacaaccaggaacactgtcccaagctttacccactgggaggatttgtcttcaccactcttcttcagggaggtcttcagaaaggctctgtagtgcagcagttgtccacttctgggtggtatgtgcatgttttgtagaaccatctgtaaaccaggcctgagtcttctctttttccatcatctgattgaagggaaccccccatgagccataggtgcagctgggatagagaaagcagtgtagcaggagtgggggccgtggacatttgagccacttcttcatgtgacttagttgtgtcttcagatcatgttctggctgtgtaggcttaactttacagctgggctggtaagataacacccagttcatgaagggcagcttaggttacatggtaacttggtgtcctatggttaagcctttagtctccactaatgcccagtagcaggccaacagctgtttctcaaaaggagggtagttaactacagaggatagcagggctttgctccaatatcctaaaggcctatgctgcaacttaccaatgggggcctgcaaaaagctccaaaagacattactgtctgctactgacacttcaagcattattggttcttttttttttaatttttttatttttcgagacagggtctcgccctgtttcccaggctggagtgcagtggcatgatcctggctcactgcagccgctgtctcccaggttcaagcaattctcatgcctcagcctcctgagtagctgggattacaggggtgcactaccatactcagctaatttttgtatttttagtagagacggggtttcaccacgttgactaggctggtcttgaactcctgacctcaagtgatctatctgcctcagcctcccagagtgctgggattacaggcatgagccaccacacctggctgcatcattggttcttgcagaatcatgtgaccatagaggcagagaaatttatgttgcagcctggacctgttgcagaagcttctgttgttttgggatccactcaaaactacagcttttcaggtcattaatgtagcacatgagctgggtgtttgaatccctgagctaattttccccctactttgttcagtgaaattaggtgcaactagacagtctcattatacttgttagtttgacaaaatgtttgaaggtatcatacatgttaacccagaaccttgccttttatacttatttaatttaaagtatctgggctgggcgttgtgggatcccagcactttgggaggccaaggtgggtggatcacctgaggtcaggagttcgagagtggcctggccaacatggtgaaatcccatctgtactaaaaatacaaaaagcaattagctagtgttcttttgattactcgtaattaatgcctttaaatctagttagtttagagtaccaatttcagaaaccaaccccagaactaattcagaaaatttattcttaagatctggttcaggtagagctactcttgctaccgaaatctgtgtgtgttagggttctccagaaaaacaaaatgaactaacaggatgtgtatagtctcagtctctgtttctctttctcagaattggtcatgtggttatggaggctggctagtccaaaatcttcagagcaggctatggattcagggaagagttgatgttgtagctctagaccaagggcagtctggagagaatttcatcttctttttctttggtttgttttctcttatgggtttcaattgaatggatgaggtccacccatattaaagaaggtatctgctttactcaaagtctactgatttaaatgttaatcccatctcaaaacatgccatcgtggcaccatccaggttaatgtttgaccaaatatctgggtaccatggcctagccccattgacacataagatcactatcacagtcagataacaaatgtttagctttgtgggtcatatggtttatgttacaactactcaactgtgtggttgtagtcatagacaatacataaacaaatggctgtggctgtgttccaagaacactttatttatagatactaaaatttgaacttcatataatgttcacatcataaaataaacttttccttggatcctttcctcctttcctcctctccccctttcccccacccaccatgtaaaaaaaaaaaaaaaaaaaaaaagtaccacagccagttgcaatggtaggtacctgtgcatatcactatgcctgtaatcccacctacttgagaggctgaggcaggaggatcacttgagcccaggactgcaaggttatattgtgctataattaaacctgtgatcgtgccactgcactccagcctgtgcaatatagaaaggccccatctctttaaaaaaaaaatatacaggcagcaggcaggatttggcatagtttgctgaccgtcaagggctctcttttctaaaacataggcatggtaagaatatgtgcaaaggccatgggtgaagagctttttattttgttgcttgtgttccagttggtgcattctcaagagtaggtactttcttttcttgttcattctcttcctgagcctatcttgggattttctaagaaggttgctattagtctagtctttttccagctgctccctagattgaggcgggagaggagaaattcagcaaagatttctctctcctcatcaaggctgtcccttgcctgctttcctgtgggacagatggtgcatgtaggcaaaaggctggaacatgttggctgctcctgttacttggtgctttgagcagaaaggcctgttgggttagttcctgggctccagtgctcaatgtgtgtgtgtcctgttttgtgtttttacccatctttctgccttggctttaggtttatatgtttgcatttataaaaacttcttatggaatagaattataatgaagaggagcagcaaagagttgtggttgagagctggcagtactggaatcagaatgcttggcttgaatctgggctcaaatgcttgagagctgtgtgactttgagtacggttcttttcttttctgggcatcagtttcctaatctgtaaaagggatggaaatagggccaggcatggttccttatgcctgtaatcccaggtactcagaaggctgaggtgggaggatagcttcagcctaggaggtcgaggctgcagtgacccatgattgtgccactgcactctagcctgggtaacagagtgagaccctgtctctaaaaaaaataaaaagaaaagatggaaatgaaatagtaactcacacggtttttttgttttgttttgtttttttgagacgaagtcttggaatctcactctatcacccagactagagtgcagtgatgtaatcatggctcgttgtagccttgacttcctgtgctcaagcaattttcctgtcccaacttcctgagtggctggagctacaggcacgtgctaccatgcccagctaatttttgtatttttagtagagatggggtctccctatgttatgcaggctagtctctaactccaaggctcaggtgatccctctgctcagcctcccaaaatattgggattataggcatgagcctgcagtggccatcacatggtttttattttttgttttttatttatttttaattttttatggatctagtcctgaatccagaacatgatttttaaatgaactaatgttaaagtacttagaaaagtatctgctgcatagtaaggatatgtggttgtacaataaataaaaataaagagagctgctcacatagagtgcagatttcaaaccatctagtctttctcgttttattacattgaatttctgcttctgaatttttaattttgttataagaaggatgttagtccctctaaagtatcatttccaatattttgtttatgttccataaattttaaggttattttacttcaaattattttataatgtatatgccttttatatttgttttagttatatcaaaatgcagctttcaaaaatattttagtgtgtataattatttcagattactattagtagaagtgcttttttaaaagacaaatattatatttaagagaccctgccacaaaagtactcctcatggaagggaagatggactggggatgatgtggcagttatacagggaaaacttcacattattttgtatttaaaacataacctgaggctgggtgcggtggctcacgcctgtaatcccagcactttgggaggcagaggcaagtggatcacgaggtcaggagttcaagaccagcctgcccactatggtgaatccccgtctctactaaaaatacaaaaattagctgggcatggtgacatgcacctgtagtcccagctgcttgggaggctgaggtagagaattgcctgaacccgggaggcggaggttgcagtgagctgagatcgtgctattgcactccagcctgggcaacagagtgagactctgtctcaaaaagaaaaaaaccaaaacagaaaaacataacctaattttatattttgttttgtcatacagttgtatttgttttaaaatatctttccaccccttccaaaagtattttatccaagtagcagcacatcttatttccatgtctgggttggactttatttatacttgtctgaaactaaggaaaaagaaagtaatttatatcagttaaaagacctctacttctcaataagttagggggcggaggaatgggtctcaatctaccactcacttttctgctagaatttttttttatattgatacctcccattctttttttattttattttatttattattattatactttaagttttagggtacatgtgcacaatgtgcagattagttacataggtatacatgtgccatgctgtagaatttcttaatgttgcatcagtgtttcacaatgtaatcgaaaactcaaaatagcaatcttccttttttattttattttattttatttatgttttgagatggagtctcactctgtcgctcaggctggacagtgcagtggcatgatcttggctcactgcaacctccagctcccaggttcgagtgattctcctgcctcagcctcctgagtagctgggactacagatgcatgccaccatgcccagttaatttttgtatttttagtatagacggggtttcatcatgttggccaggatggtctgaatctcctgacctcgtgatctgcccgcctcggcttcccaaagtgctgggattacaggtgtgagccaccgcacctggcctcagaacagtttatatttaaaaattatttcaaagataggagagagttcccatgtgtctcatatgtttcccctattaacatgttacgcttgtttcattgatgtaccaatattggtacatttttattaactgaaatttatactttatccagatgtctttggtttttctaaaataccctttttctgttccaggatctcacccaggaaatcacagtacagctagtactcatgtgtctcaaggttgttcttggttgtgacattttctcactttgttttgatgaccttgacagttttggggattactggtcgaatgtttgtagaatgtccctcaattagggtttttaaaaactgatttataattcacatagtataaaatttacccttttaaaatatataattcagtgcttttgagtatattcacaacgtttcccaaccatcctatggttggaaaattagataacctactaattccacaaaatccagaatattttgatcatcccagaaagaaacctcataaccaacagcaattactctcctttcactcctctcccatcccctgaaaatcactaatctgctttctgtctatatggatttgcctattctttttttttttttttttttttttttttttgagatagagtctcactctctcacctaggctggagtgcagtggcgcaatctcggctcattgcaacctccgtctcctgggttcaagtgatcctcctgcctcagcctcctgagtagctgggattgcaggcacgtgccaccacacccggctattttttgtatttttagtagagacaaggttttgccatgtcggccaggctggtcttgaactcctgaccttaggtgatccacctgcctcggcctcccaaagtgctgggattacaggcgtgagccaccacacttggcctggatttgccaatccttaacagaacatataaaaagaaccataaaaacgcctgacatgttgcctcatgtctgcaatcccagtactttgggaggccaaagtgggatgattttttgagtgtaggagttggagacctctctgggcaacatagttagaccaggtctctacaaaaaaataaaaaaattacctgggcatggtggtgcatgcctgtagtcccagctactaaggaagctgaggtgggaggattacttgagcccaggagatggaggctgcagtaagccatgattgtgccaatgcactccagcctgggtgacagagtgacactctatctcaaaacaaacaaacaaaaaaccccataatatgtggcctttttctgtctagctgctttcactcagcataatgttgtcagggttcttccatgttgtttcatgaatcaacactccattcctttttatagcagaatgatattccattgtaccatgccatagttgtttcctttttcttttctttctttctttttttttttggagaacgggtctcactctgttgcccaggctaaagtgcaatggtgtaatcatagttcactgcagcctcaacctccctggctcaagcagtcctcccacctcagtttgggtagctgggactagaggtgcacaccactatgcctaactaattaaaaaaaaatttttagtagaaatggagtcttgctatcagggagatcttggactcctgagttcaagcaatcctctcgccttggcttccaaaagtgttgggactgcaggcatgagccattgcacctggcctcacattttgtttattcattcatcagttgatgagcatttgagttgtttccagtttttaactttttttttttttgagacggagtctcactctgtcacccaggctggagtgcaatggcagggtcttggctcactgcaacctccgcctcctgggttcaagcgattctcccacctcagcctcccaagtagctgggactacaggtgcgtgccctcacacccggctaatttttgtatttttagtagagatggggtttcactgtgttggccaggctggtctcgaactcctgacctcgtgatcagccagcctcagcctcctaaagtgctgggattacagtcatgagccaccaccagttttttagctattataaataaggctgctatgaaaatgcatatacatgtttttgcattaagatatgttctcatttcttttttttttttttttttttttggtgacaggttttgctccatcacccaggcggagtgcagtggtgccatcacagcttactgcagtctccacctctcaggctcaagtgattctcctacctcagcctcccgagtagctgggaccagaggtgtgcaacaccacatttggcttttttattttttattttgtagagacgagtcttgctatgttgcccaggctggtctcgaactcctggattcaagcgatctgcctgcctcagcctcccaaaggattgggattacaggcttgagcccctgtgcccggcccctatgttttccttttttttttttttaaatttgaaacggagtcctgctctgtcgcccaggctggagtgcagtggtgcaatctccctcaccgcgacctctgcctcccgggctcaagggagtctttagtctcagtcccaagcagctgggactgcaggcgcccgccaccatgcctggctaatttttgtattttttagtagagacagagttttaccatgttggtcaggctgatcacgaacctcctgatctcaggtgatccacctgtctcggcctcccaaagtgctgatattacaggcgtgtgaaccaccgtgcctggccgttttcatttctttgtgatctgcttaggagtagaattgtaggtcatatggtaacttcagggttaacatttgtaagcattgccaaactcttccactgtggctgtgctgtttcacatcccaatcagcagtgttagagggttccaatttctccacctcctccacaacccttgtcattgtctttttaattctagccccaagtggcatctcattgtggttttcatttgtacttctctaatgacttaacgattgtgtcttttcatgtgcttattggccattggtatttaagaactattttaatcctttgcccattaaaaaaaaatgtttttgtccttttattgttgaatagtaacacttttttttttttttgagacagtctcactctattacccaggctagagtgcagtggcgtgatctgggcttactgcaatctctgcctcctgggttcaagggattctcctgcctcagcctcccgagtagctgggactacagacatgtgccaccatgcccagctaattttcatacttctaataaagacggggtttcaccacgttggccagaatagtctcgaactgctggcctcaagtgatctgcctgcctcagtctcccaaagtgctgggattacacttatgagtcactgcgcccagccaagtactaacacttctttatacattctggatactacactcctagtagctttatgtttagcaaatattttctcccattctcttggctgtcttttcactttcttaatgtcccttgaatcgaaaacttttatgtaactgtgatgaagttcagtttatttattatttttggttgcttttgttttaggtgtcatatctaagaaactgttgcctaattcaaggttacacggatttatatatatacacacatatatttatacatgtatacataagtatacatggaatatatgtgtaaaatatacacatacacaaatgttatatatcacatttatacataggtatatatgtgtacctgtatacatatataacatgtatatatatgttctataacaagtgacttatattttattgatctattttgagttaatttttgtacatggtatgatgcaagggttctgattagtttttctagtctcctttgtctattctgtacagaatagttttattgcagttttagtgtcctttaagtacataaccttaagtgtttggcttggggataaatgtagactttgggaaaattgaattgttgggagacctatcagggtctactagcatgtcatagtggagtttagtggcaatgtctccttctctgtatcttcactccccagttgtaggatatgttgaatcagacctattattaactaacataaaatataagtgagcctaatggcagttctctttagattttctgtaaagcccaggacacccattgtgacctctcagactccaaagcgaatttcctaatggagtagaacaaacaggaaattatgaggaaaggcagtcagagtttgaaaagagaacacaccagaaacaatggaagataggtccaagaaactagataagtgcgagttgagaattgaatataattttatttaattttaataatactttaattgtaaaagtaattcataatcactgcaaaaagtaccaagcactgtaaaaattaaaaatacaaaacaatctcaaattgtgacagccaagagaaacctaaagaaacatgattataatgtttgtggcatgtaagtttggtgtccacaatggaaaaaggatattaggaaaaaaaagaaatataagatatagaaattagttaaaacaatgagaataaaaaatgaacacccaattcctgctcctagaagaagtagtactctaacatttggtgaagttctaagagccaacatttttacccagcttatactaggacctgttctaaatagtattttagctcatttaattgttaagccattgtataaagtaaacagaatcccttcttttgttacagattaggaatttaatgcacagagggttagataacttgctcaaagtaacattgtggtcaagagtcaaagctagaatttgaatcaaaagagcctgagtccaaaggcatggttttcatcactggactataatggtgtgtattctttcataattttttcagtgtaaaactgaacatacagtatgcttttattttatttatttttttgagatggagtcttgccctgtcaccaggctggagtgcagtggtgtgatctcagctcactgcaacctccgcctcccacgttcaagcaattctcctgcctcagcctcccgagtagctaagattacaggcatgtgccatcacgcccagctaatttttctgttttttgtagagatgggtttcaccatgttggccaggatggtctcgatctcctgacctcgtgatctgcccacctcggcctcccaaagtgctgggaatacaggcgtaagccactgtgcccagcctacattttatttttcgattgactcccgtgatcagagtcaacttcccatgttattttatgtgaatatgtatcaatgaactattagaaattgcaatgtttttgtaggtcaaaacaattcaatattgacaattttatatgattcagcctaatacatcattttttccatcagccatattgcatgttattatttatatatacgtttatttagttagcctatctgttctctgtgaggaacattacacagtttctgagattttgttacgatagaagtcagcattgataagcctctgcgcacctgttttaatgtaggatcattgggaactgagcagtagcttacagggcttgggaggggatttaaccatttagtcaacctccactcacatcaccctcccttcttcgataatgggcaattgagaaagggcaaatgtgtgtaaaaactatgcagatgcagtttcaggattattttcttcttttctgcagtgtcttttcccaagctacatcagcgtctaaattttggagttactgatgcttccgttatttctgcagatagaatattatgtcgtaaataatgtttacttgtccattagtattatataaaagtgcctgtttctccccactccagctatcattgattattggtaaaaattttaatgtatccaattctaataggcaaagaaaggctctcctacttagatcttaggtgggggtctaagttcatatttttgttttacaaaaattgaatagccagtgtttttgagttgaatgatctatccattccgtataggagagtttaattatattgtgattttgggggagataattttcacaatttaccccctcaaaatgtagaaagtagaaaaagggtagaaaaatcgcaccaaatttgaacaatgtagcatgcttttagagttagggatattttcttttggaaggatttcaagtctggcgtatttgcattgattgtggttatggcgcatttaacttttccaaaccagcttttttgtaccgcacataggaagacctgagggtgagtgtaaattaggattgtttggccagtggtgtgtgcaaaaatttattgtagaaccaagaattatttctttagtattttacacattttaaaaaacaggtagacatgtccattgatcccaggttgcttatggtttctagaggccccctctcattgcaacagtgctgtggggccctaggggtccagtagccccctccccccaggtcattccggtgagggagggagctgggacccctgcactgcggcaaacaagcacgcctgcgcggccgcagaggcaggctggcgcgcatgctcaggcggggatgtgtgcgaagcctgccgctgctgcagcgagtctggcgcagagtggagcggccgccggagatgcctgacgcatctgtctgaggagcggtcagtgacgcgatggagcgggcaaggtcagctgtgccggtggcttctctcaagagacagcctggggagcggccacttttattcatcagatattccaagtttttaggacttggagtactgaataaacggaatttgggccctaaagtcctttgttctggagaaccagatccggaatgttcagaggcttgctgttgtgccgttctgccccgatggtatcctgtccgctcgcattggggcgcgtcccccatccgcccccaactgtggtgtcgcgacaggtcctattgcgggtgtctgcggtgggaagggcggtggtgactgggagcatgcggggtaaccgcagtgggcaagggacatgggtggaggtgggtacatcagggtgattgcagttccgtgtggcgagggtacgtggggggaccagtgcatagggattttaggcggaggtaggtatattggagtgattgtggcggggcgaaggtacgtgaagtgatcggtatttagggggtgttgagcgcaggtaggtgtataatagtgaccactgcgtggtggagcagggtacgtggggcgactggggggggaattcgtcgcagtgaccgaggcgaggaggctatggcagtggaccagggggatgagtcggtgtgacagtggtgggggttgtgttggtggtcgcggcgcggggagagtccgtaggaagtggctgggaggtagggggaaggcggcgacagtgggtattggcggcggtgggcattggcagcgggtaggcatggcggtggtggactttggcggcggtaggcatggcggcggtgggcatggcatggaggcggtgggcatggcggccgcggggcctgtcgctgtccggagtgactaagggacgctgaatgattgctgtgtagaggagggggcatcagaaggggcagtagcacagtccgcagcctttaattttcctgtgacctgcgatggtcatctggtttgcctactgtggtggtggtgcttttttattaaaactgcgcaatgcctacactgccgcaggggctgcagaaatgcgtggaatccttgcgtaccctttaggaaccctcgctttagaggctatggcataagaagactggaatgatgtgcagaacttgcatttacagatcttttgactgataggccaggtgatgcctgggggttacttttttttcattgtttctctctgttgggaaccaggtcttggaaggctatgtcgaaataacctgggggtctgtgttgcgtcactgccattgtgcagctccttcaagatggccgccgctgcagcggcttagatctgcgcaagcgcttcagcgggggggtggccgcttcctccctgtagagccgccagtggggagggggcaggtggtgtgtgttcagcttctgctgtttcggagtttcagccgtaccctctttagggtgcagtggtaaggagaggaagccggccaaggtgggcggctgccccctccccaaagtgctgcttgggaaaggatgcaggttgcgcagacgcagcagaggtgacagtcgcctccgcttgcagtggggcgagacgtggggcaggggagcgagggcttacgcagcttttgcctggaaggaatggcagccctccccttcacctggctgatacagcagctgttcctttccggttgtggcgcagtagaggggggaggagggagatgggttggcgcaggctccgcctagcaagcttggcagccaccccttacccacggtgcagcagtagaggactggaggggaatgtggctagaggccaggcatttgtaccacctccgcctgtgtgggatggcagctgcactgggctactgcttttcagctctgcagtaaactagagtggtggcggcctggaggccatcaaaggtgcagccaccccaagacctgctgtgctgtttcagcaagcctccattaatgatagagattttaaattggttttctgactccctggaaaatcgtaccttttcatttttgtagttcctctcttggttgtattgtgcgctaattctctattttcaaactggacttgttaaccccttttttttaactccctgtagtctttgatttccattcgacacatttaataaatgtcaccatttaagattcagttatccttcttaatctctggatagtccattctgatgcactgcatactttccttaaatgggttgggggagaggacatcgtgatggctcttcccgactaaggttgaaaggtgtttcaaacactggacctcttcatcttctgggagttgaaagctgcaagttttgtgctcaaagagaataaaagagaaaagtggagacaatcttattggggtggggttgtgctttggatcagttactgtctttttttggatttttaaattaatgatcatttttgaagttggagctactacaaaaatttggtgagaaaggttaatgaataactgcatttttatattccagtacttttttaaaaaatcattttattctaaggattttgtcttcctttgcaggattttcagtgcttgccttttctgtatttacattttccctctatcataactggtatgtctggttgcactgagttgtaattaacagaaaagttaaatctacgaagcccgaaaagccttgttctggaataatctatttttgggtagttttaaaaatagcaggagtctgggattttatatgatatttataatttacccttttttttctgcttgcatgaagatagcagttcacatacatatatttcttggtttaacttctggtcatttggctatttgcaagctgagtatttagtctgatccgccattttgtagtcttgcattcaggcccgggatcctaatatggcagatccctttggaaaggcctcttgaagtttcaaggtctgtgtcctactcagtgaattggctctgtgctagggctttttggaggcagggagtggcagcccttcctgtgatgcagaggaaggaagcttggttgagagacccttatgttgttgtctaaggcagggtactaactgatttggatttattcacagaccttgccttatcttgatttcactattctatctgaccagtgtgtcattgccgaaatgttttccacatttatagttactctgtatctttatgtttcccttaccctgttccttttcctaataaacatctttgttttacaaaaaattttgtttataaggtgtcaaggatgccaagataacctcctttgtttatcagcgccctctgtttagctattttttaggaagaatcatttaagcaggttgtgagtactgccctcaattacttggacaatgaagttttaaaaatcttatttagacctgtcactggtcctgtctcctttttttttttttttgtggcccagggccagaaagcttgagtgagaattgttactacttaaggtagcctctctccatttctggatgctagctggctcaaagttttttttttttttttttttttttttttttttttaaatagaccagggtctccctatgttgtccaggctgaactcgaactgctagactcaagctatatcctctccctcctcagtctctctctggccactgtggctggcccaaattctctttttgttaattctcctcagatttgttttggaggcaatgaggtttcttatattcatggggtacagattagcagcctatcattaaccttatttttttgtttttaggagacagggtctggctatgttgcccaggttggagtgcagtgatgcagttatagctccctgtaacctcaaactcctggatcaatctagactcctgcctcagcctcccaagtgcctgttagtacaggcttgaggtactgtgcccagctaactttttatttttttgtagagaggggtctccttatgttgcccagactggtctcgaactcctggactcaagcagtgcccctgcctaggcctcccaaagtgctggcattgcagccatgagccgctatacctggccaactttgtttatttttattcttgagatcttagttaaattttatggaaaatttaggccgtaataaaattgggattccattgctttttgcttttcaatatatttccggattattactttcagtgtaagtgatctgagggcaaacatttaacaccctttctatatgatgattttttcatgatgtcctcagtttcataaaatgttggtttctgtgttggggatgcagttagataaatgcatgtgtgtgtgtatctagaacattcaataaagtagtgttttcaaaatcttatagatgacattttatatgtagattaaaaataagtagatttaagccaggtgcggtggctcatgtctatagtcccagcacttttggaggccaaggcagaaggatcactggagcctgggagttcaagcttgggtattgagaccccgtctctacatttaaaaaaaggtaaattcagaaagttgaaataatagaatattttggtttgatggctatttcctcagttgacctcagacctttcatattgagcaactgccgaatgggttctttttgttttttggtaagacagtgtttgcagttgtacactattagattaatcatggtttagttgatagtttctttaattgtattatattaaggtactacattattagctgtatttgtgtgcccaccataatgtagcactgatcagtactaaattcctttttatggctgaaagacattcgtttggatatatcatattttcttcattcgtaagttgatggacatttgagttgtttccactctttggctattatgaataatgctactaggaacacgtataatacgtttaatacaaagaattagtttcacaaggttttacttagccctcgtatatgccaggttcttgaaattttgtctttttggaagtatgagagtagtggtagctgggaaggctgcaggtataatagaaagaacatgaactgtctgggcatggtggctcatgcctgtaatcccagcactttgggaggccgaggtgggtagatcacctgagggcaggagctcgacatcagcctggccaacatggtgaaaccctgtctctactataaatacaaaaattagctgggtgtggtggtgcatgcctgtaatcccagctactttggaggctgagtttgggtcttgtaatattacttcatctagcagtagagttagtgtcatatgttactttcatgattaacatttttaggaagttggcaaagtctatatataacactttatgtttccaccagcagtttccccacatcctttacaaatattgtggtgtcagatggtggcatttcagtgggggttttttcattttgaggcagggtctggctctgtcacccaggctggtgtgccagtggcatgatctcaggtcactgcaacctctgcctcctaggctcaagcgccctctcaccttagcctcctgagtagctggtaccacaggcatgcaccaccacacccagctaatttttgtatttttttgtatagatgttgcccaagctggtctcctgagctcaagtgatcgctggcctcagccttccatgaaccattgcgccctgcctcattgggattttgatttgcattttttagtgactaatgttcagcatcatttcatatagattagccacttgtatgtgtttggaggactgtctattcaagtgttttacccatcgtagcaatagaatttgcccttttattgttgagttgtgagagttccttacatattctggataccaaacttgaaaaaatacttttttgaggtgtgagtgacatacaaaagctgtagatagttaatgttaaaagttgatatgctaagagataagtacatgcctttgaaatcattcttatcaaaattagtggcataaatgtgtctgtcacctgaaaaagtttctttgcctctccctaccttcttttttttcattgtttggattttctttttgtttgttttggatactagaaacttagctgtatgttaagcaaatattttttcctattctggttatcctttcactttctttagtgttttcggaactttattttttgatgaagtccactttattttttatactgcttgtaattcaggtgttatatttaatagaccattgtgtaatcaaaagtaataaacattatcagtgtataaaattttaccatttagaaatcaaatatgtgtgtatggcttgattagaacatttaaactcttgaaagaataaaacagctgtgcgttattggtaagctattttaccaatctaaaagtctaacatgacttaaaaacatctagggttcagagaattattaatagcttttggcatgtatctttgaattttgcttttgagatattacttgtgttactttagtgaaaggtcctgctgacctttctgatttatcatctttaaaggttcataggtggtttctgcagtccctaatatggctagtctggtgtgggatttcatgttctgttcccttgagcagccattttatgaggggttctgcagacgtaacatggcgggttttttgtttgtttgtttgtttttgctatgtggatagtttttagcttgagcagctcttctattgctttgcaaatcctaaagaaagcaccatttgcatgtttttttaaagtagatattttataatttaaactatgttctattccactatataagtatgtctactgtatcctaaaaatattttttgaaaccattttggaaatcaggtttactgtttttggggggaaggtgagtagggtagtggtggtatgtatgtatctacatctgcataagtgggaattttatatgtacgtgactacaaatagaggtagatatattattttaatttcattttctgattttttttaaaaccagattttctgatgtcatgggcttctaaaaggagaaaaaagtggttatagcatagattatgactgtttgaaggttaaagatcttgtaataattttaccttgttttaattagatttaaaaatccattatattaaatgtagttctaaatataaccttgacaaatagttatttcatagattgatgcagtctaccaaacaaatgcctctcttttctgtttcagggatcgcttacacctgagacgaactacagaacagcacgtaccagaggtggaagtccaagtcaaacgcagaaggactgcctcactgagcaaccaagagtgagtacagactgtgttgggaacaaatgcaagtcagaatctcctttcagattagaacaaaatatcatgcaatgaggggattaaaatgaacataattgaagaagcagacacatctaatacagaagatgtagtaaaaaagcaatgaaattcttaaccatattatcctaaaataattcaccctcttaaagattttagtataattttcttttttcctatacgtgggtaagtgcattttatctttataaaattttgtaattacccttcaacataagcatacttaaatttttctgcattattaaatcactttgtatgcttgcaaaatgtactgtgcgctgaagtgattaatttacatattcattcttgctctgtgatatttaggtgtttgtttttggttagtgcatttattctgttaaaatttaaaatacatttgtgttttttatcctgttttaagtatatatatgtggaatgtatatataggatgtatacacagacacactcagacacatattttaatttagatttctagaagggaaattttaattaaaaataggtgaacattttaaatgacctaatacatatttagtccacattgaaactttggcattttgtcattgccattaaaattttgatggcattaaaatttgatgccattaaaattttgatcagtaggtagcatttttttcttagctacaattgttttttttaattataagtattaaaaattcatgaagatgattctttttgtaaaacagttttgcataaaaagtaagtctcattttaaagcaactaccaacttaactggccttttcctccccagagataatcattaagtaaatagccatcagaccttgtcctatgcattgtgtgtgtagtggggagagaggaagggaggacatgggacacatttgaagtttgtgtgcatacgacaccgtgctgtctgtattttgacaatatgtcttggtgatcttttcatatcagtacacataaatctaccttattttacaaagtgtgcgtggtgtgataacattattattgtaatcgttagcttgctgctggatatttagtttgtttgcattgtttggctattaacaatgaaaagaacagtcactttgaaaacgcagtgtaggccaggcatggtggcccatgcctgtaatcccagcactttgggaggctaagccaggcggatcacaaggtcaggagttcgagaccagcctggccaacatggtgaaaccccgtctctcctaaaaatacaaaaattaaccgagtgtggtggcacgtgcctgtaatcccagctacttgggaggctgaggcaggagaattgtttgagcccaggagacggaggttgcaatgagctaagatggcaccactgcactctagcctgggtgacagagcaagactccatctcaggaaaaaaaaaaaaagaaaatgcagtgtatgaatactaatttattttatttttttcaaattaaaggtttttcctcatagtaaaaactgagtagtagtttgtgtgtcttttgttatttcctcattttatatgtgaaaagttgagctggatgtggtggctcatgcctctaatcccagcatgttgggaggctgaggtggatcacttgagcccaggaggtggagaccagcctgggcaacatagagagacctcctctctacagaaaaataaattagccaggcgtggtgttgtctacctgtagtctcagctacctgggaggctgaagtggaagggtcacttgatcccaggaggttgaggctgcagtgagccatgtttgtgccactgtactccagtctaggtgacagaatgagatctagtctcaaaaagaaaaaaaaagttgtaaaacatctgttagcaagttttaaattatggtgagggtaaagattttttttttattttttcctatttattttgccgatttttactatagtgagtatatttaagtacattttcattttttaaaattgctttggaagacgtattttatgtacgttttgtttgtatattggtaaatattttgaaagtattttgtgtaatataatttgtcctttatatataataggttattcgatcattcattttatttgatatgaaatctcttttttcatctcttcattctttttgagacggagttttgctcttgttgcccaggatggagtgcaacctccgcctaccaagttcaagtgattctcctgcctcagtctcccaagtaactgggattataggtgtgtgccaccatgcctggctaattttgtatttttttagtagagacagggtttctccatgttggtcaggctgggctcgaactcccgacctcagatgatccgcccgccttggtttctttcccaaagtgctaggattacaggtgtgagccactgcgcccagcctctcccttcattcttttgcagctctgacgtttttttaaagtgccattactattccctgagtttctagaggtagttcagagatggtggtggaggtagggctgaggtttaggactcttaggtttaggactgttaagtgggtgaaggttctatcttgctatatttttgttacagtttttttcctatgtaacctcagtgtggactaaataacaggtagtctcatcctcatcttgttgtgggatgacgttagccttctaggcatcttgtccatatttatggaaacattttgatggttttgaagaagaaataacttgagtttttcttatctgcactgcatatatatgtacaaatactgcagggtcttgagttgggggaatgatctgagtaaagtgtagagttagggaaatagtataatttttcccccttgtgcgttttcattttgagagtaattggattatggaatgggtaagcaggattggttaacactgcctcattgtccatgtgtttaggattctcaggattggtatacttagaatgttatactagaagtgttcaatatttacccattcatctcctacttcctaccaaatcataagtagtattgggaggcagtcttcctggaggagttgtgtggttattagccctaaagatcaatgaaggaggctgggtgcggtggctcacgcctgtaatcccagcactttgggaggcgaaggtgggcagatcacctgaggtcaggagttcaagaccagcctggccaacatggtgaaacctcatctctagaaaaataaaaaaatcagccgggtgtggtagtgtgcacctgtaatcccagctactcaggaggctgaggtggaagaatcgcttgaacctgggaggcaaaggttgcagtgagccgagatggtgccattggctgtgcctgggtgacatagcaagactccatctcaaaataaagtaaaaataaaaagttcactgatttattttaaattttttattctgtctttcagtgtatttgtcactaaattagctcttattctttggggctggatgatgtatcgtgagttcgaagggaaattggaaattggagctggagagttgtcttaatatattttatgctaagcttcacatgtcttttcaaattaatattctgcactctatgaattaaattctgtgtaggctgcctcattttctcagtctttaatcttctattgggttacaggttagatctgagggggacattgcaatagagaattatcttacgtttcaagataacattatatatatttttttttactgaaacactttttagacctttatgaataataatcagaaacttagttgtcatttgtaaacagaggttagagtggagaatgcccaaattaagatttatttattcagtgattagactatgaattagagtataaagtagactatgaattagagtgtgaagatttagaggtatgtgcagtgcaattctgactacttggagttagtgcaaatttcacagttgtctagatgccctccagaacattcccctcaatgcagacaccaactccaagctccagggttggcagggcacccacacttccgaccaacagtctatagattctgaggtcctactattttctcagactttataattgactaaggttttataaatgactagtagatctcaagaaagtgctatacttactagttttttttataaaggatacaaatgaacagatgcatagagcaaaatctgggcaggtcccacacaaatcttccctgtcctcaggatgcattacctgcacattagcgtatatcaccaatcaggaagctcaccagaactccagatgtcgatgatttttgttggggattcattatgttgacaagattgaatcactggacatgtcactgaattcagtcagcaactctcctgccctcccaggagggcttgctcaaaaccccaaccctttagtctttgtttgatcttttgtggcctggttagtcaccatcttgagacatctcattaccaagaactcaggtgtgatcctagggacccaccttgagtaacaaacacatttctttcactgggtaaattccaaggatgtataggatgtataggttacttcccaggaaccaggagcaaaggccagttaaattctttattatacagaagcaattttaaaatgttactgaaaaaccatagaaaaaagtccaatttccaaatccttacatgccaacaagggcagcattgttggtgatcccccagctcctcacctcaaggcaagctgtcatttcctgtatgtcttccttctcatcatcagatttcacagccaggttactgattcataggggtatgtcgagggcttttgtctggaattccctgcttaccagtagatgattggtttacatattttaagagcccttaaatagccctggaagttctatatttcaggtagtgacttgtcaggaggatcaatatgaaggacggcctaaacatctccctgcaaatgctttagcagcatctccctcccctcacccctggggagaaaggattgttcacacaggataatttgaaagtgagtgactatatatggtactgatggtgtttcttcaaggctgccagctcttgtgtttttagttcttttggaaatatttctagacttggtaagtatcttaagtatccactagtcccttgtacaatctctgtgtagagattcctgttttgtgttataatttctcataagatagtgtcatcctctgaccctaaagaaagatcttcttccctgggcgtggtggctcacgcttgtaatcccagcactttgggaggccaaagtgggtggatcacctgaggtcatgagttccagatcagcctggccaacatggtgaaaccccatctctactaaaaatacaaaaaaattagccgagagtggtggcaggcacctgtagtctcagctactcgggaggctgacactggagaatggcgtgaacccaggaggcggagcttgcagtgagcccagatcgtgccactgcactccagcctgggcgacagagtgagactctgtcttaaaaaaaaaaaaaaaaattagctgggtgtggtggtaggtgcctgtaatcccagctacttgggaggctgaggcaggagaatcacttgaaccccgaaggcagtgtttgtggtgagcagaaattgcttcattgcactccagcctgggcaacagaatgagaccctgtctggaaaaaaaaaaaaaaaaaaaaggaatatcttcttaaatgtaagggtacctagttttctttcatatggtttcctataaagacaaatgtatttttatcatttatatatattgtgctcttgttgtaggtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggttagagctaatgcagcaatgatcaagaataaagaatcattaaagaatggggtgttgggggttctcttaattatcagtgacacattaatttttttccttagagcttcatacaataaacacattgcagaaagttttagaaagttttgcaggaccttaaattttctgccctgacactttcgtcatgtttctgtattccagttattgtagcgcatgcttttcaggtagttttcttttgcgttttttttaattatataaaaatatttcactataaatggctcttgaataccctgttactgaatgtttataatttccttttgtgggaggtgtcatttttttctgccagtagtttgaacaaagctttagtagatagctttgtataaaacttagaataattttttcaaatatgcagatgtgaaaataaattgaatcaaggaatatgaacttaaggtacatttttctaaattatattgcaaagtattaaattagtattcattgctttcgaaaaataaagggccagttacaacatactttcacagcattattttaattcaaatatggtttatgtcagtgaattataaatacacagcacataattaacaatgagtattagagaatctaaatactttctcatgcttatttactaattcctttttgttttgtctttttctcacttttctgttttaaccaatgtatttcctctttgaatcagcagacaatgtaataaaaatattattcataatttttcaatgtgatgtagatttatttagttctttttatgttgctttcattttttaggaaaaagttattacaaagtcgattttgatttgttttcttgtttttcctctgtgatttttctttttttctactttaagttttagaatgccctcatttctgagagtttactatttactttttacaaagtaagagcagagaggaattgggtttactgataaattccttctagcctttttttaagtctgtttttgaagtattatccttcaacttgaatcagttaggcttgtttatggccaccattttgagttattaattaatttatttatttagagatgaagtttcactctgttgcccaggctggagtgcagtggtatggtttcggctcactgcaacctctgcctcccaggttcaactgattttcctgcctcagcctcccaagtatctgggattataggcacccaccaccacacctggctaatttttgtatttttggtagagacggggtttcaccatgttctccaggctggtctcaaactcctgaactcaggtgatccacctgccttggcctctcaaagtgctgggattacaggcgtgacctaccgcgcccggcccattttgagtttaaatcaaaggagacagaaattttctgagaaatcctcctttcttgaatcctttatacacaacattttctagcaattgcataagcaaattggaatctaatcattgtccaaagcttttcccttgagtaagggaatttttcattgaataggtgtgcacaactgattttttactttttaggaattttttagcttctcagttcagttcacagatttttgtaaatttttaaatacaacatttaagtcatacattatagtctgcaagtaggaccatctaattttatgatacttaattatatcttattctagtctcaactgctagttctacctaaatagtacccattactagtattcctgtagaagaagggttggtaatatatctggaccactacctgtgtctataaatgaaattttattggaacacaactcagttcatttattatgttatctttggccacattggtgctacggtggtgcagctttgagtagttgtgacagattgaatgacaggcaaagcctaaaatacttagtatcttgctatttaaaagaaaataattggctgagttttattttagaggagcagattgaaagaagaaaacaccaaagtgggggccagtcaatatagtcataatgtcatagaaggtgataaagaatagattatagaagtatatacgaagtatacattacagcgtagacaatcagatgaatttcttggggaagggatcagtctaagagtcatgttaaagtctgctgtggaggaagatgggtagtctttaacaacatttaaacacttcgtacccgttttcattaaaaatgtaaggcacacgatggccaggaaaaataagaaaataaactattaatgtggccgggtgtggtggctcacgcctgtcatcctagcacttggggaggctgaggcaggtggatcacctgaggtcagaagttcgagaccaacctggccacatggcgaaaccccatctgttctaaaaatacaaatattagccgggtgtagtgggggacacctgtaatcccagctactcgggaggctgaggcaggagaatttcttgaaccctaggggcagaggttgcattgagcagagattgtgccactgcgcttcagcctgcgtgacagagcaagacttctatctcaaaaaaaaattgtgttatgaatattctgtttttctttggtacctaaatatttaccagggtacatatccaactggatacctacctagtagttgggatgcagggtgtaatattagtatgacttttaaacgtttttgttacattgttttctaaacacatcatgagaagtgctgatggccactaaaaattagtagaccattagtttctcagtaccaccctttgtattctggtgtttttttgtttttgttaaataaacctttccaataaaggaaatttgttttcttgtgtttttaattggaattattgtgtattaatattttgcatttagttttcttttgtcacttgtttttgcatactcttcgatggaggatctctatggagaccctctataattttaaattttaacagatcaatactgatattccatggtgtgtctcatttgctatgtgtgccttggccaaccctagtcatcttattttactatttgctatgtgtgctttggccaaccctagtcatcttattttacttttgaattaaagtagatttacatttttatgtagtttaatcatttgaaagtctacagtttcctaaagtttgaaaacttgtgcttctgtgagggataccagttcgttaatttgcttatgtgccctttgatctcagaagatacactatgactgctcatccatccttgcagtgtgatgttgctactctcgtcgcctttctcatgaagttttgttttcttgtgctgtaaagataaatttgaccactctgcagtgatttattttcttctttcacttacaaggtcatgactacattgtatcacatttagggatgagagagaactgtttctaaattccaaatctgtctcttaagggaatccttttaactgctgtaggaggtcaactcctattgtgagtaaaacatatatctcttctagctatacaggttattattatattatgatatatatataaatataaaataataatctgtccctaattctctaggtcttcagttctttgggccataactcacatccctagatgtgtttcatacctctggaccgctaagcttgtgggagttatttatatcctattgctcaaggtcattgccaaggtctgatttttcacaaaaaaattccaacctctggcataaatgggttaaaaacggctttagtgatgtagtgctgataaacataaaattcacccaatttaagtgcatgaagcaatgatttaagtaaatttacagaactgtgcaatcattgccatgaactactctggaaacattttcatcaccacagtaagatctgtcttgctcattcacagtcatgatccttgttgtctctttggatggctgaaggtcccaagtgttgcagtgctataaaaatggatattgctggctgggcgcagtggctcatgcctgtaatcctagcacttggggaggctgaggccggcaggtcacctgaagtcaggagttcgagactagcctggccaacgtagcgaaattccttctctgctaaaaatacaaaaattagccgggtgtggtggcgggcgcctgtaatcctagctactcaggaggctgaggcaggagaaccacttgaacccgggaagtggaggctgcagtgagccgagatcactccattgcactccagcctgggcaacagagtgagactctgtctcaaaaaaaaaaaaaaaaggatattgctaatgagtctcatataccatgttttcttggatttagactgctttataaagaatcataagataatattcaaaacttctaagttatagtccttaaactcttactcatatttaggacagaaactacatttaatttttgtggaggtctttgtttgcttatttgaaaagttcttttgagatctttataggttttatttaatacattttttaatgtacagacatcagattcatggccactgaatgacagccaggcattagagtattctttttttttttttttttttgagatggagtttcactcttgctgcccaggctggagtgcaatggtgcgatctccgctcaaaaagatacttttgaatccttttcaaaagtaatttgtgtttcattttttaattagtatgataagcacttcaagaccctttacaattctggctagatttggttgccatatttaatagcattttataaataatggagaaaagggaaacattatgcatgcttgattacggtcatgagctgcattaacaattccgttcaacaacagactgcatatgtcagagcagtcccttaagattacaaaaccatgttttcattgtgccttctctctcttccccaccacccccaaccctgagatggagtcttgctctgttgcccaggctggagtacagtggtgccatctcagctcactgcaaactctgcctcctggtttcaagcgattctcctgcctcagcctcctgagtagctgggattacaggcgcctgccaccacacccagctaatgtttgtatttttagtagagatagggttttcgccatgttggccaggctggtcttgaattcttgacctcaggtgatccgcccacctcggtttcccaaagtgttgggattatgggcgtgagccaccacacccagcctcttctctgtttaacattgtattgtgagtgttcatagtatgcaggatagtaacatgatatacaggtttgtagcctaggatctaccatattgcctaagagtatagtagactctgtgtatcctctaggtttgtgtaagtacactgttcatactgtgatgaaatcaccaaatgcatttctcctaatgtgtccccattacgtgacttatttatttattttgagatgaagttttgctcttgtccctccttgttgcccaggctggagtgcagtggcgcgatctcagctcactgcaacctctgcctcccaggttcaagcgattctcctacctcagcctctcaagtagctgggattacaggcacccaccaccatgcctggctaatttttttgtatttctagcagagacgggatttcaccatgttggccaggctggtctcgaactcttgacctcaggtgatccacctgccttggcctcccctggtgctgggattacaggcgtgagccacctcacccggccgttaacgtgatttataactttgtccttcattacttgatctatgaaagttgtttatgtgagtctatatatatatattccatagtcatgtgttctcttttgacatgggaagtcttaggcaggtttataacacacttggctcttagtggggaaagattacctgccatcatcttgaagcgaatttaggggaagaaagaatattgcaaatgacaacataggtatttcagaaaaaaggaaaaatctgaatgaaagagtaattgagatgttgatacagagatgacttcatattaattctgaactagagagagagacactaccttaaataaggatggaaagaaaaatactaaatttgggaaaatgacgcttagtttttgaaacatttaggaattactaggtaaaataaaattcaatgactttcatcagtcctaagtgtgtcaaatgtgagagttaagaatgagggactagggaaatgtggcagtcccttggtgaggaagctagtatgagaggaaggatgtttttgaacgtgtctgtcatagtgattttcatgcaaaattgtctgcctgttttaaaacatggtagattgcagtgcagctttaacatgctttcctctgcaggctccatctactctttgaagcttctgcccagcttgcattgtttctaggagaacctgcgtcatacctttatctatagccttcccctaggtcttcagaagcatcaagttttaactgtggacattggatttggtggaacagcaatcatggtaagctgtatgataaggctgagggttgaaatgtgctgtaagggccgaaagaaatagtttgccagcatgtgcagtgatcttgggttctgaatgttagaaataaggatacatccatggatatggattctcattgcattgagtatcagctgaagatgagctgatttttttatttttatttttttcagacggggtcttgctctgtctcccagtctggagtgcagtggtgcggtcttggctcactgcaaccctgggttcaagagattctcgtgcctcagcctctttattagaaacagggtttcactgtgttggccaggctggtctcaggctcctgacctctggtgatccacccacctcggcctcccaaagtgctgggattacaggcatgagatgagccactgtgcctggccatgagaaatgtttcatgatgtgagaaaatacaggagtttttggtcatgattccaccagtggtgaaggactgtcctgcagatgatggactctcaggtcagattacaatagaaataaagagggctttgaaaatggaagggttttggcattaacagtacagagaaaagcagtctggagagagagaacaccctacatcattgtggtttggtttacttaggggagtggacagtttagagcatgcatcgtcacagagaaggataatcacctgtaaggaggtgaaaattggttcttgagatgtgaaaaaatacttcataatcctttgtggtcctccaaagagccatactaaatatggaagaatgttggtgaaaaaggagagaatatttgtttagttaaggaaaccaggcttagattatgtaagggtggagaagaaacaggagaagattagaagactagggtgttggcaagctgaacatgactcttgtcttactgcttctagactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagtaaggctgatttgggcaaatgggggttggacacagaggcagtgggaagggaaggccagagctggagtaagggatttccgagggtaactgaagtagttagggaaactatggtagagccagtctattgtttaacctcttgacctgatctctgaattaggtcagagtctgcatctgaactcttttaagtttgtaaaacaatcatggatttattactgggagtaaaagtatatgctatggtcagaatactcgtatttatttttaaaattgagaaaaatgctatattaattaattggttggcttctgcagcagtcttagaccaaatcttggttgaaatggagaagaacagttgttcttcatggttgaggagttgggatatggttgccatttggtatcctctctttgcctatcactgttcccattatttcagttctgtgtcacctgtcattatgatttaattatttaagtaattttttaaagaaatttccattttaatgtggaaacccaggtttcaattttgtttttcttaaaaggtatttcacaaaagaaattagtcttgttgtagtgtaacatcaaaggaacattctgtaaaagactaaagttagattagaaaatagcttcactatttacccttgtatattaactgtgtttacagatattttttggcttgtttttcagtgataactcagtaaatgtttagcatcagttgtcttaattgatacttgaggttgtataaatattttgatgagtgagtgatcactaaaatttatctcactaaaatttaattctgatttgtaggccaaagaatgcgaagcaaccagagcgtgaagaaaagcgggttttgggtctggtgttgctgcgtggggagaacttggtatccatgactgtggaggggccaccccccaaagatgtaaggaagatgtagggcaggacagaactttaatttgcagggacatcatattatgtgagatgtctgaaatcagggtagagcagacacagttcaacatggattgtcaaataaaatgtgccaggcacttaatatcaattgttggttgcctatgctattcgggattaggggatttttggtgaattattctatgtgctgggcattacctaggtaagggtaggagttggtgattcatgtttgcttggtatgtttataaaagaggtgttttcacaatttgacaaataatgtgcattttatacacaagatacctccatggtatacttgcttgtttgttcatttggacacagaactaatatgagataggtgtcatgggaaaatggtggagagaagtgatctctgatgaataagaatactgagaacttgtaaattgtttgattttaggctatgaattttcttgtttcagactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtgaggaaccagcagagggttttatattattgggagaatatgactaagccggaggccgaggagatttaaaaacctaagtgtatgtgtcatacaatgtaaacagcatatggtttaggaggaaccaaaacacagatatatgggaggaagggaataaaactagctgcttaaaatggtcattgggtgattaaagttacccaggttactcttggcaagagtaacttgccactagtggtgagtgaacagaatgcatggatataccacagttgaaaagaccaaagggctttttggatgtcagtgtactaagattagtttttaaaatatgggaataggccgggtgcagtggcttacgcctgtaatccagcactttgggaggccgaggtgggcagatcacttgaggtcaggagttcgacaccagcccggcccacgtggtgaaaaccctatctctactaaaaatacaaaaatcagctgtgtgtggtggtgggtgcctgtaatcccagctaccaggcagggagacaggagaatcgcttgaacccaggagtgggaggctgcagtgagctgagattgcgccattacactccagcctgggtgacaagagtgaaactgtctcaaaaaaaaacatgggaataatgagagaagtacattgcaacagttgtttgtaactaattggtcatttttctcatttattttctgtgtttgaataatgtgaaggtttgcatcgctttgactgtttcccgccctgccttctcaggtaatgactccacagggaagaggcactgtagcagctgctgctgttgctgcgactgccagtattgctggagccccaacacagtacccaccaggacggggcactccgcccccacccgtcggcagagcaaccccacctccaggtaagggattggtgaacacgaagacgaacttgaatctctgatgagagatagcttactgatttaagacacagcctgagagcctaagaatttggggaatatgcttccttcttctagatactggtttttaatgaaagacatagaagagtaattgtcatatagaagttatttgactctatcattgttgtctggcccatttctttagggattatttgggctaaattctaacttttctaagccattttatgaggcctttatttctaccatttttcactgtaggcattatggctcctccacctggtatgagaccacccatgggcccaccaattgggcttccccctgctcgagggacgccaataggcatgccgcctccgggaatgagaccccctccaccaggcattagaggtgagtgggagcataggggtttgatggttcagccaggcccctgaatatgtgtatcctctttttctcaatgtttctatttcctttccaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtgaggtactgttgtatatatttttttgcctgttgattttgatgagatcttaagttactgtggatgagggtgatgcctattaagcagttgattcaaatcatattctctttaattcttaggataaaaaggttttctgctatctaactttcactttgtgcattgactggtgttggttaataatgttttcatgacccgggggtttaagtggttgtgctgcttcacacatggcctcctgcttctcatgttgctatgtcacattatctgaagggaagtggggatgggatgaaaggccttgtaaggccacctatatactgaaggaagttgtagtgaatcacagtccatgctcattacatatcaaggcatttgaaatagaagttactctttttcttgggatgttgacctcagttgatcaggttttacagtgtcctatgatcagaatagaggatgtgatactggaataatcattttctaccattgagtaagtatttatttataaattactaaatgagtggaagatcctgggtactgggaggcaggaggttgcatatttgagttgataagttgtactactgataataaagataactgacacactaaaacatacttggtacactgaaatacaaattacggttatgtccagtggtatcaccaagtgacaaactgggagctaaatagttcagaaatgccctagtctctaggtccagtttgaattggttatggaacaaagaagccatttataaaagggaagagatttttaggttttgcagctaaggtttatagtaggcagcgagggaatgattcatagtgattgtagcagttggtttaccaagcactaaagagattggtgttaactccataatactgatagactgattggaattacattttttctcttgaatttaccaggagtggttgtgaatgtcaccttttccatcttttaaattacatccttgcaggtggtaatcactcaaggaaaaggaattatcagagtaacaatagttcctgttactgacttgatatggtctctgccagaatagcttctcagattaatggccactctcaggtaaggaaaataaagaggcgaagccttagttgctttaggagatgatataatacaggtgtgacatcagtgttttcagaatttgtaaatgttaaaacaaacttcttgatttaccaaagccacaaccaaagtactttacctggatctttcaagacagagcttctcagttcagacaaattgactgatgataagacaaacacttttcctctacaaaccgtggggtagtatgtagagagacctgtgatttcttcccatactgctctggaactacttctaattatacttttttctttgtttgtttttgaaggggaagcatttctccttgcattggtttgctggtatggatggcccttagattttggcatgagtgattatgcagcctatttgaagaaaacctgttttcaggacctttttaattaaatatggcctgttacatgagttaaaggtaagttataagagctctagattctgcaagatgcttgcttcttgtagttattttgcttggtgataatacattttcttttgtctggagcttcctggactttttgagaatcctgattgtgatgatataataggagaaaacttgggatatagatagtataattgagtgtggtgaatcttttgttatggaatgctagtctaagcttctgtgtgtttccactagggacacacatcaacatatcagtcttaaaacattcttggtagttaatgcttgatgttacttaaaaatcatcctacattcttgcattaaactacatacacgtggctgggcgcggtggctcatgcctgtaatcccagcactttgggaggccgaggcaggcagatcccgaggtcagaagatcgagaccatcctggctaacacggtgaaacctcgtctctacaaaaaattcaaaaaattagccgggcgtggtggcaggcacctgtagtcccagctactcgggagcctgaggcaggagaatggtgtgaacctggtggagcttgcagtgagccgagatcgcgccactgcactccagcctgggcgacagagtaaaactctgtctcaaaaaaaaagaaaaaaaaaaaaaaaagaaaatacatacatgtctcatctaaaacatggttggtcaacaactttctgatttcctgatacacattttattaaccggctccttaaatatatccatgttgcatatcatgtttgacatgctttcattgtagcttatagaataatttcaaatagaattttgggataaaaattatgctaccttaaaataggttatgaagtatttgaggtattctctttttatatgataggtaaacttggcttggaattaaaaagattttgaaagttgcttagggagctccctgcttttgtgaactcattattccttaattatgatgtcaaatttcagaagtttgttattaacataccggtattttgctttttatagattcttgtaatagaatattacaagtagaaactgatttacatagataattatgtgaaatagtgctgcttgactaggattttcatgatctcatttcaaagattagcaaaaacaccctttacctggtatgtttacctctgatactaccttcactgatttcagcaggtagtcagttataatccatggattgaagttttgatttatttatttatttatttgagacagagtctcactctgttgcgcaagctggagtacagtggtgtgatcttggctcactttagcctctgccttccgggctgaagcgattctcctgcctcagcctcctgagtagctgggattacaggtgtgggccaccacacctggctaatttttgtatttttggtagagacagggtttcaccatgttggccaggttggtctcaaactcctgacctcaggtgatccgcccaactcagcctcccgaagtgctgggattacaggtgtgagccaccgcaccccgccatgggttgaagtttttaaatgcatgttttccggtagttaatacattgcttgattctgtcttataattgcatttcagttctcttcatcttgtccatacacataataatgcttagtatataataaagcaaggtatattttcatgggatttttgtagtgggagaatgacatctgagcctgaaataggatatttgtgttgtaactttttcagtgtcatacgataccattttttgaccacttagttgatgcctctgaaaggaagagagaatcagatcgctaaaatttgatgtgtcgtcagtgtggatcctactcagtagtgtcacaacgaggctgaaaatcatattaagtgcttttaggacagaaacgtaaactgctcaggtaaaataaccttataaagagaaataagcatatattgcagaggccttggctaggttcatgatgacacaggaccttgtctgaacataatgatttcaaaatttgagcttaaaaatgacactctgaaatccagtcagtgtgcctcactagacttttcgatttcaagattttctgcagaaaatgttttgaaaactttgaatacttaaaaatggcaggtgtagtattgcactttgctagttgctcagatacccttttttatttgtatagatattctgagttcctttttttttctacatgttgtacgttgtcgaaagctaaaaggaaacttatccttggatcacggaaggcagaggcatttggtgagatggaaacaaggatgtgtaaaaatgagacgaccacctctcggattaaaaaaaaaaagtgccagagttctagggttctaagtgatgtccaggaaggaggaggaataatatttatggagcatatattatggaacacagtgagtatagtacctgcctttaaatgaatactgttggttttttaggacagttgcttttttttcttttttcttcagctgtgtgcagttgattaacttgtacagagcctatcacacaatagatgtttaagaaatattaagtgaatgaatgaggcagcattgctaatttttgtatagtgagacagtatctcacagtccaggctggagttcagtggcattaacataactcactgcagccttgaacacctgagctcaaacgatcctttcaccttatcctccagagtagctgggactacagtcgcgtgtcaacatgcctggctaattttagttttctaatttttttagagttgggatctcactatgttgcttagactggtcttgaactcctggcctcatgccatcctcttgcctcagctggtattgtaggtgtgagccactgtgccaggtactaattttttttatgttagaaaacaagtttttaggtattttatagttacttccttatgacaatatctcatcagaatctaggcctatctgatatctgactccatacgtttataccgtgtagtcagccattcccagatagaggtcatttgagttacttagtgtttaccagcacttgtttactaccttgcgatgatatttacagtgtatttttgggtatggttttggggttatttggttgttgttaaaatgcctgtaatcccggcactttgggaggttgaggcgggtggatcacctgaggtcaggagttcgagcccagcctggccaacatggcgaaaccctacctctactaaaaatacaaaaattagcctggcgtggtggcaggcacctgtaatcccaactacgcaggaggctaaggcaggagaattgcttgaacccgggaggcggaggttgcagtgagccgagatcgcgccaatggcactccattcagcttgagtgacagaggtgagactcccatctcaaggtaaaaaaaaaaaatagaaatcagcaactgctatttgagtttacaggagtgagaagtcctctcttgcatggtgagatggggaacatttaattcaatagaaatatttgagaccaggtatggtggctcaagcctgtaatcccagcactttgggaggctgagttgggtggatcacctgacatcaggagtttgagactagcctggccaacatagcaataccctgtctcaaagatacaaaaattacccaagcttggtggtgtgtgtctgtaatcccagctactcaggaggctgaggcaggagaatcacttgaacctgggcggcaaaggttgcagtgagccgagaccatgccactgcactccagcctgggtgacagagtgagactccgtctggaaaaaaaaagaaaaaaatgagatataaagttcaaaggatgtatttattaagccaatataaagtaaagaggtggggaatgttgtagaagtatatgttgataaagggatcaggtggttgtacaataagaagggggttgcagacatggagaaacagttcttctagctcttccactttcagtatcatctgtgtgggtcactggaatcctttttcacaatgcctgcttgcccatgagttttaagaactagtacagtgtagaaatgattagtaggaaaaacttggctgggttaatttgctttgctgagccgattcaacttaaaaagcgaggtccatactaagtgcccaagaatcaagaaggaggctcacatttgaacttgatgtttagttaatgtgaatcattttctgttgaactaatgagaatacagtgaccttgagggttaggttgtacatctgaattgttcgggctgtttcctgtcttttggatgttttgtttgtatagatattttcattttatgttacatcatttgttctttggtagcaaaaattgagttgaaatgatacagttcctgaaatctatgatttcatgtttcggagatatgtatcaggaataatagtgtgggttctcatgagaaaatctggattgcattactgtgctactttggtttcttgtcagagaagttagtagtttagacctccttcagaatcctttctttggactttgtgtttcttacgttgtgccagccttgattttatttgtctgtcctctgtctttctataccatttgtttacacttaactctagaattttttgatgcatgttttcagtgtactctagtcctaaaattggtttacatttaattattggggagaatagcaagttgtcgatagtatctgtggtggcattagtgtatttctgtttcagttctttggacagtttgctagtggaaatagtcattgtatttagctctgtgagacccgactggcagattgctgtctctctctctctctctctctctctctgtgtgtgtgtgtgtgtgtgtgtgtgtgtgtgtgtgtgtatgcgcgcccgcgtttgtttccttcatgtagattgctgtgtgtgtctttttcttcataattccccttaattctgtgtgctttgaatgacactgttgttgttactgttgttttatatccattgtcacataaaactcttatcatttattcttccaggccagggactgtccttatgggtagagatacactatctgcaggaatttatttttttacgtatttttactagttgatgggaaagacattgggaaagacctgggctggatttgtgatgagctgtgtttactgagcatgatgaagtaaagctcaacgtgattactctgaagtccagccttactgtcagtctaaggactcaggatacaaatactcaaaacataaattcttagactctaaatttcacatggtttttcctatcagtacaggttaaggataatggcgtgttgtaggtttttccagtgcaatacaaggaagttggttctagatcctttagtacagttaatgttttgtagagtgtgttctatgttcactgcattggtatgtctcatctttggcatgatcttggctcaccgcaacctccgcctcttgcattcaagcacttcttgtctcagcctccagagtagctgggattacaagcatgtgccaacatgcccggctaatttttgtatgcttttgtggagacaggctttgccatgtttgccaggttggtctctaagtgatccacccgcctcagccccacaaagtgctgggattacatgcgtgagccaccgtacccagccacacctttgcttatttctactatgcatttcaagtgatcatttcaagagaataagtacttaggagctcctatgctctttttttttttaaccctgttgcttgcatcacccggttccaaccctatatgaaagtttcatgagcatgtttctgtcactgaggcagcttctccatttggcatataattgagaaattgctagtttgtggctgagacattggtttgagaggagacgtaatttatatatttagcagaatgcttaagttacatttccagagattaatttaattctacttttaattaagttaaccctttgctgtatctttacaagacgtaggtggagatttaattttgactcttagattcagttaaggtgatgaaattggcattatatagtttttgatgctgagccccacggagattaaaagatttgctaaacaccatgcaatttttgaatcacatctctaatctcacattattctgtactctattttttgcttgtatgattgatgggtctttcattatctgtgattgacattctatgagtaggtgcttttgctttgcctataagtcgttattatgaaggaggaatggtgaataagaaggtaatttagaaaagcctatattaaatataccatgaacattgaatatagcaagatcttattctctagttgttatcttagttgataaattctgtatgtgttatgtgtttgtgtatacatatgtacatattaatgatgtgggtgttgatactgtgatcacatgacaaatgactggtttatagtgaaaagctgttggggttcagagaaatgaacattcttctaaaagtgaggtagataagttattttatagttcttgcctttgagtctctgttcttctggtagaaatgttagtgtatttataacctctcagatttgtttggttctcttagtgttcttgatccaggcagttagcgatatgttggatgaattgagaaaaatgagtttttcctttcctactaactgaattagattagaaataagcagttaagtgagaaaaatagggaattagtgccagatatgttgaggtgtagtgttgacagggggtcttttaccttcagatgtttggtgcaacttagagaatgcagtggtagttgctggcccagcccatccaaacaacctcatttgtggggtgatacttcacagatgacttaaaataaatcccctgaaaataagaatctctggaagagatgacacgtgtatgtgcgtgtgtgcacgtgtgtgcgtgtgtgcacgtgtgtgtgtgtgtgtgttttggtggagtggtaggaggagggttggcttaatgatgagaatcattatttcttgaattggatgacactttccattcctgcaaagggagcgtgaggtccagccttgctaattcatgatcaaagtaatttgctgagagtagtggaaggaatgagttagcagaagatggcaaattgcattaatgagtagtaggaggaaaacaaataagcaaattttaatgtggttggaacatgttcctgagttgtatgaagggagacaggtaaattgagagtaatgttatgattgtttcatttgttggaaataaggaaaacttgcatggtttgaattgtggaacaataggtggtgtatgttaggagtcagaattatcatttaacatgtaagtttctgttttacttcagataaagaatgtcagctacctttcccatgttagcttctataccttttcttgaggtgaccataaataggtaatattgtctttcactgagattgttttaattagcgaagtgtgctgattaaatgtcttttcttgataaattattagaatgaataaaggatggtatttctagatagccttggttagtcagtgatttgtttaaatttagtgtggataagaatcacctgagggctttttaaacacagtttactgggtcctgaccttagtgtttctggcttattaggtataagtatgagaagttgatttttatcaagtttctagatgctacagatctaggaaccatacttagagtgctattatatgtcttttaatgtacactgatatggaaaaagcaatgatacatcatgttatcgcatattttaaaatgtgatcatgaccagggaatcttgaaagttgtcttatgtaataatgtaaatcaatgtagaataccatatatttttttcttgcaaggttattattaataggaatgactatttgtagccaatgtgttcaaatgcatgggaggacgtaaacacttcataatttcctggaaatacagacatatatcacttaaaataatacatttctaatataaatttaaattatctacgtgatatgaggaaacgagcttatttttgataattttcctagcagtgaatcaactatactcatttgaatctaaattaaattaaatttgagtaaattcagccatttctaaattcagtccatataaattcactttgggtaaaagaagacaaaattcctgaaaacagtagattaaaaaaataacattttaagagcaggtatgatctcaatgaatatagtgtggtaatttctgcctaatacctacccttttggaggaaggaaaggtaatcctgtttgtgtttaatgttaattactgaactctttataacttgttttatttatttattgtttgattttaagcatctgcttctggtggacttacatatgttgggtttgggaaatttcaacatacaggttggcattccagtggctatagttgtttcttgaaatttagtactgttttccaatgatgattctctttgggaataggctgttctcttttacttaaaaactgtaaaattagccacttcagttgagactcctccaggtttggaagtggtgaagaatatggatatattcagatcaaatcagtcattctctgtgatacagcaactgaacaagaaacccagacttcaaacaagcagacttctttgggttggactgaataaaatgagaagaaattacagaggatttgaaaatgtatatggcctaggaattattgaaattattttggagggtggcaacaaatttgggacattgtactttctgttttaatgtcaattgtataatgtgtaactctagtgagcatggctggataccgtggcttcacattttaggtagactgggtgttttatctactgagtgaattacagccttcggcaatgatgtcaaggtagcaacaaaacccaaaaaatccatcctttagaaattgttttaagtcacaatgatgataccttctttaaaagctttgacttactgaaataatgcttttcatttgtccaagatgagtacatagcagaatttggaaatatggttccaaaaggctaaatagactgacttttttgatatttttcccttatagggagaaagaaacattaacggtttatcagatgccttgactgtactttttactgctttgtcttcaaggcctagtgtaataattaacatctagtatgtgtttgatggatagccaatttttgcttcattggtatgttgttaccacagtcattggtagagtcaatatatgaatgaagaaagtataacaaatttgccctctagtagagtacaggcaaagtatggccgtcagtttcaccctgattttttttcctccattcttttttagggtttaggtcaagaacaagggcatttcattgtaccacatagctgagagtagggaattgggacatactgtcttgctttaaattaaagttgtctgtttcatcaagtagagaggttcctaagatattgccagatttctgactcggggtttgttaaaaatagaaaaggtagttccttaaggttgtattttattggatgcctccacctgcttcaggctagctcactggagaataaatattccaggttaaaaaaaaaaaagcatgtgttcacgtgaacttgtcctttgagcaaacctgttggaaatcaagaggtcattgctgttggagaggataagagggtgtacttgttggtgtgttaagagtagttcacaacataaaaataaatgtaaatgcatctattatatttgggttggcaaaatatattggttatttactctgttgattcctgtagtgtacataaatatgatctacaactctgtgaacaaaaaggcttgaaaaattgttctgaaaatggacaaatcatgaacagataattgaacaagaaaataagcagaaagtaaatttgtgaaatatttcaaactcatttacattcagaaacatctttttaagatcactgtgatacattcgactgtcaattctgaagagacgtataaaggaaatgccagctaaggagcaaggaaacagctttcattcatgggctaaattgcagcttaaaaaagatggaccaggattatttcctttagaaacttactgtacaaaagatactgttcaccccattagagaactgatttgaagttactcttccctgtgagggctctgtcatcttaactgtattcacatactttcaactgttccccttgctgctaacctcaggttctttagttcatctatctggcagagctgatttggggaaaacaagacaaaccttctcaggttttcttaataaataagcagttgtcatgtttcaagagttttagaaatgagcaataatcaaggaagaggacaacgattgcatacgtttataatatttagaacatcttttgccacaataaacactggaaaccacccacttgtggacaccaaacatttggatttgtatattttgtggcattccctcactctaatcctctcatccttaaaaattttcagaaatttttgcagcaacaaacactgattgcaacatatgatttagggtagatttatgaaccattttttcactgaaatacatcaacaggagtgagtagtctgagtgaccaccccagcatggagaaaactgtagtttacagattcttctggagcatttttatttctagattgcggtggaagtctaaccccccttggagatgtctgccttaaagggtctttggccagggtcctctgtagagccatagtccagatctactctatttgtgtgctccttacaacatcagaacagcaactctcaatccggattcatccccagaatgccgtctgagtcacagcgtggcaggtgcataaagaattatctactgaattgagaaacatttcaaatatataaaacttgaaatattttgggtagtctgtacaaactcaagttgacaagccaaccctgcaggaatatatggatagaaggggaaggataacatgttgaattcagctacatgcctcatcagctagaaaaccttggaagaaagaaagatagattgatacttgcctgaacttcatcaaccaataatattttttttcttgctatggagagtccactcgcctttggaagatttaccagtaaaagccctgcacatgatatacttgtgtgcacatgcaataaggacatcattccccaactcctgctagcattgtgaaagagctccaaatattcaaataatataaactttttttcgtggacatttagcttacgagtttgtttaaatatgtgggaaaattatgtttagataatagtattgaaatgagaatgtaagatacacattgaatgataaatgtgtatgaattgttcattgtgccttaggtaagccagacagtgaaattaaatgtgtaatagttgtatttttttgcataatcttggaatgtaattagttaaaagcaaacacttagattttgaacatgaatctgttaagcttgttaatgtagttgctgtggctaaataactggtttcctggggaagcttctatttgctagaattttattctggaacagttgttagaaaggaattctcaggtcaccttttaaagatatacacaattctgtattcactttttgagtgcataagggtaatagaaaatgacatgggaagcgttaattagaaaaaaaggcattttgtttatgtgcatttgaggatacagtgtttgaagtttctaaataattgttttatgacattttcttggtacatagatattgctaacaattagtttgctgaagtatgtagaaacattttaagaaatgattttagaaatataattgttaaagtacctctgatgtatattaaaaatccttttattttggtttatattgctatggatgtttttctgggggaacttaatgtatacaacttctaactaagaagttttattaatgctgctttatgtatgaaagtcatggatgtggatgttattttgtcagtggtctttctgttaaaatttacgtggtgtaagattttcttttcatgatggaattgccaaaaaggccagcctctagaacacttacatgttaagggttgggtgggatttgtattactttgtgtatataaccgacaggattgtgttactgaatcttaaccagcatagagatggctgacattttgcattttgggggacattaaattgttacacaatgatgtcattggttactgataggagtgtttagactcttagatggctttgttagtattaggcaaatattagatgtggatttaggagataagagggtggggtgttggagccctgtgtgcacatgagcatatgttgcagggcctccagacctaaatccacgtgaagatggtggtggtggtcttacctatatgttaacattacattgtaaacaggtagactactttccttttgctagtgggagtgttaaatcacctctcagaacattaattcattaaattgcccctaaacattaattgattgctggtggatatgctaaatatttttaacatctatttttctaaatgtatagatgtcatttttaattcataggggatagaaccagttttgcttgcaaaaagcaaactgttcactggatcattgggcttaatttttaggttgtggtagatataatagaaatgttcttacaatttgtagtataatactgtatatctctataaatatatatgtgactgtttttctgatagatgcaacatggtggaaatgtcatcataaatgtcggtctgcctttgtttatagttttcagatgtgtatatgcagttttttatacaacagaaaaattgccacatgagtcaaatagcataggttagaaaagttctcatttgccaaaaatatgtgactttcataatagtgagttgtttttgatttaaaatgtttctatctgtagaggcattttataagtttttatggggatactagcaatgggatgtgaaacctgagttcattagatcattgggtgataatggaacccttatgtgtatacaatatacatggttatatgttttttaaagcataggagctattatgtctgcatggttctaaatatatatacacacacgtaaacacatatctatatatctatctatatagatagatagataaatacatacatatgtagtgaaagcttttgtttcctccctcacataggcagattatttgtgtgtgtaaatgagcagctgaaggggaattttgttacatgtgtataagacagtcacaatatataattgttttgctttaattgtttagtctttgatttgtaggaattgccaacacgtatatttgtgtgtatgcaggtttatatataaatacatatcactgtataaacaacatttattgtcataggatagaaatattcttaagttgccagagatactgtatggctgctaaatgtatagtagaaaaatgttaccttttgctttttagcatctgcatacagattactaataggcgtatattgtgaccagtaaaccactagacaagggcataaacactttagtttgatcagtagaattgctatgccatgtttaaatgggatttatttggttgatgcagaatatataattgtatctagaagataaatattacaaaaatattttaatatacaatttctgtcatatttttggaaatatatttttattcaaaagtagaatcattgttgccaatagagttagcatctttgtgtgcttgtgaggtttgattttgagggttttcttggttttgttttgggttctggagttctaaaaaatgagattgtctttgtctaaacaatttttatataaaaatgtacatttttgtattattttttcttattccaacctaatcggtggcttgtcccttcctgtgtttattgggctgttgggtgcctggatagagctggagaccatttaactgctgtatgaataatagataagcgtcttgaataacatctgaatttcctaggtatgtagaaacacccaccatgcacatatatgaacatacagaatatatgaatgttaaaatatggtgaaaacaatcttttgctaatagaagtgttaacctttatttttaaaaaaaatttggtgtgtatgtagaggtttatttgattgttagttgtgtccatgtataatatgtcatctacctttacagatgtgcagaaatttgttgtatttggtggatatattttacttaaaactatagggcagaagctttttatgtttgttgaagtgaaatggcataccaaacctgtgtggtagagtgggatttttagattgctgtgtgtacagtcaggttatatctttaaaatacctattcgttatatattaatatgtagacattgctgatacatatgtatgtaaaaatcagagtatttttattaatataggcattagcttcttgattcacttgtttgttgggaagcacttggagaaggatgttgaatactttgtcatttcatctctgtgacgtacagttgtcatgtcaaccctcctatctgcgggttttgcatctgcaagcacatgcagctggaaagtacagcattggcagaatctgaaacccgagtaaagagcacctcattttcataaccatgggttctgaagagctaagggagttgaggatgcaccgattttggtatgggggtacggtacaggtacaaatccccgatggatatcactagacaactgtacaatcctctttagctttttttttgttttatagacagtgtggacgtgcatatattgcaagcatcactttgttaaactatgcttaaccctgcaaatgattttaagagctctgtgtgggtggctttcttgggtttactattaaatatctgtgtttatcatagttgttctataacatttcaactttgtaaatatgtagtttgttgataaagaggatagagacatttttcttttgttgatagattgttctttcccctttgcttagtcttcattgtgttgctgggattgtaaaagacaaattacttgcacatatttaagcttatatattaaatgtatatatgctgtcatgttagagagggagagtggttccctcccccacattttgatttaaaagtaaaaattaatttttattaaattgtttgggtcagtttcatgtaagaataatctctacattgaatggtatatcttggccgggtgcggaggctcacgcctgtaatcccagcactttgggaggccgaaggggccagatcacgaggtcaggagttcgaaaccagcctggccaatatggtgaaaccccgtctctactaaaaatacaaaaactagccggccgtggtagtgcacatctgtaatcccagctactcggcagtctgaggcagaagaatagcttgaacccaggaggcagaagttgcagtgagccaagatcgcgccactgcactccagcctgggcgacagagtgagactccctctcaaaaaaaaaaaggtatatcttattttctttgatgtactgaggttcatgatgcaattcattcttaagcatatactatagaatctttaaattatatggttctgtgttcatttgtggcatgacagtaaccaagacaatttagtaaataatcagcaaatgaaatatttaattttgaacatctagtatttctagatgtatagagagtctcacgaagtagattttttaagtatcttgttgtaaatttgttagtactgttgtcttttgcaattaatgtggcaatgaaattgattattgatacacaggctcttggagctaaacaaaatttatcgtgttttaatttggatattagaaggaggaaatgaaaagagactctctacattttacctgttattatatagcttaccattatatcagatatgaattgctttttttaaaaaacttagattaaatgtcatgtaaatgcatttagtctttccagatacacttcttgatatcataatttttatttcctgttaatattcaagatataaatgacttcattaaagagattttctactacctctaggaactatacaatattctgtatgtgttcccttggttgcatgacaatattcaagacaactttgtaaataatagataaaaaattttaatttttaacatctagtctttctagatgtatagagtctcacaaagtataattttgtaaataagtcattgtaaaatttcatggtttcattgtgttttgcaaatgtcttggcaaagaacttgataaaattttgggcttcttgacctatacatattttggtatctctttattgggttgtttagtgtaaggaaaaagttgaaagaatgtattttcaactttgaattgtaatcagaaagaaaatatattttaaccattgtttagtgcttctgttatatattgaaaacttcagtcttaattttttagttacattgttgatagggcattatataaatatacttctatagtcattgtaggaaatgtcttttataaggaaatatttcttctacctctgaattacacagttttgtatttacttggactgcatggcaacattcaaaaaacactttgaataacagataaaaatgacattttctaaagctctaggtttgctagatgcatgaagtctcagcaaagtataaatttgtaaatatttcattgtaaaatatcataaattgactccttcaagtgttcagtagtacaataggtaatcaataattggcctcttgggactgactgtaacgttttggtgtttgtatgttttgagacagagcaatagattgcctccatatcttttaaacattcaggtctcttgtataagaaaaataaccattgtggggtttttgtgcatcttatactaatatgaaacaaacaaaaccccctggatattttatccttagaaagatagaggaagacaggagaagggaatggtcattgtaaattagatagatatattgagtgttagaagattatttaaataattgttcttttgttatttgtactctttgcaaatttatttaaatgcatattcatgtatatcataagtatatattcacatgcatgtctaaatttagtggcatagatctatctcaggggtattaatctttcattcgtgtactgatttgtgttttattttcatttaaaaaattgtggaaccagtggctgggcatggtggctcatgcctgtaatcccagcactttgggaggctgaggcgggtggatcacctgagggtcaggagttcgagaccagcctggccaacatggtgaacccccccgtctctactaaaactacaaaaattagctgggcatggtggtagatgcctgtaatcccagctactcgggaggctgagacaggagaattgcttgaaccctggaggtggaggttgcagtgagccgagattgcaccattgcactccaccctaggcaacaagagcaaaactctgtataaaaaaaaaaattaaaaaaattgtggaactagtgttttatttctaagcttgcagatatttctagaattccacttactgttacatctaaatgtatgctgatttttcgttaaataataagcaggtctgtaaacattttcttttctaacctctttccatatttatatgagtatagaaaaactgtggttatgaatattttttactttttgataacttttaaaaactatcagatatgtgataatcagatagatttcaagtttacttacggtgtaaattaggaaaatttttataaagattctatccagtattgatcaaaagtataaattgtgtgtctttttaagcagcagtttggcaatgacaatcaaattgatactatgtaaaagttttgaaatgttatagctggctactggggtttttatctattccagttctcgaaaatttaccaaatataggttggctgtaaaatcataactatctgaggtatctgtcaataaatcaaagattgcaatgatgatagcttctttaacatgaatgtaattctaacagtaaaaaatttctatatggaatatgttttgtagtcctaaattgatattttatatcatttttcagtgaacaagtagttgtttacaggtgtctgtgcatatgtctcaagtttttctaactaaaatattaatagttaagtctaaaaatatgaattatacgtggggcttgtcattctgacatttaatacttcagcgtggtgataatggtgatataatatactgtttgaaattgtaacacatgagttaaaatcaaaagattgataagtacatatttgtatattgctacatgacaaaaatctaggaagaatatgattcacatgaaaattctttggaaggacatgacagacttttaacagtcctgtatagtgaaaggagaatagaacgactacttctactttctgtatctgaaattttcaaaagctatttcaaaatgaacatttaaacaacaggaaattttagagacaaccactttgtgcctgtcttcatccttgacattcaacatcctaggaacaatgggctgttgtattcaacttcttattcccaacagccattatgaatggtttttgattgatctcacaaagagcatgtgctttagacattaatgcagcgactaccatgaaacagagtattggattacctaaggaaagaagcagaggatggaatttgaggtaggtgtcaaacagtgaaatttcgtttgagaaacagatgagtgaaagaaaatagtaactgaaacattcattctataaggagagtacattttaatactggcgatgctgtatttgtgggtactgactagatcaagatgttagaggaggtgtctcttgggataagttggaagttatccttcattaatttggtataaactgaaaacagattgcttctttccttttaaagtggttgagtctctgatgggtttaaagtaggcctttggggatttatagatcattcaaaattagcaggggaaattttaaatattctctgcatctttctaaaaggtgtggtttaaagttggtgagaaagtgaaatggttgctggttgaacttgattttctctattcactatgcctggctagcctaaaattatcctaatgggtatgttcaggtgcctgatttgtatctaaatgtttctgtattggatactgtttttcttaggcaatcaggatgagtgaaaaattgatttgcagctgacctgcaaatggaatcatcaggaa

SEQ ID NO: 35899 - DNA, 33939 bp, Homo sapiens
cgcgcgcgcagtcgcgcgcgggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggtaaccgcccaggccggcctccagctcttcgctctgctctcgtcggctcagctgggcaggcagcgcggcctctcgcctccttcggcccgcggcccgctctgggaggcccgaggcggcgcggagaggggttggccgcggcggcgagggaagtcgggtgctgaggagggggcgccggggagacttccggccgcggcggggcagccggacagcggggacccggggcttccaggcggctgcccggcgggccagggagtgctgtcccacgccccggcggagggtggggcggcaaggctgggggtctctgggcttgggcgcgggcctccatagcttctgagaccacccccccgccggaggccgcgggcgcgcgggaatcgcggcggggctcgggcgcctggtggggattgtggcccgacaaggtccctcggcagccaagcccctcttctccgccccgacggggccgcggaggtgcggcaaccgcgggtgcagaatgaatgaaccgggagggtcaggccgggcggggccctgcgccccgggaagtggctctgggaggcccgcgcgtcctgccgcggtcagcacatgctcgcccctggttgccgcggctgcctgggtcccgggacgtgggggccccgcgccccgctgcccttgcttccgcgatctctctcttctgaatacgtttccgctcgtttatctctgcgaagtgattttactctggttggcaaactctttcagagctgttccgaggaaatagttttaacacaaggctgggggagggccgcagttatgggggattctctttctctctcctcttctctcctctcctctctttttcgtagatatgaggcctcgctatagtgcccaggcggcttccaaaactcctggcttcagagatcttcctaccttggcctctgtgggggatctcgtgaaatcttttgcccctcaattttgtgcgttttaattattaattggctgtttatgaatactgtgttttgacaagtatgtatggaaccatgacattttcgattctttgattttgtaaagtcttaaggaaatatcgacaagtcttcagacgtgagatattccttgtcatcacaacaactaaaccttaaatttttgtgtcggtttttatgaaggaaattagttgcacatttatgtgactaaatgcgccagttaaagtgactcaattgcagcatcattttgcttgatataacctggtgaacgtgtatgttaatcttgctcattcttgtgaaatctgtggggagatgcatactaagtggaagacctgttaggcttcgaggatgatgtactgtatactgcttcatccaattgcatttaaatatatctgagatgagggagatgtcactgacctaagggtgctgatgtagagaaataagacgtttttgtatggtagaaattcttagaaatgagagaagtagaacagattgtcagggagcactggagtctaataatgtgaatcttcatagtccgaaatttgttgtgtgtggatttatctaggattctgtccaaggagttttaattgtcatatgtattggcaggtccgtacaacgtggttttagttataatgcagtcacatggtccccaaaggtcatgtttattgaggccccagttgaaaaatgaatagggagtgatagagccatacatcaaatatccttgttttcgttgttacttaggttattgactaagtacataatgcaagttgacattcatgataattctctgaaatacatagtgaactaaacatttaacacgcatttttctatttttgattatgaagatatgcccagtaatatgaaagccttggatgaaaaaataaattctgtggaaccttgtttataaatttacagaaatggtttaaggcaataagttgaagtcctcatgattcaatccatttggcacacagtaatttacactgggcatttacattttgctgttgaaactaagacagtaactcatactgtgatatataatcttaattttacggtatcttgttgacaacatctatctaatgaatgacaccttgatttgggttttatcttactagtttagtgtcatttatagcttaaaaggatggttttctctaatccttaaacagaagactaaaagactagatttttaaaagtgtccatgcttgtgttatgtaggttgttccataatcagtgacaatgctttaaaaaaaatcagaatttatttttaaaagttgcctcttttctgtcaatcactatacaaacttctgtgtggtggatgggggtaacggtattgtcctgaggcaatagggacatgactttgttgattggactgttaatttgttttatttctgggtgatctttgactttcttcttttctttctgttttcttttcttgagactcgtctcactccgctcccaggctgcagtgcagtggcaggatcatggcttaccacagccttgatctcctggtcttagatgatcctcccacttaagcctcttcaatagctgggactgcaaggtgcatgccaccacacccagctaatttttgtagggacggggtttcgccatgttgcccaggctggtctcaaactcttgacctcacacaatccacccatttcagcctcccacagtgctgggatcacaggcgtgagccactgtgccccgcctgacctttgactttcaaaggatgaaatttagtgttgatataacatcagtgttagcattctcatctaatgaaaatgttaaaataaggtggcttgatttgcatgactgttaatatgatgctttctaacttataatgatcactatttacatttgtagatttcttaaccatttgattcttacagacatttttgtgaactagacaatatattttgcagtctagaaactgacttaaatgactttcctaaggtaaagctggtaagaggcagaatttggatcttgattagtgtaacattcccctgtctcttgttactgtaaaatgactaactacaaatacaagatgattttctggactactattcacccagttgctatctcatttagattcctgtatctaatccagtagcaaattctgtaggttctgctttcaatatatgtactaaatcagacactttcccccctgtctttcaaacctctgttcacttccatcatttactgcctggcctcctgtattagcctactttggagcagcagctagtgttatcttcttaaaatatagaccatgttactcccctgctaaaaactgtagaggttctccatcacacttacattagaatcttgccttcccccccaccccttagctataaggccctgcattcatttgggatgcctacttctgagcgcatctgcacttctctctctgggtcactccactgtagccacactgttgctttgctgtaccctgaacaataagtggttgagcttattccagtcacaggactttcctccagtttgttgcattgcttgctttgtccagttgttccgttcttagctcatatgtcataccctctacctaacctgtcccgtataaaccagtttccctttttcctcccccacaattttatcctcctatctccctttcttctgtataagtgcttattactgttcgaagttatgttatttactgtttatttctctctattccccattaaaccttcatgaagttagggactcttggatatcccgggcattgctcattcgtgcctagaccaatccttggcacatagtagatactgaaatattaatagactaactgaatagatgagccttaatctcaatgagcaataatttgacattgttactccttggtatattctgtctgaaccaatgtctgagctaaaagttaaagctagtctcgttttccacccataagctcacttaaaaaggacatcaatcttttacattatttcttttttgtgtgcctactctgcttatgtatctttttttattaactaggaaatgcacacatagagcacatttgaaaggctctgaaggatacgtagagaatccctcatctgtccttcagcattccagttcccctgcttagaaaaccactgtttttgtttgtttgtttgtttgttgagacggagtctccccctgttgcccaggctggagtgcagtggtgcaattttggctcactgcaaactccacctcccaggttcaagtgattctcctgcctcagtctcttaagtagctgagactgcaggcatgtgccaccacacctggctaatttttagtagagatggggtttcaccatgttggccatgctggtctcaaactcctcttctcaagtgatccacctgcctcagcctcccaaagtgctaggattacaggtgtgagccactgcacccgacttcaaccactatttttattgtgtatccttacaagaagaccagagcaactttctgctataagttaggcgtcttctccttctcatgcaaataccttgattcccttctcttcccctctaaccacctatgtatcttcaagttgacttttttttttttttaagagacagactgctgctttgttgcccaggctggagtgcagtggcttttcacaggcgtgatcatagtacactatatacatacagcctcgaattcctaatatcaggtgatctctaccttcagcctccagtatctgggattacagacatgcatcatagtgttctgctttggctcttttttttttctcaaagggctgtttaatggaaccttatggttagactttattttattttttcaaatattggaaatttaatactttttcagtagagatggggtcttgccatgttgcctaggctgttctcgagctcctaggctcaagtgattcttccacctcggcctcccaaagtgctagggttaacaggcatgaaccaccgtgcctggcctagactttattgtaactaattgcttattcataactttcagaatgtttcctaaattgtgctatataaaaaatgctgtaacgaagttttgtatgtatggcattttgcacaagtgtgagtgatattgagtcttagtagttctgttttaagctagaatctttagtttcgtttttctgccttatcttctggaccaaagctcttttagccaataaaagtgactgaagctgggcatggtggttcacacctgtaataacagctctttgggagactgaggcccaaggattgcttgaagccaggagttgagaccagcctgaggaacatagtgagatctccatctccaccaaaaaaaaaaaagtgagcagttaaagcttaaagtcataaaggttaggaggtacctaaaatgtccctcaaatgagaggttctgcataatcctgtcataaaggagaatcactttcgggaaccgataagtgagatctatagttatggccttggtcaaaaccaaatctgtttcagctttacatgttacgttgatacagtgactgacattcctttaatggtcttttcagaattaatcatgagggctgagcactgtggctcatgcctataatctcagtactttgggaggctgaggcgggaggatcccctgagcccaaggtttcaagactgggctgtacaacataatgagaccttgtctctacaaaaagataaaatgaaaattagccaggtgttgtggcacacatctgtagtcccagctactcaggagacaggtgggaggattggtttggcccaggaagttgaggctgcagtgagcctagatcgcgccactgcactccagcctgggcgacagagtgaaaccctgtctcaaaatagtaataatgataataatgaaaatgataaaatacagtcttgggaaaaagtagttaacttaccctaggggttgacttatttgattaaaacctagtgagtcaacctgctggaattagaattttaccagtctttcgcagaatttactttatgtctcccttccccactggtcccttgtctatggtgcttaaaaatttacttaagaaaatacatttaattaattttttgaaacagggtctctgtcacccaggctgaagtgcagtggaaaaatttactcttctatttggtgtgatttagcctcaaattcttaaaaatcagatacagtctgattttacattgagacttgagtttacttttttaataggattttttgaagtacacacattttttcctgttactgtttaaaagccactcatttgataggtattctagtgcataaggtatttttttttgtaagaaaagtgatttagaaaactcaccttttatttatttgagacgggagtcttgctttgttgcccagcctggagtgcaatggcacaatctcggcttactacaacctctgcctcccaggttcaagcagttctcctgcctcagccactggagtagctttactctctgccttgaacattttttttttcttattttgagatgaagttttgcttttgttgcccaggctggagtgcaatggcgtgatctcggctaactgcaacctctgccccctgggttcaagcaattctcctgcctcagcctccctagtagctgggattacaggtgtatgccaccacgcccagctgatttttgtatttttagtagaggcagggtttcaccatgttggtcaggctggtctcgaactcctgacctttggtgatctgcccacctcggcctcccaaagtgctggaactacaggtgtgagtcaccgcgcctgtcctatctgttgttttaagctctgaaaatacttgtctgataatgttttcttccaattaaaaaaaggcatggaaaagttaccatgatgtttcagaaatatatgtacctccaggtgggggcagggaaacttagccaggtatggtggttcatgcagtaatcctaacagaagactgaggcaggaagatcccttgaatccaggaggccggggctgcagtgagctattagtggcaccactgcaccccagcctgggtaatagaggcaagaccctgtctcttaaataaataaataaataaataaataaatacaaactcattatgatgaagacagatttgttataagttgtaattaaaatcacctttggaatttaagaaaaaacttgtaaaaaatttgactaggaacagtggttctttagttctttcagttgtctcacttaagaattttctgacctcttcctaggaaaaaaagctattttttttaacgtatgacttctggggattcagattcttgccaagtttatttgtggattccctaggtctccatgtgctccatgttaagaatccttgaactgcttttgatagtgattaaactttcaggctctaaagatactgttttaatatactatctaatgttttgattatgaaatgtgagcataactgaaagtaagttaaaaatagcagtcagttcagtattcttttttaagctcctctgtgtcaagcagttcctttagtccagattgatcaactcctgcacaagtgaaattaagttttgtcaaattatcaagtactttagtattcactgtgctaaatgactgtgactggaaatgttatgcatttgctttgctcaagtttggaattttttccacacgtgttaatgaccactcttaaaaccagagtttttttttgttgagacggagtctcgctctgtcgccaggctggagtgcagtggcacgaactcggctaactgcaatctccacctcccaggttcaagcgattctcctgcctcagcctcccgagtagctggaattacaggcacgcgccaccacacccagctaatttttttttatttttagtagagacgggtttcaccatgttggccaggatggtttcaatctcctgacctcgtgatccacccacctcggcctcctaaagtgctgggactacgggagtgagccaccagagttttacacattagagaacatctgttctatccttttctttctctggtgaggaatttgtaggccaaagaagttggatgaccagattcctgatgtacaattcggttcttcttcttttttccctataccttataggatagtttacctgtgtaaatggatttaagaagaaaatatgctacagattcaagttgtatggattctgaacacacattatgttttctgttataatgaactatggatgcatatgtgctatagaaataaatactagaaacaaggaaatgaggacagcagcatccagcaggggcttttgacattacaattatagtaatcagagttctgatttaggtgccaaattcgtatcttatacagtgctgctttctaaaaacaaaataaatatgagaggcatagtttatgtaataatattatatcaaggaaaagaattcttatgtgtgtatgcgaaaaacgagttggactgttgtttcattagagttgaaattttctttgcaaatgtaatatatgaaggaatgaatgtggatataccaattaggcaattaaataatagggaatcttttaacttcagctaaaatcttagcagcttttaaaatttcttcccaagtgaagtgattgatggccctagggtcttttgtggcagaaacatgactgtgtggttggaagaactggataattggttaagagccctcagaatcaacagaaatacttcattattattcattctttcaagggctacatgacaccattgggggcattttatattttttaaaaatcctggccaggcgcggtggctcacgcctgtaatcccagcactttgggaggccgaggcaggaggatcacaaggtcaggagatcgagaccatcctggctaacatggtgaaaccccgtctctactaaaaatacaaaaaaattagctgggcgtggtggtgggtgcctgtagtcccagctagtcgggaggctgaggcaggagaatggtgtgaacccgggagcagcagagcttgcagtgagcggagatcaccccactgcactccagcctgggcaacagagcaagactccgtctcaaaaaaaaaaaaaaacctgaatgaagctattctaaaatttcttgagtacttaggcacagacatttttggttttgaattggccagtaactgagatgcttctgaataattaggattctactgtaatttaaagtaattttagatactggtttcagaatctaaggttgacatattttgcattaaaacaactggctatgttgtctttagattttcaattttttttttagttttcaataccttcacattatgtctctgtcagtttggttaattttgggcaaatgaatttatattttgaaagtctttacagttctagggattgaaggcattgtagttaaggaaacactagaaagaactaacaaatttatatcatgaaaccattggtgatttttttattgctctgtaactttcttaagattatagcttatactcgggaaaatgttagtaagtagctgttttgttttgtttttttttttttgtgactcttaaagacaactagattaccatcttactatgaggcagggacaaagtggttttagtaacataggccgatcccaaggccaaatttcagttttctgtaaccttgtgatttgcgtgtctctttattatccattcatgagattttttttcagttcaattaattggacattcattgaatgcataatatgcatttaccagtaagccaggtgaacaagaaaggcatccctgtgtaatggaaaacacagtcatgaaacaaatttctgtggcccaggctggaatgcagtgacgtgacttggctcactgcaacctctgcctcccgggttcaagcaattctcctgcctcagcctcctgagtagctgggattacaggtgcacgccaccacacccggctaattttggtatttttagtagagacagggtttcaccatgttggtcaggctggtctcaaactcctgacctcgtgatccgcccgcctcagcctcccagagtgctgggattacaggcaggagccaccgcgcccagccgaggaagtgtttttaaacttgaagagtaagagtttgctgggccaagagaaggagggagtgtgagtgagtttttggcacatggggcagcagatatgaaagctggaaggagagacagaaagcatggcatcatctagaaatatagtatgtgatggataatagaatcagggtctcatcaaaaataattattactgtttaatgactgtgttcaaagagttggcatcaagaattgttaggcaaacaaagtgtttctaattatgaaattcatatttagtctgtgaactattcactagcatgcagtgtggcagctgttcctgaagtgaggttggtcatatagtttttattatgtaaaaatagacatctttcattggcatcgtgtaccaggcactgttctaagcatgttacgtgcattaatttacttaattctaattgcagttttatgatgtgtggatattagtatcattcctattttatagctatgggaacctgcacagagggacttattagtttctagagctatgatttgaacccaggtggtctgattctgtagactgtggatactgaagaacatgtctattcctagataataactggcagtgcatgtatttttatactgtatcatttggacacatgaagtggaaacatgtttaagaacaggatctaagtgcttagcttacttgttttgggttgtgttttgtttgtttggttggttggttggctttttttgagacggagttttgctcttgttgcccaggctgggagtgcaatggcacgatctcggctcactgcaatctctgcctcccaggttcaagcgattctcctgcctcagccttccgagtagctgggattacaggtgcccgccaccacacccggctaatttttgtatttttagtagagacggggtttcaccatgttggccaggctggtctcgaactcctgaccttgtgattcgcccgccttggcctcccaaagtgctgggattacaggcatgagccactgcgcttggctgtgtttttttttttaagatagggtctcactgtgttgcccaggcatgatcatggctcactgcagcctcagcatcccgagtagctgggatcacaggcatgcactaccatccccaactaatttaaaaaaattttttatatatatataaaatatatattatgtacaatataaaatatatatacatatataatatatattacatagagacagggtctccctatgttgctcaggctggttttgaactcctgggctcaagtgatcctcctgtctcagcctcccacagtgttgggattacaggcgtgagccactgagcctgccgcttttcttggttttttttaatcagaagtctctttattgtaatttaattagaggctttcctacaaacatgagaccctgtttagtaacatagttcactttaagatggaatgcctctggtctggatggcatattcttttcctccccctccccacccagccagtcctggatttgaggaattttgtggttctggtgagaagggactctttgctgctctttcttaccggcaaaatatacagtcttgaatcacttaacgatggagttactttctgagaaatgcaccataggcaatttcatcattgtgtgaacatcatagagtatatttatacaaacctagatagtgtagcatgctacacacctaggctatgttgtatagtctgttgatcctaggctacaaacctgtttaatatgttactgtacttaatactgtaggcagttgtaatgcagtggtaagtatgtgtgtatcaaaataggaaaggtacagtaaaaatctggtataaaagataaaaaatggtatacctgtatagggcacttaaccatgaaggaagcttgcaggactggaagttgccctgggtgagtgagtggtgagtggatttgaagggctaggacattactgtacactacgatagactttataagcattgtacacttaggctacaccaaaaaattttttaaaatgtttcttcaataataagccttggcttactgtaacttttttattttataaacttatatttttaaacttttgatttttttgtattaacatttagcttaaaacacacatcatacagctgtgcaaaaatatattttctttatatcctataagcttttttctcttacaatcttttttaaaaaaacttttttgtgaaaaactaagacatacacacacatattaggcctattcaggatcagcagtatcactgtcttccagctcctcttgtcctactcgaaggtcttcaggggcagtaacacacatggagctgtcatctcctgtgacaacagtgccttctggaatacctcctgaaggacctgcctgaacctgttttacagtcaacttttttttttttttttaacaagcagaaggaatacactctaaaataatcaataaaagtatagtatagtaaatactaggcaataggaatttttcagttccattataatgttgtgggaccactgtcttttgtgcagttgatcattgactgaaactcatacagcgcatgactgtatttaaagtaccactgaatcagactaattttaaacgagaattttttttctcagtaagtctaaaaatatgttagagttatcttgcattcatttatatatcaagttgagttttgtgttttctttctttctttttttttttttgagacagagtctccctctgtcgcccaggctggagtgcaatggtgtgatcttggctcactgcaacctccgcctcctgggttcaagcagctctacttcctcagcctcctgagtagctgggactacaggcgtgcaccaccacacccagctaattttggtatttttagtagagacggggtttcaccatgttggtcaggctgatcttgaactcctgacctcgtgatccgcccgcctcagcctccaaaagtgctgggattacaggcatgagccaccgcgcctggcctacactttttcaaataaagtgcactgtccaggaccctgtctttattgttgtggttcaggtaagggttaaactaaaagtgctgcaagttctgttcaggggccagcactgactgtgcttagagaagtacttggccagaccttgcctatttcttctcctagtttaattggcagggctgctgatgtattggcaaggatgccaagacaagaatctatgggctattttctctgaacacttgtttctagtctgagtacttagttcatggttatacattggaattatctggggaagtttgtaaatttaacattgccagcccaacatatttttgttgttttaagagctgcttatgattttagtgtacactttgcagaaacactggtcatatgtgtgcttggcttcaatgcaaagatgggtagaatgggagacaaaagtaaaatcatacagctagcactgctttgtatattgaatacaaaggcatcaatgggaacaccaaagaagtgacagactggcctggaaaaccctcaaggttggtttagggaaaggtttttagaggatgatatttgagctgaattttgaagcataagtagaaaagggggagtagaatgtcgacataccagacccaggagatatttgaactaagactgtgtaacttgagtcagcatgtctatgcttggatcacagatacttagcttcaaaagtaatcttttaacttgaagtttcttttcttcagaagtgtagtccatgaatatatattcattactaaaatttctgttggctgggtgcggtggctcatgtctgtgatcccagcactttgggaggctgaagcaagtagattgcttgagcccaagaatttgagaaaagcctgggcaacatgaagaagccccatgtctacaaaaaaatacaaaaattagccaggtgtggtggcacatgtctgtagtcccagctactagttgggagggtgaaatgggaggatcacttgagcctgggaggttgaggcggcagtgagccaagattgtgtcactatactctagcctgggcgacagagcaagatcctatctcaaaaaactgaaaactctgttaacatgctgtgaatatgttatatactaaatagtcaagtaatagatatttattttcccttcacttacttttactattccaatctctaattcatcggtaagattccaaaatctcactgaatattgaaggaaaactcaaatgcttcatttatttttttgaggtataattctcataccataaaattcacccactcaaagtgtacagtttagtggttttttcatgtattcacaaagtagtacaacatcatcacttgctaattccagaagatttttgtcaccccaaaaagaaaaaccctgtgctcattagcagtcactctaccttcaacccctggcaaccatttatctgctttccaattctatggattttcctattgtacacacttcatataaatggaattatacaatatgtggccttttctttctggcttctttcatttagcatgttttcaaggttcatgtatattgtagcatgtattagtacttcattcctttgtaaatattttacctgaagtgttttctaaataaaaccttttaaaaagtgatagtgctgaagggaagcaaggtagaatttttaggagataggtaatctgtattggctctcataaaactagtcacatgtgaagcctgcattgctttagaacagggatttccaaccttttggcttccctgggccacagtggaataagaattgtctcatggctgggcatggtggctcacgcctgtaatcccagccctttgggaggctgaggcgggccaatcccttgaggtcaggagctcgagaccagcctggccaacatggtgaaaccctgtctctactaaaaatacaaaaattagctgggtgtggtggcacacgcctgtaatcccagctacttgggaggctgaggtgggagaattgcttcaacctgggaagcagaggctgcagtgagccgagatcgtgccactgcactccagtctgggcgacaaaagaaaaaaaaaaagaattgtcttaggccacacataaaatacactaacactaatgatagccgatgagcttaaaaaaaaaaaaatctgctgatgcacccatgagaggggagacagcactgtcgtctctcgcagttttcccttaacactcccttatctgcagacttaaactaggagcccctggcagagtcctacctccagaatcacaaaagtgtagaaggaaagtgagagacattgattgactttatatctgacttactagtttcctaaggcagagattttttagaaaactgcctggcctggcccagcccaggatagatagggatgggtaagaagcccttgagatgtggcagtatgtggcttgacttcagacttgtcagattaggggttttatagggtttttttagctcttgttttgattaagcttgtttgacttgcagggtgtctcctacctgtgttccagccacccgatttccttcctcaagaaaactgtttacttacactattcaaattagttattctcagggctatttttatgactttgtagcttttttttttttttttttggatgcagtttcacataataacattgctggctcgtgttgctagcaagaactgattccagcatttatgttctttgaatgtattgtcgcattctttcggagactcaagctgtccacatgaagtggatgaatttgacccagtattattgtccatcgtactctattgtaatacatcagccctagtgtgtaagtttgtgcttatttcagttacattaaaatctgagttgtctggatcatttcctcttctggcttagtagtgcaggacgagataatctgaaatcacagaagagtaaaaaatctgctgagttatttactccagctggatctcttaagactgttcaaatttcagacctaattgataatctgtgaaatattaaagtccctaaccaagctgtttcatttcagattcttcccaaaaccttgaggtaggggaaagaatcatctttaatatgtcaactcgtgattattgaggcaatgatcacttttttaaattgaggaaaatgcttattagattgttgaagctgcctagaggggcaaaagaagtgataaggctggtatctctggtgcttcgtaattggtccatttaagtgtatgacctgtaggaatagtgtcaaagctaaggcttttggacagacgtgtgaaatagtttgtaaagattcggtttggagtcttgcaagtctttttttctgcatactcctgctctttgcagtcactgcttggctaggcctactatttttggaagttcttgaatttccttttaacccagtcagtggttttccttactctgtggggttggtctcaggtagttctgcagttgatctgttcattaaccagtaagaaatgcaagacacactggtgtccaacattgggtctgcaaatgttagacacaggccttgatctctaggaactagtttagttggagagacagtaaggtagcaaagtgtgtaagggatggcttacagaaggttcattcctactgtagtcttttgctgacctcttaattgacaattgactttcaagatggtagaaatgctgcttttcatgactaaaataatgttttatggctcagagagccttacttcctaattctctagagcaaaacactgatttagggaatatgaaatgtatgtttatgtatggcaggaacaaagaatctgaggccagactcttgagtttgatttctagctctgccaaatattagcttgggcaacctcatttgacctctctgcttctttatctgcttaatatactaatctagctctatggtaattggaaggattagaatgtaaagaacagaccctaacgtaatactgagccttatgtagtgttggttattactgttttctgactttgcaaagatgctgcttcaccataaacataaaaagattgaatgtcttcctagtgtgtgggaaaatggtttgttcgtttcataaacgaaacaaagttcatttatgtatttgtttcacaaaatagataacattaaatataactctctgaagtgaggcatagattttgtgaaagcacaatgaatgctcatttaccgacagtggatagcaaaatgggatgttttgggtaaataacattttgatttcattaaaattatcatatgtgtaatccattttccatgggttaggtaataataaagttgatctttgcaactgctaaattgaagttttattttttaatccaaagtatttcactgtataacttcaagaggcgccatttatgcagactgtcatacgaatggtcctctcctgaagctgtgcggtatggttagccctgagagaggatgcttactgtgtgggagacaaccctccaatatctgcatgctttcatgtttcctaatttatctcagagttagtatgcagagtgtgaaagactgttttaatttttctttcctgatggtttggattttatacaaaattgtgttactggtacaattggattgagaatgcaaatctgagcgaaatgtaacttgtttttttgtttgcttcgctgaaaagttcaactgctctgcttccatctgttcttgtcttgccttacctattatggagtcctcaggcattaaattttgttgtgattgctgcatttgaaaccagaagtaacctgaagaaaaagggtcgagtaagtaaatacatggtagctatactagtatagtcactagcttgtaggccaggaaaagtacctgtttatgccgtatggtttttaaagaatattgatttgtctgtaaatcaactagccttgaggaaagtggctgcagtgacacaggagtgaaaaaatgtaaacatattaaactgtttttaagggcttttgtctttatcagaacaacaacaacaaaaaacattctagaatgttaattggattttggttattaggagaatggctaattttatttagattaattttatgtatttctttaatgagcaagtgaaaaaaacttgggaaaaaagcaggtgcccttagcaacaaattttctctttatttagatattgaacgttggcataaataccaggatgacagttcataatatccttctccttcagcagggaagactaaaacagtaattataggcctaaagaatgttattacaaaaggggaccttccagtagaaagaagcatatagcaataagattcaactcattctaataataataaagtattcagacaattttggtgctatagagaaccttttaaatgttcaagggacattttagaaggctggagaggtaaatgatttgtctgtggtcacatatcacattggtacaattaaaattggaattaaattcagatgtgctaactcttgagcctcttccccctccccacgctaggtacaccaggctgcttagttgaatttaactgtctaatgtgaaattagctcctcctctaaaaggttttaagtagaagttctttgataaagagattggttgacttgtatgctctcctcttttgacttcatttaatcccaaagagttatttagcttcttaacgtatttaccagcccccaaccccctcctgccttggtctgctaactcttaaccttttcttcacttcctttcctattgagtttagacttcattttagcaaccaacagaagccagctttggctagtttaagcagaaatgatattaagagttattagttacctcacacattcttcaggagggccaaagaaaagagggagccaggaacaaacttcagaatcacatcacgatgatttcagtgctcacactgtgtgcaacacattctacagtgtgtgcggtgtgattattgatgtcaagcgcagaatgctaccactagaactctgctgctgtcttagtggtaactactgcagttctctccagaatgggttatttctttgcttgtgatgcgcaagaagtgctggatgcatactaccaacctcattttgccctaaatgcttccaggcagtccttttgtgtgaccacgggtaagtttttctttttctacaagttacttaaaatttttacaattttcttatctcccagctccaacattatactaaagagtgggagctaaaggaacatatgaatgagtgggggaatttttaacattgtttaatagttaacatagacaaatgactaaaattacacataagggcctgaaatgaattaccaacttgaaaaaaacaagtaaaattttatgaaagaaaaaacccacaatctacatcattttttacataaaagctggatcaaagaaaaaaaccaagttcactggtttttgctaataaatcttattattttagtgttcaccacataaaacaggcttttaaaaaatttccctaattttaattcaagatgaatacagaagaacatttcctacctcacctactaagttatatacccactcccagaacctaaaatatgcaataggtttgttaatagtgcctcgaggaccatggcacacagcagtcccaatgaactgtgttactaagctaggtcctttcttttcattcagcattctgagacatctctgtcaaatcattcctgagataacagagttcattaagatagacagctacattatttaaatcactaaagtcttatttttattttttgagctggtgctaagaaaagttcaggcaatgaagtgttatgtcattcatcaaatcaggaaccatagaaaatggagatgcttgactgccacgagtctactaattatagtgctgaatattcaaaggacatttttaccaccaagaacttcatgagtgttttatgaaggaatagttgacaccatctttagctgtgatgccaatatttggaaatctttgaaaaaacaaagagggaaaaaagatggagacgaggtttttaatctttccagaaaactttaaaaatgtctttagaaataaacaagaacataatagccctgtaatctggttctgctcttcatatattaatagtatcctaactcacacctcctgtaccttaagaccttgactactcacaatgaaataaactgctggatgccaagaagttttactcttccttccagttatttaataccacaatgccatgaacaaaatagcaatgagtaaacatttgtaagtaaatttatatttcaaagtcacgaaacattttagagcatgttgatctcatgcactatcaaagataggcaaaatggtttaccatctgataattccaagtcaaaatagtatataccaatttttcaatcaaatcagtttttttcctatttttatcttaataagactatacttttctggttaccagttcaaaaagaaaaaaaaatttatgacattatggcttaaatttacctttttcatgaagcaccacttcacgattatgaagggttgaaaatagcccttttaactcccgtgctgtttactgtccctgccaaacattagacatttactgcttatgtagttaattgtctttattgtataccatcaagattaggaaacatgggccgggcccggcagatcacgaggtcaggagatcgagaccatcctggctaacacggtgaaactccgtctctactaaaaatacaaaaaatttagctgggcgaggtggtgggtgcctgtagtcccagctactctggaggctgaggcaggagaatggtgtgaacccgggaggtggagcttgcagtgagctgagattgtatcactgcactccagcctgggtgacagagtgagaatctgtccccccagcccccccaaaaaaaaaagaaagaaaaagattaagaaacacatcctgaaaccagactgaatagagcccagcagcttggatttgaatcttcactctgtcattcactagctttggtcgattactctttgtttctcagttgtaaaatgagtatgaggattaaatgagctaatacatatgtagcacttaagtcagtatttggcatagtttgttcttaactgttacccgagattttcttttattgattctctgtatatctgggacagtgcttgataattgcatgtggtccctgcttttatggggcttacagactggtggggaggaaaatatacacagactataatacaacctgatgtgtttagtgggcagaagaattggggaggcaagatagacaagaaataaaggaattcagcttaacagtttttcttcttggtgggacaatttgttagtaggattattctgatttttgtccattgtcattgtcagtgattggaataatcttaaatgctgttcctgagatggaatttaccaatgaacacagcagatacagtattcctcatcagctctgggtggtacctaagcattgcagatgttcgttcaccaagcaagcatttatttagaatttaccaccatttactagctggggttcctctcttcaaatagtttagggtctgagaagtaaaccagcagttattgtgcgtagttacagtaagtggagaggtggtaatgaacaggaaactggaagtacaagggagaaacttttagactaattcagacctgagatacattctgatgtatctcagattatatatactttgactttcagaagtccctccagctcccaagtctccattccttttcactgagcttcacagaaatattgatctggtctaggtttgagggaaaaaattaggatgtagagatttctagcccaagtcatctggccccatctgttcattattacttcaagtggaatagagagtacttacctatttgttacctatcaacccataaataaagcttttcccaaaaaaggaatactctggtctaaagtactctgagatttagtctttggtacgcagaatcttagaaatagatttttcttccgtttttccttctctgaatctgccacctaagaaattttgagatttaaatatgtgggagtagaagggaaaagaaagaacaagggaggggtgtgtcttgagaatcattattctccatttgactttaggataggcattttcaggaaattctcatggacccagttagcttatctgggggagtctaagtggttaggagcaagataggcacaagaggtgaaagcagaaagggaatacaaaattgtcttagctttgcttggtttgcttttattagttttcttaagctattttcattttatttactgttggaatctataggtctttttcaaggacgtgtttaggtaggtgctaactttggtttggttttaccaaagcaaggagtgatcatataatgtaagtttaaaaagcttagcaaacttgggtacagtaacttttaagagcatcagttttttcatttgcaaaggaaaggtggtgaaataagtagatgatgtcttatgtccactagggggtagtgtgtactgtaaaaattaaaatagttcctcagtgaactctttacttcatcattcagttagcttgtttgaattaatttttgttcatttaatgtgttttgaaattgccataaatttttttcaaacacaatcttgtgagtgtagcaaacagcaactgttgttacatgcatttctgttattagtgatgtcaaatgttctgacattacttttttttttttttgagacggagtttcactcttgttgcccaggctgaagtgcagtggcacgatctcggctcactgcaacctccgtctcccaggttcaagtgattctcctgcctcagcctcccgagtagctgggattacaggcatgcagcacgaggcctggctaattttatatttttagtagagacagggtttctccatgttggtctcgaactcctgacctcaggtgatctgcccgcctcggcctcccaaagtgctgggattataggcatgagacaccacgcccggcctgacattactttttgtatagaattttttgaggggaaaatagtgatgctttaaagtttctgtacaaaattttacctattatatgaaataaattaaattattcataatgaccaggcagtaacattataacatgattgtcttgtgtttcactctccagactaatttgggagccactaatcattccatgtggctgttgagtagttgaaatatgactagtttaaattaacatgtgctacaagtgtaatttgcacagtgggcattgaaggctatgataaaagataaaatacatcattaatttcatactgatttcatgttgaaataatattttgaatacatttttagataaaatatattaaaattaattttacttgtttctttttacttttttatttggctactagaaaatttttaaatacttacgtggcttgtattatatttctgttggatagcagtgctgtggagaaaagtactcatcagccatttttatcttagtgtatctctaggtggccttatgatttgtaaggaagtagtgtaatggggagcttgagcaaaactttggttctatttctaatcccagctagaaaataggcagtcagttttactataatgagacattatatgtttctaagaatgttatgttatacaaaatcatgtagtaaaattcacagggcttacagataaaatgaagcaaggggtatgcacttgaaaatgtccattgatgataattaactttttgttttgttttgttttgtttttaagagacaaggtctcactatcgcccaggctggggtgcagtggtatgatcacagctaactgtaaccttgaactcctgggctcaggcagtactcccacctcaacctcccaagtacgctaggactatagtcatatgccagcatgcccagctaatttttttagttttttggtttgcagagatggggtcttgctatgttgcccaggctggtggtaacattttttaaatgctcacttattgggccaagtgtggtggctcacgtctgtcatcccattgctttgggaggccagggcgggaagattgcttgaggcaggagaccagcctgggcaacatagagaaacccatctctacaaaaaaagtgataaataaaaatgcccacttatatatatagagggtgaacttgcagattctcataagtaacttacagttgtgtacataatgaagaattgacttgctttattagtgatcccaaaaaaggagcccgtttgttttatcttacaaatttttcataatttttttctttatttaaattttttttctataacacacaactttgtccagaaccctgtttgttaatattttagaatcgcttaaagatgtagtgacaggttggagtttacagagtaggtatcattgaagcatcactcagttttttaacacttatttttcagtaatgaaattggcagttactgagttatcagacagctcttgtttgagatgagctaaaagatctacagttgatattactggtcatatattgcaattttgtgtttcagagaatattctaaaaaacctaatcactgtagacaggatgcactgggatatagatagttactaactggaccaacttttctcacacacaaattagcactttttctaagaatactgtttattaccccaaaattttactgtacatactccaatcattgccttgcagaagagcatctaagacctgtcattgcttcgtactgagcacaaattatttttcaacttaaaaataagagtcctggttaatagagataggttgacagaatgtcagttgttataattgactaactacagtatagtttacagtagtgtgagtctagggtttgctcttcaagacccagtagatctgttgataattagatcaatttgatgtgatatttgattccttttaaaaatatttgtagcattaactattgtatgcgttctataagatgagataccttcctttagacttaattttgtggacatttaaatccataccctattcctttaccaacttacctgtctattttagtaactaacttcctgaacatagtctacattaactaatttcctgaacatagtctacagtgctttctattatgcatggccctaaactcacttctgtttgggattcaatccttggactgcttttaaacataatagaatcacaaaattcatttaagggttattctgtttttctgtaaacaactatggccttcctatgtgatctcatttgtcaacttttttttttttttttttttggtagtgatggggtctcactatgcttgcccagcttggtctggaactcctagcctcaagtgattcccctgcctgcctcagcctcccaaagtgcagggattacaggtgtgaaccatggcatcccacctgcaatgtaaattatttgtgccaaaagatagataaggccgggcgtggtgcctcacgcttacaatcccagcactttgggaggctgaggcgggcagatcactttaagtcaggagttcgagacctgcctggctaacatggtgaaaccctgtctctgctaaaaatacaaaaattagccaggtgctcacttggacccaggaggcagaggttgcagtgagccaagatcgtgccactgcactgcagcctgggcaagagagcgagacttgtctcaaaaaaaaaaaaaaagatagataagtgaaacagtaggaattttagccctttacttcttcacttaaagaaatcatactgtactctgtctttccaccaaagaatagtgtaaaaccagaaggtattttagttagtcatgtgttgaatagtggccggaaagattttatttcctagccagtttttgcctttttaggaaaaaagttgacatcagtttctgtggttgagactttttcagatgctgccatttcagacttgtttcatttagtttggattttattccttttttcccctcccacagtttatgctgtgggtttgttagggaaaccaacagtttagtgaaataattatgcatgtttttgtgtcagtccattagaacttgagagcagcatatattataaggactatttcaaaatgttttctacacacgaaagcttattttagaatgtgttccaattaaatctaggcttgatcaggtcacatgatgtgcttaatatgtacattctttacaaagaatatctgattttgagggtgaactgaagatgagaaagtaaatgccatacctatctctgccactgtgtattgagagtgattttgaagctattttgggatacgcttttggaggcctttctgtagctttttatagtagatacagagctgctactactttgtgtaactggtgagtggtggattgggactcttgggccctggctttcttttttttccagtcacccaatttatggctttctaaaaacatgaagacctggggtaaaattaaaggatggaggtgaggagagcccagaattcaaggaattttaccatccagttattttctcatttttctactcctgctattcatccctaatatcttaacttttttcctaaaaaatgaagaccagcctcttttgttctggtcacatgttaaaggacttcccaaggtcagaggcttcattattgcctcttgagctttttaatactctaaaaatgttttagtttgaacctaaagaacatgtcagtttctcacttgctcttacatcgccatgatcaaaacaaaaaactagtcttaaaataccagagacattacctaaaatggccatgggtttaattaacacattttggggaagcatttgatttgtatttacatcttatgactatttcagtatattactgtgctgagagagaagttatttgttgttgttgtttttaacgtatgccctgtagcttgtggaatgaaacagtttatgatgtatttttttttaggtgaaggcagtgtaaataaaatgttctcatttattgtttttcatacctaaaagcttatttaaatatgaacatttttctggttaaaaataaatataagtagaagttagactatttttccccatacctgagtggctccttttgttttccttccataatgtgcacatcctgccttgaaaataaccctgccttaatgatgttaacgatgaaattctgatcgtttatttccctcttttcataacatcaaatagattcagaattcagtaaatattaattgaatatctattgtgccaggcagtgttccaaatgctgaggatatagcagtccataaaatagactcaaatccatcctctcatggagcttaaattctgaacaaaataagtagaaatgagatttgttagtagtgctgtggagataaagccagggagtggggatagggagtgtgcagggtagggttgaatggggtttgcaatttcagttatgatggcttcactgagaaaacatgaagatcttaggagctgagggagcaagccatatggatatcttggggaggaagaggaagtacaaagcccttgaggtgagcggatgcctggcacgttgaagaactacaaggaagctaatttttgtctggaacagagaaggttaggggatggagagagaacagctgaagataagtcagagaggtaggtggagtgagggcatcatatagagcgtcttttgggggcccattacaaggactatgactttttttttttttttttttttttgagacggagcttcgctcttttgcctaggctggagagcaatggcatgatcggggctcaccgcaacctccacctccggggttcaagcgattctcctgcctcagcctcccaagtagctgggattacaggcatgcgccaccatgcctagctaattttatatttttagtagaggtgggatttctccatgttgatcaggctggtctcgaactcctgacctgagccgatccacccgcctcggcctcccaaaatgctgggattacaggtgtgagccaccatgcccagactttttttgagatggagtctcgccctgtcacccaggctggagtgcaatggcacgatctcagctcactgcaacctccgcctcctggcttcaaatgattctcctgcctcagcctcccgagtagctgggattacaggcacgtgccaccatgcccggctgattttgtatttttagtagagatgggatttctccatgttgatcaggctggtctcgaactcctgacctgaggtgatccacccgcctcggcctcccaaagtgctgggattacaggcgtgagccaccgcacccggctcaggactatgacttttaaagggtctgtggataatagacctgcgagggaggtagtgaggtcagaagcaggaagaacaggttaggaggctgttgtagtatgccaggtcagagctgatggttgcttggatcagaggtgtagcagtggaatggtgagaaacagtccaatcatgagtagaatttgaagtataaaaaaaaccaatttgccaatcaggctagatgtgtgtggcatatgaaggaaaaggtggatcatttggaaagatgggtttgccagtaactgatgtggggaagactttatgggaggagcaaaggttggggatagggaggtcatgttaagtttgggatgcttattagacattcaagagtgtatatcaagcaggtagttatagaggcaagaggcacgatgaggggagaggtctgggctagatatgaattaggggaggcttcagcttatagagtgtgtttagtatttaaattcattgcattacatgagatcactgtggaaatgtataaacagagaggaagccctagaatagagccccagtgcatttcagtgttgcgatgttgggagatagaagaaaccaacaaggaaactaaaggaagctgctgccagacaaggaggaagagagccatgagaatgtttataggaagttagataaagctttgcaaagaggaaggagaccagctggataagatgtcgcatttaggtaagataaagattaagcactggacatttgatttaaccttgtggaaatcattggtgaccttaacaaacaagttagcgataactacagcttgattggagggtatgttcaagacagaagaggaggagagaaattggagacaagcaaagtagaggttcctcttcaaagactttcctccccatctaattaggaataaatagtaacttctcttagaagcaaaatttattcgaagacctgtgcaaacattcttaaatatttgctagccataataaagaaatcaatatactttatgttcttagctcccacaatttagcctaaatatttgccctggcatgcttatactggtccaagcaagcattaggtcatagcctgttcctcttccttatttaaaagtgtttttacctttctcagcattccacaagttacttcctccttcctttgttcccctctacctttacctcttttaaaaagttctaagttgctagccagtcaggacaaatacagaatgtgagatcccgttccagccagtggaaaccggacacagcagtagggtggacgcgtcaggttataaatgaccctgtctcctttgttcagtatactcttgtggcaaaactcctggcgagtgtaccctttctgcaggaagtaaaaatggctttactaaataaattaaatttatgttcaagtgctatttctttatggtaccgaagaacaaacatttcagagatcagtaagatctagtgctcaagaccgattggccctagccaagagtacgtgacatttcatctatacaggagaaaaaccagagtgtatgggtgcagatgcagggaaatgtccaaatgctacagtgggaactgatggaagtatctaacttgtcatgaaataggaagcaggacatcagccacaagtgaggatggggatggagatgctggaggtttgaagagagaagagaaataataataatacaattatttaggggagagggagaatgatgaaaaagagaactaatggtatgattgttgggagtattaagggttcctctgaagttaattgtcaattttagagtaatcagcattgttaaatatatttctttagtcctgttcaggtacctgggcctcttcttatctcctttctttagtccgttacatttttcagaggggaggttttcagtgggtttaaaaactaatttttggccgagtgtgttggcccatacctgtaatctcagcactttgggaagccaaggcgagcaaatcacttgaggccaggagttcaagaccagcctggccaacagggtgataccgtctctactaaaaatacaaaaattagctaggtgtggtggcgcacacctgtaatcccagctactcaggaggccgagttgggaggatcacctgggcccagggaggtcgaggctgcagtgagccaagatcttgccactgcactccagcgtgagtgacaaagtgagatcttgtctcaaaaacaaacaaacaagccaaaaaaaaccaccaaaaaagctaattttactttttaaatagcttggttttggttgagtttagagcaagttgccttacttatgtaatcctaatgttactttattttacttgagtaaaaaatcagttttattaagctaattttattaacatatttgtagacatttgtagccaaaatgtatgataacatcattagtattcgcttgcagtttcattcagctggttgtaattatttaaatggtatttttttgaattttgcattttataagctaaatctgttgggagattggagctgttctattatgcgtagttctaagagatgaactttctaattttacttttggtgtctagcaaaatgacatttgtttcacaaatgtgtttgtttttctgtcataggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaaggtaagtgttatctttatcagcatatgctattattaagctttctcctttttctcttaagcattccatgtttagaatgtaaacattatacaaagatcagagaggtctgtgggagggaagtgaagcagttctgggcctgtttttttcatgctttatcatactgggcctgttgccttcatagataagtggtccccagcactgcagatccgcacagttctgctatcgatccaggccttgttaagtgctcccaatccagatgatccattagcaaatgatgtagcggagcagtggaagaccaacgaagcccaagccatagaaacaggtatctaatattcattctccttcacaccacttccacttttacaaatttgtattaccacttaaacttttctaaagctcttggcaaggaaaagaaatagaaaaaagtataataagtgagatcctgcttatagtatgtaaatacgtcttaacaaaatggcttgctatgggaccccccaaatataaagacaacctgtaattgaaagatcttggagtctcttgtaactacacctggtttaacaaatactgagtgcataccatttatctagttatatgtaaagaatactggaaaacttgaactgtttttgtaacccatttgattaaagtattcagctgtttatggctacggaatttggagtcaagaagcttctgctacagattttaagaaaattagtggggagaattgtgtatctagaaatggacaacttgattcatcctcttgaattttctagaacttcttaattttattgtagtgttttggtaattggacatttacaaaatctttcagccctgatccaatttatagaaaaaggcgtgaatttaacagattacagcatgacatttccataattaatagtggttgtttgccatttatagtttggaaagtaacatattgaactaagtaaaataataatcgtatgtttgtttctgtctacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattctactttgcctttgtacagtttattttactgtgtttatttcattttcccaatttgacaatcgtattttaaaattgaaactgatggaacattctttcttggtcttcaccatctgacaaattgaatggcaagaggtggattttgccagtttcttttcactgatgcagatttgtgttaagatagtactgaatggagtatttataaactggccctgagcatgcataaagcatcagtatctgacctttttttaaccttctaggaatttgaaataaatgtgtttgtgttgtctgattagatgatcattggtgtcttgccacaatgtttaaaaattactgtacaggaaagtcacagcaaagatagcagttgtgactgacatgtaggactttcacagttgtgccacatttttgcctaaaatttgggttatgacatttttcttggttcttatctgaaaatttcatctgtaacctttcatgtgtgttaagaaacactgatctgatcatttgggatttgctgaggcatttgtgagtcttccttataaacctgatgagcagatctcaactatctagcttgtgtgtcatcagaaaggtttatccctttgagagtatcaagtcctcagttaatgattcttgctttcatccctccagtatttgctgtgggagctcgttttattctttaatttggaattcagtaatttttcttctttattgacgaattcctcccctcacaaaactgttctttcccacctctctccatatctaattcctgattcttgttatttttaagtcataaatgtagccagtcataaatacataaatgttaaccttcgggttgcaaccttgtctcttgcagtttaaggtaatggatattgtagcccatttgaattttcttcactcttattctcgtaattctggagtttcttcagattgtggtgtattttattgtgctcctatgtaagatgaagaattaactattaaaattacattttcaacatacaaaagcttttgatgactggtaactggtatccttccaaataaatgcattgcttggtaa

SEQ ID NO: 35900 - DNA, 33939 bp, Homo sapiens; identical to SEQ ID NO: 35899

SEQ ID NO: 35901 - DNA, 3295 bp, Homo sapiens
ctcctcctgctgctgctgcgccccatccccccgcggccggccagttccagcccgcaccccgcgtcggtgcccgcgcccctccccgggccccgccatgggcctcaccgtgtccgcgctcttttcgcggatcttcgggaagaagcagatgcggattctcatgggtgaggcagatcgagcgcgcggcccggaccggggcgccggccccggcgcagcccttccgcccccgcgtccctccagccccgctcacctgggtctctggccccgagtcacccacctcataacgccccggggcctctgctctcgggcgggtcccggtctgcatcgccgaccccggggcctgacacccggagctgcgggcctgggtggggtgaagctccctccgccccagcccggctggtaagaagggaggattccgcccttggagacgacttttaaaacgagcgcggcctacctcccgtgccccttgcctcccagtcctctcccgctccgcgccctctttggagttggctcacgccacccgactgccctccaggcctcaaaggtagataacgacgcgcacctggaggcgctcccgctctccgccccagtcaccatcagctgttgtggcctctccctttccctggtctctagggggctccctcgctcccatctccatccctgtgcccctttccgttgcagttggcttggatgcggctggcaagaccacaatcctgtacaaactgaagttgggggagattgtcaccaccatcccaaccataggtgagcccggggacgaagcagggagcgggagcgccgcggcgggccctcgcggggtctgctcccagttctgccacttttctggagctgaccctgacaccagatacagctatttgagaagtgggtcagggtatctctacgtggataccggaggcagggtggatgtgacctagccccgccctgttgaccgccagttctggggttctgttcccctgggccttgatcattgccttctggttttgtgtccctgctgaaatctaagtagttttagtgagttcctttctttcaggagttttctcatcttttttttccaattatctgcaggcttcaatgtagaaacagtggaatataagaacatctgtttcacagtctgggacgtgggaggccaggacaagattcggcctctgtggcggcactacttccagaacactcaggtggagtgttgggaggggactttctaaccccacgggaaaaggtgttagggctgggagaacagaattgttggcctaggctgggcccccaggccaaggaaaaaacccttccccacttctaccccttctgtttggctatcccctactcactcttcagaactcaccttagtcttccccagcttggacttctctttagaagcaggattctgggaccaggctgcctgatttagccctcataacatgtctttatttccttgcacatctttggataaactacttcctctttgcagtggggtctctagtttgtgccatgactcctgtagagcttctatagagttctgtaaacttctgtagagtttactagatgagaaggattgacacaattacaaatgggaagaaaacagaaagggccacactacggtatgtcccaggcagaagtgattgcttctcctttcttccttccttcctgcccagggcctcatctttgtggtggacagtaatgaccgggagcgggtccaagaatctgctgatgaactccagaagatggtgagtacccagagccctgggaactgagccctcagcttggggacagagtgatctctgtagtggtatagaagtcagggagcccccaacaggcattgaagaccaggaatataagtttttctttgtggacagacacattgtgtatctcaccctgttttggatgggagtgactttttcactttttctgtgcattgtcttgtctttttttttttttgaaatgggagttttgctgttgttgcccaggctggagtgcaatggtgcaatctcggctcactgcaacctccgtctcccgggttcaagcaattctcctgcctcagcctcccaagtagctgggattacaggcgcccgctgccatgcccagttaatttttgtatttttagtagagacggggtttcaccatgttggccaggctggtcttgaacccccaacctcaggtgatccacccgtcttggtctcccaaagtgctgggattacaggagtgagccactgcgcccggccgcattctcatgtctttacatctgagtctgagaagttgtgggagagatgggacttatatgtggcaaagagaaacattttacattcctgccttttccatttggaaatgttgtcattttgcctaggcaagtactcaaattaggaaaaggtctttcttttctggacttatgggctcaggtcacctcaagctcatttacaactatgtcttgtcttcaacggcagactgcacaatactttttttttccaatcaagatgctaggaggtagaaagggaattccccaacacagtagaggagacgcagcctgggtcccaccttctcttctcctctctcagctgcaggaggacgagctgcgggatgcagtgctgctggtatttgccaacaagcaggacatgcccaacgccatgcccgtgagcgagctgactgacaagctggggctacagcacttacgcagccgcacggtaggggtcctgcccacctggtgctgaatcctgcctcttgagggaagctgcaggctgggacagagatataaaggcattccttttgttcctggttgctgacctctttctttccttttccccacagtggtatgtccaggccacctgtgccacccaaggcacaggtctgtacgatggtctggactggctgtcccacgagctgtcaaagcgctaaccagccaggggcaggcccctgatgcccggaagctcctgcgtgcatccccgggatgaccagactcccggactcctcaggcagtgccctttcctcccacttttcctcccccatagccacaggcctctgctcctgctcctgcctgcatgttctctctgttgttggagcctggagccttgctctctgggcacagaggggtccactctcctgcctgctgggacctatggaaggggcttcctggccaaggccccctcttccagaggaggagcagggatctgggtttccttttttttttctgttttgggtgtactctaggggccaggttgggagggggaaggtgagggcttcgggtggtgctataatgtggcactggatcttgagtaataaatttgctgtggtttgt

SEQ ID NO: 35902 - DNA, 68025 bp, Homo sapiens
ggagctgttgcggggtccgcggggaagtcttggcggtggagccatggtcggccaactgagcgagggggccattgcggtgaggaggtgccgggggctgggccggcggtccggggtggctgcggccccgagcctcgcggagtagagagggggaggggagcccggggcgacgggggatgaacgcgaggggaggagatggcggggggcggtggggacccgccgggcgtccctctagtgtcatcgccccctcctcaaagcattctttcgatcgtctttaaaacatgctcacatttttcctacgtaagaacaaactaaataaacgcttgcctttctctgcatcttccacctgcggacactttctgtctcttctcctttccccacccacagccaaacttcttgtctggtttcagccacttcctttcctcgcctttcatcaactctttaacccactccagtcatccctttgatcgctgtagaaaaccctggctgaaggtaccagtggcctccaagttgctaaatccagcccttttccgttttcagcttacctgagttctcagcagcgtttgcgtttaagccctgcttgcttcaggtcacaccctcttccttggtttttagtggctcagcttggcaggtctatccccgtcttatttgtaagtccctctttgtaaatttttgttgaatcaaggctccctctaggccctcttgactcccgaggcaatttctttttttttctccagcctgggcgacactcactgtcgcccaggctggagtgcagaggcgcgatctcggctcactgcaacctccgtctcccgggtgcaagtgagtctcctgtctcagcctcccgagtagctgggactacatgtgtgcgccaccacactcggctactttttgtgtttttattagagactgggtttcatcatgttggccaggctgatctcgaacaccagacctcaagttatccgcccgcctcggcctcccaaaatgctggaattacaggcatgaaccaccgcgcctggccccaaggcaattccattgccatctattaatatatgtcagttgctcacaaatttctttgtacagagccacctttactctaaaagacaaacttccgtcatctgtctgcttattccatgcttcagagggttttaagttcagtatacgtatcccaaagcaaattctttatctttctaagtctgggcctcttgatccctatctccacggatggcaccattatctattcagttcagtgctaaccagaaattgagaaatcattcctcctatattgtccattacctgggcatccagtccctcacgaagtgaagtgtattttgcctctgcgtagatctatcaagcccactggcttctctccatccatactggcaccgtctttttttttgcctgagctgctgacttccactcagcatacgttcctgccaccattcccatccacagcatactctcagcctacctctccagtcacccccacatttttttttaaatttagatttctggtatattccatactcctaccttcttccatggggcctttgaacttttttttttttttttgagctggaatcttgctctgttgcccaggctggagggcagtggcgcgatctcggctcactgcaagctctgcctcctgggttcacgccattctcctgtctcagcctcccgaatagctgggactacaggtacccgccaccacgcccggctaattttttgtattttttagtagagacggggtttcaccgtgttagccaggatggtctcgatctcctgaccttgtgattcgcccgcctcggcctcccaaagtgttggggttacaggcgtgagccactgtgcccggccttttttttttttttttttttttttttgaggcagagtctcactctttctccccatacccccccactaccgccccaggctggagtgcggtggcgcaatctcggctcactgcaacctctgccttctgggttcaggcagttctcgtgcctctgcctccagagtagctgggattacaggcatgtaccaccacacctgcgtaattttttgtatttttagtagacacgggggtttcaccatgttgcccaggctggtcttgaactcccaaccttaggtgatccaccctcctcggcctcccaaagtgctgggattacagaagtgagccaccgcacccggccctgaacatttttttccctctgcccactgcctgggtggttcttcactcttccccacactggcaaacactatcttcgtatctcagctcatttgtgacttcccttactaggctaaatccctttgagaccccaattcctgttcattcacttattgaattatttattttttttctttttgagatggagtcttgctctgttgcccaggctggagtgcagtggcacgatcttgactcactgcaacctccgcctcctgggttcaagcaattctcctccctcagcctcccaggtagctgagaatacaggagactgccatgatgcccggctaatttttgtatttttagtagagatggggtttcaccatgttggccaggctggtctcgaactcctgacctcaagcaatccacctgcttcggcctcccagagtgctgggattacaggcgtgagccaccgcgcacgaccccattcacttattagatgcatgacttgaggcaagatactaaactgtttcttttctgtaaaatgagagcaatgatatctattgcataaggtaagtaggaggatggagtgagttattaaatttaaagtgcttagcacactgatacatagtaaatgctcagtgtttatgttacctattaataattgcagttttatgtttgttgatttatcagtttctttttaaaattttaaaattattgtgtttgtttgtttgtttgttttgagacagagtcttgctctgttgcccatgctggagtgcagtggcacattctcggctcactgcaacctctgcctcccgggttcaagcgattctcctgtcttagcctccctagaagctgggattacaggtgcccaccaccacaccctgctaatttttgtatttttagtagagacagggtttcgccatgtaggccaggctggtcttgaactcctggcctcgagatccacccaccttggcctcccagtatgctgggatcacaggcttgagccactgtgcctggcctaatactttgtgtaaattccatgaggcctgcaatcatgtctgggttattttactctgcattgtatccccaatacctggagaagtgctggcaagttttaggtgctgaataaatgcttgctagttgcatgaatgaatgaggcagtgggaagaaagggacaggtgaatggggaagaaaggcagcttgggggaaaaacaggaacaggaagaactattgttggactcaagtgaatatttaaataaattaggaatgtgtgaatgctgaaaccggggaagtgattttaaattgtagctttcatttactttatagctgctaccttgtgtctttaagacaaattaagaatgtttctaggccaggcgcagtggctcacgcctgtaatcccagcattttgggaagccaaggcaggcagatcacctgagattgggagtttgagaccagcttggccaacatggagaaactctgtctctattagaaatacaaaattagccaggtgtgggggcgcatgcctggaatcccagctacttgggaggctgaggcaggagaatctcttgaacccgggagatagaggttccggtaagccaagatcgcaccattgcactccagcaacaagagcaaaactccatctcaaaagaaaaaaagaaaagaatggttcttcacttttaaaaagactgatcatgggccaggcgcagtggctcatgcctgtaatctaagcactttaggaggccaaggcaggtggatcacttgaggtcaggagttcgagatcagcctggccaacatggggaaaccctggtctactaaaaatacaaaattagctgggtgtgttggcgtgtgcctgtaatccctgctgcttgagagcctgaggcaggataattgcttgaacccgtgaggcagaggttgcagtgagccgagattgcaccagtgcattccagactgggcgacagagtgagactgtctcaaaaaaaaataaagaatgatcatggagatatttaaataatttgataagtttttttattttttagagatggggtctcactctgttgcccatgctagtctcaaactcctgggcttaagcgatcctctcgcctcagcttcccaaagtgctgtgattatagatgtgagccactgcacctggccatgtttttatattcaaaattttataaacctatttccagcgtaggtgaagtattttgttcataaatgaagaatgaaagtttcacatgtgtttgtggtgatggaatgagttggagaacctttgctgactttcattatcagctaaagcaggtatcattttcgttcaaaagacacaggccacaaagggtacgcaaataccacacacatgtgaaggcgtttgggcaagagtcacatgataaaataagagatgatgcatagaactcttgtggtcaacagaatacatagcatttgtatcttaattatataacgaaaggggaagggaactaatgtttttgactatttctaatgtgacagatgctttagtagtcagtacttaagtaaccctagaagatagctattatactcccattttacagaggaaggaagtacagagaggttgaataatgtgtccatggggtgaagatttgaacacatgtgcccttgagtattacatttgttgctttatatacttactagggattttttttttaaagggtctcactctgttgcccaggctggggtgcagaagcacaatctcagctcactgcaaccttcacctcccaggttcaagtgattcttttgcctctgtctctcgattacagacgtgcgccaccacgcccagctaatttttgtatttttagtagagatgaggtttcgtcatgttgtccaggctggtcttgaacccctggcctcaagtgatctgccgcctcggcttccccaagtcctgggattacagacttgagccattgcacctggccgtaattttttttaaatgacagagtcttgttctttgtctctcaggctggagtgcagtggcatgatcatagctcactgcaacctccaactcctgggctcaagtgatccttccacctcaacctctccagtagctgggagtacaggtgcatgccaccatgcccagctaattttttttttttttaattttgtgtagagatggggtttcgccatcttgcctaagctggtctctaactcttggtctccaaacagttctcctgccttgcctcccaagtctttgggattataggcatgagccactgtgcctggccttgtcccttaaaatgagttacatttgtaaacagctgatttctttggagcatcgtccccatatacttttctttcataagtgatctcatccttcttccacccaaccttccccttgaatttgttgtttgttgttgtttccattttagcagaattcatgttgctctgataggggctcttttcaaactgatgtcttatccttcttagtacctcaaactaggtcttgttcagacatgttataacaagttagtatgagtttattttagtgcaaaaaaaatttttgaaatgcatgcatagttttttcataatgcacatttttcgtgtactttttgaatccccctcatacatgcacgtggttttaaaatcaaacggaacagaaaggtgttcatggccgggcatggtggctcacatgtgtactctcagcacttggggaggctaatgcaggaggatcccttgaggccaagaaagagtttgataccaggctgggcaacatagcaagatcctgtctctatttcatttagaaagaagaaagaaagaggtgtttaatgtaattactgacctcctgccttaccttgtccagtactgttccccagaataactgctttttagaaaaatcactgtcattgacattttgcttacgtatagtaaattgcaccttttttatttatttatttatttatttgaggcagagtttcctcctgtcaccctggagtgcagtggcgtgatctcagctcactgcaacctctgcctcccaggttcaagcagttctcatgcctcagtctccttagtaattggggttacaggtgcacgccaccacctggctaatttttgtatttttaatagtgatggggtttcactatgttggccaggctggtctcgaactcctgacctcagatgctcctcctgccttggccttccaaagtgctgggattacaggcataagccaccatgcccggccaaattgcacgtattttaaatgtacagcttgatgaactttgacaaatgtgcgcacccctgtaaccacattgcccctgtggagatatagaatacttccatcaacgcacaactcctcttgctccttccccacctccatcctcaccctaggcaaccagtgttctggtttctacctttgtaggttagttttgcctttcctaagacttcatataaatggaatcaaataatatctatccttttgtgtctggcttctttcagcagttttttttttttccccagaggtagggtctctgtcacccaggctggagtgcagcgacacagtcatggctcactccagccttgacctcctgaactcaagagatcctcgcacctcagcctcctgagtagctgggactacaagtgcatgccaccactcttggctaattaaaaaaaaatttttttttttttttttgagacacagtcttgctctgttgccagactggagtgcagtggcgcaatctcagctcactgcaacctctgcctcctgggttgaagcgattctcttccctcagcctcccgagtagctgggattacagccgcatgccaccatccccagctaatttttgtatttttagtagagacggggcttcaccacggtggtcaggatggtctcgatctcttgacctcgtgatccacccgcctcagcctcccaaagtgctgggattacaggtgtgagccaccacgcccggcctaaaaatattttttgtagcgatggagtcttggtgtgttgtccaggatgatcttgaactcctgggctcaagtgatcctcccaccttggcctcccaaagtgttggggttacaggcacaagccaccactgtggaccaaaatggtttttgagatttacccatgttaattcagtaatctgcacctttttatggctcagtagtattccattgtatgactataacaaaatttgtttatttacttattattgcacatttgggttattttcatcttttggctattataaatgaagatgctatgaccatttaagtacaactctttttgtggaaatatgttttcgtttctctgggataaatatctaggaatgtaattgctgggtcacaggtaactgaatgtgtaaaagaaatcgccaaccttttccagtgtgatcatgagaattctagttgctccatatccttgccagtcatcagtctttgatttcgagtattctagtgaatgtgtaatggtatctcactgtgcttttatttgtatttctctggtggctagtgacgttgagcatcttttcgtgggcttactggccatttgtatatcttcacgaaagaagtgtctgttcacatcttttgttcacctaaaaattgggttttgtgcttattaatgagttgtgagaattcttgattcttgctaggtcttttgttaaatataaatattacatatattttttcccaatctgtgacttgccttttcttttttgaaattttgttttttttgaagtgcacttttaaattttcatgaagtccaagttatcaggttgtgtttttttgtttgtttttgttttgttttttgcagagttgtgtttgtgtgtcctaagaaatctttgctaggctggatgtggtggctcatgcctgtaatcccagcactttgggaggctgaggcgggcggatcacctgaggtcgagagttcgagaccaacctggccaacatggagaaatcccgtctctactaaaaatacaaaattagctgggcgtggtggcaggcacctgtagtcccagctactcgggaggctgaggcgggagaatggcgtgaacccgggaggcggagcttgtagtgagccaagatcgcaccactgcactccagcctgggcaacagagcaaaactccgtctcaaaaaaataattaaataaataaaataaaaacagcagggtgcagtggctaacgcctgtaatcccagcactttgggaggcaaagccgggcagaacacctgaggtcaggagttcgagaccagcctgaccaacatggagaaatcccgtctctactaaaaatacaaaattagccgggcgtggtggcgcatgcctgtaacctcagctactcaggaggctgagtcaggagaattacttgaacccaggaggtggaggttgtggtgagccaagatcgcaccattgcacttcagcctgggcaacaagagtgaaactcagtctcaaaaaaaaaaaaaaaaaagaaatctttgcctacccgacccaaggtcacaaatcttttatgctgtgttttcttccagaagttttatagttttcgctttgccttgtggtctgtaatgcatttcaagtttactattttatctatgatatatagctcttttttaaatacagatattcagttgttccagccctgtttattgaaaacactatcccatttcattgagttacttagtcactttatttatttatttttttaattttttatttttgagatggagcctcgctctgtcacccaggctggagtgcagtggcacgatctcggctcactgcaagctccacctcccggattcacagcattctcctgcctcagcctcccgagtagctgggactacaggcacccgccaccatgcccggctaatttttttttgtatttttagtagagacggtatttcaccgtgttagccgggatggtcccaatctcctgacctcgtcgtgatccacctgcctcggcctcccaaagtgctgggattacaggcgtgagccactgcgcccggccccttagtcactttatataaaatcaatggactgtatatgtgtatctgtttctggaatgtcaattgatttctatgttggtgcttatgtcaataccacatcatcataaacattgaagatttatagtaaatcttgaaatctggcattgtaaattctccagcttcatttttattttttattttttattttttttgagatggagtctagctctgtcgccaggctggagtgcagtggtgagatctcggctcactgcaacctccacctctcgggttcaagcgattctcctacctcagcctcctgaatagctgggattacaggtgcccgccaccacacccagccaatttttatatttttagtagagacggggtttcactatgctggctgggctagtcttgatctcccaacctcatgtgatccacctgccttgggctcccaaaatgctgggagtacaggcgtgagccaccgtgcctggcctctagcttcatttttttttttttttgagacaggatctcacttagtcatccaagctggagtgcagtgacatacatgatcatagtttactgcagctttatctccctggctcaagtgatcctccctcctcaccctctgagtagctgggacgactgcgcccagctagtttttttttttttttttttttttttgagacagggctttactatcactcaggtagagtacagtggtgccatctcaccttactgcagcctctgcttcccagatgcaaacaatcctcctgcctcagcctctcgagtagctgggactataggcatgtgccaccacacccaactactttttgtattttttgtagagacggggtttcaccatgttggccaggttggtctcgaactcctgacctcaagcgatcctcctgtctcagcctcccaaagtgctgatccctttgcatacactgaagtatagagaaacaaagtacaataaaaaaaaagaaaaagaaaatgaaaacagacgtttgtttgtttgttttgagacagggtcatgctttgtcacccaggctggagtgcagtggtgcaatcacagctcactacagcctagacctcctgggctcgagtgattcttcctcagctttctgagtagctgggactacaggtgtgcaccacatacctggctaattttttttgagatggattctttctgtgctgcccaggttggagtgcagtggcgcgatctcagctcactgcaacctccgcctcccaggttcaagcaattctcctgcctcagcctcccaaatagctgggactacaggcacgtcccaccacgcccggttaattttttatatttttagcagagacagggtttcaccgtgttagccgggatggtctcaatctcctgacctcgtgatcctcccaccttggcctcccaaagtgctaggattacaggcgtgagccaccacctggctaattttttatagagacaggtctccttctgttgccccgactggtctcgaactcctgagctcaagcgatcctcctgcttccgtctccgaaatgctgggattataggcaagagccgccgtttgcagccttgttggtagttttcggtgtgcagttcttacatatgtatactgttaaatatatccctaaataatttacttttgaagcctggcacggtggctcacgcctgtaatcccagcactttttgggaggctgaggcgggcagatcaccagaggtcaggagtttgagaccagcctggccaacgtagtgaaaccctgtctctactaaaaatacaaaaattagccaggtgtggtggtgcatgcctgtaaccccagctacgcgggaggctgcagcaggagaattgcttgaacccgggcattagaggttgcagtgagctgagattgcaccaccacgctctagcacgacagagcgaaactccgtctcaaaaaaaataaaataaaataaagaaagttcttttgatggtgtttaagtggcatttttgaaaatttcattcttcagttgtttattgctagtatattgaaatacaagtgattattccacaccagccttgtgtcctgcaaacttgctaaatcaacttactagtttttatagataccttaggattttctatgtaaacgatcatattgtctacaaataaaggaagttttatctgttcctttttaatctttttattttttattttgagagggagcctcactctgtcgcccaggctggagtgcagtggtgcgatctcagctccctgcaacctccgcctcctgggttcaagcgattctcctgtctcagcctccccagcagctgggattacaggcatgcgccaccacgcccagctaatttttaaatttttgatggaaacagggtttcaccatgttggccaggctggtctcaaactcctgagctcaagtgatttgcccgccacagcctcccgaagtgctgggattacaagccaccttgcccagccagttcctttttaatctttatgactttttttcccttgccctattgcattagttagaacctctaataccacattgaataaaggtgttaagaggtatatccttgccttattcccaatcttagtagcatattattgtcttttactgttaagtgtgatggtaaccgtagattttttttgtagacgtcagctatcagtttaagcattacttctatgcctagtttgctgagactttataatgagtaagtgttgccttttccgtatctattcagttgatgatgatttttctctattctttgaatgtgacaaattacattgatttttcagatgttgagtaaaccttgccttccttggataaatcacacttggataatatgtcatgacatattatccattttatatagtgctggatttgatttgctattattttgttgaagattcttttttttaaacagagtctcgctatgttgcttaggctggtcttgaactcttgggctcaaagcagtcctcccacctcggcctcccaaagtgctaggattataggcatgaacctctgcatggggtggtctttgtttttttttctgtcgtagtaaacctaacatcataaaatgacttggaaagaaagtattgtcttttctattttctgaaataatttatgcaagtttttttgtttgtttgttcttaaatgttagataggattcaccaataaagccatctggacctagagggttctcttttggaatatttagaattataaattcaatttctttaatagacatagagctatatagattttcttttgtatcagttttgataatttgtattttttgagggatttatccactttatcttggttgtttaataaagttgttcctaatactcccttattatctctttaatgtatataggatttatttatctaattccctgttaatgagcactagagggaaatgaatggctgttaagaataacgagtacatatgggataccggtgctagagatgtgctaagtgtttccttgtaaaacacgtatctccctcttatcattttatgatttgtccagagtgataaactagatgcttcagctgacaggctctgaataggctcttttaacaatcttatctatatattccaaataccaactataaaaacatgtcattttcatcatgatttgagtgcgtatctcacacaaacctgtttttactccctcaggccatcatgcagaagggggatacaaacataaagcccatcctccaagtcatcgtaagtacctgcgtatgttatgttccatgtcaacttctttggagtcatcgaattacaagttacgtttgatgaaggacagacagatttgtccactttcggaaattcacccccagtcacaaaaaataggccagtctacattgtaaccctgagagagcagccaggctttttgaaaatgttactacgtgagctgctaagttctactgtctttggagattcagactgaaggctttgcctctctcttcctccccactgttgatagatgactgtggagctacttgcctttcctgcccttgggtttgtcttgttcacattggcctttcatatgacctccagaaatatatctagtatgaacttgtctcttttacattcttcagttaacacatcatttatttaaggggttctcaaacttcagtgggagttttgaaaaatagaagcagaatggtgggctcacccctgcaggttttcagtcggccggtctgatgggtctctctgctgcaccacacgcgccgtgggtcagcttggggctctgggtacaggtgtcacttgctttggaaacctgcctctgctctctctcaggtggggataaaggtcccggctctgccgcctgatcacggacacatcacttacgtctctctgcctccatctccaccccagttgttagctccttcaggacaaggattctttttattcattttgtatttttagcatgtttcctacacagcaccttgtgtatattgggtgcttcattattattattattattattattattattattattattttggtaattgatttttaaccatatttgagtcaggggtgagaacacaagagtataggcagctcgttttacttccctctctgttgtgtttaataatgttagtggagggaggttagtgggaaaatcatcaaatccagttttcttttacttggatttaagtgtcaagagaatgggcaaacagtttgtgttgaactaatggcaaacccactctcctgccacttcggtttacgtatccctggggacggggcagacaacctggctaatgaatcaagttttctgtcctagaacatccgtcccattactacggggaatagtccgccgcgttatcgactgctcatgagtgatggattgaacactctatcctgtgagtatggtgtatccatctagaaatgtgtgagtatttaaatagtagaagcacacctggtcctttggttgccataatttgggggcattcgtgaagtccgtacttgcttggctacgtacttcattcagacagaattgcagctgtcagagagcattctaacaatagactggaggtagtggaaagctgccacttggcttaattaattttccctaactggtgttctgtgttttctctgattaatttccctaaggatgatattgacatcgactgagtgcgaggggtcagctgccctatactttccttttctggggttttatttctgtgttggaagctgtaaaggggagaaaggagagaatttttaaatgattttggccactttaacaaattcacacatttaagagtagcagcaaatgtttaacaggcagcaaaatacacagtttttcactctgcagagtctgactagttttaatttcaggagcatatgtaaggcatttttctttgctagcacaggtatgagtagctctcagaggcttaagactgcaggattttggaggctaaagaaatctctgtggttttcagctttcatgttggcgacacagttgaaccctctcgtggaggaagaacaattgtccagcaactgtgtatgccagattcacagatttattgtgaacactctgaaagacggaaggtatgtgctgtgtttttttctgtcttattgtatcgtagaatgggaacaaatttaggaataaaaaaggcaatagtgagttttcagctaagaatctgcagcttttcagttaagaactcaggtagctaacacatggcacccaaggaggagaaacatggaaacaagttggaaatttcagagcagaagattaaagtagaatgcagaaatcttgttatttctaatttcttcagaagcagcatttttaggatttcccccaaaagaatcttatctcttttgtttgtttttggtagaaacggggttttgccatgttgcccaggctggtctcgaactcctgagatcaggcaatctgcccacctcagcctcccaaagtgctgggattacaggtgcgagccatcatgcccggcctcaaaagtatcttttaatgaaaagaggtactttattttacagcagaaaatgataattattttgtaatgctgctttgtgtgtgtgtgtgtgtgtgtgtgtgtgtgtgtacaatcttgaatcttttatattaaatgctatatttagccaatatagaatacattgaaccacatgtggtggctcatgcctgtaatcccagcgctttgtggtgctaaggtgggaggattgcttgaggccaggagtttgagaccagcctgggtgacatagccaggccctgtctctacaaaaaaaaaaaagttaaattagtgaggtgtggcggcacacgctacagtcctagctacatgggaggctgaagtgggaggattccctaaccccaggagtttgagactgcagtgagctgtgattgcaccgccgcacttcagcctgggcagcacagcaagaggccatctctaaaaaaataaatttaaaaaaagaatgtgttgtacacggacaagttactgcatgctagagatacagtgatgaacagaactgttactctcattgctaaaacatgactgatttcaggcaaggtgcagtggctcacacctgtcatgccaacactttgggagaccaggtagggaggatcacttgagcccaggagtttgcaaccagcctggacaatatggtgagaccttgtctctacgaaaaaaaggaaaagttagctgggcgttatgacatgtgcctgtggtcccagctactcggaaggctgaggagagagagtggcctgagccctgagaggtgaaggttgcagtgagctgagatcacgccactgcactccaggctgggcaggagagtaagaccctgtctcaaaaaagaccaaaacaacaacaacaaaaaccgagataaaaaatgataacaatactaagaggtttaagtaattagttttttaaattctgttatactgattttaggactcttacattttctccagctgttcttttttcctacctctttatctctgtgttggttggatttcactcaataacttttttctggactggctctttagtgccgtcttccccattatcagcctgttggtctttatgctagaatgaccacttgcctggctgtctattgttaggttatgtggctttaccctcagaattttgtcttctggcattgaatgttgatctggagaagtcttaaggccagcctggtttgatttcttcccttgtaggaagctttgctttttttttttttttttttttttctcctgaggcctcactctggttgcccaggcgggagtgcagtggcaccatcagggctcactgtagccttgacctcccgggctcaggtgattctcccacctcagcctcccgagtagctgggactacaggcgcccaccaccacgcctggctaattttgttttgtatttttagtagagacggggtttcaccatgttagccaggatggtctcgatctcctgacctcgtgatccacctgcctcagcctcccaaagtgctgggattacaggcgtgagccaccgtggccggccgtccatattcttttttcttctggtatgtggtatgcttgttcagtctgccgattcagttcttttcaacgaagtttttctgtgtgttattccttaatgttgttttctatttcacttattgagttccagttttttacatacgttgtagataactttgatctccgcataggtctttactttaaccttttttctgatggatgcattggcttgcttcgaggttttccaacgtaatagtacagtttttagttttctctcttctactcctcaatctttataaattattagatgtataatagtattgattttgttctgtttttttcttagctgttcaagctcccttttcttcttagtctcttgttttagctcatcttttgactgttaatttgttggattcatatagtcgtacttattttgccaatcgcttttgggaagtgtcactccttttcttggcttgtactttcttccagagtgggttctttaatcggctttgcctccctgttgctttcccttttatgcattgttgtgtattgtattgttgctttgtcatcatccctttttattttgttcatgcttaatgtggacagtcctgtccagacttggtatttgctctgacatagtctaggctaggtacatgttgccaaccttctcacttgggaccttttatcttccactccaggctatcttggagcgcttaagtggtgttttgcagccacttttctgtcctccagggcatggttgtgggagagggtggaagtgttgctgggattgagtgcagtccttgctgggaaacttcacagcccactctctccagtcacggagacagctccactcccctgggctttgcctgatggcactgcctcagcttgcaggcttgcctcatattcttttgtacctctgctgagagcctgtgtgtgcggctgggtttatttactccttgcttttttggtgatcattcaggtttattctaaacaggacttgagcagtcatccttgtactttatcttaacgtgtttatgcttttatttctgaataacagatcattagaatttgtattgtggggtcaacggacatctgtggaaagtatactaattatactcataaatgttatataagagtatctattggccaggcacagtggctcaggcctgtaatcccagcactttgagaggctgaggcggggcagatcacaaggacaggagatcgaaaccagcctggccaacatggtgaaaccccatctctactaaaaatacacaaattagctgggcgtggtggcgggtgcggcctgtaatctcagctactcaggaggctgaggcaggagaatcgcttgaacccaagaggcggaggttgcagtgagccgagactccagcctcggttacagagcaagaccccatctccaaaaaaaaaaagcgtatctctgaatagacaaatccatagaaacaaattcaatgactggttctcaggggtggtagagtgtggagtgactgtcattgtacacatggtttcttttgctgatgacaacagtgttctaaagtgaggtagtggtgatgcttgcataactgcaaaatgcaaaacccataggattatccactctggaagggtgagttcattatggtacgtgaatgatatctcaataaacatgttatttaaaaagaagtgtttgccattaagcttgtcaacatactgtgtattagtcatattttaaagaataattatcagccaggcacggtggctcatgcctgtaatcccagcactttgggaggctgaggcaggcagatcacctgaggtcaggagtttgagaccagcctggtcaacatggtgaaacccgtctctactaaaaatacaaaaatcagccgggcatggtggcacatgcctgtaatcccagctactcgggaggctgaggcaggagaattgcttcaacccgggaggcagaagttgcagtgagtcaagattgcgccattgtactccatcctgggtgacaagtttttcttgcccaggctggagtgcaatggtgccatctcggctcactacaacctctgcctcccgagttcaagcaattctctgcctcagcctcctgggtagctgggattacagatgtgcaccaccatgcctggctaatttttttgtatttttagtagagacggggtttcaccatcttggccaggctggccttaaactcctgaccttgtgatccacccacctcggcctcccaaagtcctaggattacaggtgtgagccaccgcacccagcctgttcctttttatggcagaataatactctgttgtctagatacatcacattttgtgtatctattcgttagttgatgggcattcggattatttctgcctgcttgctattactaataattctatgaacatttgtgtacaagttttttgtggacagacgtttccatttcttttatagataatctgtctaggaaaggaattgctaggctaaatggtcattttatggttaactttttgaggctattgttcaaagtgtgtacaccagtttacctccctgccaacagcgcgtgagtgtggagtttctccccgttcttgccagtacttcaaattacactccatagagtttcagttaaacttctctgtagactatttagtagtttatagacaaggtctttctttactttttccctccaaatttttgttggctgttctttttttttttttttttttttgagacggagtctcgctctgtctctcaggctggagtgcagtggtgcgatctcggctcactgcaagctccgcctcccgggttcacgccattctcctgcctcagcctccccagtagctgggactacaggtgcccaccgccacgcccggctaattttttgtatttttagtatagacggggtttcactgtgttagccaggatgatctcgatctcctgacctcatgatctgcccacctcggcctcccaaagtgctgggattacaggcgtgagccaccgcacccggcattccttattctcatatttgtcattttgttttttttttttttaattttactgtattgacagcgctgtcaaaactttgttggacgatggtaatgtcagcagttgcctgattttcatggaaatgcttttggtttcactgttcaatgcagtgttgatcgtggaaaaacgcgcagtttaccaggtgcaggttttattttttaagtcctcaggatttcatcagaaatggctcgtaaattctttcaaagcttttactacatcttgatatgatcatatttaatgaactattttaatagattatctaggctggacgtggtggctcatgcctgtaatctcaacactttaggaggccgaggtgggtggatcacttgaggtcaggagttcgagaccagcctggccaacatggtgaaaccctgtctctactgaaaatacaaaaattagccaggcgtggtggcacatgcctatagtcccagctactcgggggactgaggcaggagaatcacttgaacccgggagatggaggttgcagtgagttgagatcgccccactgcactctagcctgggcgacagggcaagactccatctcaaaaaaaaaaaaagattacctaatattcaactcttgtttcattcttgcgataaatcctgccttaaaaaaataatcctagggctaggctggtggctcacgcctgtaatcccagcaccttgggaggccaatgcaggtggatcacctgaggtggggagttcaagaccagcctggctggccaacatggtgaaacaccatctctactgaaaatacaaaaattagccaggcatggaggcacacacctaatagtcccagctactcgggaggctgaggcaagagaatcacttgaaaccaggaggcggaggttgcagtgagttgagattgccccactgtactctagcctgggtgacagagcaagactccgtctcaaaaaaaaaaaaggattgcctaataattcaactcttgtttcattcttgcaataaatcctgccttaaaaaaaaatcctaggctgtgctggtggctcatgcttgtaatcccagcactttgggaggctgaggcaggtggatcacctgagatggggagttcgagaccagcctggccaacatggtgaaaccctgtctctactaaaaatacaaaaattaggtgtggtggcgggtgcctgtaatcccagctactcaagaggccgaggcaggaaaattgcttgaacctgggaggcggaggttgcagtgagctgagattgtgccactgcgctccagcctgggtgacagagtgagactctctctctcaaaaaaaaaaataagaattatcttagcttgctaattttctctttttatttttaaaaatcttttttctggaaaactttaaacatctacaaacatagacagaatacacagtagtctgatgaatccccatatagcccatcattcagctccaaattgtcatctgttgtccagttttgctctagctccatcctttcaacgtccactatcctctgtaattttgaggtaaatctcagacatcatattatttcatccataaatattttagtatgtatttttgaaagataaaaactcttaaaaagacactatcccatttcacacctaaaaaaataccgtccgtgttgtatttccatcttgttgtatatgtgcgtgtgtatgtgcgtgtgcgtgtgtgtgtgtgtgcccacacaatctatatgaatcagaatccaaaataagtttcctgtgacggtagattgatggtctgttaagtctctctgaatctgtaggctctgcgtctgccttttttctcctttactgtttatttgctgaagaaaccaggtcatttatccttcaccttgtgcagtttcccccagtctggatttggctgattgcatccctgtaaagtcacttaatgtgtccttgtcatctgtattctctgtaagttgatattagtgtattcttttaatatgctgctaggttcatcttgctgatattttatttaggatttatgggatattgcaggatgaaattagttttggttttgtgtgtgtgttttgtcttaggttttagtattagagtcatactaaatgattcataggccttctatttttatatgttctggagtgatttgtataatttggaaagtagttaaatatctgccactaagtatcagatagttattacagggaatctagataccattttcaggaacagataatttcaggcttatcttattgaaactctgatgtgaaacctgataagggtagcacacactgattgattgtatgtaaaaatccaaattatagcagtcagaccatttaaaacaaacgattgattgtatgtaaaaatccaaaaacagcagtcagaccatttaaagtctaaaacgtgatgaatttgggtagattattgcttaaatattgccctaggcctgtttcttcagctcccttgccactaacctcattcaggcctctgtcattttgtctcttctcttggtctccctgcctccagtcatgttcccattaaattccttctttttaaaatgcagacattgtgatatgctcatcaagtatgtattgagcaacaactgtgggccatttgcttcattaagcactgagggatacctgtctttattgacagtacagtctagtaggagcgagagagaataataaaataatcactaatgaacatataattaagacggagcagagtgttctgaaggaaagaaatcaaggctgtaggaaagactagaacaaagcaacctgatctcaactagagattaaggaagtgtctcttgaagtgatgtttgagacgagagctaaaaaatgagtattagatgaggcaaaatgagaaggaacacaacaccgcaatctcagagcatcacggacaaaggccttgtggcaagagggactgtcccatgtggtggaactgaaagaaaacaggaaggccagagggcagagggcagagggcaggcagcggcacgggaggggggttagcaaggccaggccaggcaagccatggcccaggtttttctttgtggcctaaggtcattgggaagttatcacaacgttttaattagagttaaaaagcaaaagaactgtaagttcttaaaaatgggtcattattacattttttaaaatatctattgtcataattggttttcactgggaaaaagtcattgttgagataagtatgtgtttctgaaaacagttcatctctttttatgccatatattcttgtgtttagtaatctaaattcttaccatgtcggttggctccttgaagatacggtgcgtagcgagaacactgcattttaattaaggaactagttgggaactgaaaaccctgcaatcacttgataatgatgcggcgaaagatgaagagaaatatttatgtaaacagatgacaaatggaaaatagttcatcacaatgatcatcggggaaagcattttgagtagcttatcatttgaacagaatttgtttttctaacctgtttctgtttgtctgcttttgcaggagagtagttatcttgatggaattagaagttttgaagtcagctgaagcagttggagtgaagattggcaatccagtgccctataatgaaggtaaaatgctttggcgtaggttgtagcactcaaatgaatacctctttatatattcggagttctaccttttggattcagtttgacttgttagtgttaataaaatgatagtgattctgaggtctaggaaccaggctattctgtcaggctttttcagttctaaagaaatgatgtatgaagaaagggcacaattagaaagcaatggacaaacgggttgggtgcacggtggctcacacctgtaatcccagcactttgggaggccaaagcaggtagatcacttgacgtcaggagttcgagaccagtctggccagcatggcaaaactccgtctctactaaaaatacaaaaagtagctaggcatagaggcctgcgcctgtaatcctagctactcagaaggctgaggcagggaaatcgcttgaacccaggagacagaggtttcagtgagccgagatcgtgccactgcactccagcctgggcaacagagtgagactctgtctcaaaaaaaagtaagaaagtaatggacaaagattcagttatactagactaaaaaaaaatctaggatatcacagtaatataggatactacaggatatctgtaatattaatgagaaacgtgttttcctaagacttatgtacacttttgtttttaaaaagtgtgaagcatgcagtctatactcctgtgataacactcactgcactggtagcttttagaattatctctatttactgctaagccatgagtaaactgtgtgaaggtagagatcatgtttgttctagtgcctaacttgaggctggcgtttagtaagtatttgttgaaacaagttgaatatataacgttgttttactgtgattatctcttgatggtgaaattactaatgatttaattttctcatgaaaatgtatagaaaagcacattgaaataaaaaaagtccattttttctttgcatcctaaaagaagctgaaaaaaaagtcattacttcagacaattctagagaaaggcgaaaagaatcttcaaatcactggccccattaaaggaaaggattgtttgcccttacaccaagtcaaaacataaaagcctcatttgacaccaaaataaatttgagatgtatttttttcaagttagaaaatgaaaccatcaaaaatcaagaggaagaggctgcacaaatagattggaataattcacaatgaatatttgattacattgaaattttaaaattacatattaaaaataggaaaccaggtacggtacctcacacctgtaatccctgcactttaggaggctgaggtggaagaactgctttgagtgcaggaggacgagaccagcctgggtaacacaggaagaccccatctctgcaataattttttaaaaacttagccaggtgtggtggctcacacctgtagtctcagctacttgggaggatgaggtggggggattacttgagcctgggaggttgaggctgcagtcagctgtgatggcaccactgccctccagcctgggaacacagcaagtgtccgctattccccactgcaaaaaattaaaagtgtgtaaactaggataaaatatttgcaactcataggattgacaaagggttactatctttactatttattgaatttttttacatattaaggaataaagtacttcattagcaaagcaggcattggagaaaaatagatggttcactatagaaggaaaacaaatggctaatacattagaaaacatctccagcctggctcgttatctttgtcttgttcctgatctcagggagaaagcgttcagactttcaccattaaatgtcatgttaactgtagggttttcttagagtctttttatcagaagtaaagaagtttatttctgttcctagttggtgagggctttcatcagaaatggatggtgagttttgtcaaatgcattttctgtgcttgctgatgatctgatgatcatatggttttctttgttagttaatatggtgagttacattgattgatttttttttttgagacagtctcattgcatgacccaggctggagtgcagtggtgccttctaggctcactgcaacctccgcctcccgggttcaagtgattctcgtgcctcagcctcagagtagctgggattacaggtgtatgacaccacacccggctaaaattgtgtgtgtgtgtgtgtgtgtgtgtgtgtgtgtgtttagtagagacagggttttgccatgttggccaggctggtctcgaactcctgacctcaagtggtccacccgcctgggcctcccaaagtgctgggattacattgcgctcagccacgttgattggtttttgagcgctaaaccaatctgggatctctgggataagtctatgtcatgatgtattattctttttacatattgttggatttgatttgctatatccctttgatctgatttactttgtttagaattgttgtatcggtattcacgagagatatttttctttagttttcttctattgttacatctctgattttgatacctgagtaaccctggccttatggaataagttgggaagtgtgttccgttcttaaattttctgcagcagtttatgtagacttggtacttcttccttagatgttcagttgaattcaccagtgaagtcatctgggcctgattttttttttttaatggaaaagtcttaaactgtaagttcagtttctttaatagagagatacagggttattcaagcacccttcttgagtagactttggtagattatgtgcttcaaggaatttaatttcatttaagttcttgaatttattagtctatagaaatataaatattctaaacaccccaattattagaaattatcagatggatttaaaaaatatatttccagctgggtgcagtggctcacacttgtaatcccaacaccttgggagaacgaggcaagccgatcgcttgcgcttgggagttcaagaccagcctgcgcaacatgataaaacccagtctctaccaaaaatacaaaaaattagctggatgtggtggcgctcctgcacctgtggtcccagctacctgagcccgggaggtggaggttgcagtaagccgagatggcaccagtgcactctagcctgggtgacagagtgagaccccataaaaaaaaaaaaaaatgccaggtgctgtggctcacgcccataatcccaaaacttttggggaagctgaggcgggcggatcacgaggtcaggagttggagaccagcctggccaatatggtgaaaccttgtctctactgaaaaaatacaaagattatctaggcgtggtggcacgcacctgtagtcccagccactcgtgaggctgaggcaggagaatcacttgaacccgggaggcgaaggttgcagtgagctgagatcatgccacgggcactccagctgggccgacagaatgagactctgtctcaaaacaaaacaaaacgaaactatatatagtttttatttatttatttaatttttatttttatttaatttttacttttttaatttactttttttatttaattttttatatttttagtagagacaggattttgccatgttggccaggctggtctcgaactcctgccctcaagtgatctgcctgcctcagcctcccaaagtgctggaattatagcatatatatatattatataacatacatatatgtttccttgttatcctttgagtgtctgtagaatttgagagtttcatcaatcttattgatctcaaaggagcaacttttggttttattgattttctcttatgttttgtattctattgatttatgctttttatctttattttcttctacttacttcgggttttgtatatttttttctcgtttcttaaggtggaagctgagttcattgacttgagatctttttttctaacataggcatgtagcattataaatctgcccttagctactgctttaaaagtatccagcaaatttggatatgttatattctcattcatattcaattcataatactttcttatttccctttcaatttcatcattaacattctgttatttagaaatgtgtttagtttttaaatgtggggattttctctttttttctttttctttttcttttttttttttcaaagataaaatgagtatttaattcagtttcagaaaaaaagggtacattacttcgatgagaaagcataaaattaagaggcttttctggaaatccaagaaaaagaaataaccattaatatgttcaatgataattttctggatcttcctcgtgtccaaagctatatattttctcctcaaaagcagctgctccaagaactaactagccctctttatctccctctagctgggacagactaattcccctccacccccacctctcttctttcaataacactgtgtaggtgttaatggcctgggctctcaccaatgaagagaattgtcctttaagccagcaacccacaggtagtggcacccaaagcctcaccaacccaccccccacccggcccgtccccagggcagaagccacagagctggcattgtttccactgtctcaggaagaaggagccaaaagctgaccctcagcacaaatcaaagcccaatatggagagagaataactgcttctaggccgagagtaggcaagctgtgggcaaaaaaggggagtttttgcagccacctcatctttagaaacaaggggaaaactagaccgttttccactattaaggtctaccaggtactctactgctccaaggagatctgaaaatacaaaaggatctaaacaaataaggagaacttttcccaggctggagataagaatgacaaacagaaagatgggtgaatgtaataatgtgtaggaagatgatgctgggagcctcctttcttcacatggctgccagccccatagaggacaacacagtaagaaccaggacaaccactccagactggtatagctggggaatcttcaggccttttcctaggttccacatcaagtgtcggatcccattccaggtatgatacatgagagggaagacgagtgcaaacttagctgtgtggatcagtgctggccccagacacagggacttcacaagttccaaataagactcaaagttcccagggagtaacacggccgacatgccaaaaagagagacccctgcactcaaagcaataccagtgccacggtggcagatggacatcgccatgggaagagaccaatttctgatacagagctgagggctaaagtgggctcggaggcaatgacgaccaacgtgtctcagcaacagcgcagccatcttgggttctggtctctctttttctttttttttttgagacagagtcttgctctgtcacccaggctagagtgcagtggcacaatctcggctcactgcagcctccgcctcccgggttcaagcgatcctcccacatcagcctcctgagtagctgggactattggtgtgtgccaccatgcctggctaattttttatatttttagtagagacgcggttttgccatgttggccaggctggtcttgaactcctgccctcaagtgatctgcgtgcctcagcctcccaaagtgctggaattacagacatgagccatcgtgccagccaaatgtgggtattttctagagatcttgttcttgatatctaatttaattctagtatgatcaaacaacatactttgtatgacttgaatcctgttaaatgtattgtcttattttgttttattttatttatttatttttattttattttttttttttttttgagacagagactcactctttcacccaggctggagtgcagtggcatgatcttggctcactgcaatctccacctcccaggttcaagcgattctcctatctcagcctcccaggtagctaggactacaggtgcctgccaccatgcctggctaatttttgtatttttagtaaagacagggttttgccgtgttagccaggctggtgtcaaactcctgacctcggatgatctgcctgccttggcctcccaaagtgctgggattacaggagtgacccaccttccccagccttgagtcttattttatgtccagattatggtctctcttggtaaattctgtgtgtacttgaaaagaatgtgtattctgttgttgggcagagtcttacaaatgtcaattaggtcgagtcggtaaattgtgttattcagtttttctatatctttactgtttttctgtttacttgttctgtcatttactgagagggatattgaaatctctaactgtaataattgtaagtttctctgtctctctgcagttctattagtttttgcttcatgtatttcaaagctgtattattaaatatctatataatttagaattcttgtgtccacttgatgagttgactcttattattatgaaatgattttatccctgggaaattctgtgctttgaagtctgctttgatattagcatagccactttggcgttttttttgttttgttttgttttttctctcctagagacaacatcttgctctgttgcccaggctggagtacagtggtacattcacggctcagtgcagcctcaacaccttgggctcaagcaatcctcccacctccgcctcctgagtagctgggactacaggcatgtgccaccacgcccagctaattttattttgttttttatttatttatttatttttgagacgaagtctcactctgttgccaggctggagtgcagtggcgtgatctcggctcactgcaacctccgcctcccaggttcaagcgattctcctgcctcagcctcctgagtagctagggctacaggcacgcatcaccatgctcagctgatttttgtatttttagtagagatagggtttcaccatgttggccaggatggtctccatctcttgacgtcatgatctgcccgcctcagcctcccaaagtgctggggttaaaggcgtgagccaccataattggcctaattttattttttgtggacatggagtcctgccatgttgcccacactggtcttgaattcctggcctccagcaatcctcctgcctcagcctcccaagtagttgggactgcaggctgcacctgtagtctgggaggtggagtgccgggcctgcctgtggactgcctggactggggctgggacggcagtgccaccacgcccggctcatttcttttctttttatttgtaggggcggggtctcactttgttgcccaggctggtctcaaactcctggcctcaatcctcctgccttagcctctcaaaaggctgaattacaggcataagctactgtgcctggccattgtgtatactttctattgctagccgttcaagttcactaatggtttctcaggcagtgcctaatctgctgttaatcccattgagtgtatttttcttctcagatagtatagtttttatccctagaagcttgattttgggtctttaaaaactcatctacatctctgcttaatttttgggacatacagagcacaatgacagtatttgttgtaaggtccttgtctgtggattctggtgtctgtgttaggtccggatttgtttccgtcagttgatcccggcctctccgatcatggatcatattttcctgctgcttttcatgcctggccctcggaccgaatgccagacattgggattcgtacctcgttgggtgctagaaacttttgtaatcctgtaattattcttgagcttttttcagggatacagttaacttggagacagtttgatcttttggtgtgttgcttttaagatttattagagaatcagagagctgcatttagtctaggtgtagttattcccaatactgaatcgagacctgacagactgttctacctcgtgccccatgaatatgaatttttcccatctgactggtagaaacaggtactatttcaagcttgctgtaaacacaggcatggttccctctggccttctcagatgattctcaccctggcctcagatcgtgtccacacacacacacgggccaaccaggactctgctgactacccaggaaacctgccacccatttctggagttctctgtgtacagccctctcttctctgctactctgtccggccagctagacggcgatctccccagactctcggcccccatttctgcacctcgggttctggcaggccccctaagcccttgaggcactgagctggtgcagacccactcgctcgctttcctgtgcacagcaggcgctacccctcattgaaaaccatgcgtctcacgtattttctccctttctggtggggggagggggttatgttaggtgttagggtgaacctggtctctgttgctccatttgtccggtacgtagttttaaaagttgaatatttttgcgaggtgtgtccttaaaaacaaaacagcattctcctgcctcacttttctttggcctctgactcctgtctagagacagtctgtttcaaatctcacagctgtttcttctctgtttgtctccatatttctaaataacacatttgtgctgctcttcgttaattttttcagttgaaacatttgtttattaacttcacgctatgggagattagaatgtggtgctctctcttttttttttttcttttttaagagtctcacactgtcacccaggctggagtccagtggcgtgatcttggctcactgcaacctccgcctcctggactcaagcaatcctccttgcctcagcctcctcagtagctgggattacaggcgtgcaccactgcaccctgctaatttttgtttttatttttttattttttgagacggagtctcactgtgtcgcccaggctggagtgcagtggcgcggtctcggttgactgcaagctccacctcccggattcacgccattctcctgcttgagtagctgggactacaggcacccaccaccatgcccgggtgattttttttgtattttcagtagagacggggtttcactgtgttagccaggatggtctccatctcctgacctcgtgatctgcccgcctcagcctcccaaagtgctgggattacaggcgtgagccaccgcccccaaccgtatttttttttttttttttttttttttgtagcgatggagtctatgttgtccaggctggtcttgaactcctgggctcaagcaatccgcccacctgagcctcccaaagtgccaggattacaggtgtgagccacagcgcccagcttagaatgtagctctcttatacctctcttgtccctgctgtccacatggaagaagtagatgttaatatcgattagctcaatatttatttatttatttatttatttgagatggagtctcactttgttgcccaggctggagtgcagttgcatgatcttggctcactgcaacctccacctcccagttcaagctatcctcatgcctcagcctcaccagtagctgggattacaggcacacaccaccatgcccagctaatttttgtatttttagtagagatggggtttcaccatgttggccaggttggtctcgatcccctgacctcaagtgatccgcccaccttgacctcctaaagtgctaagattattggcgtgagtcactgtgcccagcttttttttttttttttttttttgagatgaagttttgctttgttgcccaggctggagtgcactggaacgatctccgctcactgcaacctcccccgggttcaagtgattctcctgcctcaggctcccaagtagctgggattacaagtgcccgccaccacgcccagctaatttttgtatttttagtagagacgaagtttcaccatgttggccaggctagtctcgaactgctgacctcaggtgatctgcctgcctcagcctcccaaagtgttgggattacaggcgtgagccaccgtgcccggccaagatttatttatttagttatttggagacaggttcttgctttgccatccaggctggagtgcagtggctcaaaaagggcttactgtagcctcaacctcccaggctcaagtgatcttcccacctcagctttcccagtagctgggagcgtgaaccaccacgcccaactaatttattttattttattttattttattttattttattttatttttttgagacgagtctcactctgtcacccaggctggagtgcaatggcacaatctcggctcactgcaacctccacctcccgggctcaagcgattctcctgcctcagcctcccgagtagctgggattacaggtgcccgccaccacactcagctaattttttttatttttagtagagacggcgtttcaccacgttggccaggctggtctcgaactcctgacctcaggtgatccacccaccttggcctcccaaagtgttgggattacaggtgtgagccaccgtgcctggccccaactactttttatatttttttgtagaaacagagttttgccatgttgtccaggctggtcttgagctcctgagttcaggtaatccacctgcctcggtctcccaatgtgctgggattacgaacgtgagcccctgcagggggccgacatcaaaatttaaatggccagtcagattgaagtttttctatgaaacatatcttgctttattaaaaatttaaagttttcaaaacatacttgtagaaggcaattttcaaatggttgttatgttttcagatatttttagtaatcagaacaacataattttattgttttactaatcagccaatttttgaactaaatctgaagtcactaagagatgatggtcaatcatgaatatttggaaaaaaatttgtgatataatttatagaaaagaaatgttcagagtgtattgaataattttaataacatataactaattaagtacatatattaactaattataactgtgacattgaaaatataaaatcgactttaagctggtcagcatcaagaagctggaagatgttcatgtggcttatttgaaatcttccgctgtgtatctcctccttcccaaatgatttctcagtaggaagctatgtttgaactcagagaaggagctgtttcttaaaaattaaactgtctctgctgctcccaatagacaaaggtgcttagctggttcccactgaagtacactaattcactgtcttaatttaaatttaccaatatatgcggggcatagtggcccatgcctgtaatcccagcactttgggaggctgaggtgggcgaatcacctgaggtcaggagtttgagaccagcctggccaacatggtgaaacctcgtctctactaaaaatacaaaaaaattagctgggcatagtggcacgcgcctgtattcccagctactagggaggctgaggcaggagaatcgcttgaacctgggaatcggaggttgcagtgagctgagattgcaccattgtactccagcctggacaacaagagtgaaactctgtctcaaaaataaataaataaaaataactttaacaacatagttcttcaattagtccataactaacttttactattagtagggttttcacttaagggtaagtggaattgaacccagtaattcttaggctggaccttaggtggatcacctgaggtcaggagttcaagaccagcctggccaacatggtgaaacgccgtctctactaaaaataaaaaaaattagccgagtgtggtggcgggcacctgtaatcccagctactcgggaggctgaggcaggagaatcacttgagcccgggaggtggaagttgcagtgagccgagattgtgccattgcactccagcctgggcgacagagtgagacttgtctcaaaaaaataaaataaaaacaaattagttgggcgtggtggttcacgctcccagctactgggaaagctgaggtgggaagtaattcttgcatcctgtcttcgttttcctacctggaactgagtcctggcctttgcctaagtgagataatggaaaggaaaggaaagttggagaatctcaggtctggaccttagcagtgaattcagcacaatcgcagaatgttgaggtagaggaaactgttgtagagatcagttgatcagtttttaatcattaaataaaaacgtgaatgaggcagtgaagtaacttccccaaggtcacacaatgggttgctacaagaaatgagaatgagcatttgtcatttcccagtgagaacagtttccattgtgcccggaccttcaaagattaaccttcataccaaagtttttgcctacttgaaaattgtatttaagtacatagatcgtgtgagtgagtctactgcgggaatgttatatacataattaaaattatctctatttcacatttatatatttgtccattaaaacttgcataattaaataaatgtaaaatataactgagataatcagacatctgttttctttaataaacattaatcttgaatagataatatggttaaatgatttcaaaaagataatgtagttacatgatttaaagttatagctaccgaattgtgtgtgcagagaaatcttactcctacccttgccgcccctgccacccactgctgccctctagaggtaaagttttcgtggtttctttttatccttcaggcgtttcttcatgagaatgtaaccaaatacaaatatatattctcgttccgtactccactttgcctacacaaaaggcagcatactgtgtacactatcgtgtctttttctcctgcttttacttatttattattattttaatagagatgagacctcactatgctgttcaggctggtctcaaactcctgggctcaagcgattctcccacttcagtctcccaaagtgctaggattacaggcgtgagcgctgcgcccagccatatcctgtttttttaaagttttctggccaggtgtggtggcccccgcctgtaatcccgacactttgggaggccaagcttggcagatcgcttgagctcaggagtttaagaccagcctgggcaacatgacgaaaccctgtctctaccaaaaatacagaaaattagccaggcgtggtggtgtacacctgcagtcctagccacccgggaggctgaggtgagaggatcacttgagcctgggagaaagaggctgcagtgagccagggctgtgccactacactccagcctgggtgacagagtgagactccatctcaaaaaacaacaaaaaaatttttttttggcctagagataatcccatatacttgtatatgcttagagatcttttttttttcttttttctttttttgagacggagtctctctgtcacccagggtggagtgcaatggcgcaatctcggctcagtgcaacctctgcctcttgggttcaagcagttctcctgtctcagcttgcctagtagctgggaccacaggagcccaccaccacgcccggctaaattttttatatttttagtagagatggggttttaccatgttggccaggctggtctcgaactcctgacttcaagtgatctgcccacctctgcctcccgaagtgctgggattataggcgtgggccactgcgcccggccaccggctaatttttttatatttttaatagatatggggttttaccatgttggccaggctggtctcaaactcctgacttcaggtgatctgcccacctctgcctcccgaagtgctgggattacaggcggggaccgctgtgcccggccaccgttttagtttttacactgaaattattcatgctgcttctgtcttatactgttgtgggttcttgatttatggtgtttcgggcttcattttcacacaacttggaatgtgcgggttttctctgttccctggtttcactgaagatgtcgtttctaatgagagatgtgtatacgtctgtgtgcacgtgcatgtatgtgtatgcagttggcattcattcctgttgctctgtattggtttttagagtgggaagatgtggggctaggccatcattatgctctttctagaactggaacctactagatattaatttttatttacacaaattgtaatttgatgctttaaattggagagggaatcgggtaaattattcggctaaattattaaattgacacatcacttttttttgcagtagtaacgttttgttaaaatgagcgaatttgttatcacattctcagctttcaggaaggtgagctgagacaaagcaatgcttagcatttttctgaaacctttggatgcagtcaggacaagagagaggtgattgtgcccagctttatcacctctggccaggtttctagtgtttgtgtgtgtgtgtgtgtgttgtatttaattgaatgattgctttggacattttctgttttgggggcaaaagtgtttatagtgaagatgggctgggctcagtggctcataccttcagtcccaacactttgggaggctgaggcaggaggatcgctggagaccaggaattcaagattggcctgggcaacatagtgagaccctgtctctacagaaaacaaacaaaaaaattatccaggcctgatagcacactcctctagtcctggctactcgggaagtcgaggtgggaggatcacttgagcccaggaggtcaaggctgcagtgatctgtaatcacaccagtgcactccagcctgggtgacagatcaagaccctgtctcaaaaaaaaaattaaaaagaaaaagaagatggagatgatgaaaggattgaaggatacttattgcttagtcagaaatacagggctatgggccgggtgccatggctgacacctgtaatcgcagcactttgggaggtcgaggcaggaggatcagttgcgcccaggagttaaagatcagcctgggtagctgtagagacaaaagtagtctctacaaaaaaaaatacaaaaaataatccaggcgtgatctcgtgtaactagttccacctgccggggaggccgagtcgggggattgcttgaggccaggaggtcaaggcctgcagtgagctatgatcatgccgctgtactccaacctgggcattggagcaataccctgtctcaagggggaaaaaaaaagaaaataaacatagggctatggaaaaatattcctttatttcagtacccagctccactgggcctttcctttctccagtgtctgttaaagctcagggggataagattgctgttcaggattacttactctcgaatttcgttgtaaccagatcagtgagccagtgcggaaatagctttcttatagtgacttctacctcacggggcatttcaccgcagtgctttctcctctgttgggaaaggacgcacactctgtgctagcgggtggagaactaaagttcattttgtatcctcccagcacctaatccagaacttgtgccatgtgaggtgaccagtacaattaagtctagcccacaaataggcaggaattccaaaatgtgcgttgaaattgtcttggcggggcacggtggctcactcctgtaatgccagcactttgggaagccgaggcgggtggatcatttgagatcaggagttcgagaccagcctggcatacatggtgaaaccctatctctattaaaaatagaaaaattagccaggcgtgatggcgggtacctgtaatcccagctacttgggagactgaggttgcagtgagttgagatcgcgccactgccctccagcttgggcaacacagcgagaccccgtctcaggaaaagaaaaaagaaattgtctgatatttatagaattttcaaagtgtgagaaataaaacttcagacataattcgtgcttcatactatattgaattagatgattttaaagtctcccgtatttaccactgtatttttgtctgcgtatataagttccatgcacctatactatggctaacaatattttactttgactaaaatttgttacacaatacttaattattagtgttacttattattgaaagacattagttgaaatttctttcagcctgatttcatccattttctgccaagaggcaattgtaaattattggattgactcttctacatattgtttgtagttgttaagaaagtacttactggtagaagttgaattttttgttgcccttattctccattgtctgtttagcgaatttttctctgcgatggctcacttaaccattataatgataaaaatgataggtgtgagtgcaaataatttgaggtgctaagagtctgctctgaaatatcctgtttcggccgggcatggtggcttatgcctgtaatcccagcactttgggagattgaggtgggcgggtcacctgaggtcaggagtttgagaccagcctggccaacatggtgaaaccctgtctctactaaaaatcacaaaaattagctgggtgtggtggccagcgcctgtaatcctagctactcgggaggctgaggcaggagaatctcttgaaatcgggaggcggaggttgcagtgagccgagatggcgccgttgcactccagcctgggtaacaagagcgagactacgtctcaaaaaaaaaaaaaaatcctattttccccctaggtcaaagccagtgatatgtaaagctagcatagagcaaaagagtctgagaaccatgatgttgacctgtcttattagaatggtttgatttgcaggtgacacaaagcagaagatgtgtcagaagttaagtctctgcattactgctttggggtgtaatttaatttttagaaggatttttacttagctgtagactgatttttctggggtctcgtggccccttgccattcacaacatgcactgcaacatgttgctatgtagaatgcaccggattcttgccgtccatttggctccgggctgtctctcgtctcttgtgccagatttgcacatctggtccagagcaggagttaaggattgctctagtaagtggattagtagcttttcctaattaccagatctcacaactagagttgcggctgccagaattggtcgttcacagttaacaattacctagatgatgatgaagtacatggatctagtcataaaagcctcggttcaagcagatgtcctgcttcccagctgtgtgatttgagccagttacgtggttcctctaacccagcgttctcacctgttaaagggtatgataatagtgtctacatcctagggctggcaggcactgtagcaatgcacgtacctgcactctcctgaatgcagtacctgaagcagggtgagcactcaagaaagggtagctgtaattcatacgtattacagggcttgattgttaaatattctgtgcttcatggactctcagaatccggggatcacaagactgtactgttacattatgtactgctaaaaggaagtgatggtaagacattaatttacatgttaaaatgtgaaaaaaatgtggatcttagaataggtaaactaaggtaagtcacatttttaaaaattgtggtaaaatactacctaacatgaaatttacatttgagcagttttaagcatacagttcagtgacattaagtccattaacgttggcgtaagccatcatcaccatccatcttcagaactttttcatcatcccaaaccgaaactcttgagcctattaaacactactccattccccactcccgccattctctggtgacccctcttctactttctgtccctgggaatttgtctgttaggtacctcttaagatttagctacatttttatagaaattgaatctatgtgatcagcaagatcagatgaccacatccttttcaacaaagttcttaagcagatatgatctcagcaggggattttctagtttagtggttttggagatgatagaagagagggaggaagtcggagggagtgtagcaggggcttatgtatttttatggtactcttctgtttttgaatgtttacatctttattctcttgaataatataattcatgaagcaggtaaagatacagcttttgttctatttctttccagccacttagccccaatactatttcctgagcaactcatctttttctattgattttaaaaaaggtccactgcagaattttagactgttccttcacaagatgcattgtcagagatgagcagttttcctttgctattttgtgtgacgctttgtaaattcagagataatggaaaagccaaaatgtaaacacaaaaatttcactgtcaataatctggctctttttctatgtaaataaggtctctcaatttttctctccataggaagaactaaacagttctatttaacctttttaattttatgctaaatttattttactctaatggcacaaccacctctcatttagttgtgccagttaagagtaatattggcagaagtaaattaaatcagtgtgtaatgtgcccgtttgagttaggaccttggaaaacgcagcaggaatgcgaactcagcagttggagaaggcagagacagggtggcaggtgggaagccctcccagccgtgggtaccatttttgttctcagggcactctaggaaagttttttgagttgcctttgtgtgctgcaagtacccttggtgagctgcccacatgaggttgacttctgccttttagagccaatcactaaggcaaagtcaaattccataaatctgttatttcacaaaatgaggcatattttacagttttaacattcttcagctccatcaacatttgtgtaaagagtgatggcaaatacatgctcttatggtggcatttcttattttctgcttgagacacgctcatttccccccctttacttttaatcttcctgtttccttgacacacctgcttccgaaccccattgtcatctctccccgctgtgacagttcaccagcacttcatggtactggagactctttcaacttgccttttccaccaactgtcagttgcaaaataaggttgctttgtttgggagggagagggtggaatcctttctgaatgtctcctgttcctttgaagcaggagcacttcagagacaactgaactgcttttaggtttttcttaccacccagctttttcttctgattgatcctgccgtgaacacacggttctgttgatgacatcgatttgttgctatggaaatagtggtaatgtcacagattcaacccagtgactttactgcaggttgttgcaggagaaatgggcaaggctttaggggagaacctcattaacactgaaggctatcaattctaagcaggtgaaaggtagatggagccaaccttttgtgtaatgaaaacaaaaagtgaacccctagcaaattcaccgagtgccatggaatgcctcagcacgaattctaatccatgggagtctttgacaaaataaaaaatttacactttcccagagcattccttctacccaagtttaaatctcttaacccaaatcctttgcactaaaacggggtttcccttttgatcttcaggactcgggcagccgcaagtagctcctccagcgccagcagccagcccagcagcaagcagcaggccccagccgcagaatggaagctcgggaatgggtgagatgcctcacggggcgtgcgctgaccaggggtgtcagacttcggaatcatgttttgaagttgaatctgggactaaagggagttttccaaatgccattcattacagggttgtgtcttggaaagaataattctgattcatattttagagtatgtgattgaaaaaataattaaagattgtctttttttttttttttttttttggaagtagggtcttgctctgtcagcggggctggagtgcagtggaagcatcacagctcgttgcagccttaacctcccaagtagctggtactatgggcgcatgccaccatgcctggctaatttttttgtagaaatggtgtcttactatgttgccctggctggtctcaaactgccctggcctcaagcagtcctccgtccttggcctcccaaagtgctgggattataagtgtgagccagggtgtccagccaaagataatcttaaagatacttaacagccagacttttaaaaaagatcaaattgatacattcttctctgttagtagttgaccaagtagtttcttcgtttcccacatcatcaggttttacaccctctgactttgcattccttttaagttcttgccttttaactatccaggacccacttactaagtttggctcatctctctccgagtttcctattttgggcctcgtgggtgtttatcgtttgcttgaagacagtattacttatattggtcataggttctccttctcaatttcatggatgagaaatggtttcttcatttacttttctctgcagcaggtcctaagaggcattaatggaatcattttgtttactttctggcctttactttaggaacctcttgatctgggaagtcaccgttgaaaatttggatttgtagaatgtggttggatttatttttagaggtccttttttctgtcacggcttcacatacacctcctctcctcccctcaactattagtttctatttttcagtgctaagattctgagaaaagcaaggttaagatgtcactgatgtttctgtgaaactctcaggactttcccccttgccctttgttgtttttaatctaccttgcacgatccgtctacctctctcgctcttgcacgttctctctcttgctctgtctctccttttataagaggatctatttatacacaactcaaaaattacatgctgttggccaggcttggtggctcacgcttataatcccagcactctgggaggccgaggtggacggatcacttgaggtcaggagttcgagactagctagcctggccaacatggtgaaaacccatctctactaaaagtacaaaaattaatcgggcatggtggtgtgcacctgtagtcccagctactcgagaggctgaggcatgagaatcatttgaacccaggaggcgtaggttgcagtgagccaagtttgcgccagtgccctctagcctggacaacaaagtgagactctgtctcaaaaaaaaaaaaaaaaaaaaatatatatatatatatatatacacacacacacacacacacacacacacacacttttgaagagagtggtgaaatagactctctaaagtggtaaataatcatttccttaggcttatatacaaatagtacgttattcctctccctccctccacagaattatttttctggttgtctatctttgccttatgttaaaatatatttttaaaaatctgggctgggcacagtggctcacacctgtaatcccagcactttgggaggccagggcaggaggattgcttgagcccagcagtttgacaccagccaaacatagtgagacccgatccctctaaaaaaatctttttaagaatcagctgggcgtggtggtgcacacctatagtcccagctactcaagaagctgaagtgggaggatcgtttgagctcaggagtttgaggctgcagcgagctaagatcgtgccacctgcactccagcctgggggacagagcaagaccttgtctcaaaaaaatgaaaatcagttaatgttccctaaactatgtagtgaaaggaaatgaactggatgtgtactgaggagaagctacccagcatgaaatagattggatgaatggatgcttgtgtgtgttttataaaattatatattatgtatgggtatacacatgtattctacaaagtacctgtgtgtccttacacgatcttgaggtaattactattgtgtgtgtattgatctctctcgactccccagttagaaaatttcaacacagaaacactcctatgtatattttttactaattactacgaatgcctagaagggtgtggcacatgccgtggaaacccagtaaataaatactggatagatggtgtattgatatttttagccaaattctattctgaagaaatgttttgatgtagagggtatgaaatcactgaactaaattatattttctgaatttggacgttgagttttgcagatacgtggtgcgtataaaagaactcacctgattccctgttctttcccagcgcagggcagctgcttaggtttggattaaggaggcggaagggtcttagtggtcacccacttaacatatcttgaccaaaaactgattcctgccctttgcacccgacgaaactcattcttacagacttcattctagacttgctagtccttcagacgcattgagatctgggagttgtctggggatttggaggcgatctatttgtgataggtcccttacatcctgtctttcttcatgtgactagtgccttgccatcagttttaccagttacaaaagttgattttctttttctcacccattatcttgcccgttgaggcaagagaagtgtttaagagggcggccttcagaaacagcagtgtctggattcgtcaccattattactttgacctcggggctgacatcagcaaacatagcagtgagctgctgtgtgcgcagccttcatcctagattgcttttgtagcctccagcctcagtctctatttgatctgcgtatctcttgcatataaaaaggaaaagctttgcctctcatgttatatgatttcactagtggcacctccaaaatttagagttattgtaaagcttactataaaaaagctaagtagaatagtaataactccttttcgtttgcgtttgtttttaaaggttctactgtttctaaggcttatggtgcttcaaagacatttggaaaagctgcaggtcccagcctgtcacacacttctgggggaacacagtccaaagtggtgcccattgccagcctcactccttaccagtccaagtgagttgttgcatagagtaagttcagagtgtacttatgaaatcggagaagctattatggactcttgagttatttatgcgtgaacttcagggtcaccaccaaataccaccaaatagaatgggtttactcttttttttttttttttttgctgaggaggaaaggggtacaaattgtggcaaacttttaactcttgttggaaaatatagtaacaatagcaatctgccatagcctgtggggtttcattcattttgaaagaatttgaaattaaaaatacttaatgcttaatcagttgatagtcttatgagtaaaaataaatatttctgataattcaaaaggcatttaatcttctcctataaacaggtgacttcgtctttggtttagttggctaaaataatctgcactatttgtattaaacacatgaacataccctgaacataaatttcttttatatgacttttttccaccaaaaattaatttgaagccgggcgcggtggctcatgcccgtaatccccgcactttaggaggctgaggcgggtggatcacctgaggtcgggagtttgagaccagcctggccaacatggtgaaaccgtgtctctactaaaaatacaaaaattagccaggtgttgtggagcacgcctgtaatccccgctactcaggaggctgaggcagaagaatcgcttgaacccaggaggcggaggttgcagtgagccaagattgtgccactgccttccagcctgagtaacagagtgagattccgtctctcaagataaataaacaaaataaagtaatttgaatagttaaaaattagagttcttttttcagaatccttccagatatgtttatatttattcttcaatactctgtaacgtaggaaagatatttttccctgtgaaattataagtggggtacctaatgtgccctgtgcctcctttttccatgcttctctctaaggtcatgctgcttcagtgtgttcttcctgatggtccaccaacatcgtgtattctattcagggtgtgttacgaatgagacagaagtgtaacaccagttatatcagttcccataattgaaaactgtggcaaaatataattgctggtgttactgtattttccagcttagaacctttcattaaggggatatggttgccttggtgatgctttttggagaagggagagagtttataaatttacttatttgacaggagaatgagttagtattaaatcactttgcatgttttactatttgcttattctgtaaactgtcaaacccatgtgtcatcttggggttttaattagctggattaaaatacaggttggaaaacggaatatgcgtaagacgagaaaggctgtaggaagatgatttcttacttgatcttttccaaggaagaccccatacactaatatgatcgatttggtttgtaggtggaccatttgtgctcgtgttaccaacaaaagtcagatccgtacctggagcaactcccgaggggaagggaagcttttctccctagaactggttgacgaaagtgtgagtgtttgtcatgctggggagtgagggcagtgggctcgccgggaaacagaaggctcagctctgcggagggcagtgggctcgctgggaaacagaaggctcagctctgcggagggcagtgggctcgccgagaaacagaaggctcagctctgcgggcctatgaggtgaagaataatagtaggccagagagaagcatgattgttattgtgcttttccctctgtcatagtcttttgatgctgtctggagtagagggttaaggtcataaataaaatctttgatcttaaatgacagcgtttgtagcagtagaaagtagttttctaaatatataagtagcctcctgggcaggagaagctggaaacagtctgatttgctggcaggtgtactggaagcactgggaggtgatgcctgcttgtgagcgccgtggagctttgggacacagcagaaggcacacagttgtgacctcgatatgggagtggttttgtgggaaatgggttctgactgtgcagattctctatttgctttatttaaactaaacaaaaccatgacgatgagacaaaattcctatgccatggaagtacgacagtcttgatagctgttaatcagtccattcgttttgctaataattcctgaaattgccgggtgtggtggctcacgcctgtaatcccaacactttgggaggccagggtgcacagatcacttgaggtcaggagttcgagaccagcctggccaacatagtgaaaccccgtttatactaaaaatacaaaaattagctgggtatggtggcaggtgcctgtagtcccagctacttgggaggctgaggcaggagaatcaatcgcctgaaccaaggaggtggaggttggagccagccaagattgcaccactgcactccagcctgggcgacagagtgagactccatctcaaaaataataataattcctaaaatgtacttcagcattcttttcaaagtgctgcagatttcctgtttgttcagactcccaaatagggagaaaaaaatagatgttttttttggaagttgatataacacccaaaatgtttgtgtgatggcagaatcaatattagaacctaatttttttttagaaattattgctctaatgtatggtggttggctaaaatttcttgtccacttgtaaattttggctgacagaaaagcaaaagtgaaaatcagatcacaagcaacttgcaaacatgacttactctgacatttttggcaatggctccgaatgtgaagtggtttgtcactgagagggcactgtggagggagccggtgaatcaccccgtggcagcaccttcctcgtgggctctgggcgtgtccctcagtattcaactttttttgtttttattgtcagaataaattaaactcgtcattgccgttttgttctgttctgtttctcagttgaggctaatgcagcatgattatgggatcggctagctgaaattctcattcttcagcggggccagtgacttcagtgtgtgactgtaaaatgcgggttcctgggatgtccgtagccctctctggaccctgtttgtgcaagggccactgctctcaagatgtcactttggtgctagggtggcctgtgttctatcccagtgtcacttgggtgctggggtggcctgtgttcaatcccgcagccctaacctgcccacgtgcttctgcagggtgaaatccgagctacagctttcaatgagcaagtggacaagttctttcctcttattgaagtgaacaaggtatggccgtgctgactttagaactgacaccgcctgggggtggagtgcggatgaaaagacgctggcccaggggaggggtgtgtggtggcagactaggggtttctgtccgatttgatggtagtctcaggttctgtggcttggcctccttcgcaggtgtattatttctcgaaaggcaccctgaagattgctaacaagcagttcacagctgttaaaaatgactacgagatgaccttcaataacgagacttccgtcatgccctgtgaggacgaccatcatttacctacggttcagtttgatttcacggggattgatgacctcgagaacaagtcgaaagactcacttgtaggtaagctcgtgtatgagaaggaagagcagggatgactagctttctttgcagtgtacggggtggtgtcaggcttcagtgcttgccgttcatcatttgctggcgtcggaatgggagtcttgaccacctcctgctaacacgtgcatgtgttttagacatcatcgggatctgcaagagctatgaagacgccactaaaatcacagtgaggtctaacaacagagaagttgccaagaggaatatctacttgatggacacatccgggaaggtggtgactgctacactgtggggggaagatgtaagtgctgggatggggtcttcaacacgcacaggacctcctggggttggggcgtggtcttgtcctataggatggggccttcagcacacacaggaggagctcctggagttgggggagggagtggtcttatcctataggatggggccttcagcacacacaggaggagctccaggagttggcggagggggcatcttgtcctataggatggggccttcagcacacacaggaggagctcctggagttgagggagggaggggtcttgtcctataggatggggccttcagcacacacaggaggagctcctggagctggcggagggggcgtctgttcctataggatggggccttcagcacacacaggaggagctcctggggttgggggagggaggggtcttgtcctataggatggggccttcagcacacacaggaggagctcctggggttggcggagggggcgtcttgtcctataggatggggctgttagcacacacaggaggagctcctcgtgggggcggttttgtcctatgagttgggggctttcaccatgtagatgggaaggattgtgctgtctggtaagtatttaaaatcctttatcttacttctgtgagatttgctgtgattcaagctttacgcggggaaatgctctttcccctaactctaggaaagcagtgatagttttgatgtgtctctgagtagattctcatgtgtgaggtctgtcttgtatggattccatgtacgctgattacattcactctactattgaatgtttgccttgttttctataaaaatcttctgtgttcttcctgctagtgacacttgtatatgtctggtgtttcttttacaggctgataaatttgatggttctagacagcccgtgttggctatcaaaggagcccgagtctctgatttcggtggacggagcctctccgtgctgtcttcaagcactatcattgcgaatcctgacatcccagaggcctataagcttcgtggatggtaggttttgtggggctaaacaaagggttacttgaggctgggctttgagaaaagctggttacaatcagcatgggagctttctgccaagcagaagccttcgtccctgagtggtgcagcttccgtgtttcttgaaggcattatgccttctgtgaggagggctttaaagcccttaaacggacaaacctgtaatcccaggacaaacctagagagtcggaggaggcaattagcatgtaagtgctgcctgctgacctcgatcctgccaaaggaggggacggccaggcttcagcagcggtgtgctgaaggcgcctttctttccagggtttaggctctgggcctctgtggcgtgggggaacacatgctttctttctctgtcaagtctttggtgccgatcacatcttctagtgtgtattcactagactctgatcaagtgtggtgagaacaatgggctttttgttaggattagattgttattcccaaagcactcaagggatgaggagagcctgttaaaatctcctcactgtatctagctttttaggacattcaaactctgtcttaaaagagtacttcaaactgagacacaggatgcaagaattgatgtggtcagggaaaacactttcacccaagcttcaataattcccatagctgtagtctatgggggggaagtgtgtcagtttccagctgtgtcttaggatttaagcagctaaagaatgagctcattttacatactcctcctttgttttgagtcatttaaaccaatggcactggtgtttgaccagtttcatgaagcatcttctggaatgttcatgtcactgagccatcctcatgagtagtacggtccacacgtatctgccgaactgcagggcccgttcatagtctgaccagaactagccacagatttgcttttttcttattgcttgattttcttttaggctctggagttcgactccaggttaattgcattcccacattaaaatcgcattcccacattaaaattgcattcccacattaatgtcttcatcttttacttgtcaataatcatgatcccagtcaacataaaaagcacggctgtccccagaataaaataacttggcattgatcaaagacaagctcagtgcatacatgatacctggacaaggattagagatgtttagatcttggctataacaatgcagagtttttattgtaagaagggccgccttgactcctgacgagtgatctttggtggcaaatgtctccttggagcttttgaaaccgtgaacttgtgtagctagtagtggtgaaacagatggatgggccttgctgtgcccctgtgagggatttagccgcttacctgacaggagaaggcagctgtctgcagctcagggtaacatccattctgttagatggtctctgtttaaggaacctgttctttgtgtggttacccaccttgggatggtatttggcctttcatctccggccagctcctctccgccaccactgtgttcccgagccactttctccttggccccttttccttcatatcaattgatgtgtgatcaagaagtacaatcagttttcataataatttaatacaaattaatttagcttcgatattagcaaaagtaaaatttcactaagaaggtaaatctacaagaaaaaagataatgccttctgataagttgctctggtttataaaatcttttgggccaggcacggtggctcataccttaattccagcactttgggaggccgaggtggacaattgcttgaggccaggagttcaagaccagcctggccaacatggtgaaacctcgtctctacaaaaaatacaaaaatcagccgggcctgtagtcccagctactcggtgcgtgcctgtagtcccagctactcgggaggctgaggcacgagaatcacttgccaggaggtggaggttgcagcgagccaagttggtaccaccacactccatcctgggtgacaaagcaagactctgtctcaaaacaaaaaaaccacttttggcttctgtatcaggcataggaggccttttatggaaacacttttgctaccacggtatattggctgtccgtttccacactggtacatttcggtgatgatcaccacgcagctgctgcctgagaatgagcattagcagattaaaggactaccccagacggccactttatagcttacgggttgttgactttcccagtttctgattttaggcctggggtggtctggccactgccaatatgcaaggctagtttaagaaaagattctttggtactttggcactgattctcttcaccactggggggcatcaaagcaactgagattcaaagaaaggtcattccgtttcttcagtagactttgggccaggagcagtgcctcacgccctgtaatcccagcactttgggaggccgagggaggaggattgtctgagtccaggagtttgagatcagcctggccaacagagcaagaccccatctcttaaaaaaatttttttttcgagacggagtttcggtcttgttgcccaggctggagtgcaatggcgccatctcggctcactgcaacctccgcctcctgagaattgcctacaagtgattctcctgcctcagcctcccgagtagctgggattacaggcacccaccaccacgcccggctaattttgtatttttagtagagacggggtttcaccatgttggccaggatagtcttgatctcttgacctcgtgatccgcccgcctcatcctcccaaaatgctggggttacaggcatgagccactgcgcccagcctaaaaaaaatttttttaatgggcctgggcatggaagtcccagttacttagcagggcaaaggtgggaggatcactgagctcagggggtcaaagctgccttgagccatgattgcatcattgcactccagcctgggtgacagagtgaaactctgacacaattttttttaatttaaatattataaaaaatatataattacgaagataccagcttcagccgacatgaccgtgacctgtgtgaaagctgggcgggtggtgggaaacctgtgtctgtcgcgtagcagcaagttgcatgtggagaagcagaagcatgtcacatcaagcgctcgtcatcgttattcgttcacgttttcaggtttgacgcagaaggacaagccttagatggtgtttccatctctgatctaaagagcggcggagtcggagggagtaacaccaactggaaaaccttgtatgaggtcaaatccgagaacctgggccaaggcgacaaggtacccagcattcctaaccaccttcacaaagggctgtaaagtgtgcagaaggatggatttagaaacttggtttccagcaccagctgtcagagccgtaattcttacccggggctgtgacctgagcgtggcatgggggttgagaatcactggcagagggaagcagccaggtgtgctcatgggaatatgtgttacccctcaggggactggaggcaggagagtctgaagaactcttagagtcaattcctagagggatcttggagcaggggtgacagtcaagctttgtggtataatatcacctgctttcgggtccacgtttctttcctgtgatccttcctgcaaatttaagcgcccacatatcaaaaagatgttttttgagatgagcgttagtccgcctcaggtcagacatgaggcagtttcacgggtgctgttcctggctgtagaatagtgtattaacctcataggctgagagctgccggcattcccggacaaggattggccctgacatttgacttttagttgcagctttttcctttcagtgtttgtatttaatgaccctcctcccatcttgatctaagcctgtgttctgccagcagtttagtatttagatcatttatttctcctttacgcctgctcttttattttcatcatatacagtgtaggtttcattcctcctgtctcatttcactgtatacccttatccatcattgtcaacagcagctcttaagtgctcttatagaacatctcaagaattaaacactggacagatcctcgttgtcctgtcatgggacacccactctttcggttctctgtaatcccagctacccaggaggctgaggcaggtggattacatgagcccaggagttcgactgagcaacatggaagaccccttctcttgaaacaaaaactttattgctgaaaaatgctgacaatcatctgagtcgtaatcttcttgctggtgggggtttgtttcagggttgatggctgagcagtcacggcgatggttgctgaacatcggcgtgtctttggcagtttcttaaaataagacagcagtgaagtgtgccacattggttgactcttcctttcacaaaagctttctccatagccggcgatgctgtttgacagcattttacccacaggagaactttttcaaactggagtctctccctctcaggtcctgtcactgctttatcagccaagcttatgcaaattctaaatcctttgtcgtcatttcaacaatgctcacagcgttctcaccacaagagatttcatctcaagaaagcactttccttgcccatcgtaaggagcagctccttatccgttcaagtttgatcgtgagattacagcagttcaggcccattttcaggctccatttgtaattctagttctctcgttattttcgtcacatctacagatccctcctccaccaaagtcttgaagcctcagtgtctaccttgagggttggaatcaacttgttccaaactcccgttgatgttgggattttgatctcctcccatgaatcatgaatgttccttttttttttaacttgagacagggtctcattctgtcactcaggctggagtgcactggcttgatcacagctcactgcagtctcaacctccccaggctcccaagctgggactacaggtgctgccacacctggctaattgtattttttgtagagactgagttgtgtcatgttgcccaggctgctctcaaactcctgggctcaagggatctccctgcctcaacctctcaaagtgccaggagttacaggtgtgagcgactgtgcccagccaactgttcttaatagcatctagaatggtgaatccttttcaggttttcaatttactttccccagatccatcagaggaatcactgtggcaactatcgcctcatgaaatatgtctcttagacttaaaaagtcaaaattactccttgatttgcatgggctgcagaatagatgttgttatcaagcatgaaaacaatattaatctccttgttctgtgcatctccattgagccctcgggtgaacaggtgcattgtcaatatattaatctccttgtactgtgtgtctccattgagcccttgggtgaacaggtgcattgtcaatatattaatctccttgtactgtgtgtctccattgagctcttgtgtgaacaggtgcattgtcaatatattaatctcctcgtactgtgtgtctccattgagctctcgggtgaacaggtgcattgtcaatgagcagtcatatttttaaaggagtctctttttctgagtagtaggtctcaacagtgggcttaaaatattcaataaactacactataaatagatatgctgtcatccaagctttgatattctatttataaagcagaggcaaagtagatttagcatagttcttatgagccctaagatttttgacatggtcaatgagcactggcttcaccttatagtccccagctgcattcgcgcctaacaggagagtcagcctttcctttgaagctttgaagccaggcattgatttctactctctaggacgaatgttcttgatggcatcttcttccagaaggctattctgtctacgttgaaaatctgttgttgagtgcagccaccttcattggtggtcctagctagatcttctggataacttgctgcagcttctccatcagcacttgctgcttcaccttgcacttttgttatggtgacggcttatttccttaaacctcatgaaccaacatctgctggctgccatcttttcttctgcagctttttttttttttttttttgagacagagtctcactctgtcacccaggctggagtgcagtggtgcaatcacagctcacctcagcctctggagtagctgggactacaggtgcacaccaccgtgccctgacagatttttgtagagactaggtctcactatgttgcctggctggtatcgaactccttggcttaggcaatcatgttgcctctgcctcccaaagtgctgggattacaggtgtgagccactgcacctggcctcttctgcagcttcctgacctctctcagccttcacagaattgaagaaaggtgaggccttgctctgggttaggctttggcttaagagaatgttgtggcttgcttgatattctatctagaccactacagcttactccatatcagcagtaaggctgtttgctttcttatttgtgtattcaaagaagagagacaggaatacttgattggaggatcagtcagcatacatacaacattcatcaatataagttccccatcttatatgggtgtagttggtggcaccccagaacaactacaatagtgacgttaaagatcactgtaggccaggcgcggtggctcattcctgtaatcccagcactttgggaggctgaggcaggcggatcacctgaagtcaggagatcgagaccatcctgaccaacgtggttaaaaccccgtctctactaaaaatacaaaaattagctgggcgtagtggtgcatgcctgtagtcccagcttctcgggaggctgaggcaggagaatcgtttgaccctgggaggcggagatttcagtgagctgagatcatgccactgcactccagcctggtgacagagcgagactccgtctcagaaaaaaaaaaaaaatcaccataacagatatgataataatgaaaaagggccaggcatggtggcttactcctataatcctagcacttcgggaggccaaggtgggtggatcacttgaggtttggagttcgagaccagcctacccaacatggcaaaaccccatctctactaaaaaatacaaaaattagccaggcgtggtagtgcacgcctgtagtcccagctacttgggtggctgaggcaggagaatcacttgaacctgggaggtggaggctgcagtgatcagagattacaccactcactgcaccccagcctgggcgacagagcgagactctgtctcaaaaaatacatatataatgaaaaagtttgaaatcttgcaagaattactgtctttatgtgacacagagacataaagtgagcacctgctattgggaaaatagtgcatttacttgacccaggggtgccacaagtcttcaatctgtaaaaaatgccgtatctgtcaagtgcagtaaagcaaagcacaataaagtgaggtgtgtctgtagttgcagcagagactgtgaccaaatggctgctaaggcctgaaatatttactgtttggctttttacagaagcagcttgctgatccctggcctaaacaaggaaaaggtgaatctaggcctagacacgactgccgtgttttgagcgcgggagggatggttgatcgttgctgcactgggtgtttgtggtccgcattctgtatttcctagatctgtggcctttggagggtcagaggatcgggaggaacaaatctttgtctttcatacagtgttcaagcaaacaggaaaacaatttcacttttaattaacttagtgtaatttaggattaactcttttattgtgaaggaattatctgcctcagaacttggcttattagaacttggcttattaccttcatgggttttgtactcggcacatgtgatttctaaaactacagaatgaatgattccctgtgatcatgtgtaatcttgaggatgtagaaacacttaccacctaaacgtaagggcaggctttgagctgcctctcggtccgatcctgggcgggctcgcgactccgtgcctcatgctgttcttttctcccgaagccggactactttagttctgtggccacagtggtgtatcttcgcaaagagaactgcatgtaccaagcctgcccgactcaggactgcaataagaaagtgattgatcaacagaatggattgtaccgctgtgagaagtgcgacaccgaatttcccaatttcaagtaccgcatgatcctgtcagtaagtagcctcggtagatgagaaccacggttgtgttcacggaggccctcccgtgtgccaggcactgtggtcacaacagtagagacaaagcattcctggtaggaagcccgcagatgagtaggtgtggaagagcttatccatccgctttttcatgccagaaagtggtgttgagataccccagctgattcagtctttcatgcacgtcatacagccatagcgtcagtgacacttgcctgctaactgctatgaagataaattaatttgaaaacggcatttatagacagcactaattgtacttacacagccaatgcccgtatttagtcactttcatgtggataatctattctctagctttagtatagctgacttcagaggaatgtgacggtgtgctgatgtgagattgttgcttttttgcattttaagaattgtttctttctgttttaaaaacctttttaaaaaagttgtaaagttgggtttaaaaaaatttttttttttttttaagaaacaggggtctcactctgttgcccagaatagagtgcaatggtatcatcacagctcatggtggccccaacctcccgggcttaagcagtccttccaccttggcctcccaagtagctgcaactacagctgtgcaccaccacacccagctaatttttaaaattattttattgtagagacagggtctcgctctgctgttcaggttggtctcaagttcctggcctcatgtcatcctcccacctcagccttccaaagtgctggcattacaagcctgagccactgcacccggccttaagatttttattttgttttgttttgttttcaatgatagaactaggcgataatagcagtttaagaaaacagtttaaggccgggcacagtggctcacttttgtaatcccagcactttgggaggccgaggcgggtgcgtcacctgagatcaggagtttgagaccagcctggccaacatggtgaaaccctgtctctactaaaaatacaaaaattagccgggcgtggtggcgggtgcctgtagtcccagctactcgggaggctgaggcaggagaatcgcttgaacccgggaggcagaggttgcagtgagccgagatcacaccactgcactccagcccgggcgacaagagcaaaactccatctcaagaaaagagaaaaagaaaacagtttcacatttttccaaaggatgatttggcagtaatatatcagaagcctgaaaaatgttcatattggccaggcgcagtgacttgtgcctgtaaccccagcactttggaaggctgaggcaggatgattgcttgaggctgggagttcgatatcagcctgggcaacatggcaagaccctgtctctacaaaaagtaaaattagctggctgtggtggtatgcacttgtcccagctactcatgaggctgaggtaggaggatcgcttgagcccgagaggtcaaggctgcagtgagccatgatcgtggcactgcactccagcctgggtgacagagtcagaccctgtctttaaaaaataaataaataggccgggcacggtggctcacgcctgtaatcccagcactttgggaggctgaggcaggcggatcacgaggtcaggagatcgagatcatcttggctaacacagtgaaaccctgtctctactaaaagtacaaaaaaattagccaggcgtggtggcgggcacctgcagtcccagctactagggaggctgaggccggggaatggcatgaacccgggaggtggagtttgcagtgagccacgatcgcgccactgcattccagcctgggtgacagagcaagactccatctcaataaataaataaattaaattaataaatgataaataaaatgaaatgttagcttagcaggacagttctacgtttaggctcattttttgtaaactataaacttttcattgaactaagatgaagaaaatttgttttagtttgtggaaacatcagcctttctgttaaactccacagcgcaatctcccgcacacttgtttgatttgatatttatcacacgtgtgcgtcattgtagttcttgccctgtgtgatgagatgctctttgcttcttagaaggatagcgtgggttaaaggaagtgtgagcccagggtgtgataccgttgctgtgtattgagagcgcttttcacttttaactggtttcgtcaccttatttttcgtcataacattctctctattaaaagccttgtacccatgcaaaatgaagatgtaaaatcgtcaaaatgatgccttaaagaaaaaccactcgtgtttctacaaaggcttttacttcagcaagtggattctttgagatctgctttcttccttgactttgccctgtttaatgttacaccacagcccagtgggagacatttgattgctcatttcctttgccaggtcaatttggtgactgacagaggctcacgggcaggctcttcagttgtctgggtgcccagcagtgacagagccgtctcatggaactcctcctaggaactacagagtgggcaattgaaaatgcagagaactcccccgattcactcaaaacccttcatccaaagccagctgcacctcgacaggaactaatctgatgggcctctctctgtcacccaggctggagtgcagtggctcgatctcagctcgctgcaacctccgcctcccgggttcaagtgattctcccgcctcagcctcctgagtagctgggattacaggcacccgccaccatgcctggctaatttttgtatttttcgtagagacggagtttcaccatgttggccaggctggtttcaaactcctggcctcaagtgttccacccgccttggcctcccaaagtgctgggatgacaggcatgagcccactgcacctggccctctctggaaattattttaataagtggaaaaagaacattaacctctccccatcttctcagtgtgtctttttattatttctttgctgaaataatgtagaattgtgttttttaggtaaatattgcagattttcaagagaatcagtgggtgacttgtttccaggagtctgctgaagctatccttggacaaaatgctgcttatcttggggaattaaaagacaaggtcagccacatattttattataacttctataacttttaatggttctcattctataacactgaccccacacatttttttttttttgagatggagtcttgccctgtttcctaggctggagtgcagtggcgcgatctcagctcaccgcagtctccgcctcccgggttcaagtgattctcctgccccagcctcctgagtagctgggatgacaggcacccgccacgatgcccggctagtttttgtatttttagtagagacggggttttaccatgttggccaggctggtctcgaactcctgacctcatgatctgcccgcttcagccacccgaaatgctgggattacaggtgtgagccaccacaccttgcccaacactggccctctttttgctgtttaatattttttagtttgtttctttttggtattgtttgtatacagtttctcagcctgataattatttaagagctcatctgatgttatctaatcttgtccatttgggatgtgcttaacagtgaaataatgtatataaaagtactttaaaaccaaagcactttctaaatcgaagccacccgtttctcctgttcctattagcacatcagagctagtgtgcctgagatgacttaggtcgggaggtgtccctgaaacaacctgaattattacaggcatgcttttttaacatagtaaataccttccagaaaagttgagtcagatcctggttaaaatgcacgtatgtcaagttcctgggtctgtcctataaaacaataataataaatgcacatataaggtgcctgccatttcagcccatcagatgcaattcttatgcggtgactttcttccgtaaggtaactttgtccatttcatttttataagtttgcattttcacatattaggtttatttaatgtacagaatagattgctaataatgctgaatttaggaaaggtagttgctcaggtaaaacataaggaagaccaataaaagctatgttttctgggccacataaatgggcacctttctgtagatggcttttcccccgatttcctccaaattggttggaatacttgtaaaggccacaaagatgaaaggctttgccatttgttctggtgtgtttttctttttcttcctgtccccagttctgtctgtttgggctctgccctgactctttttttaaattgtccatgagagctctcaaaatagtctcaacaaatcctgttacagaaataactagaattgactttaaagtgtgatagtatcttttgtctgtttttacctggtcttcaattttcgtatcagattttaaggcccgagtaagcctttcaggatttttatgagcttattatatttgactgttttttctgccggtgaatgaggacatatagaaacttccccgaggaaccgtgagatcctggagttcgcactccacgcccctcatcttggaagcataatggcagccggtgtaattttctcaagctttaacccattgttttattttcatatctgaaagtccatttggtttgggtttgggttttgatcaagtaacctttacagaaaagagttctgtatagcaaagctgctttcacgccgtgcgtgacttgcaaaaaacactaggttggtgtgaactattaattagtttttctttttttttgtcaaaggtctcaatcaactctgttaatatagttattacacatttatttatgcatctttatacaaactatattctctaattcttgtctgtttaccagacttttttttttttaataaacttaaattgcatttgaggagtgagagagggaaaaggattgtttttaggccttccctagcctttgcgcacctcaacagtcttctctgcttgcacaccaaatcagtagctataaatacagaggctgaaatcacgaattatattgaactttcttctgagtgtttttcctttttttcttttttttgagacaaggtcttgcctcatcacccatgttggagcgccgtggtgtgcgatcatggctcactgcagcttcaaactcttgggctcagacagtcctgccacctcagtctcctgagtagctgggactactggtacacgccaccatacctggcttaagtttttttttttttttttttggtagagatggggttttgctatgttccccaggctattcttgaactcctggcctcaagcagtcctcccacctcggtctcccaaaacattgggattatagtcacgcgccaccatacctgacctcctaattttttttttttttgagagtctcgctccatagcccatgctggagtgcagtagtgcagtctcagctcactgtagcctccgcctctcaggtcgaagcaattcttctgcctcagcctccctagtacctgggattacaggcacctgccactatgcccagctaatttttgtgtttttagtagagatggggtttcaccgtgttggccaggctggtcttgaactcccaacctcaagtgatccacccgcttccgcttcccaaagcgctgggatgacaggtatgagccaccgtgcccagccttaaagtcttagaaacttcctaagagcgtttttaattttttgtgtctagtaaagcatacataaccaaatttgcctttgtaaccatttttacgtgtacagtttagtggcgttaggtacattcacattactgtgcccctgtcaccaccatccttttccagtacttttttaaataggcaaattcatagagacagacgacagccttgtgttttccaaggatggagggaaggggagaatggagacacactgttcatgggtggcgatttgaaactctgcacattaagcaatagctccttttccaaaaccctcttctccctggccctgacaactgccattctaccttctatgaatgtgattagtgttttaattttcaataagattctacttaaaacagtttcatgtaatgttacctgtagatgagtcattcctaagtaatttgaaactacccaggagatgcattttcagaagtctttttaaaagtcttatcagtatttgcaagttgtccagtggtttccatgtgtcaagttttatgtttgtttttgcagaatgaacaggcatttgaagaagttttccagaatgccaacttccgatctttcatattcagagtcagggtcaaagtggagacctacaacgtaagtaagggcctgggcagcagggttggtggtggggaggtgctgtttgtcacctacggcagtgtcgtgacactccctggcagggagttactgtactcactgccagaccccggtgctgactttgcccaacacaggtgctgttatgatccccattttcagatgaggaaggagagagagcttaagtgtcttgtcgaaacaatggcgggggggtggggaatacaatatggatttttttgtttgtttattttttttatttttattttttttcagttaaatcctaggattttttcgtctgtgttctgacaaaaaaattataacgcatgcagtagagtcatatctttgacaaatttagattgtagaaaagtatattaagtatatgagccgggcgtggtggtgtgtgcctgtggtcccagctacttgggagactgaggcagcagttcaaggccagcctgggtaacatagtgaaaccccgtttctaagtcagtcagtcagtatatgaaacaaaggccacgtgtggttaaaactaccttgaaaattcctgaaattgcccataataccatatagtatttatttatttatttatttatttatttatttatttatttatttgagacagagtctctgtcacccaggctggagtgcagtgggacgatcttggctcaccacaacctccgcctcccgggttcaagtgattctcctgccttagcccctcgagtagctgggattacaggcgcccgccaccatgcccggctaatttttgtatttttagtagagacggagttttcaccatgttggccaggctggtctcgaactcctgacctcagatgatccacccgcctcagcctcccaaagtgccaggattacaggcatgagccaccgcgcccagcttagttatagttataatcaaacagtattgagcatggtctgccaggtaactgttctacatcctttacgtggaacatctcacttgagcctagtaaccctatatgtagaaactgtggttaccctattttgccactgaaggaattacatacagagagacacgggcattcagagaacaagtcacttgcctaagttgtatgctagcaagtggtcgagctaacgtccaacccaggcagcctgacttcagagctttgcttttgatcatgcttacgagtatcacgggatttagtaccgaccaagcacacagcagtgtgacagccccgagctcgcctgtgcagccttcctgggtatcactccgttctgcccggaaaggcaccattcaggccgtgagtgtaaacgtacgagtgggcagggggagtggtagaaacgcccctgctgattgcagggtttactcacgtatttaccttaacgcccgttcttctgcgactactataaacattaaatgagataggggatcagatgtcaccgtgaaacaatgtcagggagtggggtggggctgggggggatttttggggccattcagccccatcgtgtctggacagggaaggtgaagtgaagagaggctgcctccccagagctgagacaggacagactcggtcctctccctctgctgcaggtgctcttcctttcaccactcagcttttcttgaaatgaaagtttgaaagtttagctttcagaactagctgtgtggctttgtgcaagtcacatgtcctctctgggctgtatcccctgcagtagggagaataaatgaaactagagaaaccctctaaagtccatctcactaggattctaggcttctgggtgtttgggagcttgggtaaagaatcagaagggcctgtgctggagaaaggacctgttcactcgcccagccccagacattcaggaggaggctgtcactcactggaatgactgaactctgaacccgtgcgtctgttccctcccgctgggctcactgaaaccactgaagcaaaaggggtttcactgctccacaccacactttcactgctcacaaactacttctccctttttgaaggacgagtctcgaattaaggccactgtgatggacgtgaagcccgtggactacagagagtatggccgaaggctggtcatgagcatcaggagaagtgcattgatgtgagaggagcagtgccaatcgggcagaagtttgcaaataggcagaatggaatcgatttcctcccacctccgtgtgacgatcccatgttagctacacagtgcagaggctcttgatggtggactaagcaatttcccccctcgtgcgcatctcagaacccatcggtaggcaaaggaaaatacgctcaggtggttgtggtgtagactgtgtcaggcctacggagtcagccagtggctagcgcaagaccagtcactccctctgccttcaggcttctgtcaatttcattatcatcaagcaggaattatgtcgtaagtcactgaccctaactgcagaccatgaagtaaattatgtaactaggtttttgcttctccagtggtgaccacccccccccatccccgctcacaacttgggttcttctcagcggggcgagctgagaagcggtcatgagcacctggggattttagtaagtgtgtcttcctagaattcgaaggctctctctttctagaggtgctacatagttggtaatgcttggaatggcaatagggtagaatgattaatcaaaggcatatcttctatatctgaagagtatccttccttcagggtttaatagactgagtcagatgggtctgatattaatcaaaattgtctcttctgaggaccgctgataagcattgacttgccgtcccctaaggaaatccgagcggctacaaagcgtttctttacttctcacttcaattaatgctgcgcttcgcttggtgagtgcgtactttttctacctgtacacattcctgcattcatgtattttgttttttttgactaaagctatgttacatggaaaggattttgaagccttttgtttcccttgctttgttttaataaacagtatattctttggttgtgaatcct

SEQ ID NO: 35903 - DNA, 12857 bp, Homo sapiens
cgccgctctccgcctcgcttgctcctgccgggcgtgcagggccccgccgccgccatgtcgggctcgttcgagctctcggtgcaggatctcaacgacctgctctcggacggcagcggctgctacagcctcccgagccagccctgcaacgaggtcaccccgcggatctacgtgggcaacgcgtgagtccctttcgcgagcccggccccgccgtccctctcgggacgccccgcccacccgaggctggggtcggggtgtcgcgagtcttgggttgggggagcccgggcgcgatggcccctccgggagccacagcgggggcttgggaggggcctggagtcgacgcctacccccgcgcgtggggccaaggaactggaaccctgcctggccgggcgcggcccttccccgtggcggggtgcacggagcccgggtggcgcctgcccgggtcccagccgccacccgcttggggcttggccttgggcggggtcggggctaccatgttcacttaacaggtgaccctcggtcgcccggccggtctcctgcccgcgcgtcatgtgacagctgcctggttctgcagtgaggtcaccgcggaatgtctgccttcgccgccatggcaacgggccgacgtcacaattcgggcatggaattttcccggcccggcagtcccggatcagggaacctaaacaccccaaatgagcgagtccggggagctgggccgggatttccaggcccccaccttccagatgtgatttgatttacaggagattctagaacggtccagtgataacccccctaaggacctgagccaccacctagaaaaggctcttgacctttcacccccaggctctgtcacccaggctggagtgcaatggcgagatctcggctcactgcaacctctgcctcctgggttcaagcaattctcctgcctcagcctcccgagtagctgggattacaggcgcccgccaccacgcctggctactttttgtatttttagtagagacggggtttcaccatattggccaggctggtctcttggccaggctggtctcaaactcctgacctcatgatccgcccacctcggcctccaaaagtgctgggattacaggcgtgagccaccgcacccggacagtaagagattttttttaatttaaattttaaattttttttctagtaagaatgtctaatcagcaggaaagaaccagtgttaacattctgagatgtgaaataggagcctcaagaaagaatatattagcatgcctgtacagccttggaaagcctcaagttggattttcacgatactctgaggacccagttaccaaaatcctaagcttcatggctcagcccaaggatggcatgttgaaaactcaaaactaaccctcctcccattttacagaggaggaaatggtggctcagagtgtgtgagggactacaaggacagggtcaatgtcttgttcatgtatgtatttcctgacctccgctatgacctgctgtttagcctgccaaggactgccacggaaatgggggtcatcatggaactagaaggggtccatcaggccccagcctcatggggacagttctcatccattccatcattcattcaccagtctgagcacctgctttatgtcaggcactgtacaatgttcattcatagtagagatagtaataatgataattgtaaattttttgaatgttgaattattaatagtattagaggcctggcacgatggctcacgcctgtaatcccagcactttgggaggccgaggcgggtgggtcacctgaggtcagcagttcgagaccagcctgaccaacatggtgaaaccctgtctctactaaaaatacaaaaattagctgggcatggtgcctggcgcctgtgatcccagctactccggaggctgaggcaggagaatcgtttgaacacgggaggtggaggttacagtgagccaagatcgtaccgttgcactccaactgggcaacaagagcgaaactccatctcaaaaaaaaaaagtattagagaagggagatgaatgggagtgactcttcaaagtgtttttttctatcagccactgcttcacagtcttgcgcggtgtcctaagcaggaataaacagagtcccacagtgtcagccaaaggcttcaggaattggaaagctctagagacacccttcctcttgcaccaagcagcaagcaggccttgttagcctcaggaatcccgcttgcttgggcaggttggccattcagctgtcatcacttcccaagtggaaaccaaggttgtacacgtctggtgtagccagagtggcaattgctgatggccactgtagaaaatacatcccttgccctctaagcacctctgaccttgacttggccaggggtgtgggggttcctcaacagggaggatcagtgagcaccaagcaccaagaggatttgggctccattcccttaacaaaatcagggccgcagccacgtcctcacaaggcagagccagagcctgtgtgagccacatgtgccaggccttgggggttttgcagcagatgtgggcatgaggggcagagtgaggtggaagatagagcagggctggatgtcgggagaaaggaggtcttctcccagatctgccaccagcagcacacggggcctgtgcccatccctctgctcatcctgttgggcctgagttcaagctctgttaagcagggatattgccatccttgttcctcacagggctgctcgcagtgggcaagcaagatcacacaggaggtggcattttataaagtataaactgctatttggactgggatgttttgtgagatgaaataaaggggccttttcaccattcagaccaattattatttttattttattttattttatttttcgagacggagtctcactctgtcacccaggctagagtgcaatagcacaatctcagcacactgcaacctccacctcccgggttcaagtgattctcctgtctcagcctctgtaatcccagagtagctgggattacaggcatgtaccaccacacccggctcacttttgtatttttagtagagacggggtttcaccatgttggccaggctggtcccgaactcctgacaggtgatccacctgcctcggcttcccagagtgctgggattacaggtgtgagccactgcacccgaccttagataaattattttgtaacctcccatagttctgttggggccacttactccccaagtactaaatcacccaaaagagctttggaaacgtagccagtggaatgtggcaggtaggatccctctgggggcagggagggggctgcctggtacgtgacaaatttattcttttgcactcattcaccgcttatttattcagcacctactatgtagcaggtactatagcagatggtggggaaacagacttaaagcagacatggttcctctctcaaggagctcacagtctggatgtctaaacacagaagcacaatcaagcattagaatcatagtgctcactaccgtgtccagctctgtcaatggaatagcccatttaatactcataacaacctcaaggagaaggcactgttatccccattttacagagagggaaactgaggcacagaaaggttaaatggcttgcttaaggttgcctggctagtacctgggcaggatgcagacccagttagtctggttccagagcccatctgtaaccagttggctatgtacacccccaccacagcttagggagcatggggccaaatggaatggaggggagacaaacactgcggagggtgtgaaagatgagagggcgcatttctccagagaaggtgggaaagagcattccagacagaggggacagcatggctatgaaaccaccagtctatttggggaagctgctggcaattcgatatggccagagtgagggaagaggtcataagatgaggcaggagaagctggcaggggccagagcatggagggtttccttgctttgctaagaggcttaaatccttctccatcttcctccccctggggctgccatttggttggttaatcatccccaccactgtctcctgtccaggtctgtggctcaggacatccccaagctgcagaaactaggcatcacccatgtgctgaacgcggctgagggcaggtccttcatgcacgtcaacaccaatgccaacttctacaaggactccggcatcacatacctgggcatcaaggccaacgacacacaggagttcaacctcagcgcttactttgaaagggctgccgacttcattgaccaggctttggctcaaaagaatggtaagggacctcccaccaggaaaagatgggaggcagctctgactggactgtccctctggaaaacaggcccacaacaggtctcttcttagaaactcccttgtttcccatcttctggggtgaacgacagagctgtaggtctctctctgctcacctggctggctgtcaagtggccccgtgtgtcacaggatgtgcaactcattcacaccatggcagccccagggtcctcgcgtttgactgcactttggctggaggttggtttccagttgcttacacgtcccccattcaaacagctgtaacgatgaggaagatgtgttaatgtgttaatgtgcatggcaagaagtcctgaggtgaaggagcatgggggctggttgattaaggggctgcttgattcagcagctccatggtggcctctggaccaggccctttccctttctctcttctgccacctcagtgttgggtgctcccgtcatggtcccaagatgggatccagtcaccacatccaagcaggacaaagtacagcagatgaggccctgcagccatctcttcccactcttttttttcctcttctctctctccttttttttttttttttttttttttagatggagtttcactcttgttgcccaggctgaagagcaatggcgcgatcttggctcaccgcaacctccacctcccaggttcaagcgattctcctgcctcagcctcccgcctcagcctcccaagtagctgggattacaggcatgcgcccccacgcctggctaattttgtatttttagtagagatggggtttcaccatgttggtcaggctggtctccaactcctgacctcaggtgatccgcctccctctgcctcccaaagtgctgggattacaggcatgagccaccgcgcctggccactctctctctcttttttaaagagacagggtcttgctatgttgtctagactggtctccaactcctgggctcaagcagtcctctcacctcagcctcctgagtagctgggactacaagcacgtgccaccatgcccagtctctctctttaagaacaagtaaaacatttcccagaaatacccctcacatctcattggctagagattcacgtgattgcctggcaaggagaaaaggggtagctgcggtcagcttaggttggcagtcagcaaaccacagcccccctggccaaatcttccagccacttacgaaacacttcctgcagcccccaaatataagataagactgaaggagaactaccaaggcgctggcagtcaccaaggcattccagcaagaaaccctagaaggccacaaagcagacatcagctgagcaggctgggccacttgccctttctccctttctgcttttagctgtttctctcagctcctccctttacctcttcgtctctccccaccccaaaccctcccagcggaggggacccccatgaggtgtgaacagccttggctgtactacactgatgactcttgggcccagcaggctcactgtctgaatgatttccagtaaacagaattttctagaccactggacagtgaacgctcagggctcagagagaagctttactgtggagtatctgcagactttgctgacaggcccctcatggtccttcctggtcactgtcaccccccaaccctgctcacctcctccactccagctgtactgagttcctcaccctgtgtaaacataggctgggcgaaggggaaggattttgttgttctcgtataatagcaattggttattcattcagggaatttcaagctctctgactttgtttcctctttccaaacaactaggaacacgccctttttttgacctgtctcagtccaggtgtgctgggtctttagtctgaaaagttctctctgcctctccctaccccttcctctggcaaactccaccttgtccttggcatggtgtcctctcttccatgaagcctgccctcaggctgggtctactttgttccttgtctgtctccttagcacctgatgtagcatcaggcacatagtaggtacactgcaaatgatgaatgagcaagtgatgaagaattccatgggctctaatgccaagtataaatgcttctaagaatgagtggcgaagtgagtcaacagaaacatgctggcctccaacagtgtgtggggcccagggacccatcactgagagctgggtgggatggctgagggtactcaagagggagcagtcacttctagctgggaaaacagcttcatggaggaggtggcatctgggctgagcctagaggaatgggaggttgaactggcccctttcccagtaggctctgtgtgcactgggcatgcagagtatgttctagatggtaaggtggctgctctgcagagggtctcattcctagggtggggcaggggaagccccactctgaatatttcgggcatacaggccggagggtgaatgggcaagaaagtggaggactcctgcttcctgatttggaaggcattgggaaaatagagtggtgttttgggggtagggtgataggagcagaagagactctgttggactctgggctagcagattccttgccaaacaatggccttatagaggtgttagtaggtaataattcactcagctagtcagcaaatatttattgagcacatagtgtatgctagagattgtaacgcatccaaaaatcaatgccccacatttcttgcctttttttttttttttttttgagacggagtctcgctcttgtcacccaggctggagtacagtggctcaatctcagctcactgcaccctccacctcccaggttcaagtgattctcctgcctcagctttctgagtagctgggattacaggcatgtgccaccatgcccagctaattttttgtatttttagtagaaacggggtttcgccatgttggccaggatggtctcgaactcctgacttcaggggatccgcccacctcgacctcccaaagtgttgggattataggtgtgagccaccgtgtccggccatttcttgctcttaaagaattcgtcctctgggagagaaaagtcaatctgcgcatgtctggcaatgacacaggaccagggctgctgtagttgagggtgtactaggtgctaccagaggatgcccagtattgggtaacatttattgagtgcacatggatgccaggtgctaacctagaggattcatgtgtcctctcctttaatctaaccaccttgtgcaatgggtactattggccagataagaaaactgaggcaccttgaggttaggtggatcatgagttaataaccagtgtattggtcaggattctctagaaaaaacagaaccaatagaatatacagtcggtcctccatatccgtgggttccacatctgtggattcaactaacctcagtctgaaaaatattaaaaacaacataaaaagatgttatgtctgtactgaacatgtacagattttttttcttgtcattattctctagatgatataatctaataaatgtttacattgtcttgggtatcataagtcatctggagatgatttaaagtataggggaggatgtgctgtgcagaggttatttgcatatatgatgtcattttataatcagggacttgagcatctgtggatttgggtatcggcaggaggtcctggagccaatctgccctgtggatattgagagatggtgtctatttatatatatatatatacacacacatacacacacacacacacacacacacacacacatatatatacacgcacacacacactatattaaaataaccccacctctactaaaagatacaaaaaaattagctgggcatggtggcatgcgcctgtagtcccagctactcaggaggctgaggcaggagaattgcttgaacccgggaggcggaggctgaagtgagccgagatcgcgccactgcactccagcctgggcaacaagaaggaaactccatctcaaaaaaaaagaaacaaaacactaccagcaccctggaaagcacccccagtctctatgctccaccacccccatccccagctcccagggcctctgccacgcgggcttctttttttttttgagacagagtctcgctctgtcacccaggctggagcacaatctcagcacaatctcacctcaccgcaacctctgcctcctgggttcaagcaattctctggcctcagcctcctgagtagctgggattataggctcgcgccaccacacccagctatttttttgtatctttagtaaagacgggatttcactatgttggccagtctggtctcgaactcctgaccttgtgatccagttgccttggcctcccaaagtgctgggattacaggcgtgagccactgtgcccagccccttgcaggcttctgacagcacagatggttttgcccgctttcctactctgtgggctcatccacctcatatgtgtgtgctgcctccgtgttgcttctgctaagtggcagtctggtcattctttgtatttgtcctttctactgtggatgggcctttgggggtttctaactgtgggccatgatgtgcagtgttgcctgtgaacattctggcccatgttcgtgaatgtgaatgcgtatctctattggacctgggcctgggagtgggattgctgggccagaggggatgcacgtgttcagcttgaggagataccgccgtgccgcacagctttccaaagtggttgtgccaattcacgcctcacctcccccagccacgcagaagagttccagttgccccatatcttcaccagcactttgggttttccatccttttcattttagccattctgacaggcacacagtggcgtgacattgtgcttttaagtggcacttcacggaagagtcttgaccaacgccatggtgtgatgggacgcccccagctcaccacgtctcccctgtttcttacaggccgggtgctcgtccactgccgggaaggttatagccgctccccaacgctagttatcgcctacctcatgatgcggcagaagatggacgtcaagtctgccctgagcatcgtgaggcagaaccgtgagatcggccccaacgatggcttcctggcccagctctgccagctcaatgacagactagccaaggaggggaagttgaaaccctagggcacccccaccacctctgctcgagaggtccgtgggggaggccgtgggcaaaggtgtcccgagctgccatgtttaggaaacacactgtaccctgctcccagcatcacaaggcacttgtctacaagtgtgtcccaacacagtcctgggccactttccccaccctggggagcacataaagaagcttgccaaggggggcgtccttgctccccagttgtcctgtttctgtaacttatgatgtcttttccctgagatgggggctcagagggggaaggcctgtggcctgcatgcttcccgatggcccacggcaggaggtgtgtggaagtgtaaggcctaagatgctcacagaggtccctcatgacctcccttccccaactcccgaatcctctcttgagtgtggacctcaacaccttgagccctagtaaaggaactatgcaaatgcaggccactctccccaccacgtctgtgccctgcactgtccccacagccttccacaccctgtgcataggcagccctctcacgtcttgaggtccgaagctggggtgggggtgtccgtcagttattagtggatggagattcccacagcaaggctgcatttgaatgatttccttaggatgaatggtccctacacaaagaggccttgtgggcaaacctggagaaccctcctaaatccatagagttttcaaaatgtgaatctttggaagccttgagttcagaatctgctgctctggaatatttcccttcgatcttatctcagtcacttcgtttttgagaagagtgatgccttgggcatgcttttttttttttcttttttagaaaacagggagttgaagtccaacctatttaaaaaccccaccatttggagaattacaagggttttgtcctgaattgtagtgttggcaagcccaagccactcgtgctaactgctttttgtctcggttgctattccaagaacagaaggaggaagttggccaattacagcgtgtgtgcatggatgtgtgtggggggcgtgcctctcagaaacgcggccagaagacaagcagggaagtgaaaggtcccaggcacacaccctgcccattgcaggtggctcttacagctctctggtgccagcacgggatccctgaagtgactcagccaggcagacatgagacatggcggagtgtccaaatggatcctttattggtggtagagcaaaaaaacccaaacacgataaacctttcaaaagactttctaaggatgatattggaatgcaccagccctcacatgtgtatgcacatttgccagaatataagagttttgttttaaatacagtcttgttaggattttacgttattgttattatggaaagtgattgtgatgctatttatcttcagggtcactctgggcaaagagaaggtcctcagccatgcccccagcaccttgcacataggtgtctgataaaagtttaagaaagtaaacactttttgagcaccaaatatatatagggcattgttctggtgggtgtgtcacgctcccagaagactgaattcatggtaggatcactcgcaaggccttgtgaaggagtcttacctaaaacgaaagaaatatcagggacttttgttgactatttacaactcagttttacatttaaattcaggcagtgttaatatgccaaggtagggaatgtgcctttttcagagttggccaggagctcctggctgggacacggagaggcaggtgtggcgtaaggcctcactcccggctgggaaggtctctgatcacacagaagcagccctgcccagcctggtcatttgctgtccgcttttctctgtgaccacagcagccctgaacaaccagtatgtgtcttcttctccagatagtgaaaaaggtgtccagataaacccacctaagtgaaatggccatcctctaaactgggtacctcactgcacagcttctaggtagccttccaacttaatctaacttgagcctcacagtaaccctgtaaagttagtagagcttgttcttgtattgtgaccttttttaaaaaaaaggaactgaggttcagaatgattaagggcctggcccccagggttgtccagctccataaggtggagctgggcaagattttgggtttgctgctccctgaagctggattctttcatacgatactctttctcaagaagggggctccctgggatctccaggtgtactgcacttaccctcaatccagccccggagaagcaagtgaaaagggtgggtccctcataggctagaatgtgcagctctttctccaggtgggatgtagcaccccgaagtagagctttctgctctgctcctggaaaaggctagggagctggggctggggctcccctcccatgaccaggcagtggtcaccccatgggacaggcacagctacttacgcgaacacagcaggttggtgtggctggctaactaggacctctcgaaagtctctgtgggggcatgagggagaaaaggccattgggagaattactgcctttactttgggactacttttatgctgataacttgggatttcttgatagtccttcacccctgaaaccccgtatttacttaacaagatttagctcttagttcttcaagtaaaattaaagtctcttgtgtaagagccaacacatgcccagctgcggatgggagctgttcctggacagccttctactgcctgggaagtgatggaacaggaactcagggtgcccttaccccctccccagacctgttccctttctttgactgacagagcaccatccaggcaaaattagagcgccaaatggttttcttctcaatcttaaagcagtatacctttccacaggctcgtctgtgtccctgccactctgagttatccagaaaccaccacctacaaatgaggggactcatctagaagacctctaaggtccccttttggctctgaggggtctctaataatccccacttggaattcagcaccgcaaggaaattatgggtatgtgagccataatatgatgggcagcaggtggcgctgccttccacccatggtgatggatggtttggaaagggaatgttggtgccttttgtgccacaagttaagatgctactgttttaaaggaaaaaaaaaaaaaaaagtactgatcttcaatatgaagacatgagcttttctcgcaggaaattttctttttcacagaactggtgtcaggaatcactgaagggctaaccgtgatagtccttgcaagtaagtcaaggttttatcctgattggaaatagaagacatttccggttgagagaacagattcgttggaagcttaacttttgttgcctcttaacgccaccaaattttagggtaatttgattatgaaagagtgaatttttctggacagaaaagggagagctaccaaattgtttttttctttttaaaaggaagtttaatgtccgttgtatcacaaatcagtgttaaaacaccagaactttagccaaaataaatgtcttacattacaaaggt

SEQ ID NO: 35904 - DNA, 12857 bp, Homo sapiens; identical to SEQ ID NO: 35903

SEQ ID NO: 35905 - DNA, 12857 bp, Homo sapiens; identical to SEQ ID NO: 35903

SEQ ID NO: 35906 - DNA, 63829 bp, Homo sapiens
cggagggggctcagtccgcagccgccgccgccaccgccgcgcctcggcctcggtgcaggcagcggccgccgccgccgagacagctgcgcgggcgagcatccccacgcagtaagcccgctttctttccgcttgtgcgcgcgtgtgtgcctcccgcccgccggcgtcctgggtcccgggggagcggctgcccttctgccccgccgccgccgccgctcggggctggtccctgcggtcccggctgcctggccttccagggctgggtactgcggcttcggcggcctcgctgaggccgggggccaggggccgtcccgggctgcggggtgcgggacgagggactgcgagtgcgaggtcccccctggtgcgtgcctcggccttccctgggtttttggctcgatggggactaagaggcagtggggtggaggtgggggggatcgggagtgaaatgggggctctccatgttttcctgtgcgggggatggtggggagtgaggagggagtgaagggggggccctggttttgtcaccaaggatggcgggcagtggggggtggggcgaggtggggacacctcttggttctttcagccaggatagctagcaggggctgtggggagcgggtgaggatgaagcggtgggtcgactcccttggttttcccatcaaggatggcggggatcgtggaggggggagatgggagacctgccttgcttcgctcaacgaggatggcgggggtggcgacgaggagtagacgtgagggggcccgcctcggttttcttgactgggatgcttgtggggtggttggaggatgggggtggggtgcagaataaggagggagggggagggcccgctgtggttcttctgtccaagggggatggcgcgggtttggcgaatgggggtggggagggggtatttcagctccagcgtggaatctagagaagcacgaggaaggttctatcacgggggttgagccttagaaggtgggttttcaaaactgcagggcgtgacctctcccgcctcgaaaaacgtgaaatccttacaaggtgccgtctgttctaggctctgggacagaggtttctgctttcgaagtttctcttcctttcctctctgctcttagcgtccaggactaggtaaaggttaaaaaatcatcaaggctaagcgactgttgtgtcgttcgtgttgagcgctgtattattttctgcatttgggaatgtgcgagtttctcaggtttgttttgattgccttttacaataaaaaccccatactagggagatcccttaggaaaagaaaaggacaaggcttattaatgggatgccaggtttggattttgaatttcctgaagggcaggagatacatccttgtagcatttcgcttggttttgagaagagtagaagtagtagaataagcgtatgtatttgctggaagtccccttgtattcatttaaattatcccttcgggattatccgagccccctttgatttgggtttggaatagatccagttttcctaattggagccatcatcttgtaattgcttgtaattcttctctgggttatcaagtctatggcaagcttatagaacagcaggaataattttttccgtcatcttaagacagttttaatgtaaacgttacggtgttccttgcaaatgtgaacatttgcagaatagcacaagtttaaattatgggcccccctggaattttgtaaagcctttcctgcctcagctcatctccaagaaccgggccctcccgatccttacactgaagaagcaagagcttctgggatggtagctttgcctttacaaactcatgttcatgtttgcttaagaagaatacgtattaagcaggcatttgccttttatgtggtgagactatagtgttttcccatttttggttacataaggttccgatcaagtctttaccttcagtctttaaaaatgcttatttaacatttttaagggcaaatataatctttatgcaacaggaaattggtcagataggccatgatttgtgcaaaccacctcacgataagtacatagtctaagactatcatatagattctgtaaccatatatggtttttgaaattctaggctaccattcccatatttaattttcagaaaaggaaaatatttttttcagccaagtctagatttttgagtgaaactaagaaaaattgtgtaagatttaaattgataaaattcctcctgtataataccagtgcattggaggtaatttaatatatattaaatgaatcgaccgctaaaacaaaataattattttttttcctggaagtgttaaactggaaatgtttaaggggaaatagatttttagtcacaaagaccgacaaaaatgcatttatttacactattgtattataatgttagtatggtattcattctgtgcccccaaatagcaattgaaaaaatagcatatttttataataaaatttaagcataatgtttttttctctgaggagtagaatgcagaaagtggtaaaaaatcttttacagagagaagcatgttgataggaagtgggctttaagtttctctctggacagaaggtgtaaatggcgtatcttttacctggctttttgagaatctgttgccctctaggacatgaaagacatttcaggaattaacagaagtcggatcaaattctcttgctagatgttcttaaagattttgctgatacgcatttgaaaatttgtaaatcacgttttcatgtaagaaattaaccctcacctctaaagtttgagcattaaaaaagtttgttgaaggcatggaaggtaatctcctgtgactgaaccctgttttcccactctccacctcctagttcccttcttccccatgcctctcctttctcccccgtccggtgccagcaacattggcttttataaccttatgggagttgaaccaaatattcctgcttgctcgaacttgaggccttatctttttggctgctttccccagcttttgcctactgaacttttttttgttaattgaactatctagttgtttggatttggggtaaaagggagtagactgtaattgttttttcttaaaagatcttttcttttagctcctgtgggacaagagcagagaaaggttcttttttggtcagtggtgtacttaattaagcagaatatatgacttttcgtttattcaacaaacatttgccgagttacctcctctgttggaggctccatgctaggtgtggagttatttggttgataagaaatggcttccacctttctggtgaagttatgaaaatgaaaaatagacagtgaatctgttgtgagtaatcaagaattgtctggagttttttggacagacaaaaaagatttcttgatgtttacattcagctttgtattactgtatagagtagggagaagtggatggccagcatcccttcctgcgacttaatgcatctctgatggcaaattgggcctccccaaaatatttttctggggtcaactttgaattatggatagtaatggatgatggagcccagaagagtggatagtcctaaatagtagctcgaataaacctttgaccttctacagggttgcttcctgagtgcctggagaaatcccctctttgtggatagtgccacactggtggttttcagccagggcgcttttgccccccggggtcactcaacaatttttgctagatgcactccactggcatccagttggtagagacagggatgctgcttaaatatccaacagcgcatagggcagtgcctggcggcaaacaaaattatccagcctgaaatgtcgatatgccgaggttgatgtaatttcctctacataatgtagcagaacataattccaggagagtagagaacaataacagcgtcttgaggtgactgagtagttggcggagctcactttattcgtctcaaaaatgactagtttcagccaggtgctgtggttcacgcctgtaatcccagtactttgggaggctgaggcaagcggatcacttgagcccaggagttcgagaccagtctggccaacatggcaaaatcctgtctctactaaaaatacaaagaattagccgggtgtggtggtgtgcgcctgtagtcccagctacttgggaggctgaggcacgagaatcgcttggacccaggaggcggaggttgctgtgagctgagattgcaccactgcactccagcctgggcgacagagtgagaccctgtctcaaaaacataaaataaataaataaaagtgactagttcctgcataccaacctgaagaattaaagaaaataacagctaccatttatggcacttactctgtgccagaggacttgtatacattatatattctcttcattttataaatgaggaaccacactcagagaggtagaagatcttgcctggagcctcacagctggtcaaggttagaagtagaaatcaagattaagattattactccttttaagttcatggttttaagcacaactatgcattatctcccttgcggcatgcatcattcaaaatcttatgtaacaaaatgaaaattactatatgtcctatataccattgggcttgcctgagagtaattaaaaccatgaatgctaaatgtgatcatacttggagtaagtgacaaggagtaggggaaaagggaaccaacattaattgaacacctactaaaatttcaggaagcacgcaaattaaatatatactcattgtctaatttgattctcagagcaactctgcagttatgatgcacattttacagatgagagtgggagatatttgttaagtaacttgtctaagattgcacaactaataagcagcaaggttgggatttgagatgatgtcccacaaccaagccactctttgctgcttactctaaaggtaggaagtaagttgagcctcttggagaaaggaaggtaactggctctgggtaaaaagtaacttcaggcagagcgcagtggcttacgcctgtaatcccagcactttgggaggccaagccgggcagatcacctgaggtcaggagttcaagaccagcctggccaacatggtgaaaccccgtcatggctaaaacacaaaaattagccaggcgtggtagtgggtgcctgtaatcccagctactcgggaggctgaggcaggaagaattgcttgaatccaggagtcggaggttgcagtgagccgagatagcgccactgtattccagcctgggcgacagagctagactccatctcaaaaaaaaaaaaaaaaaaaaaagtaatttgagaggtaacacgtagtagacgttggattatattcaggtagagaatggagagatgaattgctataccttcctcatctgataagaatcgaattctacctggaatttgttctagagatctactcaaattgaaacagtgattgtcattttgtcaaacttcattttctatctcacctgaattttccaagctgtgctttgataaccatgaacctggaagttatggaaatctgtgcttaacctttcggtagctcaccttccacctttcttagggctgtcctgtagaacttaggagtgacaacatttggtttttgtcttctttttacacaatttaaacatttgtgcttgctatggaaattgtttttataatacgcggcatcaaattcattcttgtgtttttcatatggggttgttttgttttgacaactaaatatttactttaagttttaacgtgttttgtttcggagcacaaaaagaggaaacatttaaaaaacagcccaatcacaatcattttgtctgaaaagcatttttttgcgggaggtgggggggggcaggaaaaggaccacatgtttaatttcatttgcttcaattggaaaggaattttaaccacgattctcaagggccaggatgctggaaaaaaatgttatttagataaaatgcctgttttgatatccacatagaactgtgagccatagattctgattataataataatgtcctgattctactacagcaatcagccacttgagtaatcaaccactgtgtatagacagacatgcatggtggtaccatctgatttgtcccatcacccattgattcattctagagtagacttgagagatctgatagaacttgcaagaatgaatgatccttttgaaaatcaaatttttcaataagaatggtacattttattgtaggaaaatgcagaaaatatagaaaagcttcaagaagaaaaccaaaatcagtcataatccaccaccccaaaattaatgacaatattttgtatgtcctttaaaaatggagtactttctaaaaatggtggattcaagcccattgcaaaacctccaacttatatagtgtgttatttttttttaaatgactagattttctgaacgactgctacatctctagatggaagtcatggtcataacccatgaaaagggaaagctgacaggtagttggagaactatgctatagcctcttcctggcagctatgtaaagaagcttaagggtagctccttcaaatttctcctcttccagcttgaatgatcaagtttcaatgctaaaagaggctgttagtacccaccccccattattttacagatgaggaaactgaggctcaaaggggtcaagcacctaatgtgctaacgtcagagttccagcttgaatttttagattgtcttcataggtaggtaaattttttatttcctaaagattcttcacagtcaaaaactttttcatggcctgaccctcaaaagaacaagctattgtggtgggagtatactataaaggatactaaaaggccaagtataataacttgctaatttcagaatatgttccgaacagctgtgggcagtacaggaatttttcatgttatttgctttattgtaattgaacatttagtgatggggaacctcttggatgggtctagctctcagtttaattttctctagcctatgaggcaagtgccaaggcatatgaagtatgcctataggtacaaaaatgaaagatgacattgaaagagtctttagacatggtagcctggaagatcgcaattagggcttttgctccatgaaagtatttttttcctttataaagggagatatctgttgaaattgtgggatagagattttaaagattgcatctgcttccaaactaaggtcaaaagttaaattgtagtaaatgtgtgcagtgtggtatcattaaactgtacacacatacgtgaaattgttgttttaatctggcatcttttttttttttttgagatggagtctccctgtgtcgcccaggctggagtgcagtggcgctctctcagctcactgcaacctccgcctcctagcatcaaccgattctcttgcctcagcctccctactagctgggattacaggcacgtgacaccacatcttgctaatgtttgtatttttagtagagacggggtttcaccatgttggccaggctggtctcaaactcctgacctcaggtgatccactcacctcggcctcccaaagtgctgggattacaggcgtgagccaccacgcccggccttaatctggcattcttaaaaaaatcagttatttagctttcttccccctcttctcctgccccatttcatttctttctgtagctgtgagggtcattctctctttgtatctgtttcactctcagggtgactcttttttcagtccacctgactgcactcactttcctttttccaggctctccgtggatccatatccttctatcacattcatctgccactgcatcttgcccttgtccccgtttgccagtgttaacaattaccccaccctgggctgggccagggctgtttttcagcttaggccgggcagggaagctgatctccagggcagatgtggagtgagaagagttgttgtcactctatacagaaatgtcattgacagaataggattaaacaaaatatgtacagagattacataggctatgtatacatgtaaacttgtgaacacaaaatcattccttctttacagctagggtcccagcaaatgctacagctacatgaaataatgagtatggatacctattgccgagggcttactatttgaacaagtgagagaattgtactcttgcctaggggtgtatttttaagtagtttttgctcctgttccttattattgcctgctaatggatacgtatattgtcagtaagtgaccaactctcctagcttcctgtagtacactgtatttctcttctgaaaatggattttcctctgtatttaaaccacagatttacttgtgcctcatttttgaactactatagataaaaactcacagataggaaatacctgtggactgtttgaaatgcagtgaaacctagaaaaaaaaaaacaatcaaaataataagtatctcctgtcggcattttactgcttgtagaattgatattctatttgcccacataaaatctctctggatgttattcctattgcaagacatagtagcttttcttcctgttccttattattgcctgctaatggatatgtacattgtcagtaagtgaccggctctccacagcttcctatagtacactatttctcttctgaaaatggattcctctgtatttaaactactgagatttatttgtgcctcatttttgaactactatagataaaaaaggcacagataggaaatacctgtggactgtttttgaaatgcattgaaacctagaaaaagaaaataacaatcaaaataataaatatctcttgtaagcattttactgtttctttttacccacataaaaactgtctggatgttattcctgttgcaagacattaaatgttctatagccttttttttttttttttgagacggagtttcgctcttgttgcccaggctggagtgcaatggtacaatcatggctcactacaacctctgcctccgggttcaagcgattctcctgcctcagcctcccaagtagctgggactacaggcacccaccaccatgcccagctaatttttgtatttttggtagtgacggggtttcactgtgttggtcaggctgatctcgaactcctgacatcaggtgatccgccctcctcggcctcccaaattgctgggattgcaggcgtgagctgttctgtagactttctaataacaagaatttgtaacagtcacaaggttttaaatttccttttcagtactaaggaaatgatagctgggaatgcaaaggctttattggcaagattgttttgacaaggatggcacaaaactaaatttctatacttgattaatttataagtcttgtcactcacttttagttttagagtgtggataaagctgtttgattcttgtcagatttgaaatgtatgatttatgagacattaaggattggtttttcagtgcactctgccaggtctagttttatgcgtcattctggtttgggaagctgagtgcaagtctgcctacagacataatcaatcacctgcactttcgggtggccaggtggactgaagtaacaggtttccccccaggtttctcagagactaaggaatacacacacacacacacacacacacacacacataggcagacctgcaaattatcggtccaaaaatatttatatcactaagccagagcagtggatttagacatttgacttaacaaaatttgtttttcaacacgttctagcaactaccctgtaaatgatcgtcatttcacctacaacaatgaaaagataaagtcctcagccgcatagcttctagaggctaaagaggcacgttaagttgcttgtcaaagactccacaccttcagatgccagggtcaacacaagttttcaaaccctagacccaatcccttctaggccacagaaggtctgcctcttgtaaggaaggaattttccaatgcactaagcacagctaatcacactaaggaaagaaaccaagcagccaaactaatatgaggaagtgaaagtttatacttgcatcttatagcagatggcctttgttagagccacttttaaaatatcaacttcaccgagcatgatttaggtacaaaaaccggcatccaattaaagcctccaatttgatgagtttagacagatgtatatacccatgaaaccactgccccaatcaggatgtggaatgtttttatcacctccacaagtttatccttgccccttttccagtaacattcttcccccagcccctttcccccagatatcccgttatgcttttgtgtgagagccactttcaaaactcagatttgaaagtttgtggatcttcctctataaaaagactatatttatgtccaaaatgcaattgtcttctctatgtttaaaataatactacagagaaattctaggtattgatttcctagaatctttccctcatcctctgcaagtaagctacttagtaaatagtttcattatgtacttgaattgaagagaaattacagccaagagaaaaacaattctgatagacagaaaagcagtgtatgttcttctcaagtagttacagtgaggtgttaaatccctcaagaaccagagaagtaaaatttgaattttgcttcgtacttatttgtaaagtaaaaatgaagactgagaataaaggttttatatgtatctatctgtctaatcattcatccatccacccatccctccagctagtgtgtgtatatatgtttctgtataaaattactatgtattaataaccctatcccttgaggattacaaaagatttgaaggcttcagagggaattttctgtgcatgaaaggtgtactgtctttacacacttaggtgcaaagcaagcttttcatatgctgttattactctcattgatatatttaattgaactaataattattgagcaatttaaaggctgctgcattgagatggagtttgtcccttcgtttgtcaccttctagaaaaatccaagtgtcaaaaaatatctcgctggctctctgttctgttgctattacttcggcatgcgtcgtctcctcttgccactctcgatttctactgtttctgccctatcttccttccctgattttcctcctccatgtctttcccgtatcctgatgccacttctcttgcactgctctgatttctcatgagaaagccatttttataaacatctccagaccgagagggcagcagactaattccaatgtgtcagatagcatcttggaggctgtttctcctgtgatccaacacttttttcacactcctttccagtttcgagctgtactggaaattggagagttgtgaaaggatggtttttggataatcaaagttgaatatacttgctgggctgtgttatgaccgtctttgaagccacgaatcattaaaaataagtgaatagtttacattataatattcctaggaaacttcctttgataattgtaaagcaattaaaattgtcctgagataaggtgatttattgtttttcagaatgggccataaagatattaaagaacccattcaacatttgtcaaaacccataaaatgcacaacgcaatgaatgaaccctaatgtaaaccctagactttagttcattataatgtattaacgttggcccatcaattgggacaaatgtaccacatcaatacaagatattaataataggggaaactgggagatggatgctaaggaggtatacagaaactcagtacttcctgcttagtttttctgtaaacctaaaactgctaaaaaaaaaaaaagtctactaattaaaaaaaaaaactcttcaaatgtatgggtttcagaaatacaaagactagatcaggagctttttattattaccgtgtggattaaagtctactgtttgtggccaggtacagtggctcatgcctgtaatcccagcaatctgggaggctgaggtgggtggatcacttaaggccaggagtttgagaccagcctggccaacatgatgaaaccctgtctctactgaaaatacaaaaattagccgggtgtggtggcatgtgcctgtattcccagctattcgggtggttgaggtgggagaatcacttaaacgcgggaggcagaggttgcggtgaaccgagatcacgccactgtactccaacctgggagacagagtgagaccctgtcttaaataaatacataaataaataaataaattccagtgtttgtttttcagaatgagtgaaataagagatgtgtttctccttgagtgatgtaacttgtggcacgagcccctgaaaaggggaagtatgaggttccaggagagctgcccagtacctccaatgctatgtctagttgcacaatagtcagtagataggtcagtgggagcagtgggttgggacttcgcttgccacccttgaaacatcatgccatctttgcagtggagtcccagatttggcaaattccctgccctacaacccagtgggccctcttttgacccttgcatttgtggtatcattagcaacagtgacagttggtgaacttatgccaactctgagccaatatccaggtcagagtttgattgctttgggccaaaggctattattgcatggcttgtagaagcataggcccaatgccagaacttccatgcacttactcagtatggccagctctacagtaaacgtgtgtgaaaagattcggtttttataggcattaatgtaaatagtttctttatattggacctgggtaactatgatgggcaattacaagtacccattgctttcctgagttggctatgagaacagaacattctgtggtacgtggtagtgggggtgaggggaggatcaggtctaagagggacattgcagctgcaaagggaaagaaaaaaactgagaagccatcaaggattagaaggcaaatgggagccatcactcaagcactgtgtatcttgaagtggttgtctgtcaggtctgtgataagacctggggtgaaaaacctcatagttcatgtgattatctgaaaaataccaataaagggaagagttgattatagagttcgcctgtttagtttttttgtttgtttgtttgttttttttgaaactgtgtcttgctctgtcacacaggctggaaaacagtgacgatcgtggctcactgcagtcttgacctcctgggcgcaaacaatccctctgcttcagcctcctgagtagctgggactgcaggtgtgcatcaccacacccatctaatgttttagtttcgtagaggcagggtctcgctatattgtccaggctggtctcaaactcatggcttgtttagcttattaaactttattttgtatattggaaataattctttgtgtacagatctgttaggtgtcctcattgttacatctattgttagacagaattttatttttcttaatttcattggttgcctgaattgactatatatgtggtaccacctgttaaaagcagattttgatgaggaaggggagaaagaggataaaaataacctctccctcaagtcccatttcatgatggaagctaggattccagttcagtggccaggctaaatggtcacttgatgccagtagtgagctactgccactggatttctttcagtcagcttcacaatcgacaccaaatcctgcagctgacgtgactttactgcaattcatgttgattggaaaaatggcaaaagtcaccatctaacccaatcataatatgtttgtttcccagatatagacaggctgggttcgtcattaggcctagtgtagtcatgctccctaactactgtgagtatctggaaggattggggaggtatagtggcagcggcttgtgggacaggcatgtgacagcatccttttgcccccttgctgctcacccacctgcttcttgccacctattggctcctctttgtcttcccctcattctgtcttctctttatccttaatccagttacttttgaattttctgttaaggaaccaggagagcctcagcatgaaaataattggcttaagtattcaaagtaccagagcaacatactttataattcttggactgcctgattgttactgctgcagtggtttgttgggtattaaatgagacttagggtattttgtaaacgttttctgacatacaatttgaaagttgaattttgtcaccttacaaacttagttattcctgcaacttttaaaacccccctaaattttccttatgtgttcatgattatccccatagcagataatggccacatgcgtgctgatatgaaggatttgctccagggctaattgatgggagcagagctgcccagttgctgaattgtaaggaaacagttcatggagcgccaatgccaatttaggaaaagtatggggctgagtacttagtaagatgaaataaaaaaatatttatccagtgcttactctaaggagaaggcacttggctaggtttgctagatgctgtggggagccttaaaacaacagtgatctcttcaaggccgggcgtggtggctcatgcctgtaatcccagcactttgggaggccgaggcaggcggatcacttgaggtcaggagtttgagaccagcatggacaatatggtgaaaccccgtttctactaaaaatacaaacattagctgggtgtggtggcatctgcctgtggtcccagctactcaggaggctgaggcaggaggatcacttgaacctgggatatggaggtggcagtgagatgagattgtgccactccactccagcctgggcgacagagagagaccctgtctcaaaaaaaaaaaaaaaaaaaaagtactagcgatctcttcaagcaaagaacgcccattctaattggagaagctgttaaagacacatgaaggatgtggtggaaagagtattgaactgcatagggtgtggggagagagtcaggagttttgaatcctagcctgagttctgccactaagcattggaaactctgggcaaatcatctccccactctgggtctcagtttataaaaaggcaaatgaacgagatcatctctaagatattctgtagattgattcataaatgtggaagagattctggaaaacggaagcttgagcccaggagttccagaccagcctgggcaacatggtgagactctgtctctacaaaaaatacaaaacattagcctggtgaggtgatgtgtgtttgtagtccctgtttctcaggaggctgaggtgggaggatcacatgggcccaggaggctgcagtgagctatcacctgggagcttgttagaaatgcaactttcatgggccccactccagacctagggaatcagaaacgctggggatggggccccgccatctgtgtcctaacaaggtcctctctcaggagattttgaggcacaataaagtctgacaattacaggctataggaatttgggtcagtggttctcagcctctgccatacaatagattcatctgggggaactttgttgggggtggggcgctgactttgtttgtgctgctgtaacagaatatctgagactggataccttataaagaacagaaatctatttctcacggttctggagactgggaagtcccaagatcaaggtgcaaacaggttcgattgttaagggctgctctctgcttccaagatgacactttagttctccagcctccagaggggaggaacgccctgccctcatgtggcggaaggcagaagggcaagagagccaaaggctctgttgaagctttaatcccatccaccagggaggagctctcccggtttaatcaccccacctcttagaggccccacctctcaataccatcacattgtccattaagattcaacacctgaatcttggacacatgaaaaccgtagcaggcacccaggcatcactagttgctttggctctccaggtgccgccaattttgagaatcactggtttaggggaaagtggcatgaaccaagacttctgtcattctctagctgcaatgaacgtcagatgcagggagtcagccaaagccagaggcttgaatttcactcaaagaaacttggcctttagattacaatggagaaaggtttttggcaatgggagtgatacatccgaggtggaacatttgagagatgattctgatgctagctatgtgaagaagagggcatacccatagttaagaaatctgatgaaatagtctggtgtgaagtgataatgggccaaattaggaccttagaaatgaaattataaggaagaaaatgtatgaaagctcttttgcaggaaaaatgggcagggtttggcgatggttgctggggtgacagcaatgttagaatgtctttggttcaggagtacctctcagacttctgggagggccagtgctctctagatgcatctggcaaaattgtcatgtatggatctgtacaattctttgttttttgttgctttgatttaggagttataatgcggaggtgacccacagcaagttatagaaaaatacagaattacagtcacctcaaaagctactcatggtcatcatgtcagagggaaaaaatgctgtttttcttttaaggaaagaatgcttggagttgtgggaaagttgtagacttggcaatgagtaattcaagcctatcagtcaattaagtgagtttttattttatcatttgttttatttgggagctgctgtaatagtcattgagaggacatcagtcttcatatttttaaaacaaaacaaaaataccattgaacattagggcaaaggacaagaatttcaaggtttttaccttttgacttcagcaaatatttgctgctccatttttcttgctagattttgccatttgacttgtgtttttcctttgttccaatttgttctttgtgcttgataactgtagtgtactctatttttttttttttgagacacagtcttgctcttttgcccaggttggagtacagtggtgcaatctcggctcactgcaacctctgcctcctggattcaagtgattctcgtgtctcggcctcccaagtagctggaattacaggcacgcaccaccatgtctggctcatttttgtattttcagtagagatggggcttcaccatgttggccaggctggtctcgacctcccaaagtgctgggattacaggcgtgcatcactgctccttgcctctattctattttcgatggcttttttattcataagtattcttaaggttttaatattccagttaaaaaataaatatatttgtccctttatgtttttccccaatatacttattcttcctttatgaccaaaaattattcaaatttgcatccagaaatggctcacagaaagagctccttggtatttatttagggcatggtgggaccttttgttagtttctaggtcatgccacatctggaaggaaagacaccttttatttactaatttgaaaatctatgaaagcagactcagtattttacagggttgcatatattcctatgcaaagttgcatatattcctatgcaaagttaaaaatgactcactactccaactttggtaaatgtgtgcactttagtttttgaaagaagtgcaaaaatctgcagaaaaatctggactaatcataacttgaaatttttagtatatctggtagataacttttaaaaatataacccatcttttcccaaactggatagggataattcctctctttgcaaattgtgaggaatattatgattgtatcatataaaataaatatagaaacgtgtagaataaatgatcttccagagtatatagaggatatcaccagataatactctgtactaaatataaggacacaaaactggactttattatatttctataactggtaatatccttccagtttttgcttgtttattaaatgaatatactgttaaagatttggttatgttgtagatcttaattatgttggaattattaaaaatgaggcatctttaatctgtactgcttatttccaataaattattttgccgaatgagagccagtttaccagttcttttgttaaagaaaatgagccagtggctacctcagttgtatttatcattgccttttatggtaaacatttaaaatgtgtttttaatggtgcacatgccgatgtttctgacctctatagtagcataagtatttgaataaaagtgaggtaaatgagaagtctgtgccacccagtctcatcacaagtgtacctaattaagaagatgtttggaattcactgttctttgatttcttgggtgggagagaatattctgaaggctgtgattaaggaatcgttaccatgacaatcacattcaaagaattgagaggagacaatgagtctgtgggggatcatctcttttgattgatttgactcttcttttaagttctttcaaacagctgttgtcactggattttcttttccacgtaattcacacaattgattggtgatgtggggatcattgaagcttggttgtcagtagtgataagggtcagcagtgtccatgaccacaatacttttgctaaacctggagagtgattgtatgtgttaaatgtcactaaaaagtaactcttggcttctttctggaataatatatgtggtttgtctattttcacttattaattttgtcagggtgggatatgattatcatgatctctttgaaagcatgactaactctaaagtgtttgagctttattttggattactttgctgtcatcttacccagtgttttgtgtgctgttttgtttttattctttaacttgcacaatgttgtcaacgtaatttatatgatgttctggtcagagacacagttacacgctgcagattgaaaagtacacacaaatatacccaccatgagtgcttcagcctcacgaccccagctcatgttaagtgggacatgctagtacagatgataaagtgaaatggagatacaaaggcagttcagatctgactgtcaatttttctcctttgtggactaattctgggtggtgaaaccatgaactatggaacgaagactgctccagcatgagtctgagttgaatcccatgtgagagctttgcctcctcagcctttgggcctttctttcttctgccctctggagggtgtcagagaacatgaaatgcaaggactttctggaaaggatagccagggtttggtctggtaactagaagacactttccctgccccttccccaccaccccctccaagccggaacatgtagaggtgaggagcagacagagagatggcagggaagccattggcaaggtgggaatcttaggaaggaagtgattccggttcttgaaaaagacaaccggattccattaagtagaatcggtatgaattgtactcatctctaggaaaaatcaattccagaagggtgagtaagatgaaatatgataagactagtgtgtgacagattcaggtttgaagcttaaggtggatggaatcgaaagaaaggtatatttggtgtcaagtgtttgtggcggcatgtgaaatcattatccacgtttgataacagtttgactctttgcctgctataataatagtagtaagtatgtatttaacattcaatgcgtaccttgtgtgggggaggcactgctaaatgctttgcatggacgtacctccttacctctatgaggtaggtggccattatgatgctcatagaggctggacagctaatatgaggcggagcctgtatttgggctcaggcagtctgactctggtgcccctgctgtgaagagctgtgccctgctgcattcctcctgtagctgcacgaaagggtgtggaatcttctagaaacagtgagttctatatgagtggagtgtggtggtgggagaatagatggagtaaagccttttgtgtaaacataccatgctaagtactgggagatagaaacgaaatgagagatttttttgttttgttttttgagatggagtcttgctctgtcgctcaggctggagtgcagtggtgcgatctcagatcaccgcaacctccaccttccaggttcaagcaattctcctgcctcagcctcctgagtacctgggactacagacacacgccaccacgccggctaatttttgtatttttttggtagagacggggtttcatcatgttggccaggatggtcttgatctcatgacctcgtgatccacccaccgcagcctcccaaagtgctgggattacaggtgccagccaccacacccagccaaaataagacatttctttgcccctgccaccaagatatttaacatcttacaggactaacaaaacctaacatgaaccagtccagattcatatgatagaatatgaaaatgttttctggaaagaatagccagagtcccagtctggttactagaagacactttccctgtcctttccccacctgtagcccttccaagctggaatgtgcagaggtgaggaacagacagagagatggcagggaagctattggcaaggtgggaatcttaggaaggaagtgattccggttcttgaaaaagagaaccggattccgtcaagtagaatcggtatgaattgtacccatctctaggaaacatcaattccagaagggtgaattagatgaaatatgataagactagtgtgtgacagattcaggtttgacgcttcagttggattgaatcgaaagagaggtatatttggtatcaggcgtttgtggtggcatgtgaaatcattatccacgtttgataacagtttgactttttgcctgctgtaataatagtagtaagtatgtatttaacattcaatgggtaccttgtgtgggggaggccctgctaaatgctttacatggacgtacgtccttacctctatgaggtaggtggccattatgatgctcatagaggctggacagctaatatgaggcggagccggtatttgagctcaggcagtctgactctggtgcccctgctgtgaagagctgtgccctgctgcattcctcctgtagctgcacgaaagggtgtggaatcttctagaagcagtgagttctatatgagtggagtgtggtggtgggagatgagatggagtaaagcctttggtgtaaacataccatgctaaatactaggagatagaaatgaaataagaaatatttcttcctgacaccaagatacttaacattttaccggacaaagaaaacctaacatgaaacaatccagattcatatgatagaatatgaagatactgtctctacttaagtacaggtgggaggaagactggaagatgttcctttgaattaagtcactttaaaacatttgctttcaaatgttagcgcttcaccatgggcacaaaatttgtcttcctccaggcttttggcctggcaaacaagaaccctgtccctatagtcagcagattcatccattttgagttgggaagcattatcttcagccttttcttcctgacaacgatcctgacaatcgtcgtcaggatctctaaagagatgaactcattagcctagtgaaccaacagtctcagctgtttatttaccagcacattaacagtttttccatttatatccactgcctgtgtgacgatcagcctggaaatggtttgagcatagggtgggaggggtggttacacacctggttgtaatccttggtttatttttgccctgtttccatctatacttcttgagagcttcctgtgttacaggcactgacctgggtgttggggcagagtagtgaaaaaacagactgggtcccccgcccaaggcactgtcttttcctcagatttcattcgctcatgtacattttcatagttgatctaaaagcggcatttggtgtgaattctaggatttcacacttttaggataatacagtgatcacactccctttctcctttgccccagccagtcctttctgaataaaggtcgagggattgggggaggaaggcagtgatgcgaatgggcctgtggggaggtcgcacgggcttgaggagggcagcatgtcgtagcgggccatatttgtgtcagggttgggaacggcacaaggcacacctgtttcctagtgctgcagaaccctcgtcctgggatgagcctgcccgctagtctgcatcctaatcctgctgttgattggagataacttcagcggtcacagggcacctcgtctccatggcaacccctctaaatattcctctagtgacttgtgctctacattctggctggatcagagccctcctgtggcaaaatattctaaagatgttaaaagagagagagagaaaaaaaaaggctcaactaataaatctattctaaacgactgagtcatttgttttgattacccgggtgattgccaaatgttaatttaaaactgaaataggccatgagctcactcccctaacaatgctgagtgtttgagctaatacggcttgataatgagggagccagatccactgccagtgctcatgttatatgataaacagacatttggagaagtatgcagaacatcttggcagttttcctttaactctaagggttgtaaatacaaagtagaatgtgttaccatgagccatttcataggaagttgactttatttttttagaattcagaactttgcttctaaaaaggtaactttgcctcttgattctcatttttttccctaacttaggcaccttggaagttgttttcaaccatatccagcctttgccgaatacatcctatctgccacacatccagcgtgaggtaagttttactaattgccacaaattcttacactgatctccaaccttctaagttgtggtattaggggcggcattgtacaaagggctttatttgtaccaggaggtttcagaaggttcattttaattgactcaaccaatgtcactgcttaccctaaatattagctctcgggggcaatgtcttttcaagggaaaatctcatttgctttcaacttgggcatatgaaaagggaatttgccaggcacaacagaactatttgaatgtctgctttaaagtaaagatctgctcatgtcgttgcacgaacagtagggagcaggaaagctgcatggagcaaatgctgggatgggacagaggagactcctgctgccagccacgagaaggttaggctgacctgatcagctattaggaatctttctccctgggtggaaggagccaaggtgcaggactggcattgcaaaatctggtgatagaaggccaaagagtgcttctgctcggtgacattaatagggtccaggagattttcttctgatttgccctcaagttcagaacaacctgtgggaagccagtgtaagaatgcttatactggataagcgttctctgtcctcttcatttagccacagtggcttgtttatactctgtgatgactcagggttcctcaattttctctttgagagagggacattgacctttgaaaataatgaaggaatctaagagaaggctcatccaggcacgatacagtaatggtccctcctttttggtgccccggtctctgtgcgctcacaagagggaatgtaacctttgccagcaccatacctgtcaggctttgccatttcatccctcaaaaggttgctgcgtttttgccttcaccttcaccctgcccacccctgcatgcagccacatggtcagtgtaggtacttagatttcagttagggtacatgctcagcaggtgacaagaattgcctttgttatgtctacttgctacagaattctccccaggttttaaaatatatatcttcaaatacctaaatgtattaaaccttaaagagtaaaaagcataggacaaacttttagaaatgctaaacctgaattttatccatttcatcaattatggtggtagtcggaagtccttccaaggccctcgggcttgaagcaagctcggtgatacaagctttcagcagcttccctctgctgctggagatggaatcttcatttctgggtctaaatcctgccatagctctcattcatagcctttacctataatggttgttttcaaacttaaaaaaaatgatagaaacctatcttcaaaaaatacaaatctttagatctaaccccaatagagaaaaccaaagctgaactgctttggctcaagtaggaggctgtgactctctgtcaccctcctctaagggtgaaccctattgaaagagcagagattttagctctgtgccctttcccagctcttatttttattttcccacagaagaggctagattctttaaggagatataaagaagggagagagaaagatataaagattctttaaggagatacaaagacatcctctcatcagctggaaatgccagctaggtgagacctgactatgcatatgcattgtttgcccttagtaattccatagcaatctgcaaattcaatcagcttcatcagcagaaaactttgatagaaaccatgtgtaaaagggctgtgttcttaaagtggaacatttaaatcgaagtttttcaagcacacatttcaagtggttttatgataccaagcacaccccagtgacatctttacattgaccaaaacttggtatccttgggttttcttttaaagcactgagtttctcaggtgtgtcagttgaatagaatctgctaaattctgttttttttatttttttaaattttttattgatttatttttttttatggagtcttgctttgtcgctcaggctggagtgcagtggtgcaagtgcagtggtgcgatctggctcagtgcaacctccgtctcccaggttcaagcaattctcctgcctcagcctcccaaatacctgggattacaagcgtctctacatcaacatgcctggctaatttttgtaattttagtagagacagggtttcatcatgttggctaggctggtctcaaactcctggcctcaagcgatccgccctccttggcctcccaaagtgctgggattacaggcgtgagccactgcgcccggccaaatctgttaaattctgtttccatgtaacagaaatatataggattacacaactgcatctggtgttctttcttcctttcttttattcattcattcagccctactatgggccagggcaggaatgtagtggtgagcacaaaaacaacaaaaaaataccttttgggtttgatattcttcaagggtgggacatgcctagattattttctcttttgcagacaaggaaactgaaaattgctttgcttttctcaattacattgcccagtattcagtagacaggtatggatgcaggggtacagttccaagtccccatctctactctattctttgagcctatgatttatgccacttccatataagcatgtgcaaataaagtattcagtaattgccatggatgcagctgtccctgggacccgaaggccctaaaatgaaaataaatgtaaactgtgcgtttcacactctatttttaaaacgtttgtttggaataattgaatagtttagtaaaatgggctttgctgtttccacatgaggatatcttgttcttttattttttattttttttgagacggagtctcactctgtcgcccaggctggagtgcagtggtgcaatctcggctcactgcaatctgtacctcccaggttcaagcgattctcctgcctcagcctcccaagtagctgggattacagatgcgtgccaccatgcctagctaatttttgtatttttagtggagacggggtttcaccatgttggccaggctggtctcgaactccttacctcaagtgatccgcctgctttggcctcccaaagtgctgggattacaggcgtgagccaccatgcccggcctattttgttcttttaagtgatggtgtgtccccttttaatacagtatttatcatagataaactttattattcagaaacttagaattattccatttggctgccttttagtttacagaattatttggaacacaagcttgaacacataattcttaacacatacgtgaactgggctaaatttgagtatttgtaccatagtagtgacaatattgttaattaaacatgtgtttcacatgtaggagatatttgtatcactgacatatggtcattttcattattgatttggcagttttttaatattcacaaaacacaaaattttgaaatacagtagtcaaagtgatttgatctgtgccatttgtattgatgtaacctctcttcttggtgcactagcaataagaaggagaatcagcacagatgggttacacagacttagaggatttggaaaccatcactttagagccaaggtctcaaactgatgggctggatctggcacacagaggtgttcttttaaaattttaattgccagcatttaaaaattgaaaggtttcatattttttgaagtccaaatttttcagcttctcttgaaatatcagaagatctggcaatattgagccctcactcctgtttggctacactaggctggagccaaatggctgctgtttcttttctttttttttttttttttcctgagatggagtctcgctctgtcacccaggctggagtgcagtggcgtgatctccgctcattataagctctgcctcccaggttcacgccattctcctgcctcagcctccccagtagctgggactataggtgcccgcaccacgcccggctaattttttgtattttttagtagagacggggtttcaccatgttagccagaatagtctggatctcctgaccttgtgatccgcccacttcggcctcccaaagtgctaggattacaggcgtgagcccccgcacctagccagctgctgtttctttagctagagcatgaactctgaagtttgccacagtctctggcagtatctgtaatctccttgacactaaggacaagggttggttgccattatctgaatgtttaacccctatagacatgtgagttttcaatcccaggtctagataaaattgaggttgcaaacttaaggtcatcctttttctcaagatatcagcttgctaattttcaggggcacgacatagggtgacagtcatattaaggaggtgctttaaaagggttgagggcaaacatttcagaggaaggttactttctgatgatggtacctgattaagaaaaggatacatcgacaggtacgggtgatttattttattctggcagattcctgtagtctactttggtgcttctcacactttaatgtgcagattctgatgcagcaggtctagagtagggcctgagatcctgcatttccaacaagcgccaggttataccactgctgatctgaggacctccctctctttgagtagcaaggggactctaaaagcaatcctaagaaaaatcagtcaggcagtgatggtgctaatgtttagaacattcacttttctctagcctgagaaagaaaaagagatacgaaccagggtattttgggttgaatcttcccagataaatctggatctactttgagttggagcagaggagatgaaaaatcaattattttcaatacagtatagcacatgggaaagataaatctaactctgattttaaaatttgttttaaattaagtgcttctggtaaaaaaaaagctagatatgctcaggaatcatgaaatgtagggattagagcttttaattttaggaaaatatggggctgttagcaaacttgtaaatcagaccacagaaaataggataattatcaaatccctggttatatgataaccttgtaagctataaaatgattttaaaaagttggaaagaaagaaatcaacagtttcaaatatatacagtcctatattgaaaagtataattaaaatgaaaaagcacaccaggaaaaatctgtggcacagatgacaagatacataatttctatatcatgcacagacctcatacagattgtaagaaaggtgcgcacaggcctagcacgtggtaggtgcttcctaactgttggctgaatgaattatccaattgatagatgggtaaaagacactcaagttatatcacaatgtaaagaaatgcatggaaaacactcagcctcactggtatgcaaagataagcatatttgaacgtcagcaaggcacacttttactaagttagcagaattacaaaaagaaaacacaatgttaatatggttaacttgaaatggatatgcacttattcactgctggtagcaaagtaagttggtacaaagccttttggaacattgtttggcaatatatgcctaaaggcacaaagattggtaccctttaatctagtaatcatactttgggaaatgtgttctgagaaacaaattattctaagaaaagaaaaaaagctgtgtaagcattcatcacagtgttatttgtgaggacaaaaagaaagaatttaaatgtctaatgtgaaaaaaatagttcatttattcaataaatagttttgattgagtagattatgatacatctatgcagtggaatttcatgaatctgttaattataattttcacacttacattagcaatatgaaagaatttgtataatacagtcttactaaaaaatgcaggatgcaaaattgtatatatgctgtgattgtaacttgcaaagtgatatgtacctgtggacaagaactagaaggcacaaggaaaaaatgtaagtatcactttatttgaagttgtattcatgttgtgatgttgtttgtacattttgctattacttagatgttgagaatcttccacttttatgtacttaactccatatcacaagccggatattctaatctatcacagagtgcttagtaagtaaccaagaaacatgaggactcctgtctagagcctaaacatggggttccagtgctctagttccttctcgcttgttgtgtttcatcatccagagcccccatttctctttcttccgtatttggtggttggtagaggcatcttggtatataccacatgacaccaagtataaatatttgtttcagagcttttaatgaatgtctagcagtgccaggcagggaatgaattttcatgtttaaaggtccagtgtccacttaaggaacatcttaatggagctacagctcaagagcaagcccatttcatcttctgatttccattagataagcaacaaaaattggctttaaggtcatgagcctccttacagcagtccctctcaccttcagctgtattccctatttcagatatacttgtttctctgctgtaagtacacttttcttttctaattaggtcagttacttcatgtctgtttttcttttttgacatggtttcttctggctttggcaccacatattttccccatatgtcattgcctctggagcttcatgttgcaatagtttttcaaggggaacggagagcacattgctaagggtgggggatggcttttgcctcttttgcctgccctttgcttcagtgagtgttcgtatttctgttgggcctagttctgtttggttttgtagtcttcagagtcagttatgtttggactgaaagatacttaagtaaaaataatggcaagtcagagatatgtctggcaaaggtgcagcacatttgttaaggttactggtttatttatctcccttgtctctatggtgactaaatctgggtctgggatttaatggacttagttttgacctcttgtaacatctcctaacttttcccagcctctgatttagaaagaattcattttcacttgaggagagaaactgtctcacttagaaaaggggtcctaactggactctcgaaaagtggaatctctagtctttgattcttacacagtcttcaaccagagtacccattgtggttgtaaagaaagctaagaagtcatgtagaaatacacacacacacacacacacacacacacacacataatgtctcaaggaaatacttttctttttagtgaaataaagtattatttagttaatgtgaatgaactgtctgtaaagagaaccttttgtcagaataccaaatcaatggaaccattgactggacattatgtttttattttttaaaagtatctcctttacccattacaggattataaatttgcacacatataaatgtttgaaccatatttcagagttcaagtgtattaaattgtgccatggaagtccacaataaagattgggtttgaccaggattctcatggaagaagtcagatttggacagctaagttcaaatctagtgttccatcttcacaattgatgtgaaatgaggacatagatatctgatctctaaggtaggtagagtcaaaccatcttggacttcagttggttcaaatgagcctttaaaactttttctcttctcctgtatggtgctttgagacttataaaaacattccagctgtaagaatttactaatttgttcatctgtttacaggtcttttcagcttctctaagaataagctcacatgtgaattttctttgaaaccccaaaacaaaggagtcagtaaatgattgattatcaagtattgcacagagactgaggcaagggaagtgacaaaagtcctcttctgtccttactccccaagtataaaatattagagttcagatctgtcatcaagtttagttcaagcccaataggaacttgtgattacttagtaaggtttttgaacatcataaaagttcagtgcatatggaagttgttgtaagattttgtccatcatgaacgctcctattaataggcaaagatttgagaagccaacaacagatgctcacttgtaagagagaaccatgcctgggagatgaatgttggatgctccttaacttctgagtttgaaaccttgactcacttgtcttataaccgtggacgtagaatatttgttagattaaggtcatagctaagtcatacaaattttattatgatcagtacagtaagcatagctggggtcaaagcttttatggaaatcacaatgttaaggcctgaagtccttaataatgcttgagaaagaatggcacttttatcatcatcattatcattgtcatcatcattattatcatatcaaccttatatcacatgttgaaagcccagtgtggtgaactgtgctaataattgttataatttatgtatttcattattgatatttcaattttgtttgaacaactgtagggatcaatttaaaataaaaaggaggaaatatataaaaatgtatttagaatagtagcctcattgtcttgtcttatcagccagataagctttgtgctttgtagagcatctctcactgaaggatacctaattattggataaacaattagttctttaacagttcttaggctgggtgcagtggctcacgcctgtagtcccagctactcaggaggctgaggcatgagaatcgcttgatcccaggaggcagagggtgcagggtgcagagatcgcacgactacactccaacctgggtgatagagtgagactctgtcaaaaaaacaaacagacaaaacaacaacaacaacaacaacaaaacccaaaccaaagaacagttcttcacctaagtagaaaagcagaaaaacaatggtttgaggtctttgtgagtctgtggacatctcttaaaccatgtgtgagaggaccatttctttttctattctttttttttttttttgagacatagtctcactctgttgcccaggctggtgtgcaatgacgtgatcttgcctcactgcaacctcttgctcctgggttcaaatggttcttgtgcctcagcctcccgattagctgggactataggcgtgtgccaccaggcctggataattttttggtatttttagtagagacggggtttcaccatgttggctaggctggcctcgaactcctgacttcaagtgatccacccgccttggactcccaaagtgctgggattacaagcatgagccactgtgcccagccgataggaccatttctgtacacattcattagggctacaaattcataatttccataaggtactctctgtgtttctttcccaggaccggtagagtttttcctatgggtggtggtgagagtttgtgtacataattgtcagcgtgcacaggcatagggatttataatccagagggtcttttgctccctacagtggttcaaatggaaactaattggagagggtgagttccaccctttgcattgggctcatgggacaggtttgaactggaaaacagtacaacatgctccagtatttttagcctatcccttatgttcccagctctgccgtttgaactgtcagttctcatagacttcacataggatcttgacctgacttttggtcctctcgtgggtgttttccattttccttactggggcaatctaaggcacaaagagtaaaggatttggtcagagttactgtcttaaattgtactctgctttctccaggaaactggaagcttctgaggagcaagaagcctgatgtttcctcttatgtcctttgtatcatttattatttagtgccagagacttagtaggcatttgctagagatacaattaattgaatgaaaggcattatgtaaattacaaaccatagcattaccgtggtattacacaggactgtcttaggatccctgttcctctaatatccatattcctgaattgttggaggatatgcttgaatagaacaatcccttttccttcactgtagcatgacattatttcttcccggcctgttatcagcaagtttttcgaacagaaaagttgaaattatacagtgaacgctcctattcctaccacctagagtcagcaattaaacattttactatatttgctttatcaaatatccaccatttacccatcttaatttttggatgcatttcagagtacgctgaaggcatctgtacgctttacccctaaacacttcagctttatcattatgtggtttcaattttgactttcttagagctgctttcaaatttgttgagatcctgacatttattttggtggtggctaagaagacgtagtaactcaaatgtgcaatatgctcagttttcagaccctgggagtttctctttgtttgtaactaccagcaagtatacggacacatacatatcgctgtcccttccccgcttcgttatatggtcacattatttgtattgttgaaatttggaaagccagcctaggaaatgcagttgaggggcttgtggatatgaatgaaatcaaagaattggggttgagaatagtagggcaaaaggttagagttagctactataaagggaggatagagttgggtataaggagtggggaagagattcagatcaggaagttatcagcatgataccactttcatatatgaagtctagagagggtttggtggctgttcatatgacctaaaggtcatggattgaataaacactaagagtgcaaatagtccttccagtctagtggttttcatattgtattccatggaaccctagaatttatagacatgtctcagaggttttaccaacatttgaattatactttcgcaagtatattgaactatttttaaaaacactaataagaaaacccaacaaaaacacttgactgtgttttatagaaaattttatcatcctggagaacacatactgattgactttattttattttattttatttattatttttttgagacagagtctcactctctcgcccaggctggagtgcaaaggcgtgatctcggctcactgcaacctctgtctcccaggttgaagcgattctcctgcctcagcttcctgagtagctggaattacaggcgcttaccactacgcctggctaatttttgtatttttagtagagacggggttttgccatgttggccaggctggtcgtgaactcctgacttgaggtgaccccacccgccttggtcccccaaagtgctgggattacaggcgtgagccaccgcgcccggccctgattgactttaacataagtaaaggttattaatgtcaacctaaaataaagttttgactaacacttatctgtcatccatcaaagtcggggtagtatttctatgtgggaataaagacaaaaggtccacagcaggaccattacactaaagccatgggtgttaaggcattggcctgcaaaagctgaagttacgttttggtttccagttaccatgagcacttatccatctgttatatttagatttttttttctagtacctttaggaatctgcaaacagacgagtatctgctttaaacttgaaacgaccataaaaggagagagatggttaggatgccggaggctggctacactgtcatccttcagatgggcctgtgtgaatggattagggaaccttcaaaaaggtctctcttctggcccaaactgctcaacctggtctgaaaatgtatgtgtgcaatattgcacttcatgatgagatgtgatgttcagggcttctttaataatgcctagaaaaaccttaaaatgggcttggcagatttctttcatttggaggctgtggtactcaactttggtgtttttcattccagactgtaccacattctgtgcccatagtttgaaaaacattttggaagccaatacctgcttgtgtgtagctgcagtcagtttttaaaggttttgctgatgtatattttattttcccctaacctttattaagatcttcaaagttgaaatgactttgcagtggccatctttatccccatcatcaacaggctgccattaatagcattttattctacctgttttattactatctatccatccctccatccatcagtctatcttatttttggatgcatttcaaagtgaatgtagcagatttcaccagttaacttcataatattttatacacttgaagtctagctttttgaacagtacacaaatgtgactaaattgctatagaatgctgttaaagaaggtataaaataaatgccccagttttggaaaaaatttaggagccttattttaaaagtaacaggtattctggaatcctggcatggagttggaaaaaaatatactaatttttaaattggaacttttttgtaactctgacattgctgacccctaaaaaagaggggatacacttgtaaattttattttcatcccaggcaggagttaagtaacttcccgttcttatagagaggcaagatcatcttgaaaagtgttatagacatagaatgttggttacgcccacagaatcaattgcatttggaaggcagaggaacagttaactgaggactaagttgatctatgcagggtctgagtccaaaccctggtgtcaaggtgttaagtgcaaattattattattattttttaaagaaaacactcttgttacaatttggacagagagaatggtatggagatgaaaggttctcgtgtatggcttttgctcctatttatgtggaaagcacgccctacattctttcaaagctgtgttgttccctttattctcagtccccagaattgtgtgcaaacacactctcttggcccaggggtttggctgggtgtgtttccttctggaagtcttcactagcactcttgagttagctggcaggagatcccttaaaaccatttccaagcagtttttctcacttccctataggggctaatcctgtactttccacttcagttccagctgctgttgcttgggaagaaacaaatttctgctgtgttctcaatctccagacggtccatgaaaatttaatgtataagaacaaagaggctgggcgcagtggctaacgcctgtaatacctgcactttgggaggctgaggtgggtggatcacctgaggtcagaagttcgagagcagcctagccaacatggcgaaaccctgtctctactaaaaatacaaaaattagctgaacgtgatggtgggcgcctgtaatcccagctacttgggaggctgaggcaggagaatcgcttgaactcgggaggcagaggttgcagtgagccaagattgcgccactgcactccagcctgggcgacagagcgagactgtctcaaaaaaaaaaaaaacaaaaaacaaacaaacaaaaaaaaaacagaaaatatattttgggcagagattagttgggggatgtgggtgggaaacctggtgattagatatatttaaacgtgtcatgtcagtatagagcgtgaattaaaaataaattatatttggagagttgtaagaaatttaccagtcccttcagacagacacatgaccctttaaaactcattaaaactccttggcacaatggaataacatgcactttggtcttggaagaaaccattaggttgcaatgtttttgatttctctaccactgacttgctctttgatcttggaaagtgactgacttgtcctgtgattgtttcataatcacccataataaaactgacttactgtatatagtgaatagttaagtttaaaactatatctagtttccgttatagctcaagtttatgtattattttattagcgtttagatgttaacattaagctttcaaatcagatgaaatttaatttgaaaaaagttttcgtgtatgaatactttatattctgcagttcatacatgcagtaccacccttaattaaatgatatttccacaaatcagtttggaagattttcttcctgcaaaatgtatgtttaaaatacataaaaattgatgggaccatgtacttatggctagtcggaaagtggaaagttttttagatttatgcttaggacaggtgatagtacttgagcttctattcttagtttgaccttgcctcccccacccccttaaagcaagacacttaatctctttaatgtctcagtttattcatctttaacacctgtattcttatttcatgaaaacaatacctggtttatatttggtagcatttaaggacttgatatagaaggtggtatggaagttcaaattatatagaaagtatttgtatgctgaatgataatcttgacaaattactgattactacatttagaaagttacaactctggagggaattgatatttgatattgttttcctgtgtgttctaagttaccaccataacagtaggaaaataaaccctatcctggctgtgttacaaagggattaactcacttcttcaagttgttactaaatctccagccctttaaacaacagaaataaaaagtgttccttattttaatttttccgaaatgaaagtcctataactaaccttggcttaattttttcttttgttgagggctttccaagttattttctttgtgaggaatggaggctaaaccatgtcagttgcttgaagcaactaaaaataccccgtacaaatatgcagaggagtatgcttttgatttttagatcaaaacgaagaagcaagattttatggagcttgcttattatacatttattatactgagctacttgtgccttttcaaataattaaatattaactaaatacaagaggattaaatagctagactttaaataaaactaaaatagccatattagtattttctaaattctgtatcattgaaagtttaggctgatatgaaagagagggaattcctatcatggggattgccagtcttttcacaaagacctgccactagattttgtagtatatgataaatgtgtgtgtgtttattgtgaaaattgtgtgagtcatatgaaaaattaagtctacttgaaaaatcaaaagacattacctacttgggtacaaagcctgatttatatatatatttctttaatgaccatattatgttatgttaaagtttgtatagtacttggacatatattatttaatttcattcctaaaacaattcaatagggaaagcaagacagatattaatattcccatttcatagatgaggaagaaaaaataacttggcttgtaagcaattcagcagagtcagagattgcatttgagatttttgattctaagtctagtgtgctttccttgggttacaacacaataaagtcaaaaacatttactgttattttcattaattgaaagcttaaaatcaatttaaaattctaacagtataaaatttaacagtataaaaatattgttaatttaattttatgacgttaatttttaaattgatttttgaatttgctaaaagtgttttaaaatcagtatcctgtttcacaattcctgaattaatctcttctctgtacatttcctgttccagtatgataatttatataggctttagcatttacttatggtattaaatgagtagacagttggaagggaattaaaattaattaggtcttgcagttcttataatactcctggtttgccacactgaattgccatgacgtggctggggatccctgttttaacatctaacaaagatagctgccagtgtacttaattttaaaacggtctcatctattaagctgctttataaacatcagccccttttctgaagtccgaagttagttttttaaaatattcactgataatggagtgggggtgctggtgacgtttctctttcttgtttatctgtaaagacagggaggtgcaatctaagttaggaaattggtgacaaatagtcatagaacatgggtcacctggcttcaattagttatgtgacctttaagaaaacaagtgcccgtttcagaaaagactgacctttgaggctagagacatcaagctactcctctacttttaggaaaaaacaatgacagggttaatttaaaactctgatgcagacagagttgaaaaatccatgacagatttatataacgaacgtggatggtgttttgttttcccagaatgcagttttaaggtcagacctatgactcagagctgtgcacttccctggtggtatgcatcagtgacatgttgccagtctaatcgtccagaagggcttgtgcccagctcggcttgctccattataatccccagctgagaagccacctttcattttttttaaatagataaggaagacagcatgaacatttgaaactcaaatactatatgtagtttataacttttcagcctgaagacttgatgcacactaagttgcctctttaattttgagaagtataatctccattgccactaatccatcatggtgtggcactgcatgaggatatgttgtgtgcattgtcagtatcggcgttttgctgagtttactgttttttagttcattggcaaggcatcgtgggttttggtgcaaagagcatggatttggaatcaaaagccacttcctctctgggtggctgattagctgagggtaaccttcatatagctggcatgggatttccagatggcatcctctctgcatgaacaaaaacaatgtgccatttcagtaaactttggtgggtgctccctcatccactccagatcttttcatctctttccttttattccctccctttccttgtaaatcaaaactcccattcctttagtgctgctgatctcttttgggggttagaagaaagcagtctgattaaactaacttactactgtttttagttggttcatcctatctttaaaaaatgtatatatttcaaggctgggtgcagtggctcacatctgtactacccagcactttgggagaccgaggtgggtgggtcaggagttcgagagcagcctggccaacatggtgaaactcttttctctactaaaagtacaaaaattagctgggcatggtggcacgcacctttagttccagctactcaggaggctgaggcaggagaatcgcttgagcccgggaggcagaggttgcagtgagccgagatcgcaccattgcactccagcctgggcgacagagcgagactccatctcaaaaaaaaaaaaatatatatatatatatagatagatagatagatagatagatagatagatagatagatttcttacagcattgtgataacaaatatttgtcaataagagactaactgtggtatagctttacaattggatactatgtacatgttcaaaaagtagaagctctttacgtactgacaaggaaaattctctgaatataaataaatagaactagcaatagaattaatagaaaaagcaaggtgcagaggagtatgtatagtataccactatttatgtttttttttttaaaagaggaaaaagaaaaaatatatagctgcctatcttttataagcccagtatctccagaagcataaagaagacactggtatcattggttatcagtggagagggggaagtagatgtctggggatagatagggggaagaatacttttcactatgtattctttcatacttcttcaaaaatacatctttggaaataaacccatgcaaaaaaaagaatgttcacagcagtattatagtggctaaaaagtggaaataacccaaatgtccattacctgatgaatggttgaacaatatgtggtgtatctgtacaatggactattattcagccataaagagaactgaagtactgatgcatgctatagcatgaatgaacctcgaaaacattatactaagggaaagaaatctgccacaaaaagctgcatattgtgtgattccatttttatgaaagcattatgctaagtgaaagaaatcagccacagaaggccatatattgtatgattccattgccagaagtggcacatccataaagacagaaagtaggttagtggttcccacggggtgggggtggggtatgcagagtgatggctaagaggtccaggatttctttgggggtgatgaaaatgcagaatcagatggtggtaatgattgatatacattatgaatatactaaaagctgctgaattgtacactttataaaggtgaattttatgatatataaattattttaaattttacttagagatggggatctcactatgttgcccaggctagtcttgaactcctggcttcaagcaatccttctgccttggcctcccaaagcacaggcatgtaaattatatctcaataaataaaataacatagcaaaacaacttgaagtcatgaacatggaaacttaaagaatcactgtgaacatataaaacaaaagttttcacctaagaaatgtttttattctaaaatattttacatattatctctataatgacaaaggacttcatgttctttagctaccttcactcacactcacctggaattatttcattttataagtgaagattgttaacccaaatgaagccctgattgataaaattttgggtaaaataactaaagaaagaatgtgtgattatctggaattgagatgttgtagctgcaggccttgcccaggctgtgccagtaggagaggaggtacggagcctcagagaatcttttggaccagtgtgccctttctctcctcacagctcatcccagagctgtccctgcctccttaggctgatatgcccctgttcccttccttgtgttctcctgcagtgagctgaggcacagggtttagggagcctattatgataggaggagattaactttggggttctgggatgagatctgtggacctgaaaatatagcctctctgatcctagtcactaactgctcatgcatggagagtgacagctaagaggtccggggtttcttttgggtggggatgtgaggtgctgggtcattatggacatacggcaatggtctgtctacacaatggtcagataatagtcttcttacagtcatcccaactctagatgctttagccggagttcatcttggggtgggtatgggggattgaccacaacgtgtttttggtcaagagtcgggtagatggtgcatattttggttctgccacccctgggaccttgggcattgctgtactcacccaagctatgtctcggcacaaacagcctcatctcctgagctgtagagtcatttctgtaagtggcttgatgagatagggtcttttagatccatgtccttggcatttattcagaattaactcacataatatgatgctaatctgcattctggctggagctgcatataggtagcctcttttcattgttggcctttatagccaacttaagctcagagatgtgaatcaagggtggcctgcctgatgaattagtgcttataaggtaaacccttatttgttgtgttggaaagtttattgactctagccagaaaaggtctaattagccactgggccctttcctggcagggaggatgtagggaagaccctctgcagctcaagactggacaggtgacctagacctattgggtatttatttcattagaggatcaatagagcagagatttgttctccccaggtctccatcatctgttcataaaccctcctgacccatgttgagtccacagctgtctccactgggctgtcaagctgctgaggccaattcctctgagtccctaggactttgagttttgctctctgctgccccagtcattctcaggcccatggtccttgcagctgggctcttggccaacatcctgagcccttatctcttttccacatattccctgtgaattagtaaacttgataaattctatttgtaggaatctgctgcttgggtcggccacatttttagcgtgtagttgaattaataatatatagtgcttactgtgtgccagccactgctctaaatgttgcaaatatttactgctgtatttctcacaatgacccttttacataggtactattatcatccccattttacagatgggcaaatttagtcacagagaagttaagtgaaacttgccaatgtcatacaaccagtaagtgatagaggcaggattcgaatttagatattctggcttcagtctgtgctcttagccactgcactatattctcttgaatcattataaaatagatatactaatctcagggcaaatttcctactatttgtcttggaactaaccatgttaattgttcaaccaatctcatataaagttaagccttaaatttctttcatggaagccttcaaaaatagttatggtccagtctaaaccgttttacctgaatttcattgaatgcaataggacaatcactccttgtttcactctctgtaccttagataatctggtcttatttataccagttaggtacctacttcccatgtttgttcttgttgattatcattggaaatgagcaagaagggtggggatgtgaggtgaatggggtgtgatctttccacgtacatgtcctttgatggcttctgctcctctagctgcagactctccttgcgttctcctttctggacttcgtgttcctgtcattctgtttcatgtacttgctgcctggcatggtgaacttgttgtttgacttcaagggctttgaaatcactcactcttgttccttaagtgtcagctgtttaggtagagcctctgcttccgcatccaacctagtccatatctctctcagctctgcgtcaactactgcttccaagttagccaaagtttatccataaactttgtttttctttttaagtttaatagggtttaattgagcaaagaacgattcgcgaatcaggcggcctctcgaaccagagtaggctaagagactccagcattaaccattaactgtggctgagataacttgactggactcttgctgctgcatgagagaatctgcaaaatgtgtcatctacacacacaactgtcccttagtctcagggtctgtgacccagcttaacctctgttgatgaatataaagtcaagggataacaaaccccctttaccatacatagcattcctaaggtttacattgtcatgagtaaagatcccttgctaatacggtacaaggaatagtgccttcggagtccagacactcagcttctagacctggagcagctgttaactcagggaagcaggtgatctctccatctctgggcctcagcttttccatctataaaatgaggtgattggattaggtggtatctaagaccatttccaactctatcatgccatttttatgaagctggagacaccctcagacctggcccactttatcttcaggtccgccaatcctctccaacttgtggaggagcctatactctgtccttaccatgcacaggttgacgaacagggaagacaagctgccattgagggtggtaatctaatggcagaccacacaccaacaggatcactctggttctgcagctgagttttcacaaaacagtgcctgtcctggcacaacagaagagctccttccacagaaagttattcctatttgctctctcagatacgaatcactgtgggccaccgcgctcctctgtccacctgtggttactcctgcattgaatctgaatcaagacactgctcaggcagtcaaatgttggccttcggggaaacttggcagatgggagccaagtgagctttcactttatgtactttcagtcctctggaaatctggatttcccctgctatcaaaatagacaatgctattgcctaacaaaatatagacttcctgagtgacatccaggtcacggcttgatctctttcctcctgctgtgttcatgcttccacttccgtgcaccatgttaggttcagatgatctactgaccaaaccccagagaaccactcatgagtcttttcaacctttaccttgaattctagggctatcttctatttggggtttgaaaacaccagtgcataataaagtaatgtattaattatagttttttggtaaataaagatagatcgtatgttactagccttgatgtttcacacaatgaagcagagctcatgaattattataacatccctgatcaaggcagttgatctcagttatcagcattaagaataaaggtatggatggaagcttatttgatttgttcttctttcctattatggatattaaccagctgggtaaattatagaatagggtcatggaatgtttagccctcaagcatttatcagaggcttaaaatgttcataaaaggtgggcttggtgaatgccaggacttagcatggttgaaagggtgttttgagtcatggtacatggcaatatggaaataaaacagatatgtcacaagtaggtggtagaaataaactggaagagaattttaacatctaaaatgtgacaaagatttatccttaccagcttctcagtttcctgaaacatttattttcctttgattttagattctgtatttatgttatatatctctttctaaaacattttcttgtttctgttttctttacttcttttacttttttgccacttctgttttttgaaaaatatcatcctaggcatgctctgaaagtcatttgttcggtgttttcctgatagtgatttctggttataggcccataaagtatctgtaggatgtggttaggatagttcctacctcttggtaaaagtctagtagtaacacaggaagggcacagactttggggacaagagacatttaaaactgttactgatcatgacattaccaaaaatcaaaagacaggggccatggctcatgcttcgtaatctctctgtgaatattataaggaaaattctaagccctggtcaactgtgaaatgaacaggtcttcagtggagttaattagcattttccaggtgctttgctgtttacagtgtcctttatttcatgtatcttctcatttgttacaggtcttctttcataccttttccttttctctgagattcagagaccctttggggaggctgaatttcaggtttgttttcattaggaccttacatgaccaaatcccccctcttggggttccaggggtgctccttcattttactctctgatgggtatgccatgaattgtgacatttaagcagtgactttgcaaaattggacgtgtcagtaggaaaaagtactcttcccaccttaaagattgacaggaacatgagatggctgaagctgttctgagcttttttctggcaagagtacataggacaagaaatactctggagagctcaacattgaatcacatcatatcatagtgcatgactagttgccttaatcttgcagttggactcactcaggagaaattgttggcagagggattaagtagcctgacaaaattatattgagaaaaaaacttgcagtctattaatttattagtagtagatatgagggaaagaagagtcatgtaaaaaaaaaaaaaaacaactggacatgaaaccacggagaaatccacaaagactccattacagtttgttatcagcctcttgcccctggccatgactaatggccagtaattgtctgaataagtttttaaccatttggaaatttcttcaggaaaagaaaaatctagtaaagggagaagggtgaccacaagtcaagctgtgaatgaggaagtcctgaaatgtgggctaagtgggtcactgaatttgccgtgtttgattcttcggttgcaccactttgaacttttgaagtttgatcctcccagtggtgtttctgaggtagagaggctaggattagattgcagtgtgagaaatcccacaaacgtgattctactgtaatcttactgttctctctcgctccttgataactgggatcccattaaagggggttcattattgacatctcagaagaaactcattgtgaagtctaaaataaagtgccattcttccctacaccagctctgcctcccatattccccattattttcccagtcacccagagtcacaacctcagagagatccttggctccttccccttctttcagttcttgtagccctgtcacagtgtcccttatatctagtttttcctttccatgcccattgcccctgcctctcattctttcagtctttccttgcatctcagtggacaattgcattaccctgtgctgtcttccctgcctcctctcttctctgagatctgctcttcttatcactgcttgcatgactccatctcattctccccttgcaccagttgcagaaagatcctccgtgtgtggctttccctcctctctagctttcggtcctactacttccttatcttgtgcttctgtcacaccccaaccccccccagctgcatcctgcttcttgaacacgtcctgtgtttttctcataccttaggtgacatggtaccattttcttggaacactccctcccccttgtctgcatgccaaagtcttaatcattcttcagggaccaggtcaaatgccgtgacatccatcaagtcttttctcatctccaaaccagatgtgatctctccctgtgataaatgtcagtaacactttatacctttcttgtaatacttgtaaggctctgccttgcatagtagtcatttgcatatttatcttgttacacttgaaagtaaggactgtattttattctttgtgaccagtaaaataccttgcaccacatagtagggcatctgtccaataaatgcttgtcatatacaataaagcaatggctggggcggcattatctacaggttaacccaataataggtcataatgtatctgcagatagtaggaccataaggatgtgtagataaaccctgaagtaaatgattcgcagagggtcacatggaagggaaacagggagtttgatacctagcactcactgaaaaaagcgtccggatactgctagagtgtgagactagaaggcctgaaatgtaaccatcatacaccaaagagagttgctcccaaacaccagccaactccaccaatagtatataaaggtgcgttgtaaacagtacagtgattcttaaagatattattaaacatcatactgttaatatataacaagattgactaatatgccaatgaaacccgtgactccaggtacctgtgaaatagccagcaagggttctgagccactgatccaagacaggacaaagttaccaactattcttcctaagaaattgtttctcatcatgcaaggggctgtttctgtcttggttttgtggaaggtctaattctgtggcttgaggacatctgcagtagggccagatgtcagagcaggtagtggtcatgcttcatgaagtttttaggagggcacagttacctggttgatgcaaatggaagtaactggaataaatgctattgttgcaggcccaagctcccagtccatcctggctggtcatagttgactaattcatggtggtcaaaaagtgattctcttgtctttgaattttctcttgtattttaggcaaaacagatttgttttttgatactttcataaagctgtctatccatattctgttgtcacttttcaaaatgatcagaaacctaaagaactaccatacttgcctaaaagaagacacttcctgatgcatagcttgaaacaggaattgacttcctaaaggaaagtatttggcacaccaagcctattgttcacagcgctgcaagagaggcatttcaacatacatgggctcttcctaaaaatataacttgctaaaataaaaaattcagggttcattaaggttaatcatctaataaagtaagagaatttcctctaggtgaaaagtttcagtttattttaggggtgtggtgttgttacaactggctaatctccgcaccataatttaatcaggctggatgagaaagagactagaaaggcgtggagccagagcacagtgtagcttctcttcttttcccaggcttatttttttcctctaacatgtaataaatttactcgtaacaacctggcttttattgtgtcattttctagctaactgggagttactgatgtcagttgtcttttagaataacttttccttaaacatttgaagatcgtaagaattggggaactcattcattcatttattcatggagcatttactgctcacctactgtgtgctataggaacatgaagacaagcaaagcactgccctggccctcaacctggtaggggagatgtgtgaatagggccaaaaccacttaaacaagacagtggctataaaggtgtctgtaccagcgagaaggtcagctgccttccttgaagttgagtggccaaaaccactttcaggattgcaggtgggactatgttttggaggcttgatggatttttcagttatttagttcattctttcaaggaatagttattgagagcctcctgggagctgggcagtgttctaggctctggggccactgcagtgagctccagtactaaatccctgccttcatggagcaaagcaggagatcagacagcaaggagagaaatcagtgcaataccagcagacttgaagtagggaaaggaacaaccatgactctgggcacaggggacagtgaggaggccagtgaggtgggagtgagggaaagggggctaagggtaaggccagagaaggaatgtggaagaaggtcctggagggacttgggggctttcttttcctagaacatgctcctaatagccagcccccagacatctgatggcctgttgagctattacaacattttaggttgatgtcttcattttcattcatgtttttccttttattgtccctgatgctgaaaaacaagaggttgagtttgtgagacaaaatgtcttcattgtgtgtgtgatggggataggcatagtctccccatcttgttctgtgctgtctgccgttaaggaggtggggagattacgatcactctcctttcctgtacagtaatctgctgatctctggaacatactaaggaggacatagagtgacaacatctataatccccttaatctctatattcatactgtctaatctccttgagttacactggtaacataagtctatctcttagagttacttttatcattaacagcacaaaaatgtattatttacagggccaaatgcaagctcttgaggcatataaagtggattaataaggttggctcagcgttaagctatgccagagccgagtccaaattttattccggtacagggatgactttctatgtggcctctctggctctggagctaatttggatgctgagtagccccgcaggtatttatatgtagcgtttggtatttttactgggtcctattcttctcccttggatcacctaaaatggttaagaattttctagtgggattaaggttgtgatctctggggaggggtgggacatctgctctcggttatttttgtgttagccgcttccccttaaatgtatgttcacaaatgagccacagccttatcagctggggttgagggaagactggtctaggtgctgctcctgaacttggtctctgagccatggcttcccatagacactcaggtaaaacttcatgctctttatcttatattgagcacagttttgttagggcagtgaatccgtcattgggctaaaagatggtttttgatgaaatgattttagtcttgtctgaatagtaaataaattatagcttgtctctgttttgcctttgcctttcatgctatttcaaagacaaaatattgttcaagtacaatgaacagtttgagtgatttattttaaaaagaagtatataaacatgttaccactatatttttacctttttcaggacatctcatgaaactataagagattgtgggaggaaaggtttttctggttaggaatttttggctttcttttttataagatacaattcttcatcttgacagtgctttacatccaaggtgtttggagaaggtaaatcgaatgtggagctgaaaggaggaacatttgtaactaagaaagtccataatgacctagcacatcttcccttttgctgacaatgttttaaatcttcccgaagtaacagctatgttccttttgatatgctaagtatgttattaattgtttttagcagaaaaaggggcacattttggactccttgggacatgagcattttcttctggttttgtaaccttacaattaaggaagccctttggccatcgacaagaaatctatgaactaggggctgaggggccaaaagcccagttatttgaagccaggagggtggctgtggccctgtggccctctgcctaagtaacggttccctttcttggggctggtaaagtcagacggttagatataaagaaggcacttcatcctgtctcccagctttcagattaagggatgtcattatctatgtttttttttttttttgaaaaatcattttttaaaactcattgcctgtcaatatttaaacaatggaaatactttaggaaatttctctttttggggttttaaatatgctgcaatggaatgccctaccttaatgaattaatatgtaatgtcttccctgttcccaagtgttcaaaagttgtctggtttttttttttttccaaccctcaggagctgtttcacaaacatggtaccaaatgcttgagattgtggttatcagccaagatacacattctctgggtgtaggcaaactagtcagctgtgctagttgtcctgatgaaccttaaatgcatgttacctggtagaataactctcattttgtttactaattaagtgacagaatagtgacagaaagtttaaaagtttaaatagtgacagaaagtttatagcatacccaaccttgggttttaaattgcaccaaattcttatgtcgttcttgtgtatgtaagtctggaggctctaataactgtggctaaatgggaccaattatttataccttttagatgatttttgaattcaggaaattgcattttgtattgcattaggttaatagattcatgaaagcagagaagaatcagtccatgagacagagaagtcctcatagaaaatcagtgttgccctgaaacgggctcagtatgggcaaaatagaagctaggataattggatccaaatccatttttagtgactatccatatactgagaggacatttcaaggacaaaaacaatgtatactcttgacattgaagactttctgtctgcaaaattatgtagattcaatttctttagcctttggcctttcaagtcgaaaaccaggtttggggtgtggagggggatcaggtcacttgccatattacacagccatcgattcccttcaccagctgctgctcagtgggccgcacaagcccgccagtcttttctcagggcagggatggaaaatgagagggtaggatgagaggaaagtaatccaactggattggcttcttaaaatacagaagatttgagtgagagtgaaactgaacattttgtgcttttgatgaccaccaaatgactacctactacttcaccacagctggagaaactaaaaacacatgctcttttgctgccgggtcagaaatgctttttttcccatatgaaagaggggctgtgttgcacgtaatctgtgcaacattatgaaaaatcttcatatacagacaaaatggtactagaattgaatctggactgcaggaagttcagtggcacataatttttcttttaataatctatatcgaaccctcctgacacccgatataatctaaaatggcattagttatacatcagtgacccaaaaaagatttgttttttttctaaatgcagcataccagtgaagttgctaattacattgaatcattctgtacacgttctattttgaagggaaaaaacactttctgatttttgtatgaaattgtatgaaagactacttttcagccgtgactcatgagctccgtctcattgcagctacttaggtatttattcccaaatgtctgacgacacctccaggtgcattagcatgtctattacacaagtgtcctattcattggctaaggctttgctccatctgttgaatgttctgaggaaagcattataccctttctttagaagccagtgtttatatgtggagtcactaatgtactggtaggttggatttagtgaagaacagatctgaaataacctgatttttttccatttgggttgttgttcattgtttacactgtacattacacccttcatggaaaacacatagaaaaatgctacctactcatgatattcacattctccttaaatattcatagtttgagcaactcaggcatgagggagaagatgaacaataggaagaaatacatgagaaaatacatgtaaaaacacaagcaagatttattaaatacaaatcgactgtaatgagaggtttatagtaaaaaagaaaaaagaaaaaaacaaatgttgtaatgttatattacttgtatgtgtacatgattaaattgaaagccaaaacttttaattaagatactgaggtttatttaggcacctctcagcatgttggatgtagttcaagaattttctgaaaaaggaagcttgtttattaagtgaaaatgatgtgtcttttgaagcaggcatagaaagtcaggctacccttttggaataaatgtctaaaattttatcacccagccacatttctaactgtattctaagcttgtaaaactttaatttagttaatttttaattaaattatttaataatgatgctttctgtcttagaaaatcaggggacatttatgtggacctaaggtgtaggttagacttcagcaccttacacgtcatataagatgatttttaaaatcaggaaatagtatgtcatattgcattaggttcataagtccatgaaagcagaggagaataggcccaagaaagaagtccttacagaaaggaaatcagtgtggtcctgaaatagggttggtatggacaaaatagaggctcagataattggatcagaagccactttcagtgactatccacataccaaagttttagaaacttagttgtggtaacatatctccatctgtcaatcaacaggcatatactgagtgattcctgtatacaaagccctggattaggtactggggccccctagtgtatgagcagaactttctgtcatagagaaaccccacttgttagcactagggaatgtatccaagtcactcggcaccaaagtatgttagcagcggggaatctgtgggtctgtagcaacctcatttcttgcctcctcaaggaagaacaaggcagagggagaagccaaggcaacttttagagcaggagtgaaagtttattaaaaacttttagagcaggaggccgggcacggtggctcatgcctgtaatgccagcactttgggaggctgaggcgggtggattacttgaggtcaggagttggagaccagcctggtcaacatgctgaaactctgtctctactaaaaatacaaaaattagccaggcttggtggtgcacgcatgtaatcccagctacttgggaggctgaggcaggagaattgcttgaacctgggaggcggaagttacagtgaacagagattgcaccattgcactgcagcctgggtgacaaagtgagactccgtctcaaaaaataaaataaagtttcagagcaggaatgaaagtaaagtacatttagaagatgaccaagcaggctacttgagagattcaaaaagtgcatggtttgacctttgacctgggcttttatatgttggcatgattcgggtgttatattacttctctcctgattcttcccttggggtgggctgtccgcatgcccagtggcctgccagcacttgggaagtgccgcatgcgtggtgtttactgaagttgtgtgcatgcttactttaagcgatttttcccttagcagtagagcattcccagaggtaggtcttataccagttaaacaccgcaattttgcctcttagtgcacatgcttgagcccaattacccacctcctgagatctcatggggacgtggctgagcatcagtttcaggtgtttctgtctattagggaccgtgtttccttggtgccagctgcaaccaattattattttagcgagagatagtttaacaaccatctgaccttcacctgatggccgcctgacattcctggttgggtggggggccctctcttgccctgctcatgtctaatacctactctggcatccctactatgtacagatgagggctacaccgagacattaaaattagtcaaagagctgcccgagggcaaacatgccctccacaaagacaagtggtaagggaagaagcatggtgatgatgtgtagcaattgtttccttcaatgatggctgacactcccattcccggataacagcaataggtcaaggcagacatatctagaagttctggaagattaaaggccttcacatttcatgtacttagaaatagctaaggggataaaaaattattccctaagaaataaatgcctaagtacatgtaattctgtaaggttgaagagagcccaaaagaagaggtaaaatgctggctgggcatggtggctcatgcctgcaatcccatcaagttgggaggccgaggtgggcagatcacttgaggtcaggagttcaagaccagcctgcccgacatggcgaaaccccgtctctactaaaaatacaaaaattagccaggcgtggtggcattcacctatagtcctagctactcaggaggctaaggtaggagaattgcttgaacccaggaggtggaggttgcagtgagccaggatagcaccactgcacttcagcctgggtgacagagcgagaccctgtctcaacaacaacaaagaggtaaaatgctatcttcatttttccctattctctcatttcaaacaaaagaaagtgcaagctgggatggacgcggtggctcatgcctgtaacccctgtaatctcaggtgcggtggctcacgcctgtaaaatgcactttgggaggccaaggcaggtggatcatgaggtcaggagatcgagaccatcctggccaacatggtgaaaccctgtctctactaaaaatacaaaaattagctgggtgtggtgtcacatgcctgtagttccagctactcgggaggctgaggcaggagaatcacttgaacccaggaggcagaggttacagtgatccaagattgcgccactgcactccagcctggtgacagagcgagactccgtctaaaataaaaaagaaagaaagaaagagcaagcttttctctcctcatgaagtcaaagcttgatagtagctcagactcagggagcccacactcaggatctttgcatgtgtgtctcagcattgtcatttataagctggctttttagagttgttttggtcttgtgcacatcagcacatcattcatattttatacaaaattgtgacgtgatcagtatctcctccaacttcatcctgagcacactgcgtgcatgagggtttgaaattgttttgtaacaaataatcataaatttagaagtacgtgacgtaagctaattcaggttgcccagagttccacttaatttgatttattgcaaaacaaatacgaaagttcatgaatttgacatagacattgttaacatactttaagtatttctagcctgtttacttattatgcaacaaatccaacattcctagaagtgcctattttatctagactaattgtttccacacacattaaaaggactcaagtgaattgtagaaatgtattctaaaagaatatgccctttgaaatgattctccatctggatacagactgcaggtttaagtatagagtggtggggaatctaaggtgtaaggtgaccctagagttttcaaactcagagtgaaaaaatcttgcctaaagctaggattcaaaaataccaagagatgaaactcttcttatgggtactattaacttggggttgattcatttaattttccttttgcttggtttaagaccatgtactataggaatgatacagtggccagtgacttcattgtctgacattttcaacaccctttgttacttctatcttcactggtgagctgtggattattttatcatctggatgcttagaactctgagcaagtcatgttctagaactatgagactaaacaatgaagaactttgcactggtaatatcaaagtactgaaagtgtgtggttttaaagtgtgaaaaacatggcagttaagatctctcaggtactttgaaccataatgcagttttccttctcttcaaaacctctacttctaaatggcattcattgtgttttctagtgttttttctttggtatgacactagttaacctgtatttcttaccataaagctaggactcaaatactaagaggtttgactcaccttaggtggaactttatatagtactttaacttagaaatatttggaatcaatttctgcttataaaggtatcaaaagcaagtgatactaaaacgagtaggttcaaagttgtatactaaatagagaccttggtaagagagaatgagggattttcaaatatggtccagaagatagtctctgaaaggctaaaccagcaatggttactagccatgcaggaagccagtgctgtctaatcttacaaattctgttttcctgccaaatggcatttaggagcaactgataatttatttcttgccacttgccgttactggagatttatttggtttctcaactcagcccttaacaagaaagcaagtctttgttgagggcacaatattatcagtatggcaaagctaagacgaggcttctgtgtgacactggaaagaccaacaagaatggattaaagagagtgattttccatatgctgtcactgggacaggtacttttctctgtagacacacaggctaaaagcagtttaaaagcttccttacctaaacagtacatagttcaaggagataggccctgtgtccattgcgtctctagtttttgtttctaacccattatataaagaaacatcccagtttgctttttagagaaaagttcaagttagaaccattctctggtcttgctaagtctcttaattgtgacacaactgtcctaagcaactgtccttgcacaagaatgtcactcatctgcttcatctgccagctccttagagatgaggggggtctgtgtgtcagcaggaggcagaaggccctgtggctcatccagtggcctgatttcctttgtttggaggcttggttctgagtgagagttcaacagcctttgcccaggcggcttctcaaacacagggtgtggtttccttagctcactctctgctgtttggttgctcatggcaacaagatccaaataacttggacatgtgtttgtataaaaaaaacctgggaatggaacccaaagtgagactttggggctttcagttagtggaagagctgcggtgagtaccaggcaactgctcatttattttctctcattctttctctctaaattacgctggaagtttgctagcacaataaccatgtttgtggatagttttagaaagtagtctcaattcttgtatttcctgcacaaatgaaataattgctatctatttacccgtgcaaatttctttttcgggggagaggaacaaattagcatatgtttaaagaagttgaaagctaatagaaactcatatttggtaccttttgggtggcaggattctataggaaatgccttggcaaagggagctgcagagtgccttagtaatgcttgggattgcaggcgtgttgtctagggccacagccggggaggggaccagggagggaagaggggttgttcatacggagggagtggaagggattcttggaataattttttccagactctattttaagattataatttttaagacagcaaatatcccaaatggtaatactggttacacttctatgagcatattgattctcacttgcttgactcaagggagggtttgattttggtcacaaagccacccgtgactatgacagataattcaaggttgccaaacttgcctgtgccaattgacaaagccatttatataagtcctctcttgctatattgctctggcctcaaaaggcagtaaactctcttggacaaaactctttaggatctattcagggatttaacacttttctgctaaattgcaagtaaatttaaacattttaaacaaattaacaaggattgcttaggtacctggtgtggtacagaatgagctgtcagtttctattctgatgaatagaattttatagataggaggaacgggaggcctccagaggatactaccctccctaaaaagagacggaggaagagctgaaagcgggcagagaggcttcttgatgacaacgtggtgggcttagagaagctgctgcctgcaggcggggcccctgctttcctgcacccctttgagcctctgccccacactcttcctttgtataaaacaactgcttcttgcctgcctgccccatcacacccctccactccatcgggtcactgctcaatggcacaatagcactgctcagccatacctcccagcatcctgtcccctatctggtgacttggccaacacaggctctgatccacttgccccgctccgcatcttttgtgaatcagcacagttgatatatctgagcaggggcttctaccatctccccagggaatcactagccatcggccatctggccccgcggggtgcttttgttcctggaatcatagtgaagtatctgttgtcttggtgcctggtagtcagctcggctgaaggggaagctgggtcttggtcctcagaccccatggactccaaggcagcattgtgcaggtgcctctgggagccactgctcagggtgctggggcatttcctgtggtcatttgtcctgtctgcttgcccccgcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggtaacgggcatccccatgtgccaatgggaagggctgggttttggagtgtcctttgcccacaaccatggcagcagcagctggctgttaggatttcccagcatcactgcagccaccttgaggcctcaaggaagcctcctccactccccaggccacagtggcccgagctgtttaatgtggggcttgactggatgggcgccagcgcccttgccagctcttttgattgcattctaaatatttcaagaattgtgagatttttatcctcacctcagcgtccctcctataagaatagtcactgtggggcagtcccaggtgtaagggactgtgtcatctcagtggtcagtcccagggaaatcagccttatgggagggctcctgccaccacccccagcacccctcatggtggcccaccctgtctgcttggtttccaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggtactgcctccttcccaccccgggttcccagggaggaggccctgagggcagacgtgatgtgggcttgcttatcatggtggggctaacgttgctctgagctgctttgagatcttagcatatatatgtacacatatacatacacgtatatatgcgtacacatatatgctcgcacacacgcacacactcggagactaaagaacactggcgagaacagcctgtggcaacagaatgaagtgaacagtatgtagcgctttctcatttgggcgtagtaagtgatgaaagcatgcttcttcctcagggtgtcattctgggccaggcagtccctgatttaatgtctaagtgcacgcagggtatagaggtgggggagtgggggattcaggcactggatcctaaaataataatgctggggtccccacccatgacagaaatcctgggttggcacaagcacaagtagaacacaggtaggttagttggaggtgtgaggccagtaactgcagggcctgcatcccctcacctctggagggcctggggaggggagctgagtggatgcagccccctgcagagcctgtcagtggggctatccaattgcttccctctgcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggtatgctttcaagggagttctgcattgaccgttgtttctagaagtgtttgacagtttgcagagcacttccacacacactatcccattccatcctcacgacagccctgtgacgtaggaattattattcccgttttacagatgaggagatcgtggattaggaagcagtgccacagccaagtcaggctgtcagtacgcatcctcagcctggtggtgcgggtggcccgtatggcatgctgagctgggcagccctggctctagaagcctgcctccaccacttaggggctgtgtaacctcacataggggctcaccttctccgagccttggtgtcttcatctgtaaagtggggataataatagcccctgcctcccatggctgttgtggagattaaatgagatattgtataccaaagcgcccagcacagtgcctggcacgcagtaggcattcaacaaaatggttgttgaatctgaatccggtgctacactccctggtctaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactggtaggctaaagagtccttgctaagtctgccaggctaggttttgcgcatggtaaccatctctcattttcctgtcgtcggtttcatccacaaaggcccccagagaatgcccttctccccctgctattgtggtcccaaaggccccccaagagtttggattcgtccccaggccaggttagcctttgcaatacagaacacttcctgactgttgactaacaatgctgagagttcacaagcctgagacctgccagccaacaccggcaggcactgccactttgcagggggattctggggggaggggtgggaggagggtagaaagaagggggtgggggagggtggggaaggggtaagggaggccgaagagtgataacccgggattgtaataccccatagctgaaggctagttcagagatgcctgttggcagggtttcttttttttttggtttgctgtttatttgtttttgcgatcagcaaagctaatcacttcattcctcatctcgcggccgcgatccacgtgccctgggccctttcccttgcctccaattttcccatcttcccggggagccttgaaatgtacatttgagaagacttttgccatcctcagggaaaaggactgtgtcaagagtgagccacccagtctctaaagctaggaagcccccagtgtgccacgggaaacgcttgcctctcaccctgtttcccagcgccaacctccggggcaggcatccgggtggagagaggacttgtccctcgtgggtggtggttctttatagaaaaaatcgaagcttagcagctcctcgaggcccggtaagtgcacaccccacgaacagcccaagtttgcctcctggtggccactttgatgtcatggccctgacctaaatcaaagaaactggttatgctgggaggtcggtgcgcgtcacagggcaatagcgtggtggcatgggaacgtggggtctttacatcagggaagcccttggccgggcttcagcatcttctcaggtccttgagagccacagcagggttgcggcggcatgggggacaatggcggcgtgggggactgtgcacgatggagtggaggagggggtctgggagccaggcagacctggctcttgcgtgcttgtcggtctgtgagtggggcaggtcgtcattttatctctctgaatcgtggtttcctcacctgtattcattcagctgtttctcttgttttcttttcttttctttttttttccccccagggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatg

SEQ ID NO: 35907 - DNA, 63829 bp, Homo sapiens; identical to SEQ ID NO: 35906

SEQ ID NO: 35908 - DNA, 20307 bp, Homo sapiens
tacatccggcgagtagctggcggtcccgggtgctgctggttagtgtgctctgagggagggtccgagccagccgctgttttgccggaggagcccctcaggccgtgagtctgagggtcgcgtcggggaggggagttggggctcgaggggctgggacggaaggcggggaggtcggagcggaggctggccctggcggggttgggtgggggggaagtgacacgcaggcggttctgtggggccgcggggctgattctgggcggggacgggacaacttggccagatctgctccgtcccctgctgtcctctttgcctggggtccacttgcattccgctcgggggtctcgcagctgctgggccggataacagtttcttgtctgtaccgtgcgctccggtttacgaaatggctccatgtcctctgtctcggaagagcctcacagccctcggtgaggcgggtgggagccctttatgattatccttgttttgtagactcggagactgaggctggccaaggctccgcagttagcgagtgtgagcgctcgaacctggtctacaggcccctagtccagggcttacccccaagtcagcgcttggttgtcttccgatggcccgggtcgaaccctgtattttctccttctcccttccccttttcccctgtctggtctctgcatggaaaaatttccttatgtgcatttgacatggattagcgttttcttcacgattctagccagtgggtcaggagcatctttgtcttgttgattccatcggcttcggttgcgacagggggcttagggagattcgccatggggctgacctttgacatttaccccgcagctaagcagagttagctaaaagccagccgcctactaccccaaatctgcctggaatggcgtcttaaagttgccctgattatgtataacaagtaatgcgtaaatttttaaattggctaatggtcagattggtgccctccttttctattaacatttgtttgaatcatttagccctggaattcgcaagttttcattttaggtacattaatagtgttttgttgatagtttagagacctaccttaaattttagattactcttaacttctcgtaaggtggtacaatggaccaagaatagaaaataaatagaatgctagttattaaaataccattcaaaagatgtgatgagttgtaaggaagagaacttcggaagatcatcctctgtgtagttggtgggttaaagaagttttagtttttttttttttccccagcaattttgtggtttgggtttgaattttatgtactgttaacaggaagagcttaggctttggtgttagagatgagggtttaagccctggcactattactttttcaactgagccgtcttaaaggactcagcaaaactaggagtatcctcatctttatcttgttaaatgaggccagtgatccttgcctggtagggttggtgtggggatgaaatgagatgtacaagtactgtgcagattgtaaaactactgatgagttggtacaaatcctaagatcttaaggagagaggagccaccaaggccattttcagctgctgaggaggctgaggtgggaggatctcttgagcctgggaggttgaggctgcagtgagccatgatggcaacactgcacttcagccttggagacagagtcttggtctgtcttaagaaaaggggggcgggggcattttcttaactttgggtagcagtgcaacccgactctttggatctagtaagggtttttattatttttagctcacctgaagagtttcttcagtcagcctccactctcatcactcctttacaacccaacacttctatatacatttgtactacactggttttcagtcaatactttacagacttgtaaaaaatgtttacatcactttagaaatttttctttctttcttttttttgagatggagtttttgctcttgttgtccagactggagtgcaatgtcatgacctcggctcactacaacctctgcctcccgggttcaagtgattctcctgcctcaacctcccgagtagctgggataacaggcgcccaccatgcctagctaatttttgtattttaagtagagatggggtttcaccatgttggccaggctgatctcgaactcctgacctcaggtcatccacttgcctcggcctcccaaagtgctgggattacaggcatgagccaagtattttcaactagatgaattctgcaaaggtgaaaaggagaaaatgccacactttaaatagtttttcatggcaattgaactactttaattttccattttattttcctttgacactcctgcttttaagccatctcctcccttggagcatacaaatcagcagcagccgggatttagctacttggatgctttaattcttccctccaaaatgatctgagtgggaatgaccttaatgaggggtgtgctctaaaggtgagctgtgcttctccaggcagtagattgagaaaagtataggaggatgtttggtttgagggagttgcagaggaagggcacattgttcttttacttatttacagtaaatgggaatttcagcacaggagctttattaagtatatttaagttgttggactccttaaagtgcggactcaatttccagagaaaactattagttaatgtgataaatgcagtctttctgctgaaatatatttgttattgaaaaggcaaaaaagaaatcacctcatttagtattttttcgtaagagcctagtatgtatccacccaaactgccaaactttatttggctgtctttggtaagggccgtgaaaaataaatattaattaggccctaaaatttacagattaggccatgggcctgataaaaacccagtaattggatgaaaaacataccagctctacttttcaatttactcttttttttttttttttgagatggagtcctgctctgtcacccaggctgaagtgcagtggagcgatctccgctcactgcaacctctgccttctaggttcaagcgtttctcctgcctcagccttctgcatagctgggattacaagcaagcgctgccgcgcccagctgttcattttattcttcatctggcattctttgaatgtaaggggatttttttgtgggtaatgcttttactggttactgttcatgaaaattttgaatgcagttggtcatatctagtataaagccctgtgttcagatgctcctgctgatggagaggagtaaaagtgtggaccttccatttttctgcaccgcatctgagatactaaagcaaaaattcagcatggccagacaatgctgagaaaccttaagacccaccagtgtgtctagatcctaccctcttaatttcattcagaggtcattttgcttattaccaatatatgtaaaccttttagtagcttttgatagctatgagaaacaatagaaaaagtagtgttaatatcagtaccagttaagttatttactggcttgggaacttactgctatatcctgaaaagtattctttttttgcttttttgtttcttgagacagggtcttgctctgccacccaggctggggtgcagtgacacaatcatagctcacggcagcctcaaattcctgggctcaagcaatcctcttgcctcagcctcccaagtagctggaactacaagcacgtgccaccatgcctgactaattttaattttttttttttttttttgtagagatgcaggtctctctatgttacccaggctggtcttgaactcctgaggtcagggaggaatcccccacctcagccttgcaaaatgctgggattacaggtgtgagccacgggggcccggcctgaataagtattcttattttaagaaaatctatttgtaaaatgagtttgggtgtgattattcatgtatgaaaagattctcttcttatcccttaatggttctctaaaatagtgatgtcatttctttttataaattgagacccgtgtctgcaaaaatgattaaatattgagataacattggtaaatggagcagggcaagtggtgctggccagtagaattttgggtgacttttgttttttagagttgtttacaggatagattaatatgtttttcattcaaatcaatgtgcttttcattcttattttctatttagtgcatctaagtggcattctgattcacattattgataagactgatttcctagagttgttcttcactggatgacagcagtcgtatgtctagggaatgtgaatgaaccgctgcctggaggagtaagtcacacagtaaaagaaagtgtaggcatacctcggatatactgtgagtttagttccagactactgaaataaaacaagtacagtaaagcaagtaacacgaatattttggtttcctagtgcacataaaagttacgtttacactatactgtagtctgttaagtgtacagtagcattacgtcttagaaaatacgtaccttatttaaaaaatactttatggctaaaaaatgctaacaagcatcggagccttctgcgagtcataacctctttgctggttggggatcttacctccatgttactccacgttgatagctgttgactgatcaggttgatgattgctaaaggttgggatggctgtggcagtttcttaaaataagacaacaaggaagtttgttgcatcagttaatgcttgttttcaagaaagatttctctgtagcatgcaatgctgtttgatagcattttacccaaagcagaatttatttcaaaattggaaccagtcctcttaaaccctgctgctgctcaagtaagtttatgtaaactcaagtaagtttttgtaattttctaaattgttggtgtcatttcaacagtattcatagcatcttcaccaggactagattccatctcaaaaaaaccactttttttgcttatccataagaagcatctctttatccattagtttgatcatgaaattacagcagttgtcacatcttcaggctctacttctaattctagttctcttgctgtttctaccacatctaaggttacttcttcctccaaagtctcgaacccctcaaagttttccacgagggttggaatcactgtcttcctaactcctgttaatattgatattttgacctcttcccgtgaatcataactgttcttactggtacctagaatggtgactcctttccaggaggttttcagtttactttgcccagatccagcagagaaatcagtctatggcattgatggctttgtgaaatatatttctttttttttttttttttttttgagacggagtctcgctctgtcgcccaggctggagtgcagtggcgggatctcggctcactgcaagctccgcctcccgggttcacgccattctcctgcctcagcctcccaagtagctgggaccacaggcgcccgccactacgcccggctaattttttgtatttttagtagagacggggtttcaccgttttagccgggatggtctcgatctcctgacctcgtgatccgcccgcctcggcctcccaaaggaaatatatttcttaaatgaaagactggcaaatcgaaaatactccttgatccatgggaagcagaatggatgttgttagtagacattaaaacaacattaacttctttctgcacctccatcaaagcccatgggtgaccaggtgcgttgtcaatgagcagtaatatcttcaaatctttttttctgagcaataggtcttcacagtgggcttaaaatacttagtaaaccatgctgtaaacagatgtgtggtaggcagagtagatttagtataattctttttttaattgtaatttttttaattggaaaacaaatacacaacttggaatggatttgaggcaaattgtgccataagcacattttctttaagtggctaaacaaagtttaaaaagcaagtaacagtaaaagaaaatgtttctggtacaggaccagcagtacagaaaaaacagtgtgtgaggtacctgggagtacctggataatacacccattctgcagtagtgcaacttttaagtacatattgttggctgtccgtagtccacacagagttacaactccatacttcaacaccatgctgacagttcctaaagaaaactactttaaaaaaaggcataacccggatgttcccttatttgaccaactccacctaagtttagatgtgcagaagggcttagatatatccggagtaagccacaggcaacatgttacttcatcagttttctaaaataaggtttcagggcaatgacagtaagggaagaacacatggaggaatgaagtcctgattaccatacatgcatatttttttttgacagtagggagaagccttttacagataagttacaaacaaaaggcaaataaacagttttgtgcaagaaatttaacacattctgtacaaggtcttcattatgctgtcatcatttgtacaaactcatagtttacttgaccatcaccatcaggatctgcttccctgatcatttaatcaacttcttcatctgttaacttcactccaaggtttgtcatcacatggtgaagttctacaccactaatatagccattgccatccttatcaaacacacagaatgtttctctaatttcttcttcactgtctgtgtctttcatttttcttgccatcattgtcagaaattcagggaagtcaattgtgccattaccatcagcatctacttcattaatcatgtcctgtaactctgcttctgtgggattctgcctgagacctcattacagttcctagtttctttgttgttatagttccatcaccatctttgtcaaatagtgaaaaaacttctttgaattctacaatctgctcctcagtcagttggtcagccatgctgcaagtgctactggtttccgagacgcaaccacacaaccactctgctcgctcacttgctccacttggactgatttagtgtcattcttcagggccctaggattttcaaaatggtaaatgagtatgggtcctaggattttcagaatggtaaatgagtatgggtcctaggattttcagaatggtaaatgaatattggcctcaacgtaaagtcaccttgcattagcccataacaagagagtcagcttgccccttgaagctttgaagccaagcaatgacatctcccctctagctatgaaagtcctagatggcttttcaaatagaaggctgttttgcctacattgaaaatgtgttgtttagtgtagccacccaccttcatcagttatcttgctgcagcttctacatcagcacttgcttttttacctcgtgtttttattttattattattttttatcagcaataaggctgtttcattttcttgacgttcatgggtttgctggagtagcacttttaattttcttcaagaacttttcctttgcatttgcaatttgggtaactgttgagtgcaagaggcctagcttctggcttatctcaggttttgatgtgtcttcgtcactaagcttaatcatttctaacttttgctttcaagggagagacctgttactttcacttggagaatagggaggcttggggtgggggcaggactgtggaggaagtcaagtttgctgtcttctatggttgtggtttgtggcacaacaaaacaattatactagtaataccaaagatcactgatcatagatcatgatgacagatataagaataatgaaaaagtttgaaatattgtgtgagaattaccaaaatgtaacatagagacatgaagggagcacatgctgttagaagatggtactgatacacttactcaactcagggctgcttccaaccttcaatttgtaaaaaaaccagaaaacctcaggatccacaaagtatcatcaaatgaggtatgcctttatatttttaactcctagttctctgagtatcatagatcaaaaactattaggaaacaagttatttttgcacatataaggattctagactctcctccagattgcaaaatctgtgtcaagaaagaatattagtttctctttactttgcttcctcccctccccttccatcccctcctccccttcccctcctcccctccccctcctcccctgccccgcctcccctcccctctcttttcttttcttttcctttcctttcctttccctttccctttccctttccctttccttttccctttccctttccctttcccttccctttcctttctcctgtcctgtcctgtcttttttatcagagtctccctctgttgcccaagtgagtgcagtggcaccgtcatgcctcactgcagcctcaaacccctgggttcaagtaattcttctgtctcaccctcctgagtagctgggactcttggtgtgtgtcattatgtccagctatttttttagttatttgtagagattgagtccagctttcttgcccaggccagttgtgaactcctgggctcaagtgatccgcctgccttggctttcccaaatgctgggattccaggtgtgagccaccatgcctggcctgctttcttattcccgaaaacaagagactataaatgtgcatcatggctagggaacaagagttaacctctccacaattgtactgtcattcagaaagctaatgtttgctactttcatattttatacaggtagtaagcattaataatgtctttcatctttgagtggatctacaatggcttcagcagtgtgctccagttcctaggtaaagccatttccttgaaatacaggtttcaaagtttgtgcctttccctcagtaatttaactacaaataggctttggtctgtagagagcaaatgtgttaacaatttttttctcttttaggactgtacaagaaatctggaaaacttgtattcttaggtttggataatgcaggcaaaaccactcttcttcacatgctcaaagatgacagattgggccaacatgttccaacactacatccgagtaggtttgaaaatatcaggtgaccttttgatctttaaaggtcagtgttaggcgtggaggatgaatccctagttggtggagttcttttattaactgaagtcccaaaagccaactcatacgagaaagttccctgtaagacacactcaggttatgtactttcagatctaaacctctggaactttgtcattatctgttgtcactggtcctgtaaagggacacctctcctatacctacttctaagaagtggaaaatagcttggaagaaaagaaacctttggcttttagaatagtttaagaacatttcacccttgtattccttttctttgttgggagtggggcgttgcctgggctggtctcaaaaatcctgggctcagattatcctcctgccctcagcctcctgagtagctggaactacaggcgggtaccaccacactcaacttcttgtatctttttctttacaagatgaaagcattgatattggcttatagtactagtagttgggggttgttgagttgacaagtttttttcttctttttaaacaatttttcagcatcagaagagctaacaattgctggaatgacctttacaacttttgatcttggtgggcacgagcaaggtaagtgatgactcagtggaaagcatgtttattgacttattttttttgtgcctcccagctccttttaaaagcagtgtgtcatttttaccttttaaattacttacattttagaattaggatcttattactttagtgaagttgttttattcatttatttttttaagtaatttcaaacttgtcaaaagttgcattaaataatacacagaagtccccttcaatattaccctattgagctgggataaagttagccataatgtataactattcatgaacttttaagtatttgcctgatatagccaaactcaactcaaatcttgactgaaaatttttacaaagcaggacagcatcttgccattttaatctttactacatttttacttattaatgtaatttaccttgtaactggaaaatatgttaaaagatatatgtattgcttcaacaagagtaattatttcatcattttaactaggcttgccctaagccagtatattttcttctataccttttgctcaaatttgttagtctcctcctccctacataatacatattaatgcttattttttatgaactgtttgtgagcatatcatgcccctttactctttaatactttagtgcctcttctttatataatacatattaatgcttgtttttaatgaagtgttggtgagcatatcatgcccctttactctttaatactttagtgccattttctaagaacaaagatatttccttgtatataatcataatagttatcaaatccaggaagttttatttttatccactctgtatttccttttttttttggtcagttgtcctgataatctcttttataccatttttttcatcttgaccaggtatacggtatcatatatctagttatgaagtcatttttgcatcctttattcaatggagtgaaagtatgtaggaaattaaatatttataagtaatttcagacttgtcaaaagttgcaaaagtaatacagtgactatgtgtgattactctgatacaagttgatattttgtatattctatccatttcagacagttggtggaacatttccttctacctttttgctttcctcagaagtgctttttgcctactcaggctatgtctttggtttccagattcctatcaggtgtttagagacatacagagtgtcatctttgtctgatgggcactcagttcacatttgacaagaccgtaggtataggagtaaaacatttaagatgtgagaataaatattctgggaaagtagggaaaaggaactattgagattctgtcagatttacttacttgttattacactgagtggagaagtcttgttttgaaacattaggttgagctaataccgtttttttcttttttttgagatggggtcttgctctgttgcccaggctggagtgcagtggcacaattttggcatactgcaacctctacttcctgggctcaagcaatcctcccacctgttttttgtagagactgggtttccgccatgttgcccaggctggtcttcaactcctgagctcaggtgatccacctgcctcagcctcccaaagtgctgggattatgggcgtgagccactgtgcccagcctaatacagtttttaaaaaatgtatagtaaaatataacattggtcatttctagttgttaagcctaataattttatagtcagtgatttcattaacatataattacattttaattaatttatttaatatttatgccctgaaaaatcatgtatattatgatcataatcacataaaataccagtaaagaaaagaggctggaagaaaatatcaaaatattgacaaggggtgtgttttgatagagggattagaaatgattttgtttcctttttttctgtaaggagcttgtatttttttcatttgggtaagaatgggtatatggtgtcctttctgctgcttccacaaaaggatttgtaactgcttacaaatttaaattcagagcaagataagactgaacctagaccatctggagaatgtagaaggaccagacgccagatggttttatatacctgaactgggaattgtagattgtttggtgtgataaatttaggtttcaggttttgttaaaagtaagaagggaaatgtattgatgtaattagttttgtttatttgactgaggaaaatctacttaacaaaaacacttttacataataacctagccaccattttataaaagttactaaagtactgtacatctggaggtttcctttttttttttttgtataacttaaaaattttaacttataaaaggagagcaagttcgatgtaacaaaatcagtatagaactacggaaagtaaaatggaaagttccttcaacctctttttcctagctccactctttaaaggtaaccattattaactgatgtagagatggttcgttattcattctattgcaagggctagaaattaatggcttagaaatgatagtacaattaaatcactgcttcccagcctttatcgtttcatgtcacaagcaaaaaaccaagtaatatttataaggcatgctgggttaaatatggtaggttgagataactggcctggggccttgaaccacttgtcaggcctagtctccctaagggctgagcagaggaatgtgtcaagacgcctacacacaagttggctagaaactaactgggactaaagttacatggacaagtaatttgtatcctgatgttttaactcagaggttgcaaactagacttggccccaggggcaaggcaagtcatttaagtgagtaaaattggctgactgtaagacagcagggaaattttgtcaagcaaaagtgttcagacatcatctgaaggggcagccactgcttagttcctgctgataattgtcacgtggataagtaggcatgggattgccagatgttgcagtttttcaaaaaaagcggaaactctgattttcaaatttacaaaaatcaggttcagctcatggaccatcagtttgcatcctctgttctgaattaatactggccagaacttggagaaatccatagagtctaatcttactgaaacccgaccaagatttgtccattttatagaccattaggttattcattttcacaatgtatattttttactcatgcaactacaaactttgttttttagcacgtcgcgtttggaaaaattatctcccagcaattaatgggattgtctttctggtggactgtgcagatcattctcgcctcgtggaatccaaagttgagcttaatgtatgttttgtcctttaatgtgtattttaatgtatattttgttcttttttggcctctatttttttttaaggaatatagctcagtagtgccaataattagtcattccagttaacatttggcaaaaagacctagttgcaggaggaaaatgttttaaatctaagacattgcttttcaatgtcctgaggaaactcagctcaaacttaaataaattaactgttgtttctatcatacagtgattatatggccaagtttgctcaggatactcctcatttatgcctgttgtcccagcataattaatagtattctgtttcacgtgtcatgaacagtaattctgttttttttttttttttttttttttttttgacggagtcttgctctgttgcccaggttggagtgcagtggcgcaatcttggcttactgcaacctccacctcctgggttcgagggattcttctgcttcagcctcccgagtagctgggactacaggcacgtgccaccacgcccggctagttttttgtatttttagtagcgacggagtttcaccatgttagtcaggttggtcttgatctcctgacctcatgatccacccgccttggcctcccaaagtgctgggattacaggcatgagccaccgcgcctggcccatgaacagtaattctttataagtagtgttggcatagtgaaagcctaaaagcgatattagagttctttacatttttgaatctgcattctcagcttgtgcctacccaccctcccactgaatgacttgccagaccttcatggtctgttctcagtcttcagttttggttgcatacatcctttgatactattaaggactcacttcaagttttctcctttgtcaacattgcattttctcatggcttgatggtttctatactattggctttgttatccctactcctttaccctatatctcttctttctctttgatttataactccttgcattcttgtttctggcaacttgaacctgtcttgaatttatttctaagtatgtttctcacatctatagctccagcctcatgtagaattgcctgccacgcagtctttaccttgctttttttttttttttttaaacagaatcttcctctgtggcccaggctggagtccaatggtgcaatcacggctcactgtaacctccagacttctgggctcaagcgatattcctgcctcagcctcccaagtagctaggactacaggcatacaccaccacacccagctaattttttttaaaaaagtgtttttgtagagacagggtctcattatgttgcccaggcttgtctcagtctcctggcttcaggtgatcctctgcctcggcctcatgaggtgctgggattacaggcatgagccaccatgcatggtctccattctctttgtttaaactcctcttttcactcttgattttggagctacctctctggctgatacttctgtctctttgagaagcactagttcttctggttagtccttaaatgttggtgttctccagagtactttctcctaggctggtcccatctactcccttcatttggcacctacatgtcagtgactctcaaatgcatttctctcctctagacctctcctgagctctaatctcatacctaatcctgcctactctcgacaactcctactactgattctgttttcctagaatggaactatttgtctttcccacccaccacctacctggacatgcagtccacaaatctgtgaattaatataaatcctaccatgaccctgatatgcaccataatgctagaaggaactttctcagacttaattgccctacttaatatcctttgatagttctctatcattttcaggataaaatctataaatcttttgcatagcacataggatcattcatgatcctccctctgtttctttttactgcctaccttgaactatattccaaacaaacaacttagccatccttgaatatgcacaagtagctactgcctggctttttcacctgtacctctcctcaacccctcgctttgtcggcaaattttaaaatgttctataagagacctcagagttcagatatgactgcttctggtaagcctcccttgacctctgagactgtgttagactcccaccttaccaatgtctgttgtctttattgatttttttatagttctctctcatcagactatgaactaacatgatagggactgtgtcttatttctttgcaaaacccctgcacctagcaaagcattagacacattaggtactttgttgttgcttaatgaatgaaggacattcttattctaattttgtgtaacatttcctggaattccagatggtcaaagtacattcctctttatctctttaactctgctttccccgctagctttcctattggtgacaactagattcccaggcttgaaatcagtggcagttttgactcatttgtcttttttaaattttttttttaatcatttagacattggtctcttcaattctttcttcaaaatgcctcctgcagtattcattgaatgctctaccttaagctagatcatgatctcttacatgaacaccacagatagatactatttgtgaattcattatactgaaaaataagattttattcactaacttctggatttgtggtcttttaggatatattgcagctcacttctcacactggcccctaatgtgagtcatctcttctcatccatttactttgtcgctgcatgtctatctaaatgcttgaatccagccatgcagtactgtgtggcttcctgaattattgtcctaatgcaaagccgttgtttatgttcttacttctcctttacacctatccaaaccctgcccttcctttagagccctgtttaggttccagatcttttctaagactttgctcaagcccaaaattgccattttatttccctgaacttgtcttaatgttaatattcagttcccattcattgtgacacttatccactatattgtgttcttacttggctttgttaacataaatgtggctgggcgtggtggctcatgcctgtaattccagcattttgggatgctgaggttggcagattacttgaggggcaggagtttgagaccagcctggccaacatggtaaaactccatctctactaaaaaaatacaaaaattagccaggcgtggtagcacatgcctgtagtcccagctactcaggaggctgaggtgggagaatcgcttgaacctggaagtcacaggttgcagtgagctgagattaagaaaaaagaaaaaaaacataatgtgaacatagagtgaggatttttttgaggacaggaatgtgcttccttttgtatcctcagtgcctgagatagttacccttcctactttattcctctcaatgcctgagagagttcttcgcacacaatgggacttggtgaatacttggggaattcctgtagtcatctttgaggctctgtagccagagcattcattcttataggactttgctgagggacatcctgaggatagtttgtggctgagcagattagctcaaaagttaatattggggcagttctgctgccttgtaaataaatagaataaagttgcaactgtttcgaggcacttaggagatttttacttaatgtcatgggtgttatgtaatgtcaaggtgaatctttaatcactcaggtataaagttgatcagattttcactttacattaatgccttaaaagattagtggaagtcagaattttcattatctggtgggcttttgtagattcctcacttaattcttttttttctttttttcttttttttcaatctttaggctttaatgactgatgaaacaatatccaatgtgccaatccttatcttgggtaacaaaattgacagaacagatgcaatcagtgaagaaaaactccgtgagatatttgggctttatggacagaccacaggaaaggtaagagaaaaatatttgggttacatataaaggacattaacagtttttaaaacatgatgtttcgctatctagattacccttttcttttaaaggcttaaacaggcttaggattagttttactgtgagtattttgtaagctcactagaggcaggagtgtgttctttttaacgttttaaatgggattcattcatcaggtatttgaggaagaaggaaatggtagaaaaggcagatttactcttctaagagtttatgattatctttcaaatttgattctgagaaattgcttttgaaatagccctttttagccagaaaataattttttttttggactggagtttgcaggttatgaagaaaaataatcatttcaatcactttccaagcattgaaatcaaagcacttgattatcctcattgcttcttgctgagagaggtaggactgttggccgcattttgcagaggaagaaacagagagtgatttgttcaggtctacacagcaagtcagtgataaaaccagaaaaagaacttgagtcttccaaatcaatagtttttactgtcttcaattggaaggaggactcttgtagaaaagcaggcttgagagagagaaaatctagatcagataaagttaagcaggaatcttactgttctttttagcttggggttttggcatatttagtttttaaatatcttccttttctgtgataactttctgacttttttacatggttccttagtctcacctcttcttgattatcggtttctttatagaaatacttcctttctttcatttaatttctcctcttttgcatcagtattaaatacacatgaattcttcatttcttcagtgccacctgttatgagtgtttatttctgcatgcttttgttaatgagaatgtccttatttttaaacagtcccagacctcttttctgcatcagagggcatgctggttccataagtcccagtggcttttttcttggtttgctgccataactttacagataaatattgggtgttcaaagcaaatgctcttcagagagagaaaggctgggaatagaactgtgctgcttattctatcctgaaaacacgaagcctggggaagtcatctatatggccttgaccacatttctgtaattaatacctacttaggtttgcttttaaggaatggataaaatgattgtaatgatcgtcctttcaatcttttccaccacagagatgctaacaggcctttcttggttttgcctcctttaggggaatgtgaccctgaaggagctgaatgctcgccccatggaagtgttcatgtgcagtgtgctcaagaggcaaggttacggcgagggtttccgctggctctcccagtatattgactgatgtttggacggtgaaaataaaagagttttacttctctggactgatcctattcacagcttcctcatgaacttttctaatagaacaaggaaagctctccaaccatgtctggcgttgagaagccaagagtctctgtcaactctctcattgcccagtggtgacatgtgctcttctccacactgttgggaggtaatgctgccccacgtgctggtgcaggtcagtatcctgggacttggaagctggcaggatttgccgggtaaagctgtatgccatcatggggcacctgaaaagaaaaacacgtctcaccactgtggttgattcaaaagaaagtgattctattttttaaagaaagcgttgttaatgtaattggtatccctcctaactttttgagttcacaatttacttggtccagagttttctattcttttttttttttaaactaatgaatgacatttagatacttcataaaattatgaacagatatggaggccagagctcatttgggtaaacttactcctgctgagttagcaggttggtgagagaagctcccctgagctcacctgtctctctgactgccttggagtaggtggcataaccttgtgcacagagaactagaaaaggggcagaaccccggccttgcagttgtggcaggtttccactgtggtaagctaggttcattcctcatcaaggaatgtgtagcagattgttcactgtggaggagttaattatagaatgggttattgttgttattcttactcatgaagttacagattttagccagtctttgcttttatacttttgtgaaatttaatttctctctatagcaccttcctttttcgttttcagttatcaaaagtgactttgacctcataaaagagttgagaacatctctcgtgtcacatactgcaggtgcatcagttacttttgcacagattctagggggacatttttctgaataggaagacaggacaaagttaacagcttaagggctcttaattctgtgagttgaggacttaaaagtattgtagcatttgtttggatccatgaaaaatgtattcagtgggctttaaaatttccatttgcagaatttggtctctcaggctgtttgggagctcttttttttacattttttctcctttgacacctattttattggtgtttaaagtaaaggttaacatctgtagcttttccaggtttttttttttttttttttttttttggtatgaaattgtctttctccattgcagaaataagctagggaaacactaacccaaaaactttctgtagagctgttcctttggaggcagcatcacttattggcagtaaagactcagtataaaagcaccggcatccctacttgggtgatggggattaattttatagcattccattttcctagtgccacatgtgaaattggattttgatgatcttaatctatattctacccttataataaaagatcaaaagatatatctcctatgaacagattggagataggagatgaaaagttgggaggatgtctttattctaatgtgagggtagggaaaatgtggataacattactggggtgagggaggcattgttctttagttggagttctcattcttattctccagtactgacttgtggggaaagcatactttttcactgccaggtactgaatgcagaggctcagtgaagtatatatgtgggaagtgcatgcatttcgtttattagcaaacatagctggattaagacaaagttgttggtttggaaaggggttaaagccttaagtgaacaaatctagctaacagtgaatgaactaggtaatataacttgcatatttttaatttcctttggttaaaggtcccccatacttctctgttcggagacatgagaagtatgattacttcagtgttagttttcttaattttttttttcccctatttgtcccttgtcactttgttgcaagctagaaatctgtgggttatacatagggcagctctttgtgaaagtggtttattccactggagaaaggggattgaaaatcagttagaaccaatgtatttcttgccccacggaacactattcctataagatagctgaaagaagctgctgtgaggagctcagctccaaacacaggatcagcaccttgtataggaattcccatgaattatgacttctcattctgttttatcagagtgcatatatgtcctacttcaggaaaagtaaaacagtcatttacgaaagaaagtcaatctgtatcctaagcattttaataaaaagttaaaac

SEQ ID NO: 35909 - DNA, 82067 bp, Homo sapiens
ttcagtctgttgaaggataccccgttgtgtatttctacctgtatgtaccagagacacctcaaattcaaaatgtccagaaatgaacacagtatcttcttcccttgagtaactcgccttctgtatataattggggtgaatgttccagcaatgccaacgggctagcatctactcaggcaggtacgccagacatctgaatcttaatacctcgtcgtcccccctcaatctgtcactatgtcctaattttatttcctacctttgcatcccttcctcataattatcagcaccactgccttaatttagatcctatcattccttgtctggattatttcaagtctttcgcccctctcaagtctgacctcgtcatagactgtttgtggatgattattttccctgcaacatctccacctcccaatagtctccatcacttattagccatgtgaattatggcaaattgcttaacctacctatgcctcactttccttattgtaaagtggaaataagagtacctatctcatagggttgtgtgattaatcatgcgatgcaattagaacagtgcctaggatatgaaagtgccccaaaatgttacgttattattattattactactattgccttctcatgaacatgctatgtgtatgttcaagctgttatctctactggaaaatccttctccgtttccaatactctttccaaaaccccctcctgggttttactgcacctaccattgtgtactgacgtgattgaatgattggcttatgggactgatcctttctaccagacttaacttcttcagggcaggaactctgatacatagtaaatggtcaataaaagttggctcaactgaaaccctaaggataaactccatccacagcggaaggcgcggccccgcccgattcgggggcggggcggggagccgcgcgcggagggtgggtcgatgggggtggggtgggactctttttcctcgccgtggcggcggaggcgcacggcgtgggcttgcggcgagacgtcgtcgtcggaggctgaaaaagcccaaggtgctgccgttgcccgtacaactcggacttgctgttgctcgagccgcgtctgcacgggtctcggaccgagcggagctcgcagcctcggtcccggagcccaccttcgcctcgcccttgcccagcctgcggtgatggaggcggccaccacactgcacccaggcccgcgcccggcgctgcccctcgggggcccgggcccgctgggcgagttcctgcctccacccgagtgcccggtcttcgaacccagctgggaagagttcgcggaccccttcgctttcatccacaagatccggcccatagccgagcagactggcatctgtaaggtgcggccgccgccggtgagtcacgccagcaccccggatccagctcgtggctgggggagggagcggggacgcgcgggtccggggaggcccgaggcgcggggggcggggagccggtcgccccgccggcctcgtcaagtttggggctgcctagaaggtcggagttgaggccgggggaggaagacgggggcttctccagggtgggagatgaggagcgtgggagaaccgggggcttcggcggtgccatgggagggccgggtcgccgcggggctcgggcggccgggtgcggaggttcgggttcggttccggatggagtgatggcaggagccgggggtggtcgcgggggagtttcctcacggagcctggcggaggcgcgggctggagggaggactgtgggcccggcgaggctcggcaggctggtcctcgcctccgctcccggggtgcgggggtgtgtgatggggtggggtgggggtgggggacttgcgagttgtcgtgcgaggaggaaagttttcaatatggcggcgggagcccctggtcctttgtgtggtggcggcgtcggcccggagcggccctcacctgggcgccccaccctccagaccagggcacccctccaccgcctggtccccgggcctccaggtgtcccccgggccggggtcaagaagggggcggccagcgctggctgggggcggggaggagccgcgggtccagccccggagcggatgtttgtggggggcgttagtgtctgggggacacttttggggcggcgggggcaggacgggcggcggtgggccccgatgcccgcccgcgctcccgaacgcgcacactcccggcttcttctggctcagccgctcggctccccggggaggcctgggctgtgctggtggggatggggtccgggcgaggccgtgtttgtaggggaacgtcagacggagagacctccgaagatttcgtgctcgtttcccccggccctcaggctccgggcactgaaaggcagtcacccaccgcagcccttccagccctgtctacagcgcctcgggcctgggggcagtgagtgaggggtgggtgttgctgaaaccatccgtaacggctccaacgttcgctgaggagagcccggccaactccttcctccgtggccggaactgggtgcgctcctacacccctgttttttttgcccacctttcgggagggtctgagtccgagttggcctaagcggcggttggacgggctgggaccgttgggaagcgggtttaactgcctttcctgctgtttaagaatcttctccccactctcttcccccacccccacttctaagtagaggaagaccccttcccacccctttctcccttaagcttgctttttgtaatgacattttgagttgtagggattctgtttgtaatcgttatgttttggaaagctgttttcagggagatccctgaaaataaggcttcttaacccttccctgccccaaattaaaacacggacacctactttagtttttcttaagcaagtttgaaaatggagatgaaatacatgcttcagaaaataactggccagcgaatatgagggaaatgtttgaaaatagatccatttcttacagcgaagtgggcaaggttgattcttgctgcttaagggaagtacgtttctcttagtgcaaagaggcctgcagaagttataacagggctggttagagccaaggttttaattcttgaataataggtcatgtttcacactgtagtaatgtagcttcatgtcacatgctaggaagggtgaatatgaatattgcacatttgcataatgggattttattcagaaattgggtaacttgactaagttcttagtaaccaaaacgtggggagtcaggttcctgggaggtgtcctccatgttggtattgtggtataccagggctggggtaaatcctttatcttgttttcttgttctttgccttttagagggccctttttctgaaaagatagtgttgctctggttaggcttggctacccatttcctcatcttggctagaatattaatggtaatctttgcaaaatgtgtgatcgaattgcctttttctcactctgaatgtcagacagacatgatggccaccattttgtattgagagtgctacatagtacagcctgaggaaaggggttaaagaggcaccaataatctacaaatacaaccagtactctgtttggagacctcctttgtgtggaggggacttgcttcctcctttgtttaacaaactcctttgccaaatggaaagagtttgagagtatttgttgttgatataaccacaaaaagggaaatctttccagaagttgtagctcttgaagaggggtcttgttggaacaaaggcttcttaagagatgtaaacagtctttgttttagaaactgttttgtttttgggaaagctaactgtgaacaagtggtttcatatagttgatatatagcaacaaaaaaacccttcaagaagtgtgaaatattttccatggtgatatatataatgtctgtatttctggatgatttttgttcaccgagtttttggaacacaaatggttatattagaaggggaattggaactattggtattttacttgttagaaggtaaggagaagtataaaacatttctgtctccttttgttcttacctttgtatctttaccaatggtacttaatatagtttcagtttatagctgctttctcagtgagactcccaaactgcttggcttctgaaaacttagagtacttacattattttgtatatggcagcttaggggttctcagaaatttgaaaatatagtaagataaatgtgagaaaacgtgattaagtcaagaagactatacttcaaatctgagtttgaagtttaatacaaacctttgtttcaaattatatcaactatgtaggataaccaggcttgttttctggaccaaaaccttcttaaatttacaattcatctggcttctggttttgtcacctttaaaatgcaaatttttaatttcctccatgatactgtacttagatgtctgtttaaggacaaatgatatttttccatatcactttgtggtatttggagatgagtaattttaagggtgtaactattaggcagaaaaatagttggctgctcagtaaatacttttttgtctcccaaattttgataggaatatatttatggctttagtaacttattttcttgctttcaaatgtctcacatttggccatagatagattccacaaatttctttttttttttttttttgagacggaattttgctcttgttgcccaggcctggagtgcagtggctcatcacaacctctgcctcccgacctcaggtgatccatgcgcctcggcctcccaaagtgctgggattacaggcgtgagccaccgtgccgggcctagattccacagatttcttctttgtgtccggagaaggtttaaatcaaaccccagaggccacaagagacaaaaatttttcagctttaacttcttgtggttactagtttgattccttcatctttatagccaagtgtaaaactgcccttaaatgttttaatacagtcaccatttttgagtgagcctgttggttccactcctagagaagagggaggaacttatacacttctttgtatggtagaagtgttaatgatatggagctcatttactccctttccagcgtatcattctccctaatttggggtttgatcgacttaggcctaaccctctctctgttttccctatttctttggtgtcatgaaatctttccctacttgtatctttggccactttaagcctttaacgtttagagaagaggcttatcagtagaaacatccttgagcaaaggaagaacttataactacttaaaaaaaaaacccttttattgaaatataccatacaattcacgaatttatgatgtgtaattcagtggtttttgatattttcagagttgtacaaccatcaccacaatcaattgtagaacattttcatctccctcaaaagaaaccctgaactcacttgtaactactttttttttcctttttttaaattatactttaagttctagggtacatgtgtacaacgtgcaggtttgttacatatgtacacatgtgccatgttggtgtgctgcacccattaactcatcatttacattaggtatatctcctaatgctttccctcccccctcccccgacccctaactaccttttaagacaaatttaggactataatgcccaggagaaaaacctggtaggaggttggattaagtcctacagttctaggccacaaatgtctaccttttttttttgagatggagttttgctgttgttgcccaggctggagtgccatggcgcaacgtcatgttgctcactgcaacatccgcctcccgggttcaagcgattctcctgcctcagcctcctgagtagctgggtgggcatgcaccgccacgcccggctaactttgtatttttagtagagacgaggtttcaccatgttggttaggctggtcttgaactcctgacctcaggtgatccacccacctcggcctcccaaagtgctgggattacagacgtgagccaccgcacctaggccacaaatgtctaccttaaagctaaaacaaacttcatttgttgtagttattgaatgggtgtttagctaaatttgactttgccagtggtaaattgggcacattagtagccacaaacatatctacccagttgtaattcttagtgaactaataaacaaaacgtgtagactttaagaatgtaatgtgaatgatattgcaaatatgagtcagctaaagatttgagtccccacccccactggaaaaatttccttcccttcctatggttatagggtatggttttaaacatgcaatctaaacttttaaaagagcgaaatgagtagagaattacctttgaaaaacattaataaacattctctattaaaagccagggcctgaaatttccttttttttttaatctcactctgtcatccaggctggcatgcagtgttgcaatcaaggctccctgcagcttccacttcttgggctcaagtgctcctccctcctcagcctctaataaattgtagggatgcggtttctcagtatgttgcccaggctggtcttgaactcctggcttcaagcagttctcccgctttggcctcccaaagtgctgggattacaggcatgggccagtgcacctggcctgaattattttgttgagacactgataagaaaaattaagagaaaattattaaaccttaattttattctttctctgtttctagggtaattttctttatgacctgttggcctagacttagagtattagagtatttcaggttgatagattagtgaaaaatgtgtttactggtttacatttataagtgggtagaaatctgccagtgggggaattttctcttgggtaaaaaaatacagggctgggcatagtggctcgtgcctgtaatcccagcacttttgggaggcctaagtgggcggatcgcttgaggtcaggagttcaagaccagcctggccaacatagcgaaaccctgtctctactaaaaatataaaaattagctgggcatggtggcaggcgcctgcaatcccagctactcgggaggctgaggcaggagaattgcttgaacccaggaggcagaggttgcagtgagccgagatcactccattgcactctagcctgggcaacaggctcaaaaaagaaaacaaacacaacaacaacaacaacaaacaacaacaacaaaaaaacagtgtaaactatttgattaaaaaaaatgaaccctgtttaaatgctgtaatgggacctttttgtagacttttgtaacctttcattgttgccttaattggaccccattaaggttggctgtagaaaaggataagggaaagcccgtgcccctaaaatgaaagtgctaattaggtttctggtgttcagggttttttgaagcctatgcgtgtacttctttccaaatgccatctataggtttgaaaaactactaacctaggagtaccttgctttcatccttggacagtcctctcagtgttgagattgttgtgcaatttttttttctctaagagaatttggtattttctaatatacctgttatagtacagatcattggcagcctcaaaaaaaaaaaaagatggaatgaaggttgggaactggagggctacacattctcaaatttaagtttgggtctcttgaaggggactcaccagagggcgtaccgacaagtctctttggggtgagtgggtgggtgagttgataccttgggaaagccatattcttaggctgctgccattgacttttgattatttaaagtttgagatactaataactggatttataaaatccagattgtgagaaacttgttttagacataagaatggtatgcaattgagaagtatttcttaagtatttattaactgctgtgtccttgcatgggattaaagaggaaaaattaatatgaaaattaaatgaaaattgtaaataaaaattaaatgaaaaattaaattgtacacttccacaaattcattcagaaatgtttctttttctgtcattattagatgaattctttgaatttgctttttacaaccaagtttatgaaccagattaatgaagaaaagatgtctctaggacagtgaggcatttcagttccataattgtaggatgtttggaacaaagatgcagaatttgactggaatgcattcttttaagtcctctaccccccaccatgatttaagacactcagtcctttaactgtagaccatccttcttaaagcaccatcagcatatatctttacacatggccttagagtcatcccatatgtgctgctgctgctttttttttttaagcatttaagctttctttcggatataaaaactaatcattttgttctgccagacccgtcacttcagggagtaaattaaaaaattttattacaaaaaatgtgaagcatacacaaaagtgtaaagaatagttactttagctattttcctggatagaagagcagaaagtggagtagcagcattggagttgagacaaaactagggatcttcatttgtaaagaacagcttagcttagcttttgtcctattcaggttataagtgacatttgggcaattatgaggtgagctttctagccttcagtcagtgatggtcattttgcccaattaggttggggatagtatttctcagttttagtcaatggctttgttgctttgttacacatttgttgggacatgtcaagtaacttgaccagctgcaggtctgttggcacatggaggtgttggagtcggttggtgggtggaggttagtctctgctaacatcacttcatttctttatctgttcatttttgtattggccagactttatctgaactttcttttcttaggaaggggccttctggtcagagtgggtatttagcctgacaaaacagagctgacatcagtagtaaccaagaaacagaatgatgttctagccaggcatggtggctctcacctgtaattccagcactttgggaggctccaggcaggaggatcgcttgaggtcaggcgtttgagatcagcctgggaaacatagtgagaccctatctctacaaaagacaaaaaattagctgggaatggtgacgtgcacctgtagtcccagctgctcgggaggccaaggtgggaggatggcttgagctcagaagttccaggttgcggtgagccctgatcacgccactgcactccagcctgggcaacagagcaagacgtttcaaaaacaaacaaaacaaaatggctgggtgcggtggctcacacctgtaatctcagcactttgggaggccgaggcaggtggatcatgaggtcaagagattgagaccatcctggccaacatggtgaaaccctgtctctaccaaaagtacaaaattagctgggcgtggtggtacgcacctgtagtcccaagctactcgggaggctgaggcatgagaatcacttgaacctgggaggtggagattgcagtgagccgatatcgcaccactgcactccagcctggtgacagagcaagactccgtctcaaaaaacaaaaacaaaacaaaagtccctttctggaaaagaagttttagggaaatgagaatttgaagagtctgatgaattacttgttagattgttaggttcaatttaaaaattaggtcattggaaaatattttctattaatgtcccttaaaatctaaagacttctccctgcttccttgaaataataacttcatttctgagataggagatgccaccaggcaggtggtcacataatgaccttttagaacttgttgatttcatttcacatggtaatctcttgtaaaatgctgtgaaatttaactattattttgcagggataaaaaagaggtttatcaaggggactgtgtgtatgtatatttttatttatcacgtttttttcttttttaaaaattactttttttttttttgagatggagtttcacgcttgtcacccaggctggagtgcatgcagtggcgtgatctcggctcaccgcaacttccgcctcccaggttcaagtaattctcctgcctcagccttcctagtagctgggattacaggcacctgccaccacacccggctaattttgtatttttagtagagatggggtttctccatcttggtcaggctggtctcgaactcccgacctcaggtgacccgcccacctcggcctcccaaagtgctgggattacaggcgcgagccaccgcgcccgggttaaaattacttttcaaaagccagttcctctattatgtaaaagaggacaggaggggtattttctagattttaaaaaataggtgggtagagtcttcaatctagttacatcatgaccttggacaaagtcatttttctgcaacgtatgcttgtcatctgctctaaggggatctgacactgacctagggctgctgtccagactaattaattgatggattgcaaggagcttaaatcccaaagctttatttgctcattgctaagaagagtctggggacagatttagtgagacaagggttagtgccaagtacacatccctcattttcccatatagtgaagggatttccccttgtcccccggggacagagtcttgctctgttgcccaggctggagtgcagtggtgcaatcatagttcattgcagccttgacctcatgagctcaagccgtcctctcacctcggcctcctgaatagctgggaccacaggtatacatgccaccacacccagaattattatttttttttagggacagggtcttgctgtgttgccgaggctggttcgaactcctggccttaagccatcctcccacctcagcttcccaaagtgctgggactacaggcatgagccactgcacctggctgtgaagggattgttttctttttttcttgttttgttgcccaaactgtaatgcagtggcacaatcacagctccttggagcctcgaactcctgggctcaaatgatcccacctcagccccccatttagttgagattacaggcacacaccaccatgcctggctaatttttcaaatttttttgtagagatggtgtctcactatgttagccaggctggccatgaagggatgttttaaaagtgaaacttgaaaaggcaaaccgcaccccgcaaccccaaaaaaaggcaaaaacccatcatcaaaaccagagtatagccagcatagtggctcacacctgtaatcccagcacttggggaggtgcaggtgggaggattgcttgagcacaggaatttgaaaccagcctgggcaacatagcagaccctatctgtacaaaaaaaaaaaaaaaagacaaaaaccaatcgaacaaaaaaaaccctagaatatatagactataatccttcaattggtttagacaaagcttttctgtccctgaatctttattttttttgagacagggtctcactatgttgccaggctggagtgcagcatgatgtgatcttggctcactgcaaactccgccttctgggctcaagtcatccttccacctcagcctccctagtagctgggactgggactacaggtgcataccatcatgcccagctagtttttgtatttattttaatagagacggggttcaccatgctgcctaggctggtcttgaactcctgagctcaagcagtccacctgcctaggcctcccagagtgctgggattacaggcacaagccactatgcccggcctgtccctaaacagattagtgagattaacatgttttaaaaggtagagctgttaaaaattatttcagaaaatttgcaggtgcatttgtgtgtcttatgtagtgcatgtatataggcaggagtttagtttggtgagatttgtattaagaagggtttacagtgatttaaatttcccctaatatgggatgactgtgacattgtggaagccacgcaaatagaaggatattgtacttactaacataatttaaataatctcaattcatgtctgacaggaggggtcaatagttgaagtctagtaattttgcaattatcctacttgtaaagtggggagaaaagtagaagtggcaggaaaaatgtttacctagatcttttaagaaaatattttaggacaagagccaccatcatattttattcttttatttatttatttattgaagttaattatatttagacttaaggaattaacaaaggagcagggagactagaccaggtcccaggatatcttgactccttggggcaggcccagctacagcaagcacagagggaaacataggggaggggcagatagcagatttggtcttgaacttggagggtaggaaatggatgatccccaggatggaagcagcaggaggaagctgtgtctgaggatggcctgggctgcccagaggggcagcctacccctggacccctggggctgttgcacagcgggaatggaaacaaggatcctcccctcagggctgaggggttcagtccctcctcccctctttccccatctgttggagagatgggggtccttgcctccttgcccctttgaatggcccagatgctggtcctgattgagtctctttaagagacttttgctgaactcataagtggtgatcgtgatagcataggaggggatagacttgatgatccaagggaggaagcctgcaaagagccctctgatgcccgacttggcacagatccacctctgagcaaccaggtagagtccgcatccagggatgtcacttccacggcttccatcactccgagtgtggcctggtgttgagtcttcatcacgacaaaggttagggtcagcactgtagccagcatcatggtgatgctgccagctgcaaagctgactcctatggttgtcatgggaccatggagttcctttggcctgagcccattcagccagctcttcactagctcgtagttgaaccagtacagggctgagaagggcacatttctaaggagagtggggccccggcacagccacagtgagcaccaaccactctaagccaccggagctcaaacacaggtaccagcacatagtataacatatgctaaacctgcagctttgtctgcataagctccagggcactgatgattgcagtgatagtgccagggtggaccagcacaccagctaccaaggttatgtagaggtaagggctcagccacacaggcaggccttgagttggttgtaggcagtgaagtagttggtggtagctggcacagtcatcaccagggtggctgggaggccactccacagggtcctggtgcccttgtgcctcagaatcttcacagaggcatccaaggtgccagtgaagctggtagggtcttaaaaccaggtggcacagcggggaccatttggtcataggtacagaggctccaggacaccattgtagtacaggattggagagaggagggcagcttggcataagagaggctctgaagtctggaggaaggtgtcagctcactggccaccagcgggcactgaggctgcaaatggaccttccaccatgtccaggggtgtcacgaggaaggaggtgaccacagcccttgaaacgtgagaccaccatttgttggagggagctaatgcccccagagtcctgtcagtcatcttgcagcttcagtcctagctctagattggtgcttgtacagtgcgaggctggtcaggcccattacagctctgtggcctcaccttgcaccaagactgactccctgtattttactccctatattttattatttaccaacaattagacaatcttcaccttgcaccaagactgactccctgtattttactccctatattttattatttaccaacaattagacaatcttatgttaaaaaaaaaaagttaattaggacccctatgtaatcatataaacttaaatttcctagttttttattcaaatatatcttctgttattggacctcataacattgcctcttaggtaaacccatgtagagagtagtcccctctttttttttttttgagatggagtcttgctctgttgcctaggtttgagtgcaatggtgcgatctcagctcactgcaacctctgcctctgggttcaagtgattctcctgcctcagcctcctgagtaggtgggattacagcgacgtgccaccacgcccaactaatttttgtatttttaatagagatggggtttcactatgttagccaggctggtctcaaactcctgacctcggatgatctgtctgcctcagcctcccaaagtgctgagattgcaggtgtgagccactgcgcccagcttctagtagtctcctcttatctgcagaaaggaaaaccacggatagaatttgtcaactgctgtccaaaaataggtgaggacagtacaataagatattttgagagaaagactacattcatgtaacttttattattattattttttattatttattttttggagacagagacttactctgtcccccaggctggagtgcagtagtgtgtctcggctcactgcaatctctgcctcctgggctcaagcgattctcatgcctcagcctcttgagtagctgagactacaggcacctgctaccacgcccggctaatttttgtatttttagtagagttgggggttttaccatgttggccaggctggtcttgaactcctgacctcaagtgatctgcccgcctcagccttccaaagttctgggattacaggtgtgagccaccacacccggccccatgtaacttttattacagtgtattgtttaattgttattgttaatctctaactgtgcctaatttataagttaaattttatcataggtatgtatgtataggaaaaaaacatagtatatatagggtttagtatttgctatccatggtttcaggcatccactgggggtcttggaatgtatccctccagataagggtggggactaccatatgctacatttctattgtgactttaatgtggattttttggtcttgaatcagtcacttaatactgctttctaaatgtattaagacactccccaatggtatatgtaccatttaaaattgtcaaatgcttaggtatttttgttaggagtagatagctaggctaagatttcttttcccagctatgtactttatgtgcccttaggcagattgttgtgcattcttgagttaatttttgccatctcactggcttgaccaaattgtaatgttcagagaactaaagcctaaacttagtgtgtttcaagcacttgattggaacttttcattaagcacatattcttatggggcatacatactacaggctacagatactgaaacattttaatactactctaatcacataaccccagaaacaaagaacaaatccctatcaagcccacataattacaaggtctttaaggcaggatcctcccaattttctgtggttataccaactcatcatttggtgacatttaaaccagatggtaatatctcatccttgccaggctttaacttggaagagatgggaggtaggagcccttaggatttgtattctgttatctttataggacagtggggaaaggggtggatataagagaagtttatacagtgaaatttgagtattacctccactttgtaaaattccaggtctttagacttttgcctgtctcagagaggctttcatccaatatgatgtattttggacaaattgagaacagccaccaaattttccagtgggaggctggcttcagggatttgtggtagagtatgggtttggggtttttaaaaattgtgcttggtagcagcccactcttctgggttcctctataactactgtttttctctggtaaccttgtggcttttcccatcttccatttctaaaatatatttttgatttatagaatatatagttgctcatcaagatttttttgacaagaacaaagtttagaatttgatttaggattctaagataatttggttttgaggggtaacattagccagctaggaaatgaaaacttcaagagaatagagattttgtggaaagaatagagtaggaatcaaaatgttgggtttctggcatgtgttccattatttccatgttatccttgagctcctaaccttaaggagggtcatgactattttcagagctttattctattaacctatctgtaaaatgggcagcttaaaatatcagcccttctttacatagtgaggcccaaagagggaaggaatctagcccaaatcctggtggagccagatttgaacttaggctgtgcaggtcctcagttactgctctgaactactgcattgccttttatataaccatagtaatgatacaattgtgatttcatgagatgattaatgggaaattatgaatctattatttttgcatatatactttgtatcctggtaggttcagcaaaacaaaaacaaaagcaacatatttgttggtttttgctgctaaggcagatccattttatagaaaaggaaacaaactgagcttgagagacttgacttgcctaaggtgacacagccttgaaaggacaaattggatgttgcaaaccatggctctttattcccaagttcagtgttcttctaatttaatatataatggctcccttcatagatcctagaaattagcctgcttctctctttcatctccccttacagtcttttttttttttttttgagagggagtctcgctgtgtggcccaggctggagttggagtgcaatggcacggtcttggctcactgcaacctctgcctcctgggttcaagcgattctcctgcctcagcctccggagcagctgggattacaggcacccaccaccatgcccggctaattttttttgtatttttagtagagacggggtttcaccatgttggccaggctggtctcaaactcctgacctcgtgatccacccacctcagcctcccaaagtgctgggattacaggcgtgggccactgtgcccggcctacagtctttttttgactgtggtcttctctctcttccttctggccacccagacttgaattcattaataacaatagtaagctgcatgtatacagttatcaaagtaccatttagatttgtgtgttttatctacttatcagtatttttgaacttagcccattcatatactgttagtttgttggctcatttatatgtaaactcctggctcatcaactccagtgaccactcagcttcacattggaagagtatttaggactcggggctccctatataaatgtaccactgcctcccattaaagtcattctggggttcatcccagaataactgaattagaatctcatgtgggcctaagtgtttgaattttaaaaagctcctccggaagctctgctaggtttgagacccactggtttaggtaatttcatgacaggtttaggcagctaatataaggaattctcaaaaaaaaaaaaaaaatctaaacaccaaaatccctcaaaatatagaaaacaaaataaaaataagaaagaaagaaaaaataaggaattatcttacctgttgacttcaaattaatcagaaatttctcagttctactacagaaaactgggcaattctttttatcagctctgttgaatgaagaaatgaattgagtccttggagttggttgtggtctcaattcagtacttattattgatatgtcagtaagtgcattgtgttaaagtcctaggtggctcatgcctgtaatcccagcactttgggaggctgagacgaggtcagtagttcaagaccagcatggccaatatggtgaagctctgtctctactaaaaatataaaaattagctgggcatggtggcatgtacctgtagtcccagctactccagaggctgaggcagaagaatcgcttgaacctgggaggcagaggttgcagtgagccgagatcgcgccactgcactccagcctgggtgacagagcaagactccatctcaaataaataaatttaaaaaataaataaaggaactcataattgactggtgagaaagattagcaagtatgacgtatgcaaggaatagaagttatgtaccgagtggttaaaggttggggggatatggagatggatgagagggagctgtctgggaaggctttgcttcacttggattagagtagggttgcgtgaggaaataggtgtgtagaatgagaatgagggtcatgacatcctcctacaaaacaacaatattcaaggaaggaagagaatttggttggaggtaccaggaaatgtgttgttaggaagctaagaagaaaatagtaagttcattgttagtatttcagacttaggtggcttaatggtgatatttctgaagtctcaactctagacacagctgtaaaaccctggaaaagtagataattacagtttttatagagtatatcccattgataccaggcagccattcaaaagaaaaccagttttatcagactgcaacttcctcatattttaggctaaagtgggttatctttcaaatcaaatttactttggactatggcaataaatttgaaagaaataaagcatttgataataccagcgctactacagtcacacagcatagtctgaaatatatcatagggtaagtttcttttaagatcttttgacatacttttatctaccatcctaaattgagcatgcctatgtattattagtacatccttatctctttaaagtaggagatctagccttgaagcttggtcagtatgttagttcatttgtgttgatataactatatctgagactgggtaatttataaataatagaaatttatttcttgcagtactggagactgggaactctaagatcaaggcactgtcaggtttgatgtcttgtgctggcctggtctccactttcaagatggtgccttgaatgctatgtggaagggcaaaaggggcctagggtgtaggttcttgcaactcttttatttatttttatttttatatttattattattttttctttgagacagagtctcactctgtcacccaggctggagttcagtggtgcagtctcggctcactgcaatctctgcctcccaggttcaagcaattctcctgcctcagcctcctgagtagctggaatcacaggcgtgtgccaccacgcccagctaatttttgtatttttagtagagatggggttttgccatgttgaccacgctggtctcgaactccagacctcaagtgatctgcccacctcagcctcccaaagtgctgggattacaggcatgagccatggtgcctggcctaatttttgtgttaaatatgttttgtagagatgagattttgccaccttgcccaggctggtctcaaacttccaggctcaagcaatccacttggttggcctccaaaagtgctgaggttacaagcgtgagccactgcccttggcctgccatccatccattcattcattcattcatttatgagacagtttcactgttgttgccaaggcttgggtgcagtggcgtgatctcggcttaccgcaacctttacctcccgagtttgagattctcctgcctcagcctcctgagtagctgggaatacaggtgtgtgccaccatgcccagctaattttttgtatttttagtagaaacagggtttctccatgttggtcaggctggtctcgaaccctcaacctcaggtgatccgcccgcctcgctggtctcgaactccagacctcaagtgatctgcccacctcggcctcccaaagtgctgggattacaggcgtgagccactgcactcagccttattattattttttagagatgaggtcttgtgtttcccaggctggaatgcagcagcgccaccatagctcactgcagtagatgggactacaggcacgtgccaatatgtctggataatgttttaacattttgtagagatggtatctcactgtgttgctcaggcttgcttctcttgctctctctctctgtctgtcttaagcctcccaggtaggtggaactacaggtgcatgctaccatgcctagctaattaaaaaaaaaattttttttatagggtcccgccatggtgctctggctggtcttgaatttgtcttaattcctttcctttccattcccctttccccttccctttcctcctttcctttccccttttcctttctcctttccttttccctttgcctttccctttcctgtggagtctcgctctgtcacccaggctggagttcagtggcgccatctcagttcacttgtctcggctcactttgcaacctctgcctcctgggctcaagtgattatcgtgtctcagcctccccagtagctgggattataggcgcccaccaccgcgtcccgctagtttttgtattttcagtagagatggggtttcaccatgttggtcaggctggtctcgaactcctgacctcaagtgatccacccgccttggcctcccaaagtgctgggcttacagacatgatgagccactgtgcccggcccttctttctttaatactattgcaaatgtgtcatctttagatgggatattgacacaacaaagattttgccatctcgtagtattttttgaggctcaaactgatttttagtctcacttctgttcgtttcttgaccctgatgttgaatctccaggcgtgtgtttgcagatctaatgaggccttaaagttagggtgtgggatgtttaagcttcccctgcccttagtgcccaggtaggtttgggtgttgcttaggcaaggttggggtcagagtccaacctctttcctaaatcccttccccctgacagacagatcatttttggaatctttttaaagtatataatcctttcttaaccttggcagcctcagttttctgccagaaattttttcttccctggattctaggtatggaaaaaacacaatgaaaactagttactagagaacctccttggaaaagctgtgaaattatatatacttgattacagcatggcttgatataggcatgctgaagtaatatgtgcaccaattataattgatgtagggggaaggatctgaaatttcttctcatcccattcagtgattgaagtatcataaaatgtctgtgaatgacatgaaagaaataatgctttcctgtttagaggacctaccaataccaataccaataccaataccaataccaatacaatacagatcattattattgccaagttttattaaaagtggtaaaagaggaatttaatgtgacgaatgcttaaaaagtaaataccatggcatatccctttattactactatatttttatttactaatattccgtagaaacagtgctttgcattcccaagtatttcatattcagaagctaaaataatctttgaaacaagttctttaaaactgatagctttcaccatggcctatctgtaaaagttataatacaagttctcattccttggtacttatttttaataatgactattaaaagtctacatgattgtgttggtattttcagggtctttttggtgataggactttagggaagactgggttgacccaggtataacttttctaaaaatgttgacattgtaaaaataggcggtcaataaatcactattagtgaatggagaatacacttgaaagggctgtgttttaaatctggatgaaaagagttctttggaaggacagattgtatggggtgttctgcagggcgttcaatagggcagttacttccagggtgtgggccgaggacccttggagggttcccaagaccctttcagtggatccaagaaaactcccccctttcagctaaatatctgtgagaggccagatttacttcacataatttttttttttttttgagacagagtctcacactgttgcccaggctggagtgcaatggtggtgtgatcttggctcactgcaacctccacctcccgggttcaagcgattctgcctcagcctcccaagtagctgggattacaggcgcccgccaccatgcccagctaattttttgtattttttttttttaaagtagagacagggtttcactacgttggccaggatggtctcgaactgacctcgtgatccgcctgccttggcctcccaaagtgctgggattacaggtgtgagccaccgcacccggcctacttcacatacttttaaccgaaacaatataccacacctgattggagaagaaattaaaacccagtttatttatattaaaccagacattaaagagatttgcaaaataatacaatgcattacagattaaagagattaactcatttttaaaatgtttcagttttaatttctaatgtgataaaaaatctatagatacaatccatgtaaattaacattctttgaggtcctcaatttttaagattttaaaggactcctaaggacaaaacattgagttattgcagtattaaaaagggaaacttggtcggatgggtggctcacacctgtaatctcagcactttgggaggccaaaggttggagtatcccttgagcccaaaagtttgagaccaacttagtcaacatagcaagactgactctacaaaaaatttctttaaaaaattagcctgatgtggtggcatgcatgtatacttgggagactgaggtgggagaattgcatgagcccgggagtttgaggctgcagtgagctatgattgtgccactgcattccagcctagggacagagcaaaatcctgtctcaaaaagaaaaagaaaaaaaagggaaacttgattctgcaaagacatgactcagtaggaataaagctaagatcttagctttttgtatatttagtagagacggggtttctccatgttggtcaggctggtctaagatcttagctttttgtatatttataaagacggggtttctgcatgttggtcaggctggtctcgaactcctgacctcaggtgatccacccacttcaacctcccaaagtgctgggattacaggtgtgagccaccacgcccggccaatatgtgtattttctaaaacttcagtaataagccttacatttgtattaaaattattttaaatctattctgttgcctagcttttgccccaataaaagaacatgcagtcaagaagttttgtatagtgggcacacaggaaatggcatggtattaggttggtgcaaaagaaatcgtggtttttgccatttttgcatttttgctttaatggcagaactgtgattacttttgcaccaacctaataaatgtgaaatactgctatcatggaaccatacctaggtttgctggctacagtgttaacttttacagtatacaagttcaattccattgccatcccagcagatctactctcagtgtgttgtctgcctttacccttgaactatatatctaaaaaatcttagcagctctttaagcatggaaatctaacaatatgtgctcttattttaaaaagcaaggttggattgggtgtggtggctcacacctgtaatcccagcactttgggaggccaaagtggaaggattgcttgaggccaggagtttgagaccaacctgtgcaacatagtgagacccccccccccaccccccgtctcttaaaaaaaaaaattagctggtcatggtggtgtgcacctgtattcccaggtactctggaggctgaggtgggaggatcacttgagcccaggagatcgaggctataacgagccaagtttatgccattgcactccagcctggatgaccttgtctcttaaaaaacagaaacaaaaacaaacaaaaaacaagcctgcattaggccacttggaaacgaaagctttgcaacatgaatattttcctgagaaaaaccggcactttttttttttttttttaattgggagtcttgctctgtttgcccaggctggaatgaagtggtgcaatctctgctcaccgcatcatctgcctcctgggttcaagcaattctcgtgctctgccttctgagtagctgagactacaggtgtgcaccaccacaccgagctaacttttgtatttttaatagagactgggttttgccatgttggccaggctgctcttgaactcctgacctcatgatctgcccgccttggcttcccaaagtgctgagattacaggcgtgagccaccacaccttcccaaaactaatattttttgaccatttacttaaataaagtaaatgttgtctgagggttctacctgtattattttacttaaccctcacaattatccctttattcacatacgtaaggtacaaggaacttaacctagtacaaagccgcacagtagtaccaggatttgaacccaggcagtgtgacttgagaatctgtcctctttgacatctattttgatgtacaaggtaaaggtaaatggcctcactgtgttttaaaaaaaatgaccatcagagaaataacaatgggaaaatatagaggaggttaaaatggagaaatacagaggaggcctttaacctgtgttaaagtggctatgataaaatgtgctagttgacagttacatgccagctagggttaggctggaaggataaggtccttaaaggtaagtaaggtttagaggtcagatgctccttgaaagttgaggttgcagcgctttttgtataggaagattcatatttcagtggtcagaacttaacataattataattgttacttttactttacaatttaatgaaaaaacctttatatttgtaaaatcagttctcaccacagtcctaaaaggtagtctgtactttttttttttttttttgagacaggctctcactttgtcatctaggctggagtgcagtctttgcctcccaggttcaagcaattatcatgcctcaacctcctgagtagctaggatgacaggtgtgcgccacaatgcccggccaatttttgtattttttgtagagacttggttttgccacattggcctggctggtcttgaactcctggcctcaaggcctgtctgggcctcccaaagtgctgggattactggcatgagccaccgttcctggccctgtttggaagactttgaatgcaattctttgtcgtacaaaacttttctgatagacacctatcagtgagtggcaattagactccatcaggggctcataaatagttaactctgcttgtcttttataggagtttataatggttgtgatagacctagttctaccttttgcatttgtgcaggtgttttaagggcatattactgacctgaaaccattcatttgatgagaaagtggtcttttatgtttcatatatctgttattctgatctttatattaaagttaaattttgtcatcctcacctgaaagatttgctaacttgcaagtgcatttattctatgatgactgggtttcatagaacatatacaattaaaacaatgctttggtccttagttgatgttattcttggtaaactaacaagaatgtgcttttgtgacactgatttctaattggttttgtctgcagggagttagagccaactttcgtagcctctgtagagcatatactttttcattttgctaattatcagatctcaaaatgacagcctttctataattagaaggataaaaacagtattctaatatattaaatatgtggatgttaatagcacatcctctacagagtgaattttcctggcattttttggaaaaatcttcagcatcttttgaaagttgttctcacagtggttgactttattttttaaacatttctctcagttaaatctgcttttagttgttgttaagttaatgctggcactgaggaaaatgtttacctgatgtttctcaggcctctgaggattttgaagcttcaactttctacttaattgccttcctaaggaatacatttttgagtcctaaggaaactaattcaacttctttttttttttgagacagagtctcgctctgtccccagtctggagtgcagtggtgtgatcttggctcactgcaagctccgcctcccgggttcacaccattctcctacctcagtctcctgagtagctgggactacaggcgcccgccaccacgcctggctaattttttgtatttttttttagtagagatggggtttcaccgtgttagccaggatggtcttgatctcctgacctcatgatccgcctgcctcggcctcccgaagtgctgggattacaggcgtgagccactgcacccggcctgaacttttaaataataaggttcttgtactttatcttgtaagggttaaaataaaactattttcaagtttttttgtttgtttttgtttttttttgagacagtcttgctctgtcgcccaggctgcagtgcagtagcatgatcgtggctcactacaggattgacctcctggattcaattaatcctcccaccccagcctcctgattagctgggactacaggtgcatgccaccatgcctggctaacttaattttttttttgtagagacagagcctcaatatgtttccgagtctgggctggtctcttctcttttctcttctcttcttttcttgttagacagagtcttgctctgtcacccaggctggagtgcaatggcgcaatctccactcactgccacctccgcctcctgggttcaagtgattctcctgtctcagcctcctgagtagctggttataaagaatgagagaggtattttatcaggcatgcgccaccatgtccggctaatttttgtatttttattagagatgggatttcgccatgttggccaggctggattcaaactcctgacatcaggtgatcctcctgccttggcctccgaaagtgctgtgattacaggcatgagccatcacactcagcacccaggttggtcttgagctcccaggctcaagcagtcctcccccttttggcctcgcaaagtgtgaaccccactacacctggcttactttcaagttttgaaagtaaaggaaattaaaataatctcagtgaggaatttatatggaactgcatgtaatctgcaaattcttattacatctagttagtatgaaaaggctgttttatgttagaaaaagtgatttatgatcagttttattgatagggagtacaagttttactttttggccagcttacattatattccttttagacacttaagcatcaagttaaacattatcgcaatgtttctaagtggggatttggattatttatttgactacataatttgaggattatttttcaaaattttcaccttagaagctttattatgatctgttgtatttacctttcataatggcttcccctaccccccatttaaaagtcatggcttggcttctgccatgcctcacacctgtaatcctggcactttgggaggcctaggtgtgaggattgcttgagcccaggagttccagaccagcctgggcaacatagcgagacctcatctctacttaaaatgaaaagaaaaaaaaattcgtgtcccattgaggtcagactttgccaaaggtattttagttccgtatgatagtgaacattacaaataaatttaatttttttattggagtctagttttgcagctgacagtgaatgtcccaaaactgaatgacatttatctcttctctcattctttataaccagaagagatgacagagtttgtagtgatccatttttcatgcaaaaatgatcttctcaaactatttctttagttttaaacatatttatacccactgtatgagcatccttattgacagatatgtactaatttccatttgatgaatcattttcaggattcattttagctttatgctaaaataagtatattgtgtatatattcatacatagaagctcattttaatttgtaaaactttaatatacaggcttttgagaacatcaaatatctttataattgtgttttggtattagaaggtacattatctgatcaatcagggaataacattatatatcacctgtaagtcttagttgttaaaattttcaggccattttgaaagtatgttaagactaaatatttgaacatttacttctatattctgacacattatttttcatatgcttttgatctcagcttaacccagatcaattcatttctgaaaaccaacagcttttataacacactggaagcaaagctctgagcaatataaaggcttcctgttagcctaccatagaatatcaagaagcagtgtgatttccttttgctaggatgtgttctgtataaattaaacacattactttggcttttagttattgagctaaacaaaaataaatcagactttaatctttttcacttgggatggaggtattttttaactttaacaaagtatagtattttttaactgacatttaaaacattaaccataaaaaggcagtacaactatgttaaacatttgaaggccttaccgataattacctttgctttttagcttaacattttatcatgcatcaccggcgggcatttttattgaagtctttgttatcactaaaacaaaacaaaatttcatttatgtatttattttagagctaggttcgtgctctgttgcccaagcaggagtgcagtggcacaatcatagctcactgtaaacttaagccccctgggcttaagtcatcctcctgccttagcctcctgagtaggtaggactacaggtttgcaccactatgcctaatttttacattttttggtagagacggatagagactggtctcaaactgctagcttcaagtgatcctcctgctgctgcagcccaaagtgctgagattataggcatgagccactgtgcctggccgtcatttttattctaaactaaaagcagtctataatgataagttccaacagcacaaatttgaaatgttaaaaaagcctcttttctccttattattgtgatattatttaaaatctgcatatgtaaaattcaacacaatgttattaggttggcgcaaacgtaattgtggtttttgtcatatgtatatgtaggtaatggcaaaattacagcttttgccacatatatatgtattttttttttttttttttagtaatggcaaaagctgcaattacatttgcaccaacctaatacatgtttttgttctagttttttactcattgatgcttgggtatctttccatatttagaatatctagatattttttattatagctgagtggtattttattgttggttgtagatataccaacatttatttagctttttctctactgatacttacattttaacttgaaggaattttgcagtgaatttccttttgcctatattgaggtgttgtgagtggtaatagatatttgtaaattcctatcagaaaattgctgggtcatggccaggcgcagtggctcacgcctgtaatcccagcactttgggaggcttaggcaggtggatcatttgaggtcaggtgttcgagaccagcctggccaacatggtgaaaccctgtttctactaaaaatacaaaagttagccaggcatggtggtggtacatgcctgtaatcccagctacttgggagactgaggcaggagaattgcttgaacccgggatgttcaattcttgcttgcagtgagtgaagactgtgccattgcattccagcctgggtgacagcatgagactccatctcaaaaaataataataataaaataaaaataaacaaaactgctgggtcacaaggcatgcgctgttaatctgatagctaaaaacaatgagagtttgtatatttcttgaattttgagtgaagttgggtgccagtcttatgattggccatttttcccttttggctgttgatacaatttgcccatttttctgtaagttattattttgtcttattgattgttatgaactctttataaatctagcacttttaaatgctgtataatattcaatgttattgtaataccataataatcgtacattcctaatgtaatgctgcagttaatttcattcatgtattttgttttttcttcctttattttttatttatttatttatttatttatttatttatttatttatttttgagacggagtctgactctgtcgcccaggctggagtgcaaaggcatgatcttggctcactgcgacctccacctcctgggttcaagtgattctcctgcctcagactcctgagtagctgggactacaggcatgtgtcaccacacccggctaattttttgtgtatttttagtagagacggggttttgccatgttggccaggctggtctcctgacctcaggtgatctgcttgcctcggactcccagagtgctgggattactggtgtgagccagtgcgcctggccattcaactctggttgaattgttttcttttttttctttttttttttgagacggagtctcgctctgtcacccaggctgtagtgcagtggcgggatctcagctcactgcaaactccgcctcccgggttcacaccattttcctgcctcagcctcctgagtagctgggactacagccgcgtgccaccacgcctggctaattttttgtgttagccaggatggtcttgatctcctgacctcatgatcctcccaaagtgatgtgattacaggcgtgagtcaccgcgcctggccggttgaattgttctcttaggataaacttggtataaaattgagtttaaaggctgtgaatttcctcattaatatattcacacaatctgaaataatacatttattatttaataaatatttaatgtattttggattatatttaaaacaaacaaggatgtaaaattacctataaccctgccagtaaggacaaccactattgtgagcctttttgctctagatagctttccagtgttttatttttctactgtaaagcctgttccgccccccgaccccttaacatatatagggaaaatcttcccacattagtaaatagagatctaggctgggtgcggtggctcacacttgtaatcccggcactttgggaggccgaggcaggcggatcatatgaggtcaggagtttgagaccagcctgaccaatatggtgaaaccccgcctctactaaaaatacaaaattagctgggtgtggtggcacatgcctgtaatcccagctactcgggaggctgaggcaggagaatcacttgaacccgggaggcagaggctgcagcgagctgaggtcacgtcattgtactccagcctgggtgacagagcgaaactctgtctccaaaaagtgaataaataagtaaataaataaataaaagatctatgctacagggtacatttttccttttttgcttttttcattgtattaaaatattaaaatgtacataacattaaatttttgcctttgtaaccatttttaaggatacagttcagtggcattgggtacatttacattgctgtacagccattaccattgtctacctccagaccctttcatcattatcccagactgaaacctattaacacatttttatacctttagctgttctcttgttgtagacattcatttccagttttctcccttcgtaggtaacaattcatacatatatgtgtgtgtgtgtatatatatatatttaattgtctgattacttcctcatgatggcagttcttccatgataggaaaattctcctctagagaacagttgtctatacgagtatacatattaaggacaaatttttttttttttgaggtgaagtcttgctctgttgcccaggttggagtgcaatggcgcgatcttggctcactgcaacctctgcctcttgtgttccagcgattctcctgtctcagcctcctgagtagctgggactacaggcgcctgccaccccatctggctaatttttgtagttttagtagagacagggtttcaccatgttggtcaggctggtcttgaactcctgacctcaggtgatccaccctccttggcctcccaaagtgctaggattacaggttgagccaccttgcccggccaaggatgacttttaaaattggatttggatgtcagtttttctccccctgacaccactgtagaatttaccctcaatttaataagaaaagttaaggtgggccaggctcagtggctcacacttgtaatctcagcactttgggaggcaaaggtgggaggatcattggagctgtagagttcgagactgatctgggcaatacatgtacctacacctcgtctctaaaaaaaaccttaaacaattagctgagtgtggtagtgttcacctgtggtcccagatacttgggaggctgaggtggaagatcgcttgagctcaggaggcagaggtttccaccagctgtgatcacaccactgcacttaagcctgggcaacagagtgaaaccttatctcaaaaaaaaaaaattaaaaaagttaatgtgactggaaggttaaatgtgttttttaaagttatagacatatagctgttatataaaaaatgaggtatgtctatggtaatacagaagtcaaagtgtcttttgcctaaatgagtgttttttttttttttttttttacaggctcaatgacattgctcagtgggaaggtttgtggggagaggtgtatatgtgatatatcatttatttgggaaagggtgttcatacatattttgctgctctcatggacaaaaggttgagaaaccactactctgtgttctattttgtttgattggttagaataagatttacctaacctgggttttaattttaaaacaaatttttgaatgtcaaatgcttataagttattctaataagagcctttgctttctcctaggattggcagccaccatttgcatgtgatgttgataaacttcattttacgccacgtatccagagactgaatgaattggaggtaatgtcttcactattgttctgtttgcctgtattccagggggaccgtctttgaaattattacgatatattaaaattgttacagaatcaccattgtaaatctgtttttagatttgtatttgagcaaataagaacatttctttctgtagagaacaggtctttaaaatatcgaattggctaggcatggtggctcacacttgtaatctcagcactttgggaggctggggcaggagggttggcctgggcaacatagcgggaccctgtctctgctaaaacatagtttaaaaaattagccacgtgtgatggtgtgtgcctgtagttccagctactcgggaggctgaggtgggtggattgcttcagcctgggaggtcaagactgtagtgagccatggttgtgccactgcactctgcactccagcctgggcgacagagcaagaccctgtattttatatatatatatatttacatatgtgaagatacacacacacagaattgtgtttttgttgtagggttgaggtctccctatgttgcccaggctggtctcaaactcctgggctgaagcgatcctcctgcctctgcctcccaaagctgggcatataaaagcatatttacttgccatataattttaaacacttatatggaattgtgcttacagtactaattaagttcctttcagagtgcctgcttacatcacaggaaggtttactgagtgtttaattctttgtctgtcacgtggtaggggctgaattaaattttttaaaaaagtcaattaaaatttttactttttttgttatggagtcccgctctgtcacccagggtggagtgcagcagcattatcctggttcactgcaacctctgcctcctgggttcaagtcattctcctgcctcagcctcccaagtagctgggattacaggtgtgtgccaccaagcctggctaattttggtatttttagtagagatggggtttcaccattttggccaggctggtcttgaaatcctgacctcaggtgatctgcctgccttggcctcccaaagtgttgggattacaggcatgagccaccatgcccagcctgaattaaatttttgttgagttaatgtatgtgtgtgtatatattatatatatatatatatatatatattttttttttttttttttttttttgagacaagagtcttgttctgtcaccaaggctggagtgcagtggcacaatctcagctcactgcaacctctgcctcttaggttcaagtgattctcctgcctcggcctcctgagtagttggcattacagacgtataccaccacatccagctaatttttgtatttttagtagagatggggtttcaccatgttggccaggctggtctcaaactcctggcctcaagtgatctgcccattttggcctcccaaagtgctgggattacaggtgtgagctaccacacccgaccatgtataattattatttttttatttttcttttttattgagacagagtcttgcactgtcacctgggctggagtgcagtagcatgatctttgctcactgcaacctccacctcccaggttcaagtgattttcctgcctcagcctcctgagtagctgggattacaggcccctgccactacgcccagctaattttttgtatttttagtagagacggagtttcaccatgttgcccaggctggtctcgaactcctgacctcgtgattcacccgtctcggcctcccaaagtgctgggattacagccatgagccactgcacccagtcgtataattattattattttgagacagagtcttactgtctcatccaggctggagtacagtggtgtgatctcagcttactgcaacctctgcctcctgagttcaagcaattctcctgcctcagcctcctgagtagctgggattacaggcacgcgccaccacactaggctgatttttgttaatagagatggggggtttcatcatgttggccaggctggtctcgaactcccgaccttgtgattcgctcgcctcagcctcccaaagtgctgggattacagacgtgagccaccgtgcccggccggccatgtataattatttaaccagctttattttgtgtatttttggccgtttctcactgaatttagaaagtggtattatatgattttgctgaaagagcattaaattaaaaaaaaatttttttaagtggtattgtacttaaatattctgtgaaagaaaataatggcaggtaataggagctttaaaataagctaaatgagatgaaaactcaattctttgtcttttaggcccaaactcgtgtaaaattgaatttcttggaccagattgcaaagtactgggagttacagggaagtactctgaaaattccacatgtggagaggaagatcttggacttatttcagcttaataaggtaaagagctaatgaccatcttacttattttataatcttactgacagaatgaatttgatcttctttgccttaaaaaggaacttattgctcagccaggtggctcgcacctgtaatctcagcactttgggaggtcaagggaggaggattgcttgagaccagcctgggtaacataaggaaaccctgtgtttacaaaaaatttggaaattaggcatggtggcacgggccctgtagtaccagctatttgggtggctaaggagggaggatcacttgagcccaggaggtggaggctgcagtgagctgtgattgcaccactgcactccagcctgggtaactgagcgagaccctgtctcaaaaaagaaagaacaaataaacttactttttgagatgtgtgaaatgagattctcaagtcagttgagtgatgaggatcatcaggtcttgaagccttgtggaatattttgcttccacctgtttttctcattttcacactttacaaaaattctgcaagctatttctttttattacagataaggaaactgaggctcagggtgataaaaaggtaaaaaaatgctgagccatggccgggcgtggtggctcatgcctgtaatcccagcattttgggaggtcgaggtgggtggatcacctgaggtcaggagttcaagaccagcctgaccaacatgtcgaaaccccgtctctactaaaaatacaaaattagctgggtgtggtggcacatgcctgtaatcccagctactcgggaggctgaggcaggaaaatcgcctgaatccaggaggcggaggttgcagtgagccgagattgcgccattgcactgcgggctgggcaacaagagagaaactccatctcagaaaaaaaaaaaaaaagaagctgagccataattcaataccaggcccatttgattctgaaatttacattctttccatcaaacatgctggcatgcatcctagtctttagtttttggaggcttatttaagagcccagaataagaccaagtattacagtcccttctttggtagagatttagttttaggtaacctggttctttccacatgattgctttggggatgtgaaaagtagcttagaggggacaaaatgtttatggaccatgttgtcaagagagatgttgaaaatttctaacttaaaattaatagtgtgtgtgtatatatatgtgtgtgtgtgtatatatatatgattggcaaaacatgtttttaaaagataaccatagccaagaacattttccccttggagtcatacttagatgtgattagaagtgacttccatatagttgtttctaattttgctattttaacagttagttgcagaagaaggtggatttgcagttgtttgcaaggatagaaaatggaccaaaattgctaccaagatggggtttgctcctggcaaagcagtgggctcacatatcagagggcattatgaacgaattctcaacccctacaacttattcctgtccggagacagcctaagggtaagtttgggggctagccttaacctgttttatcttactacttattggtacattgtcttttcagggaaatgaaaaagccttgattgtgtttggaagaccttgttttagaagaccttattttggtggggcgcggtggctcactcctgtaatcccaacactttgggaggccaaggcaggtgaatcacctgaggacaggagtttgagaccagcctggccaacatggcgaaacctcgtctctactaaaaatacaaaaatttgctgggcatggtggcgtgtgcctgtaatcccagctactagggaggctgaggcaggagaaccgcttgaacccggaaggtggaggttgcagtgagccgagatggtgccacttcactcaagcctgggcaaagagcgagactctgagactccgtctgaaaaaaaaaaaaagaccttgttttgtgttttttcctctagtgtttttgttctgctttgagagcagctatacttagaagtttgtttctggaatgagtaagattgtggaggaaatttttttactgtccaaagctgaggagttgattattatctacttgttacaactttgcattctctttaaatttaaagtagctaaagtattcctggctgtcatatgaaggtataagctgtgaaataacttgcctacctgttctcttctgccagctgagatttttgaggagattgtcagaatgttgatatggtaaaaggggattttataatgctacatagctaacgggttcctcttctagtaattcctatgtagccaagttcatttctgacaaaatggtatttgtgaaattattcacttaaaaacttttaggtaaaacagtactgtaaaagcttcccatttatttccaggccttggtagaaagaagaggggtgtcattatccattcacaccctttgagttattttaggactacagcagtgagtcctataactttaagaattgttttctgtgctgtagagaggtaggaagagaataacatagtttttgaggggtaaatcactaaccaaagtcctgtcctaatactatacacacacaaacacaccatctgtaatgcttaaatccagtagattttttcttccctctctcccttattgattccaggtgaacactttttagcctagaagaaagtagccaatctgacattcaaaacttttttttttaatacattatatgaatgtttagtgagcccatggatgaaattgtttagaatgttgaatgtgagccgggcgcgatggctcacgcctgtaatcccagcactttgggaggccaaggtgggtggatcatgaggtcaagagatggagaccatcctggccaacatggtgaaaccctgtctccactaaaaatacgtaaattagctgagcgtggtggtgcgtgcctgtagtcccagctacttgggaggctggggcaggagaatcacttgaacccaggaggcagaggttgcagtgagctgagattgtgccactgcactccagcctgggtgacagagcaagactcttctcaaaaaaaataaataaaataaacaaaaacttaaaaaaataaaaaataggctgggtgcggtggctcatgcctataatcccagcactttgggaggctgaggcaggtggatccccagaggtcaggagttcgaggtcaggagttcgagatctggctggccaacatggcaaaaccccgcatttactaaaaatacaaaaaaaaaaaaaattagctggatgtggtggcaggcacttgtaatctcagctacttgggaggctgaggcaggagaattgcttgaacccgggaggcagaggttgcaatgagccgagatcgtgccattgcactccagcctgggtgacagaatgagactcagaatgagactgtctcaaaaaataaataaataaacaaacataaaaaataaaaaatagaatgttgaatgtggaacctttttgcctcttatagtcagatctagatacagttgcccatagtagattaattttctcttcttgaactcttcctaagtacggaagtgatagtgaataaagggagagagagtccctttaatgatgctttgtgggttgtaacattttagaaacatgtcacttatatacttaaaaaggcaatgtagttttatggttaaaaagcacttaagtatttatacaatcaaggagtctgaaaggaataagcatttaaaggtacccttttgtaaacattgcatctacaatataggtagatatttgtgagggacttactctgtgccaagtatgttttaggaagtgatacacattctttgtagaaagtttaaaaacataggaaagtatggcaaaaataaaatcactcctgatccttccacctgttacttctctcacggctatttttatgcatacattcacaaattcaagtgtactgttcatatacatcattgcatcttaggtttttttactaatcatatgagcatttgctgtatcattgaatagtttttgaaaatgcaatttctaatgactgcggcaatccgttttttatagccagactttattttgatgtcttctattgtagaatgtttaggtcagttctagttttttattataatactatgatgaatattccttgtatgtaaatttttacacctatttctgatttttgaaatagttattagggagagaagaattgaagaacatatacttaagaaaaacagaggtgtacagtaaaggaattattgcaaaagggtgaagtagggtgtaagttaaatttcaggaagcttgagaaaagttgatgcactgttccagtggaacagaggcctcaatcttgcatcatcatgttttctaaatgttttaagggattgctctgtctttgggatgatgtgattatggcatgatgatgatattaatcacctgtaagtcctggtttctcaagtaaaggttaaaattagcgtctgtatgttaataacattagatataaaaccatatcgtgtgtatttttaattgtggtttggaacaaaataataaagctcttcatatttattctaaaaaactacagggcatgattttcttagatctgcaaagtccttacagaaccaagctgaccatagatgatggaaccattgagactaactagtaggagataggaaccacgtatatagcatctgaatttgtgatcatccacttaatacaatttatgtcattcagctcaattagtattttcctaatcactcatacttttgtgtgtcaaatagaaagtacattggatacataaaggggattaatttagatgatgaacaggttttattcccctctgcatgctttcattaaacatactctaaatgctcaactgaggacttgttatagaatagaaggcaatgttctatacaaattttttcaaaaaacagaatatttttttctctcaattgttgggtgtttaatttgtctcataattttttttttttttttttttttttttttgagacagagtcttgctgtgtcacccaggctggagtgcagtggcatgatctcggctcattgcaacatccgccaccctggttcaagcgattctcctgcctcagtgtcccgagtaggtgggattacaggcatgcatcaccacattggctaatttttgtacttttagtaaggacggggtttcagtatgttggccaagctggtttcgaactcctgacctcaagtgatctacctgccttggcctcccaaagtgctgggattacaggcttgagccactgcacctgaccaacttttttcagaatgtaagtgcttaactattaagaatataataggccaggcggccgggcgcagtggctcacgcctgtaatcccagcactttgggaggctgaggcaggtggatcacgaggtcaggagattgagaccatcctggataacacggtgaaaccctgtctctactaaaaatacaaaaaaatagctgggtgtggtggcaggtgcctgtagtcccagctacttgggaggctgaggtaggagaatggcgtgaacccaggaggtggagcttgcagtgagccaagatggcgccactgcactgcagcctgggcgacaaagcgagactctgtctcaaaaaaaaaaaaaagaaaaaaaaagaatataataggccgtaggccgggtgcagtggctcacacctgtaatcccagcactttgggaggctgaggcgggctgatcacctgaggtcaggagtttgagaccagcctcaacatggagaaaccccgtctctactaaaaatacaaaatcagccgggcgtggtggtgcatgcctgtaatcccagctacttgggaggctgaggcaggagaattgcttgaacctgggaggtggaggttgcagtgagccgagattgcacctttgcactccagcctgggcaacaagagcgaaactccatctcaaaaaaaaaaaaaaaaagaatagttaacttttctggatcaaatcaatatgtaggtttaagtagaatgagcagaatgtttaatatttatagagcgctattaccagtggtagatttattacttgttaacaagtaatgagtcagtttttaatagtatatcatatttcttaactattagaaataaattttatcattgtgttgctttgtactttattttgttcttcgcccagtctctgtatttctgcaaatgtgagggggaaaggggcgaatctcattagtgagattctatggtagtaactatgctcatagtgttagtgcttcaggaaggttgttatttccacgtatctcattccagatatagctgctataacacaccctagagggttacttttggaacttacttttacaaaggtttttcgtgatgttcctgggtcctgttatgaaaaagtagtgcttacctgaaattcatattagcttcggtggcaatattttgtcgtgttaatgttatattggcattaaataccctcctttagccagcttagaataaaactaaaaagaaaaaccaaagaagagatgcatttctgatcagaaccaaagttattgctgtgggctacccgttgatctttgccttgcgagttagactttgtagggatatactgtggtaaatggaaaccctagtgaggaagactactttagtcaaatgacctgttttctcaattcaggtgatatctttggatgataactttgctagttatatctgaaactatacagttgtaaaatctagaaaacatattggattccttatttttttttattccgaacacttgttaaaaatgagatttttaatatggaaaattgttttgggagcttataaggggcctttctaacaatatggaccttccattaactgacagtcgcaagcacaaataactccaagtggttcattgggaatgccttgagactgttatggcctgttgtaacctgatgatgtcagcaatgaaaaatcaaagcaacaccacctgttaaaattttttttaatgttttaaacctgtatagatgtatgtatgtggttggtaactgcagacttgtctttatttttatttagatttttaaaaattgtaggcctgttgtctacataaatagttgtaaaatgtaccttacaaaaatccagtgaaactctctaagattaaaaaaggagggaatcctttcagtccttgcacaccggggaacaaggtcgtgaaaaaaaggtcttggtgaggtgccgccatttcatccttcctcggtctctgcacctttcgcagagcttccagcagcgctatgttgggctagagcatccggaggttcacagcctctgtggtccgtaggagccactgtgaggagggccctgggaagaatttgccattttcagtggaaaacaagtggtcgttactagctaagatgtgtttgtactttggatctgcgtttgctatacccttccttgtagtaagacaccaactgcttaaaacataagggtgtttcagttcctccatttaacagatatgaagagtattttaagaggtgcagcctctggaagtagatcaaactcgaactcatgtggcatgctagatatgtttgtcaataaacttatgatgtgaaaaaaaaaaggagggaatttatcagtacagttgttatttctagtgtttgcagaagccaaacctgaccacagacactaaggacaaggagtacaaaccccatgatattccccagaggcagtctgtgcagccttcggaaacgtgccccccagcccgacgagcaaaacgcatgagagcagaggtaagagcctcatgaggttaatttaaaaggaattctcaagccctaataccaatggctgtctggcactggatttctctcatgtgtgtgctctttgtagttttgaaccttgttaatctcacaaagggatgctgtttgtattccagcttttacacttgggtgaattgtaccatcaaaggggtaaggaatcgaataagtctttctaaatttatgctgcctggacagacagccgcttattaccagtcaaggccttagaagaattggtgttcctgtgttcctacttggattgcccattaccctcacaaaattggcgttgtttaatggagattaaggctagaaaacatgaagattaggagtttttttaaacagagtggttagaagacagttaaagccacttttctcagacttctttttttttttttagagacagagtctcgctgtgttgcccaggctggagtgcagtggcgcgatcttggctcactgcaacctccgcctcctagattccagcaattcttctgcctcagcctcccaagtaggtgggactacaggcgtgtgccaccacgcccggctaatttggtttgtatttttagtagagaccgatttcaccgtgttagccaggatggtctcgatctcctgacctcgtgatccacccatcttggcctcccaaagtgctgggattacaggcgtgagccatctcacccagcctcttccttttataggtggtctcgctctttcacctagactggagtgcagtggcatgatcatagcttactgcaactttgaactcccaggctcaggtgatagctgccacctcagcctcccaagtagctggaactacagatgcatgccatgcatgcctagctaattaaaaaaaaatttttaataaagacaaggtctcactgtgttgtccaggctagagaaggattatttgctttaagatttttctgctctgagaagctttccctgggaaaggaagaagagtatttttctagtgatctcgttcccataccagaggtatgaaggttttggattcctgcctagcctgatggatatgtgagttttaggactcagagataatatatagggaactgtttagagctgggaagcctcatattgcattaatcatactaaatcagtaactggttttcaataattatcaaaaatgaaaaaaatcagccattttgttttctgaagaaatagataaataagagaatagtttttcactttggtaagttggagataggaaaaaaatttagtgattcactttttctgaatgaaggagactgcccagaataggaaaatatggttatttgaagcccataagcatgtttaaagtaaattaatctatgaatcagttctttcttgagcatattcttgatcttatacatgtgtatataagaaatgccccagtgctgtggatgcctacatctgccttgatgacacctgatagtaatgatattgcccatggaataaactcttttagcagtggacatcattaaaatgtatgaataaacacaggcaaagtgagaaagcacagttccacagatacttcagtattaccacaaaaaatggttttatttgctttaccaataagtatcagcactttaagaaataatagaaactgagattggcttctataccctcaatgaggaaggagcccttaatagtttagtgatgttagaagtgtgtagtttataataatagtttattaaaataatttatggaaaattattgtggaagcaaaattttctgtaaatactgacagaccttggaataggtcagcaaactcttagaggctaatggagttatgacatttatataactacttaggatttggcttattgcgatgattgaataaagcataaagcaaatagataagaaccaagaaccttctaggaggaaaataagaattgttcttccgaatttgaatagaaacacttctctttgttttgagacagagattggctcttgttgcccaggctggagtatagtggtgtggtcttggctcactgcaacctctgcctcctgggttcaagcaaatctcatgcctcagcctcctgagtagctgggaccacaggtgtgcacaacacctggctaatttttgtatttttagttagagatggggttttgccattatggcaggctgatctcaaactcctggcctcaagtgatccacctgccttggcccccccaaaatgctgggattacaggtgtgaggcacctcgcccagccacaatttgttcttgatcctttgacttttccctatttgtttttttgtttgtttgtttgtttttgagatagagtcttgctctgtcacccaggctggagtgcaatggcaccatctcagctcactgcagcctccatctcccaggttcaagcgattctcctgcctcagcctcccaagtagctgggactacaggtgcgtgccaccatgcccggctactttttgtaattttagtagagacagggtttcactgttagccaggctggtcttgaactcctgaccttaagtgatctgcctgcctcagcctcccaaagtgctgcgattacaggtgtgaaccactgtgcctggccaacttttccctatttttaaatttctcattcatgctttaatagtagtttcaaaggtgagctctcttccttaggaagagagagaagtatgttttgaatgccctgttaatagaggcaattggtaggatatagtcaccttgagattccagttggatttttaaagattatttcttcttaaaggaaatattcatgtatatgacaatttttttaaggccatgaatattaaaatagaacccgaggagacaacggaagccagaactcataatctgagacgtcgaatgggttgtccaactccaaaatgtgaaaatggtaagaaaatttgtcaatgaataggaaagaaaaagtaaataaagtaaaaataactattcataagtaaacataagctgaaaattcaatagaaaaaaattaaaaagtaaaatttagagcagccagtacatagtagtcactgggttgggctttgagaaaatcttaatatatcaacagtgtccttgttctcataattaactgactagtgggagagagaaacagaaactatatgtatgcatattaggagtgtggatgagtttctcagctgtagcaagttgctactttgaaatttgattcaatgcagttacttaagtaatttgtgaaaaacataggtgcctttgaccgaatgtctgatagatttatttcaggcaaggcaaacagacatgcttcctaaatctgaattgtggttaattgcttgcctgggtatcacttgatgtaagtcactgagaggtggatttgagattcttttaagagaaatcttatatcctatataggaggcacatacaaattaagaagttactaaaatttgttcaacctagggattagtgaactagtggaaaggcagcacaatgcacaggaaagtaatagagatacaatataaagtaatacagtaatcttggcacaaccgctaactagttatgtaaccttagagatgtttcttgatttactttaacatcagttttcttacctttgaaatgggtttgttgtgaaggattaaatactttatggaaagcattgagcacaatgcctaccacatgatagttcagtaattgatagccagtgttttcgccaaacttctcagtcttcagaaccaggaatttggagaccaggaggatgaccaggaagtcatcttagatcatggagagataatgtgttatgtggaggagatatagttggtgaactgttggtctcttgtagtcatggccaacaggaatttgatttcatcggtatatgttatgtcttggtcttgagaaaactaattcctattttgaaagcatacaaacctgagggacatctccagaagtaatctacatcttgaaatttaaatggcacaagagtttgcattttatcataaagtaatcagcatttgagcccttgaataaagtatactgggtgctattgctactaaaatgtgaaaacacacatgaaattatgtttgtgtacagtatgtgctttgggagggagatgatgaggaagtggagaaaagcatcataaagagctaattttggattgcctcctacagagaaagaaatgaagagtagcatcaagcaagaacctattgagaggaaagattatattgtagaaaatgagaaggaaaagcccaagagtcgatctaaaaaagccaccaatgctgtgagtgacatctccctttctcctttttctttcctgttttccttcttcccttcctttctttaatcccctttacccccaagtttaaacttaaatttgtaccttaaataagattgtttaacttagtgtctgacaataaaaatatcttctgaagtcagtttatagtgttagttaataaatgaggaaatacatgatcatactataaagatggtagtaacatccggggcggcattgactgcgattttctggaatacattcagtttagcactgactaataatgaactgtaatctagctcattatacatagaattgctcataaatcactagctcacttctacatgagctgaaggctcgctcaaaaatccaagttagtgttttccaacttcccagctagcaaagggaaggaaggaaatgaaaagaaggaacaaaaaagagaaaggaagaaggaagaggaaggaaggaaggaatgaaaaggaagtagagaaggaaggaagaaaaggaaaaggaacaaaggaaagcagttaggaatagggaagaggacatggcagagttagagggctgggagctgtttattctgtggaaaacttttattaaaagtaaagcctgatggcattagaaaggatctggttcttctctgcccccttctgagagcctgaaacggtgcttttttttcttggaactagaaattattctaattgaatgttctctccataaatgtcaccttctgccccaccccctctccccaatacaatcagaaaactgacagagctagatttttatttgctacaataaatagactgcaacagactccccatttagttgaattctcagctttctagtattgagtaatgtatcagtttgctgtggctgccataaggatgtgccgcagactgagtggcttaaacaacagaaatttattttttcacagttgtataggctgggaaatttgagatcaaggtgttggcagggttgatttcttctgagccctctttccttggctgtggatggctgtctttcacatggtctttcctctgtacatatctttgtccttataaggacagcagtcatattggatgattacctccgtaaggactcatttccaaatatagtcacattctgaggtactgagggttaggacttcaacatgtgagtttttggggggaatacagtataccccataaaaagtaataactatgctttatcactgggcattaggggaacttctgaaccatgtccccttaattagaattaaaagtgatagtttatttttatttttttagagatggctggagtatagtgacacaatcatagctactgctgccttgaactcctgggctcaagggatccttttgccccagcctcttaagtagctgggaccacaggtgtgcaccaccatgcccggctaatttttcttttttaaatttcttgtagagacagtgtctcgccatgttgcccaggctggtctcaaactcctggcttcaagcagtcctgccagggcccccaaaagtgttgggattacaggcttaagccaccgtgccaggcctaaattggtagtttaatgtggttaactttaagacagttttgttttaaatatggaaaacttgtatttttccttcataaattctacttttggttaggttggtaatgtattacctggtatcttttttttttttctcctgagacagggtctctgtcacccaggctagagcgcagtggtgcaataagggctcactccaactttgacctaccaggctcaagaaatcctcctgtctcaattccccaagtagttggaactacagacacgtgccaccactcttggcctataaccttagcatcttgttgttttggaacctactaaaaactaggtctttaaataacaaactttaaacacatgacagttgagaaagctaggagattccactttagatttggtatgcatgaggtattgtgaaatatccttcatagaaagtgaaacatttttatttaaaatatcccttatagaggttgaagcatttgtagcaggatgtagagactagattatgtctcagatccatttcatttctagaattttagaaaatcaaataatagctcatgttcctttgttctgtacccacttttattgctacaggtggacctgtatgtctgtcttttatgtggcagtggcaatgatgaagaccggctactgttgtgtgatggctgtgatgacagttaccataccttttgcttgatcccacctctccatgatgttcccaagggagactggaggtgtcctaagtgtttggctcaggtaataattaatagtagaggtaacactagaaaaatttttttagggcatttttctttgcctttgagttttattttttattttattttattttattttttttagacaaggactcactttgttgcccaggctggagtgcagtggcacaaacatggctcactgcagcatcaacctccctggctcaagcagttctcccacctcagccccccccacgtagctgggactacaggcccatgccatgatgcctggctaatttttgtattctttgtacagagggggtttcaccatgttgcccagggctggtctcgaactcctaagctcaaatagtcctcctacctcggccttccaaattgctgggattacaggtctgagccatctcacttggcctgcctttgggttttagatttggcagtcgacagtaatgaggcccatgaagaaaactgggatggacctgaataggaaagaggtcttagaagtgagttccacaatgtatgtgggtagttaagaggcagaaaataatttgtaataagtatcttattattattttttaattcttataaaaagcatcacatgctctttgcaagaattattaaaacattgaacaacttaaaaagtagagttatgctttcacaatgcatatataaccactgttaatgtcttggtgtatattcatccagacttttttctattttaaacaaatggagctacattatataagtaattattagtaatctgcttttttcatttatagagacattttcatgtagcactgtgattactgatgtttttaatagtgcatgctgtcattggtaaaatctaaaaaggatctacgattatcttcatgaggatttttttttttttttttttgagacaggatctcactctatcacccaggctggagtacagtggagtgcagtggcgtgatctcagctcactgcaacctccgcctccccagctcaagtgatcctcccgtctcagcctcccaagtagctgggactacaggcttgcaccaccatgcccagctaatttttgtattttttagtagagacagggttttgccacgttgtccatgctggtctcagaactccggagctcaggtgatcctcctgccccagcctcccaaagtgccggattacaggtgtgagccactgcacccagccattaggattattttgcattaatattatgtagcagtcagtctattacccttcttagggttgaattataatagtaaggaggtttattttaagtatagcatggctataaaggtttgagtgcttttccacgtagctatgttacaacataaggatatctccatcaatgggaggttattaggcatgggacagggataaattatttaatacctcataatagggatgaccttatcaatggatctggaatattcaagtctattggctcacaaagatctaaggcagcttatactgcccctgttaactcccagtattaggttataatcaaatattgctggcctgagagccattctgtttccatcaagtggtttatctctattttgatctattgtatgttgattttatagttttaactcccaggaggacattattgctctcattttcagtattgaaaacattatttgattttgaaggaagtcgagtctttagcctgcctcttataaatatataaatttatccaagttgtggttgttaaaattgacattttatttgctcattagcaaataaataaaatgtatttcacttgcttattaaaataaccacatttttcaggcaggtttatttttataatgtagacctagcatagaagtaaaataaacaaattaaagccttgttttttatctgccagcttgatgattgaccaagtatacttgatgttttcagtgtcacctagaacgtaattttctttattttcaggaatgtagtaagccacaagaagcatttggctttgaacaagcagccagggactataccctccgtacttttggggaaatggcagatgcgttcaaatctgattacttcaacatgccagtccatgtatgtacatatatactgctttgatttaggattttaatagcttttggagaaaagtgtacctgaagacccatttttagttgaggcctcactctagtaggcattgtcacacagaaagcagaatgaaactttaatttgttttgtggtatttaaaatttcacaatactttaaaaagcattctaattttttattttagaatttctctaaagatacctcttccacacagattatacagcaccagtaatagaacactaataaagaaaatcatcagcaatcattttggcccaacaaatataaagaatacttcacaaaatgtattaaatgactgctgtgtgccaaggtgtactatgcattgggaacacatttgttgtatattgttatgtaatcataagttagtattataaatttcaggatgagtccatttttaattcccctttatgcactttgaagcataagcattttccattcagcatttaatactccatcaaatgagtacaccaaaatgtaatgctttaattctggatatttaagctatgatttttgtcactactaataaagcactgcagcaaaccctttatgcatgtagtactctttaattggatgattttcttgggatgattattgaggtcagatgagagtcattctccctcattccatcccagttgctgtatcaatttatggatcccagcaatatatgagtgaatttgtttttccccagcacctctaacatcagctattagttacttaaaatgtttgcttatttaatggacttaaatttatactccatttgaattttcagttctcttgacttccttatgtgttataatatttgccaatatgtttgcttaaccaatcctgatgacttgcatgtaacctcttctatttgtggttaactgtatattttgacagaatattagatgaggacattgagggatagacatttaaatgttacctgcctctggatttacaccagattaacaacagattgacatttagtctggtgactctttattctaagggcgtgctgctacaagttgctccttttgttatatcatatatactggaagtccccaaccaccctttcccaacctggccattgaccaataccagtcggtggcctgttaggaacagggccacacagcaggaggtgatcagtgggcaaacattacacccgagctctgcgtcctgtcagatcagtggctgcattagagtctcataggagggcaaaccctattgtgaactgcctatgcaaaggatctaggttgcatgttccttatgagaatctaatcccccccccacctcccagcccttgcgccctgcccttccccatccatggaaaaattgccttccatgaaacccatccctggtgccaaaaacacagggacactggcgaccactgctatatactgtgttttttgtgttggttgcctacattgctctcagacaggtccagtgaaaagaatgaaaggatggactcaggtaatgtatttgaaagcatctcaaagtataaagcatcattgaaacaacaaaccttattactgtgctgttgtcaactgtacagtgctatacgtcattcagacacaactaaccattattactatacagtttatgttacattttttgaaacacagaaatatctcccggtcataaataattgctttccttggctcccttttacagttgtggcctggctggtgatagaggaacataaattccttttagacagtagaggtttcctgaattgcctaagatcaattatagaacattatagacacaatttttccttaggatgctgttctttgattcccatcactgagcttaattggtcacagacagtttgtgaggaaactcattttttctattccttgtatttccagatggtccccacagagcttgttgagaaagaattttggagactagtaagcactattgaggaggatgtcacagtggaatatggagctgacattgcctcaaaggaatttggcagtggctttcctgtccgagatgggaaaatcaaactctcacctgaggaagaggtaggcatataagtggcttggaaattgaggtatttattgaaattctgtttggttggcttgaagtaacttatgattacttttagcaaatccttaattaccagatttttaatgatttcaagaaaagtagaaagagcctacagaagaattctagtcctaactatgtcactatgttgtggtcataggggaaaattacttatcatcctttgccttcagattttataaccttggtttctccttctgaagaaaacctgaaggcctgagaccaggtctatttattttcaaactttaatatttttgagtatttttttccatactagcgaactcttaggaagagttctgtttctatcttggtaggaaagtgtgatttttttttttttttggtagttttctttgaaagtattacatatgatcagaaaagtacatagttatatgtatacagactgatgaatttccacaagctgaacacacccatgtaaccagcactaactaaaacaagaaataggatattcccagcaccccagaagttcccttttcgcccgctctccttcactacttttcctctttcaggacgagcactatgccctcaggataatcactatcctgacttctaacactatagattagtttgcctgattttgaactttgttaaagtggactcatggcttatgttcctctatatatatttaaaaagagacagatacagaagtatgtgctgtgtgagtccatttatacaaagctcaaaactgggcaaaacgaatctctgggcatcctagaaggtcagcatggtggcccctcctcttccacatttctttttttattttgaaggataatatttttagctggccttctaaaacgttagcattgtatagctaaacctttatcctcttttgtcttcttatttttaggagtatcttgatagtggctggaatttgaacaacatgccagtgatggagcagtctgtccttgcacatattactgctgatatatgtggcatgaaacttccttggttgtatgtgggaatgtgcttttcttcattctgttggcacattgaagaccactggagctattcaattaactacttgcactggtgagaagttccaaaaagaacccatgagtagtatgcatgctggataggaaaactttccttttcagtgcagatgtgtcttaactgtgtctgaagagcattgaactacttttttccctaaggtttttcacttctgttagaacaggcatcctgacaagttaagacagtggttcttaagattcctagagcatccatgaattccctgaaattgcacacacactactttgcaagaacaacgtaattctgggggaagggtagtttttatctgaagtaaggaagtctttgtctaggccgggtgcagtggctcacgcctgtaatcccagcagtttgggaggccaagatgggcggatcacctgaggtcaggagttcgagaccagcctggccaacatggagaaaccccgtctttactaaaaatatgaaaattagctgggtgtggtggtgagcacctataatcccagctacttgggaggtggagggaggagaatcacttgatcctgggaggcagaggttgcagtgagccaagagaccgcaccattgcactcctgcctgggcaacagagcgaaactctgcctcaaaacaaaaagaagtatttacctatagaaaaagcatattctaaataaaagttacttttactatagaaaatcccatttggtggcagtgctagcctggatacccctttgggagaagcgtgaattatagtaggtaccacagtgtcctccaggtctgtgtaatgactagcctctcttttgttgtgttgaattcaggtatcactatgcacagtagagtgagccttatcttggtgtgcacattgagggggcaaggcgggagggatgtgcagatatttgggcttctttactttttaaactcttcaagccatttcttcacatctgttttcttctctatttttcttctaaatataaaaatatttgaaaatctgtaactcactcaaatcctcacacaaggaatttgaggatgtaccacaagaaagagaattggcatatatatgtatagaattaattctgcttccctaggcagtttctcccagctgtaaaatgaatattatatttaccatacctcgcagggatgatacagataaattgtttgataatttaaagtcctttgaagaataagaattccttagaaatgctaattgccttactagtgtttgatttaacttcgtctgccagaatgggcaagggaaaagaaaaatggaaagttgccttacccttgtgggttgctttaggaaactgtgataacaacatatcctgaagtgaatacgataccttatattcttagaaattctggatattggctgggcatggtggctcacgcctgtaatctcagcactaagctgaggcgggcggttcacctgaggtcaggagttcgagaccagcctggcaacatggtgaaaccccgtgtccactaaaaatacaaaaattagctgggcatggtggtgcacgcctgtaatactagctactcgggaggctgaggcaggagaattgcttgaacctgggaggtggaggttgcagtgagccaagattgcgtcattgcacttcagcatggacaacacagcaagactcagtctcaaaaaaaaaaaacaaaaaaaaaacaacaacaacaaaagagaaattctaggtgtctgcattttctaaagagtcagataaaaatgagagtggggagagggacttcagatgttcagatggaaagtcttctgttcatacttgaagggggaaaatgcattacatatgttcacatcacattccttttttgttttttttgagatggagtcttgctcttgtcacccaggcaggaatgcaatggtgtgatctctgctcactggatcctccacctcctggggtcaagtgaatcttctgcctcagcctcccaagtagctgggattacaggtgcctgccaccatgcctggctaattttgtatttttaatagagatggggtttcaccatgttggccaggctggtcttgaactcctgacctcgtgatctacccgcctcagtctcccaaagtgctgggattacagacgtgagccacagcacctggctcacattcacatttctaatgatatttcgtcagtttgtggattccttttttgcgtagtcttacaaagccgagtctgaaaaatatgaactggtaacccattttgtttgtgttggtgttgcagattgatttatttttataatctatttccaggggtgagccaaaaacctggtatggagtcccagggtatgctgctgagcagctagaaaatgtaatgaagaaactagctccagaactctttgtgtcccagccggatctcctccatcagcttgtgaccatcatgaaccccaataccctgatgactcatgaagtgcctgtatgttctgggttaatcctcctgccactcaagcttaattcaccacttctctttttcctttttattcacttttttatgatgttgatttagttctgtgttttccatagcatgacttgatagcagaaacagctgttttgctgcagtactgtacatttactcagtaggactggatccttagataccacaaaaactaatttgttgcagctgataactagattgctaaacagccttcctttgcaagtaataattgcaattcattggttttagtgtatttataagtgaaaatctatttcaaggtcttgagcttgtattttagggtgcccagtctgactgaaaagtctagaggttgctaaatgaagtgacaactatacagtcatgggaaacctaacaacagggatatgttctgagaaatgcgttgctaggtgattttgttgtcatgtgaacttcatggagtgtacttacacaaacctagatggtatagccaactacacacctaggctgtatggtgtaggctattgctgctgggctacaaatttgtacagcatgttactgtactgaataccttagatagctgtaacacaatagtaaggatttgtgtatttaaatgtatctaaacagaaaaggtacagtgaaaatatggtattataatcttacagatcaccattgatatgtggtctgtctgtgaccaaaatgttgttacatggtgcacaactatactggcttccttttggagaatactctgaagacatttgggaagccatattgaaatgtatgaagagtccatcttagctaaataaaatgtaaatgatacatttacagtgttaaagtgaacttgttgtgacctaaagtttatgcttttgggttcataggctagtcaatggagacaacagaaaggactttcatttgaggcattataaattatgcatggaccatagcttagaaagtaatcaccagtaagcaccacaatctcaccatctcctcatagttggtatttcttctcataatatttttctttcctcatgttgactgttttttccaatttgttaagagtagattgctttaattgagacctgaccctggttctttaataattgagcaaactttctggagttagattctggacctacagagatagatgaatgaactccttgtgcatttagggattcattatctgaagtaaaagataatgtttatacagataatacaagggtggtgtggtttgacagtggtgacaactatgagactgatctaataactctattgagaatcagaaagggctcttaaatgagatgacatctgtagtaggagctggaactctgataaattatcacatgtttggcagagtcagggaaggaggaagtattccaagtagaagatatggtgttcctgtgatgggtagtagtctttacacagaaccctgaaggccgtattactacacagatggctggtctccacccctagaatttctgatcctgttattttgttagtctgagtggggcttcaggatttgcatttccaacaagctcctagtggatgttgatgcttttgttctgggggaccgtacactaggtaagcattggtgtagaaatgtagatgcttgaaaaggaatctaatattattatataataataagctcagtataaggatttgtgtgcctagagcaatataggtacttttggggtgagggtggtggtaggaagaagggaatgatgggaggtaagtttgagttccaaatgaggaggacctctgtatgttatgagattcttgaaatagagtgggattgctttaattggtggtagaagatgctacttgaggggtaataataatatattaggatattcttaattgcagctgtttttaaaagttataccttgaaccttaatatgggcacatttttgttttgtgttcagatactaatcaactttggtagtctgggatactgctccatcttgtgacataaattagtatctctaggtgatattctactataataatttgttttttctggctcaatttcagaaagctgcctttttttgaaaattatctaatagactgtgtccagattgtctttagtaacaatgtcactctttaagaaactcaaaaatcttcaatttctgtctctttaggtttaccgaactaatcagtgtgctggggagtttgtgattacatttccaagagcctaccacagtggttttaaccagggttttaattttgctgaggctgttaacttctgcactgttgattgggtatgtaattacaatgtagttaaccttttcaaatttattgtttttcctgaggaaatggaatataatgttttaaagtgtcatgtgggctgggtgcggtagctcatgcctataatcccagcgctttcggaagccaaggtgggcagatcacctgaggtcaggagttcgagaccagcctggccaacatggtgaagccccatctctactaaaaatacaaaaattaggcgtggcggtgggcgcctgtaatcccaattacttgggaggctgaggcaggagaatcacttgaacccaggaggtggaggtcgcagtgagccaagatcacgccattgcactccagcctgggcaacagactgaaactctgtctcaaaaaaataaataaatgtcacatggatagttgccttgacccattactgctcagctggtcagtctgcaaattgtttaccagtccacaatgagataaagcacttgtaccacagtgtaaatcaagcatgaattacctaagcatactgcttagttcagctgatgttttttcttttgtagcaagactttgttgatgaagaatggagtctattgatttacattctggctgaagctcagtatctcattgcaaactgataaataattccagtctaaaggctttgtatagtactagcttacattatctgcagtacagcaatttaaggacacatttggtttcattagttgtaaagtttaatttttatatttgtattaatacttttcatttacctaaaaagttctagattaagtggtgttaaagctaatgaattataactttgttataatggcacttgctatatctatacttatttcccattaagtagtttttcagagtattattccctgaagtaggttgatcataccagttcagcacaattatttcaggaaatatataaggtcatacttctaattagattctacattgttgtagatactcatacattgttaatatgctgggtcttttttttttttttaaccactttttaattaagatatgtaagattacagatctttgggatgcaaagataaatagggcctaggctaggaattttatgagtctggtgttttgtttgttttttaaattttttcgagacagtctcgctctgtcacccaggctggagtgcagtggtgcaatcatggctcattgcagcctcgacctcccaggctcaagcaatccttccacatcagcctccagagtagatgggactacaggcgtgcaccgccacacccgactaatgtttatatttgtttgtagagatgggatttcaccatactgcacaggctggtctccaattcttagactcaagcaaggcttggcctcccaaagtgttggaattacaggtgtgagccatctacctggcccagagtctggttttagggttggtaaatgatacgtgttaagacccatagtgtgatgtttggtaatttgataataatgggtcagaggtgtttggaaatagaagaaagatgaatgttatttttttctttccgtgttttgatacagctgccattaggccgacagtgtgtggagcattatcgcttgcttcatcgatattgtgtgttttcccacgatgagatgatctgcaagatggcttccaaggctgatgtattagatgttgtagtggcttcaactgttcagaaagacatggccattatgattgaggatgagaaagctttaagagaaactgtccgtaaattggtaaggcttatggaaatccaactgcatgttgtcattgggtattatttagtaaaatttttacgcactttaatatcattttaagcagtctttttaaagcctattttctttgaggccattgtaatagatgtatagtagtatctcgtggttttaatttttattcactatcttatttgccacatgtacatatgtctctttgaagtagctgttcaaatgtcttgcccctttaaaaaaaatgttttgtagaaacagggtctcactatgttgcccaggctggtctcaaactcctgggttcaagctatccacccaactcaacctcccaatgtgctgggattacaggcgtgagccaccacacccggcttgccctttatttttttaaaacatttggtttttgtaataattctttatgtattctgcataccagtttttttttttttaaatcagataggtgttttgctaatgttttctcccagtctgtggcttgtctttgattttcctaccagtgtctttcagcaagcaggagtttttcattttgatgaagtccagtttgttaattattttcttgtgtgaatcatgtttttttggtttcctatttaataaatcttgcctaatccaaagttacaaagattttctcctacaaagtcatctagaatttcatagtttgaagttttacatttaggtctttcatctatttcaagtaatttttgtttttcaaaaatatgagtcaaggttcatttttttgcatgtggatatctagttcttccagcagcatttcttgaaaagactatcttttcttcattaaattgctttggcacctttgttgaaaatcaattcaccacataagtatgggtctatttctggactcttgtgttctggtgatctatgcatctattctattgctaatactaaatggtcttgattattgtagctttctaagaagtcttgaaatcaggtagtatgagtcttctaactttgttttttttaaaaaattgttttatctcttttactttttttaatgtacattttagaatcagcttattgatttctaccaaatcaattcctgttggaattttgattgagactgcatgaaactatggatagtttgggggagaattgatatcttaataatattgagtcttccaattcatgaacatagtataattttatattgcatgttttttggcactattataaattgtacttttaaaaactgaatttctaattgtttattgctagtatttagagagacaattgacttgtatattgaccttgtctcctgagaccttgctaaagtcacttaattcccagtagctttttcatggattcttttagaataataatatctgcaaatagtaatactgtttttttttttttttttaaaaatatgtgcctttttgggtagaatcctggaatattggctctctgcagcccatttacattttaacagcaggttacctaccttaccctcttatattttacagttgggggaaaatagtgcccagagggtttaagtaacttaccaaagtcttacatcaaaaatggtagctcatttttagaactctgagactttttccatatatggaatttacaaattaaaattaggtatgaactacatgattgattctcaattaaaatccatggagttggtccttaatcttattttaaacaaaaatgttaactttctccatcccatgaagtcctttttaatgaccaattcaagaataaaaccaaaatctaattagcattttccttaccttcctcatctttgttggcccatataattggcagatatgaaatagttaaaaggttaaaatacaggataacagaataaaagaaagaagcccagtagttcataaacgactggcattctcaaggctggattaggatccagttttagatagggagaaaaggtgatagaagtttggtctttaaatgacaaaaggtgtatccaagaagggttctctagatgttaggtggtacagattatgttgaaatttactggttcaagaccttatttttcctgacagtcttttaggaggaaatgtttaattatgactttagtctttgctattgcacaaattttctaactattcagttaatgatatcctttcatataacttcctgtaaaaggctgagagaccactcagcatcttcccaaactcaatttctgcacgatagtcttttccactcgtcccatcttctttccttttatttttgtccttttaatagattctccatatttcctcagaagtaggaaacatattcctttcttttaatcttatctatacctcttatctatacccaaaatgtggacaaggctaatttgtagtagaacagataactaatctcagtagttttacagtcctatggtgttcatactcagatcaaaatgaccaaacataaggacctgccttgtctgaaaaaggagatctccctagacaaatgaacttgcctgtatttgctaggtcatttgtttctttgtatgccacacatttttaatcatgcatccctattttggtaaagcttttttttttttttcagactcaagtactactgcatgtttgtcttgggctggtggattatattatcctttggaggtctctctaaagtatactttattctagggagtgattgattcggaaagaatggattttgagctgttgccagatgatgaacgtcagtgtgtaaaatgcaaaactacatgcttcatgtctgccatctcctgttcttgtaaacctggccttcttgtttgcctgcatcatgtaaaagaattgtgttcctgtcctccttacaaatataaattgcggtaagtaggaagaacgattttttttcctatggaaaacagttgatccttactaaaagctcaatgataccgcagttctagggctgaaatgttaagtataaaacatctagttttctccaaagctacacgtctcaaagctaagtgtggtggtattatttccaggtataggtacacgctggatgatctctaccctatgatgaatgcattgaagcttcgagcagaatcttacaacgaatgggccttgaatgtgaatgaagctttggaggcaaagatcaacaagaagaaaagtatgtgatacagaaagtgacttggtgattggcaaattggggcttattgtgatgtagccaaattaaagtcaacaaaacatttcttgaaacagcctgacctcatccttggttagcccctctacatagcccggtttacagagcaccggcagagaaggttttaaaaccaagagtggataaggcagttgcccttacatcccagtgaaattttgttatatgagttgtgcaacatcacttacttaacaaaaacgatattgttaggaaacctttatttttgtctcagaaataaaaatttcacatttcttacaaagatgttgaaatctttaaaaaaacaaaaacaaaaacaaagcatcttgtgacaaaggcagcatgacactaaatcaggagtctctgaaatggtagtttatcacttcttagttctaattaaagttaaggtccctggcacttgtcattacctttgaaagtcactgctaccctttatatctctctctctcttttttcttatgaaaatatagtttgttttttgctttttacttttcacctcaggggtatatgtgcaagcttgttacatagataaacttgtgtcatgggcgtttgttgtacagattatttcatcatccaggtattaagcttagtacccattagttatttttctggagcctctccctcctcctgccctccaccctccaataggctccattgtgtgttgttcccctgtatgtgttcacgtgttactcccctgtatgcatccatgtgttttcatcatttagctcccacttaataagtgagaatatgcagtatttgctttcctgttcctagtgttagtttgctaactaattgcctccagttccatccatgttcctgcaaaggacacgagctcattcttttttatggctgcatagtattccatggtgtatatgtaccacatttttctttatccagtctatcattgatgggtatttaggttgattctatgtctttgctattgtgaatagtgttgcagtgaacatacacatgcatgtgtctttataaatggaatgatgtatattcctttgggtatatacccagtaatggcattgctcggtcaaatggtatttcagtctttagatctttgaagaatcaccacactgtcttccacaatcgttgaactaatttacacttctaccaacagtgtatatgcgttcccttttctccacaaccttgccagcatgttactttttgactttttaataatagccattctgactggtatgaggtgatatctcattgtggtgttttttttgtttgtttttgtttttgttttgagacggagtcttgctctgtcacccagactggagtgcagtggtgcgatctcggctcactgcaacctccacctcctgggttcaagcaattctcctgcctcagcctcctgtgtagctgggactacaggcacgtgccaacatgcccagctaatttttgtatttttagtagagacaggatttcaccatgttagtcaggctggccttgaactcctgaccttgtgatctgcctgcctcggcctcccaaagtactgggattacaggcgtgagccactgcgcccggcctttcattgtagttttgatttgcatttctctaatgatcagtgatgttgagctttttttcatatgattgttggccatacgtatgtcttcttttgaaaagtatcttttcatatcctttgcctactttttaatgtttttttcttgtaaatttgttttaagttccttatatatgctggatattagacctttgtcagatgcacagtttgcaagtattttctcccattctgtaggttgtctattcactctgatgatagtttcttttgctgtgcagaagctctttaattagatcccatttgtcagtttttgcttttgttgaagttgcttttggcatcttcatgaaatctttgcctgtgcctatgtcctgacaggtattgcctaggttgtcatccagggtttttatatttttgggttttacatttaagtctttcattcctcttgagttaatttttgtatatggtgtaaggaaggggtccagttttaatcttctgcatatggctagctgttattccagcaccatttattgaatagggaatcctttctccattgcttgtttttgttagattagttgaagatcagatagttgtaggtgtgcctttttatttctgggttctctattctgttctgttagtctgtgtgtctgtttttgtaccagtccatttctctttcagagtgttttcacttgcttccatttctgtagcccaacacgtaactccacccgcttttatttaggggaaaggagcaatatcattgtctctgagtctcctgtgctctagtaactgagcacactagttactcactaactgcagaataaaatgcaggaggaagaagtggttcaagccacaataagatttatatttactttgctttcataagtcagttgttttcttctttttgtctattttaaacatgccaggtgttttttttttttttttttttttttttttgagacaaggtcttgctctgtcatctcaactggagtgcagtggcatggtcgtggctcaccgcagccttgaaatcctgggtttaagtaatcctcctgctttagtttgtcaaatagttgggactacagttgtgtgccaccatggctggctaagttctttaattttgtagagaggagatcttgcttgtgttgaccaggctggtgttaaactcctggcctcaagtgatcttcctgccttggccttgcaaattgctgggatttacaggcgtgagccactgtacccgccctaaaacatgtcaggtcttagcatttttatatttaagttcaactctaggcacttgtttaaaaaactccgtgttcagccaccaccctgcaaaaatcaaatcaacaaatttgttaataatttaaagcattgcaaacatttgtaagttacatttctagacaagaactgacaaaaccagtctcctctgaatttcataccagtagtaataaacataatgattacagaaaatatgacttttttcttcattcctaggccttgtcagcttcaaggctttaattgaagaatctgaaatgaagaaattcccagacaatgatcttttgcgacaccttcgcctagtcacacaggatgcagagaagtgtgcctctgttgcgcagcagttgcttaatggcaaaaggcaaactaggtatgcgcttctgactgcgtgagtttggattctttggcacctatgtttggaaacctgttgtgactcctgtcttgaatttctgtgaccacctgggtgtggtggacatgtatgtattcttatatggcttccttgggcctttgtctttacagatatcgatctggtggagggaaatcccaaaatcagttgacagtgaatgagctccggcagtttgtaacacagctgtatgctcttccatgtgtcctcagtcagacaccattactaaaggtaaccatagagggatgtgtgggagaatactttggtaatcctgtattttgtatataaactctattgatattactaagtaatcttctttgatgattaatatgtacatttatttgcagatgcttttaataacctattgagtggtatatgtatataaagagattatagtagatccacagaggggaaataaagttggaaatttttactttgaaagtgaccttggctgggcatggtggctcacacctgtaaccccagcactttgggaggctgaggaggtggatcatgaggtcaggagttcaagaccagcctgaccaatatggtgaaaccccatctctactaaaaatagaaaaattagccgggcatggtggtgcatgcctgtagtcccagctacttgggaggctgaagcaggagaatcgcttgaacccaagaggcggaggttgcagaaaaaaaaaaaaagagaaagtgacctcagctagtttaagctgggataaggtgtctgttatagtcacttagtatttgctgttagttggcttatgtgttatcttatttacctatattattactaaaattaaatgggatctcattgaatatgaatttaagattctaagtttgaaagaagccaattactgaaattactgttttaatgcaacaacctgtgtatttttttttaggatctcttgaatcgtgtagaagattttcaacagcatagtcagaaactactctctgaggaaacgcctagtgctgcggagctgcaggacttgctagatgtcagctttgaatttgatgttgaacttccacagcttgctgagatgcgtatccgtttggaacaagcccgttggctagaagaggtgcagcaagcttgcctagaccccagctcccttactttagatgatatgagacgtctcatagacctaggggtagggctggccccgtattcagcagtggagaaagctatggcccggctgcaggaactgctcacagtgtcagagcactgggacgacaaagccaagagtctcctcaaggccaggtgaaaaagcagacttctctttctttgggaaggttggacagttatctccagcttaaacacagagcacaatgattggtctatggcaagtgctcagtagctgcggttattatgcatgtggaagacatgtagaaatagctgagatatttggagctgctttgggacctgagtaaaagaatgttaattttttcttattttactgattaaaaatgaataattcaattggacacaccttttctagagttggtttaatgaaatttccctggatcctgttaatatcgtgtctttgagagaggaaaatatttacaaataggtgaagctgtttaaactcacagttaatacggttccaaggagtcttaaagagaaatgtgtgagagttaataggcactgttctgcaagaaaacagtgcagataattttcaacaggaatagacaatgtcatttgaaaaaaattatttgccatactgaatttcctttgaaatgctagtttttttggtaaccataagaaaaatgaaccatcatataaaatgctaagaagtctttgtttgcattttgtaggccacgacattcattgaatagccttgctacggcagtaaaggaaatcgaagagatccctgcatatctgcccaatggtgcggctctgaaagactcagtgcagagagccagagactggcttcaggatgtagagggcctgcaggttggttttaaaaagtatatacagaatgtgtaagtgcatccataaagagcaatattggcgccccgtccgggagggaggtgggggggtcagcccccgacccggccagccgccccgtccgggaggtgaggggcgcctctgcccagccgcccctactgggaagtgaggagcccctctgcccggccagccgccccgtccgggagggaggtgagggggtcagccccccgcccggccagccgccccgtccgggagggaggtgggggggtcagacccccacccggccggctgccctgtccgggagggaggtgggggggtcagccccccgcccggccggccaccccgtccgggaggtgaggggcgcctctgcccggccgcccctactggaaagtgaggagcccctctgcccggccagccgccccgtccgggagggaggcgggagggtcagcccccaacccggccagccgccccgtccgggaggtgaggggcgcctctgcccggccgcccctactgggaagtgaggagcccctctgcccggccagccgccccgtccgggagggaggtggggggggtcagccccatgcccggccagccgccccgtccgggaggtgaggggcgcctctgcccggctgcccctactgggatgtgaggagctcctctgcccggccaccaccccgtctgggaggtgtacccaacagctcattgagaacgggccgggatgacaatggcggttttgtggaatagaaaggggggaaaggtggggaaaagattgagaaatcggatggttgccgtgtctgtgtagaaagaagtagacatgggagacttttcattttgttctgtaccaagaaaaattcttctgccttgggatcctgttgatcggtgaccttacccccaaccctgtgctctctgaaacatgtgctgtgtccactcagggttaaatggattaagggcggtgcaagatgtgctttgtttaacagatgcttgaaggcagcatgctcattaagaatcatcaccactccctaatctcaagtacccagggacacaaacactgccgaaggccgcagggtcctctgcctaggaaaaccagagacctttgttcacttgtttatctgctgacgttccctccactattgtcctatgaccctgccaactccccctctgcgagaaacacccaagaatgatcaataaaaaataaataaataaataaaaataaaaataaaaaaggcaaaaaaaaaaaagagcaatattggaaagttgtgaagaataatacgttggatcttgctgcacagtttcagtattttaggggttgaccagaagactaattctattcatacttatttggatgtacttaccagctattatcctgaccagttgtctcaaatatttaaagcttagacagtgtcaccaactttttctgggagctggggagtctttcataacaaacttgagtacttgactgcagattgaagcaaaagagctaacaatgaagtagtgagagaaagtagttttctactctttgataagtatgattacctcttgttggcttgtccacaactttgaagttcagacaatcagtaatagcaaattcagtgaatctagttatatgactaaatgcccagctaagccccaaggcccagaattttcatgaagtagtgacttaaaagtaccctcccaaccctacaaaagaaataaaacctacccagttccaaagtaattatccaaagtatccaaagtcatttccaccaagtatttgtggttttatgctagatgttatacttattgacctgtatataagtttaaaaaaagaattaaattcacttgtagcattgttaaggtacaaaaagaattcattctttaatatgattttcccagttttcagacgactggctgaatgacttaatttgaaacgtgtttgatgggggatgtcttcccttatctcttatcatcataaaccaataggtgttactgacctattgagaaaaaaaaaagtctcaagttctattttgttgaagtcctcaaattctagaaataaaatacgatctggctttctgaatatttgtgtaattttaagtggtgttaattggctaattgctaacaagaaataccaaacaggacaattctagacaaatgtttgcatctgttcttgttaatagggaaaagaagatatattgtttgaggagattacataattaaggactgactccagcaagccaaaaacaaaaacaaaagtatttactatggacataaactttgttaatgagagttttagatgcaggcacttgtcaatgatagttggtattgtagtaattagttttagttatggtcctcctttttactccatgattgctagcagccagaaggtgaagtcatggcagtaaggagaggctgacatataaaatcagaaagcaagggcatgcttctggatgagtttatttccttcatattttatatgtatatgctacttactatgtttgtaacagtgccattaagggcaaaaggcaagttttttgcttcattcctgaaaaagtagcctaccttttttttgcatcatatatttaaggactgctacacatgactaacaacaaggaactacttcctatttagtggattatttaaatgttatgcagtattctgctttacacataggaagcactcggatttctaaattaaatatcataggaatagcattaatttatgagtcacattcttaagtgtccatcagaacatttatgccctaacagatttaattctgtaagaataaatatcaaaggcagcaaaatatcaacctacccagtcttccctagttgtcccaaaaatgtcccttatggctgtttgtctaacccagaaacacatgttgcacctaattgtcatctctttaagtttcttttaatcttgtagcgttttcctccccaccccactttttctcatgtcactgactagacagttatcccatggtatgctccaccttctggatttgtttgattgtttctttgtggagtgttctgttctctgtatttcctataaattggaagttagttttaaagccctggtgcatccaagttaaacatttttttaatataatgcattaaaatgtcaggtaatactgtatattctatattgcatcacaacaggagatatatctggatgacctaccattagtgatgctaagttttacattgtattggagcaacaccaatgcatttcatcctccataaccttaatgcttttactctcctagtttggctatctctttctaaaaatacagttcccagaccagcagtattagcatcggcaacagcagctttacctgggaacttgttagaagtgcaaatttatggaccttcctctgacccactgaattagaatatttggggataggactaaggaaactgtgtttaaacaagccttccagatgattcttatacatggtaaagttagagaaccactgggctgtctcaacttatattttagtttcctgaataatttatattgagttgctttaattaatcattggtgagtggattggggtaaaatattgttttgttgccttttatttgtgtaattcagtatgaaagtcttgagttactacaaaccttcatttctgttgaaatttttttcaaactgttaataggaaccaatgagatgaatgaatttagaagggtataaatagaacaaagggaccacagtatatgccatgttcacatttgtatccttagagcctagcacaaactaggttctctaggcccagcacagtggctcactgtaatcccagcactttgggaggccaaggtgggaggattgcttgaggccaggagtttgagaccagcctggccaacatggtgaaacaccatctctactaaaaatataaaaattagttgggcgtggtgatgggtgcctgtaatcccagctacccgggaggctgaggcaggagaattgcttgaacccaggaggtagaggttgcagtgagctgagattgcaccactgcattgcagcccaggcaagagtgatactccgtcttaaaaaaagaaaaaaaaaacaacactaccaccaccaccaccaacaaaagacccaaactaggttctctgtttgtgtaatgaaggaacaaatgtcacttctacccccaatatcattggtcagctggcaggttagtcagcgtttgtgaatttagcatgttgagatcatggagtaatctgaagtactcaatggaccaatctgaattaagcttttcctgtttttcatagaagtgttcttttctctaaactgctgtaatttttcttgacttattaggctggaggacgtgtgccagtgttagacacactcatagaacttgttacacgaggccgatctatccccgtacatctgaattctttgccaagactggaaaccctagtagctgaggttcaggcttggaaagaatgtgctgttaatacattcttgactgagaattctccatattctctcttagaggtaagtttacaaccagctcatctgcaagaccttagatctcctagtttggtaaaacatgcagttcatcacatacaaagatgacatcacagattaatctatattctgtgagttgttcttcccgtaaagccagggagactcttctaattttctggtgaagcaacctttaaatgttttcttggttgatttagcataacagtatctaaagaagaaaattttttcctattgggtgaaattcctctgtgttgaaattggactcttaaacttggccgtgcttcgcccacctgaatttagtaagcctgataaatgatctcccccattttttaaaagtgctttaactgcactttttgtattttctgtaaacttgcttgtgcatcatgactgggatcaaccagtatatatcacatttttaacttgttacttaattgaataaggaatcagtctatcttttatgagtcttcctcctccttttgtaaaggagagcctcagggttgcatgttccaaagaaaatcttcaatactaagaaatgcacatcctttttactgcttaggcttttattttgggacttcctacataatgctttatctgaaatttattttaccattggttgtgccttgtcccacattaggtgctgtgtcctcgatgtgatattggccttttgggattgaaaaggaagcagagaaagttaaaggagcccttgccaaatggaaagaaaaaaagcaccaaattagagagtctgagtgacctggagagagctttaactgaaagcaaggagactgcttcagctgtatgtagggtttttttcttctcctttctatgttattgggaagaataatttctaaccctttctgttttataggaatttggagaaggcaagtagagtaacttgaaagcgttcagttttactaaaaagactttttgaaaattgtcaagtgttaagagttttgaatggtaagatgcatagaggtgggaaagattcagggtaggcttcccagtctcagggtcttgcaggcacagaaacagtcttgtttagtgcctgtgggttgatccaggaatgctaactaaagatattgagactaatattaatagatgtatgaaaatgcaatgctaatttattagtttatagttaagaagtacatttaaaagtttactggatactttgatactcatctggaataccttacatctctgacctgcatttagtaaatactgttgattcaaagatgatagtttaaagaagatgaggcaatgtataactaatgttacacattaagcaccttatcgggataaaaaagggatagctatgtgatgcttttaatggcacaaagcattgcccgttctagagtgggaatgtatacctgctactgggactagattgaatgggttcatctgtggatctggacaccttctcccattgatttctttgtagctgccagacctcttgtgatagacatgggttgccttgatttatttaggtattttgacacagatgttcttagtgtatattcgtatattcagtcaggttctagacagaattctgccatcagaggtcctccattccatctgtggtttgtttttataaagactaactgaaagttacagtccccctctcctgaggtgtatatatgttggtttgaaactttatatgcagtatcttttgtagattttagtctgtccatctgtctgtagacccctggttttaagaattctccctacgtattatctgttaatttatggtagaactcaaaggttagtcatttgctttccatctctaagctgtcagaagttaccttgttatcatataacccacacatattacctgtgtattatatttacaaaagaagtggatttttttttttttttaatatacccaaaggtctttacctgatttgcttttaggctttttttttttttttttaatagagataatggagagtttattctggccttgtaagggtgcttcatctggtgaatcgtgatggatctgaaaggggatagatgtggtgattggaaatggttttttaactgtgacagattttttgagaacttgtttactatgtgccaggcaaagagtgtcctatcccacatctcttacttgtcatctcaccctgtaaggtgggcactattatcacctccattttacacatgcagaaatttagccacaatggaatacatggcaccaggtcactcacagcttagtatgaggcagtcaggatttgaatacagatgatctactcaggatcccatgctcttaaccactaggactctgagttttaggggaaggccaagccatctcggacatcatccttgattgttaactctttttcagatggcaactcttggggaagctcgcctaagggaaatggaagccttgcagtctctcagactcgccaatgaagggaaattgctgtcgcctctccaagatgtggatataaaaatctgcctatgtcagaaggccccagctgcccctatgattcaatgtgaactctgcagggatgctttccacaccagttgtgtggcggtacccagtatttcacagggcctgcgaatctggctttgtccccattgtcggaggtcagagaaacctccattagagaaaattctgcccctgctcgcctcccttcagcgtatccgagttcgccttcctgagggagatgcacttcgatatatgattgaaagaaccgtgaactggcagcacagagcccagcaactgctttcgtcagggaatcttaaatttgtgcaagatcgagtgggctcaggactgttatatagcagatggcaagcctcagcaggacaggtgtcagacacaaacaaggtgaatctggactttccttgttgggttattggaatttgcaaagctctgtacctttctctcgaacctgtagctttggtgttgctattcccttggtgtgatcactttactgttaacagcacccactttacctgtagcttcccacttcaagaccatgcaggtataacatattcttttaatttcctctgctcctattagaagttgtttcccaggcactctttctatagagcacatatttagcttttcacagatacaaataattttttcatttatatgtatgctgacccatttatattttacatatacgtatatgatgtatctttaagtctttgcttgactaaaaagttttttaccctgcttcttctcatgtaagtcaattagtagaaagggaaaacacttcctgccttttatcgctttttgccctttaagggaaaatattttttggaagaagtgtttgagcactgtgttatttcagaggaaagctcctgggttacacaccatttgcgatctttctgccaaaagctggattcttttgacatcactggatgggcagagttttctgttatcttccataggtggctgcagtaaaagaatgtgaagacaatagaaaagtacaatcaggaagacagtattcaatctttatgaggttaatctgatggtttttaaagttggtaaacatctctgtaccagagataccacaactctcttgtgccatatgagcacagacacatggattatatgagttaaattgttgataagatgaagaccaaacaaaaaaaaaaacagtctgtcatatttgtttccttggttttttatttctttgcaggcttctgaaatacagtgcctgacacatagatgatgaattaaatatttgttgcatagatgagttgtggcatttgtgcacactcccaaagtggagtcattggtgttctttacccaggatgtgctaggagtttacctttcttagtaaagggaaaggacacaactcttatattaattcatggtcaaaggagtgtttcccctagctcctttaataaaacactaaggaagataggaaagtggttatggatgatttctgacaggtcctcatttgatttactcaaaggggtacatatgtgttcatcgtattttaatcttcaataaggagaattagaaaaggattaaaaggctgtatgatctgttctcacactgagaaagtggcttatttcccagtggccttctttacatctctgaaatcagtccaagtaaaactggaaagattaaaggcttggtctttgggaagatatgagttgatttggccagttctgaaatgccaggagactcttcagtaggggaaaatcaagttgtttttttttttttttcccctggttgcctgcctgggtaatgcaagctactgtcattggactaatgggagtatttttaatcctgaagagattttattataaaacgttttccctccattaggtatctcaacctcctggcacaacatcattttctttgcctgatgactgggacaacagaacctcatatttgcactcccccttctcaactggacgaagttgtatccccctccatggtttgtattttgttattacgttgagggctggatagtaatgagtgatcttgtattactaggtttttattatagatgatcaagtaccataaaaaggactttatgctgaaatgtaggatataggctattatgtatttgcaaaatagggaagggatcctatttgaaggcttataaatgcaaaggaacagagaggaagactttatatccattgtcctcagggatgaaagggttcatgccacaccagctgataaacaccaagcttttaagtcagatgctaagtcatgggctctcttgttgcttcattacttaggagacttgtggagaatcttagggataatccacatttgctagagtcctgatccttagtcatagcatctcagtgtatgtctagtaatgtggttagagctccttgatctactcagactgttgacactgtggccatcagtctgtttctgtgctttctgttagaagtcatcaaggcagaagtacaatctcttctgcattagcaataaggtaaatgagaagaggattcagtgtataattaatactagtaatcagaagacttaggaaatctagttttggctctgtttattatattgtggctttaggcacattaaacctcacttcaactgaaggtaatttgtaatttaagaaggagagggtagtagtggtattaggggcagtccttctatttgtctcataaacccaaatgtgaatgtgaaacaccctttgttgttatcattttgatttggtctggtcttttacaggtgttagtccagaagtgaatgaactattgatggaagcccagctgctccaggtatcccttcctgaaattcaggaactttaccagactttacttgcaaagccaagccctgctcagcagactgaccgaagctcaccagtgagacccagcagtgagaaggtgagtgtctgagaggcttctggggcaaggcacagtctggggtgggggtatgctttattttactcctcgaaacataaccagacagctggtgtgaggactgggcgattagactgaggatgacccattttgaatgctgacttagttgaaggatactccttaatgtcctgtttcttaacatagttaaggatactgcggctgctgccacttccttctagtgaactaactgacccatcacatttaaggcccctgagaatatagttaggatagaaatctactaggaagcctgaagccaaattagggaagaacttcactaaagatagcatgagggctgatgttggcatttagaatttcatttttcatggcaaatttcatttgccataccaagtagtatggcacaatcattgaatgtgttcagttaatgcgccttacacctataaggtgtgggggtgtacatccttcaagaaggaagattattagtgtggttcctcaggagcctgtaggtcacaggatagacataaacacctagacagaaactattatagtagttagtcattcagggatttggtgaaaggaagactcttagtgggcacctctccatcttctggtattggttggttaattggaagggtaatcacgtctttaacattcctttttccagtgatcctttggtagcattaacagtgataggggaaggaagtatgttaaacccaaactggttgtcttatacaagactgggaggggagtggttaagatgcagtatttttttcccgtgtagattgggggatcatctgatttctaatttacatgttctctttagcttcattagttttagtaataggtgacccataggcgaaaattgaactttcctatcttccacccagaatgactgttgccgagggaagcgagatggaattaacagtcttgagagaaaactgaagagacgcctggaaagagagggcctctccagtgagcggtgggaacgagttaagaaaatgcggacccccaaaaagaagaaaatcaaactgagccaccccaaggacatgaacaatttcaagttagagagagagcgtagctatgaattagttcgttctgctgaaactcattccctgccctcagacacatcctattccgaacaggaagactctgaggatgaagatgccatctgcccagctgtgagctgcctgcagccagaaggagatgaggtcagtgaggtttgggccatagaggacgtgctttcccttaactcagaaaccctgtaagctagacctcatctcgctgggtctttctcctctgcttatctgctttgagctgatctgaatggattgctcagcccttcccccactgatatctgtgctcttaccatcgttcctgggtctcctcccttttcttgaagaaactcttgttcttccctttttccttttcttgctcttccagctttcaccttcccggcgctaagaaggtgggagggatgctgatgtgatgccctttggcttacttatcacagggcagcgctgtcttaaccccaaagcagacacgacttgaagaatgactttgactcggttgctttggctagggggccagctacactcatttggcttagctgttgtgccagaggtcccagtggtgggacagtggctgttattggcaaacggcctgaatttcttgaggctggcctgcccaattttgaatccattttttcctctgaaaaccccatcttcctgctctttgtaaccaggtggactgggtccagtgtgatggcagctgcaatcagtggtttcatcaggtctgtgttggtgtctccccagagatggcagagaaagaagactacatctgtgtgcgctgtactgtgaaggacgcaccaagccgaaagtaaaaacacaaaaacagatacccccctacttaatgtaattcaggactccaaccaagaggatttcttcaaatctcagcaaagctacaggactggtactcaagccagcctgtaaacggtgctatttctattccttatgggatcatttttccaggactctttgaagaaaagaaaaaacaactaaaaaaatttttgacactttttgtattttttccttaagagctatttgtggttgttgaggtttgaaaagctgactgttttttttgcaggggttcccaccaatttggaaggcattgaagcttgcaccttttcatgtacagcattaaaattttacctctctctgggatttaccagcttaagagtccaactcacttccagtgcccaaaagggcacccaccagaaattccagtaaatcctcatttgaggaagctctcccttgtttactctgttaccacattggggaaatttttaagtttttcactttgggagtttttgtttgtttcttcttttcctttatccacttttcttcttcctggtagactaggtttatttatctgagcaataacttctatgttggtttcagtggctggaattaaaacaaaacaaaacaaacttccaaacagtgtgttggtgctttagcgattgattgatgtacagaacacaaatgtctagtttctagtgtcactgatgaactagtgatgtagaaaagagacttctctgtaagtaattgccacagctgtattttggctttctccctgtcccttcctttctcccctattttttggtagcttgtatcaaatgttacagtttatattgtggaataaatccttcgtcctaacataacactaaatgctgattatttagagccattagagcacagcttcttctgcccctctactgttgcacagccagaaggggctgcttgcttttgcctctgcccaaccaggttgcagtagcagtggatgttagcctgcaaacaacattaggggattcttcttttgtgtcctgctctgtttggtgggccatatgcctacagccctcactaacaaagaacccctctgtcttcaaggactagaacctatctttaaagccgtgctcttttaaaataagctttctcagaatgttggcaaatcacttcaatcctcaaatcagtcttccttgtggaatgctgcctttattatatttgaattgacaggggaacttggtttagggttaagacgttggaaggaaatctaaggaaaattaatcctcacagaggtccgggtttagtatatgtcttgagaggagacttgtgaattcccagactctgcctcctggtttcctttctcatttctttctaactgtagctatcattactggctgtggatagcccatagctattttccttgcttttcttttttaaaggggtctgttctgcagtggagaagacattctggtgaccagacttttgcttaccttttcctattctgttgccaatttttgttttccccacattctatagccataaacctgaagatgagtaaaactggtgggtctttaataaaacaacaacaaaaacagcagtttgtgatatagcagaggtttaaatgtaccctccccttttatgcacttcaaataattaaatctctttaagaatga

SEQ ID NO: 35910 - DNA, 26186 bp, Homo sapiens
gtgacaagcgctgccggccgcggtgtcttcttcgtgccggcgtcgcagtggccgggcctcttgcgtctggtaacgccgctgtctctaacgccagcccttggcgcccgcgccccgccaccgcagcgcccggcagtccgcggcccaaccgccgcccgcgcccccgctccccgcaccgtacccggccgcctcgcgccatggcggcccccggcagcgcccggcgacccctgctgctgctactgctgttgctgctgctcggtgagggggtcgaggcggggcctgggagcggcgggaccgggcggagccgaggtccctgggtcttgagggcgggggactgccgggtcgttgtcccgcgggtcgccccgcacccactgctcctggtcccggccggctctgcccgcgggcgggtgtttctctcggggtcgtagggtcggagcggagctcaatggcaggtgcttgggggaccaggaggtctcatcccaggacctggctcctctaaggtctgtctcactgaactcagtttttctgtggtggtgagtgcgaaagggaacttccgatggcttgctcggcggtctggtgctttcaggtcgttaagtttcctggcaagttgaggcggtgagatctagacgaggctgcgccgccgaaggtggcagggacgtctgtggtctcagctcccgggtgggtgacctagatcaagctcttcccaacatggatttcacccaggacagggagaagccggtgcgagcattccccacctttgtacttgaacctttctcctctttcagcggtgtggaggagatgcgagtgtatttatgttattgtgaattcacatgtatgttaaaataatttttaaagttatctttgggatttcacaagattccgtagtagacaagatgagggaaagctggcctcagactcacggtggcaatgttcatgtctagtaagtagtttaaagagcgccgttcctgtaggccgaaatgcgggaccagggaacacgtggggaagcacccttctcttctgtcagtttatagagctcagatgggcagtaggtgctcaatattgtattgactagtgaatttcgttctcatttattgtcttaataagaggatgtgtgctgtctctttaagacagtccggattgccccccgccaacactattctttcacctcctccccccgccgccctcccccgtaatatgagaagattatcttaaatgccaggatctgaaaggtgatgtagaatcaagctgggggagtgtgtgtgagttaagtagatatagaaatacactcctgtacacatctgccttgacttctttaaatccctcagtcccatccagctgtaaaactctgttactgtgagtgaatggatcttggcttcccttttttgttttgcctgttgtgtaaaatgaattctttgaactgcctgaatagccacagagatgaacttattccaatagtaagcctgaagccttgctcagctcctgcgacagggtcaggtgtagttaatgaaaggagttgcagaaacaagttttgtcatgtcacagcaactgcattgttctttgttacagatgctcacaagcctcataactttgatgttttgtttcatgttttaaaaactcacttcaggccgggagcagtggctcacgcctttaatcccaacactttgggtggccgaggcagatggatcatggcgtcaggagttcgagaccagcctggccaatatggcgaaacccggtctctacaaaaatacaaaaattagctgggcatggtggcgcacgcctgtaatcccagctacttggtaggctgaggcagaagaattgcttgaacccgggaagcagaggttgcagtgagctgagatcaagccactgcactccagcctgggcaactgagggagactccgtctcaaaacaaaaaaaaaattaactttaaaaatgaagagaaaaaatccataactccctaatattgtgattggaatattgcttgtgtaatcagtcttctaagatctgttccattatatcttttatgtttacaatcttaactttttttttttgaggcggagttgctctgtgcccaggctggagtgcagtggcacaacctcggctcactacaacttctgcctcctgggttcgagcaattcttctgcctcagcttcctgagtagctgggattacaggcacccgccactatgctaggctaatttatgtatttttggtagagactaggtttaactatgttggttagactggtctcgatctcccgacctcgtgatccgcctccctctgcctcccaaagtgctgggagtacgggtttgagccaccgtacttggcccaagaattttttttttttttttttgaggcagagtctcactctgtcacccaggctggagtgcagtggcgtgatctccgttcactgcagcctccgcctcttgtgttcaagcagttctcctgcctcagcctccctagtagctgggactacaggtgcgcgccaccatgcctggctaatttttgtagttttagtagagatggggtttcaccatgctggccaggctggtctcgaactgacctcgtgatccacctgcctcagactcccaaagtgctgggattacagccatgagccaccgtgcctagccaaaatccaacttttaaaaaaggccttttaacaacttgcatttaaagatatttaaaatgtttattttaatgtgcgatttcaccaaaaatccttttttcttaaaaaaagaaactgctcaattacaaatttccactatattaataattaggcattgtttaaagctactgtgtttgaatacttagaaagctcaaacatgaactgaaacttgtcctgatagataggattagctgtgattgcgtaatgtgaccctttaaaccattgatgtcagcaggatgaccgccttaccctttccacttgaacaactgtcacttaggaggtttgaacaattttatactcggctgggtgcagtggttcacgcctgtaatctcagcactttgggaggcccaggtgggcggatcagctgaagtcaggggtttgagaccagcctggccaatgtggtgaaaccccgtctctactaagaatacaaaaattagccaggcgtggtgtggtggcaggcgcctgtaattccagctacgtgggaggctgaggcaggagaattgcttgaacctgggaggcaggggttgcagggagctgagatcgtgccattgcactccagcctgggcaacaaaatcgaaactcaatgtcaaaaaaaaaaaaaaaaaaagaaaaagaaaagaaagaaaagctgggtgtggtggctcatgcctgtaatcccagcactttgggaggctgaggcaggccgatcactaggtcaagagatcgagaccatcctggccacaacatggtgaaactccatctctattctttttaaaaatatttttaaaaagttagccaggcgtagtggcacaggcctgtagtcccagttactcaggaggctgaggcaggagaactgcttgaacccggaaggtggaggttgcagtgagccgagatcgtgccactgctcttcagggcaacagagcgagactccatctcaaaaaaacaaagaaaaaaattttttttctactaaccgatgttacctttgattgtgcagattgtcagttatgcggtggaaagaatgaatttgtcagcagatttgaggtcagaatgtctttgtagccctgtaattttgaatttgtattgcattagccccatcccagacaacgttaccctttcttctctgtacccaagacttttattgcatgtgcttctacatggtaacatctgttcggctgcactgggattatttttgcctgtgtatctcccttccttaactgacaggtagtaagtgctgagtacatatatgaagaaaggatcaattttatagcagtggctctcaaccaaacatatgcacggatccacacgatcagctttttagaaatatacataccacagcgaggcacagtggctcatgcctgtcatctcagtgctttgaggctaaggcaggaggattgcttgagatcagcctgggcaacatggcgagaccagtgtctctacaaaaaaaattaaaaagaaatatacggccgggcacggtggctgtcacgtgtaatcctaacactttgggaggccgaggtgggtggattgcctgagctcaggagttcgagaccagcctgggcaatatggtgaaatcccatctctactaaaatacaaaaaaaattagtcgggcatggtggcgtacccctgtagtcatagctacttggaaggctgaggtaggagaattgcttgagcccgggaggcggaggttgcagtgagcgaagatcatgctactggactccagcctgggtgacagagtgagactctgtttccatttaaaaaaaaaaaaaaaaaatatatatatatatatatatatatatatatatatatatatatatatatttacacacacacacacttataccttgcctctagaggttgtgattcagtgcctgggatggtatttttttcctttagttcttcataaatgattgtgcatcattggttaagtagaataaaaataccatatttaaaagaatcaagccaagaaaaactaagatgtgatttcttttttttttttttttttttttgagacggagtctcgctctgtcgcccaggctggagtgcagtggtgcgatctcggctcactgcaagctccgcctcccaggttcacgccattctcctgcctcagcctcccgagtaccagggattacaggcatgcgccaccatgcccggctaattttgtatttttagtggtgacagggtttctccatgtttggtcaggctggtctcaaacgcctaacctcaggtgatctgcccacctcggcctcccaaagtgctgggattacaggcggtagccaccacacccagcctaagatgtaatttcttaataaattgttttttcttctttttttgagacagtctctttatgttgtccagtctggagtgcagtggcacgatctcagctcactgcaacctccacctcccgggttcaagtgattcttctgcctcagcctcccgagtagctgagactacaggcatgcgccaccatgcccgtctaatttttgtatatattttttagtagagacggggtttcaccatgctagctaggctagtctcaaactcctgacctcaggtgatccgcctgcctcagcctcccaaagtgctgggattacaggctgggattacgggctgtgcccggcctaattttttaaaatgaagttttttactcatttcttcagatggtaatctttaatgtcaaaagcgagtatttcttaatttttatttattttaattcaaaaaaattaaattttttttttaagagacaaggtcttgctgtgttgaccagcctggtctggaactcctaacctcaagcagtcctccgcttcctcagcctcccaaagtgctgagattacaggcatgagccactgcacccagccagtgtttcctcattggaagcccgttccctcagtcatcaagtgctggagaggcagcgtggctcagaagtggcacgtcctgtgagtcagaagaccccttctagatctaggtctccgccactcactagctgtgtgacctgggtgggttagttgacctctctatgccttaatctccctatgaagagttgtcatgataactgggatgtgcttagagcagcacctggcacaaagtaagtgcattccaagtgcttgttaaatgagatagtttttgatgttttgtgtcagatactgaggattgaatgatgaacttgatgggaaccctctgtacctgtgcagatgtttaataacagctgacatcaaagctggcgtcagtgccgggcaccaaatgctcagctgctccgacagccctgaggccttggcactctctcctcctgctcgtgggtgcagagactggggattgggctctgctactggccatggttgcacagctagtaagtgctgcaagaacctccaagaactgagggctgtgactcagaagcacgcatgcttcccacagcggcacttgtttcagagaacagaatttctcccaagtgggggtattttgaagccacagttactcctttatgtgatccctggagaagtggtcctgttcgtgtctgagtacaggactgccggagatagcagtcaccagtaggccagggtgcccaccttggagatgctgccaacggctgtcctgttgggctgtgacacctgtcaggttactggaaacattgtaacttacttgaggttttttgtctttttttttttttgctacccagttgccactgttgtggaggtttttaaaaaaacttctgacccttatagcatacatacatttcctcctcaagctctgtgtgctgatgctcttattttcttctataccaaaattgccttctgagggtaagtttattttaataactcaaaattcctgggtctctccagagtaatacaggcatcttgtgctgccaaagcttactttaaatttatttaaatgatatttctttgttttcctctgaaagctgagacctggctgggcatggtggcttacacccataatcccagcactttgtgaggctgaggcaggtggatcacttgaggcgaggagttggagaccagcctggccaacatggcaaaaccctgtctaccccgtctctactaaaaatacaaaaagtagccagacatggtggtacaaacctgtagtcccagctactcaggaggctgaggcacgagaatcgcttgaacctgggaggtggagggctactgcactccagcctgggcaagagtgagactcagtctctaaaaaataaaaataaaaaagctgaaaccctcagcatatttactaagtgaaaaaaaaattgtataattgaaaaatgacttagtttgaaatatttcctaatgaagtgcttcgggtcagtgaaaagtgtttgaggaaacttataaaagggcagcttaataaaagccagcctatggctgctcccatgtgggcatccgggttgtcagtggtgactgtgggccctgtgactcctcacctgagggcggggtgggcagtctccctgtccacgctgagctccagtcaagtgttaagtctctggcgtctgctgtgtctgcctgtccgctgcttctgccttgctggcgtctgctgtagcttctgtacactcatctgatctttcacaagagtgagaatattttgtctgtttttagaaacctttactatgtcaaaaataagtggtagaatcttccctagattctctagattcattggaaatgccgttagtatgatcctgcctcagtgttgcagagtgtggcttgaaaaaccaagcaaagcagacagtagattggaggtttccttgcacgccctactttgtttcattgtcgtgtagcaccttttctttttctttttttttttttgagacagagttttgctcttgtcacccaggctggagggcagtggtgcaatctcgactcactgcaacctcggcctccctggttcaagtgattctcctgcctcagcctccctagtacctgggattacaggcgcctgccaccatgcccagataatttttgtatttttagtagagacgaggtttcaccatgttgggtaggctggtcttgaactcctgacttcatgatccacctgcctcagcttcccaccaaagtgctgggattacaggcgtgagccactgtgcccggcagcaccttttctttatggacatagattttggtatttcctttaccaaagggaagataggtgggactacttctggttatatgcttcgctttaggcttgaagaacagttgctgtaaagattttattttgtgaaagacccaaggttgaaatgagtcggattcattggaatccattacttttccagggaataggattttaaatgaaaagctaagcatcctctctttcaatatctgccctcacagtgtgcctgagttgcatttacacttagagtgacagatgagactcgggtgtgtgtgtggttggaaggctgtgctcacgcagtgtgagatcagcccctgggtggtgagtgctcactggactggcatgcacgaacttgtagtggcagagacaagtgaaagcatgtcatttctgcacggattccagtggtggcagataggtgtttggcgttagaacaggcagaaacacctgttttccaatctgtaatgaaagaactgtgtaataacgtgcaatttgtacaattaccagtgtctctaccgtagtgatcagattacatttgttgccaaacatcttgatcagggaagtggagtatgagtaagtcagagaggaaatatttagcagtgaccactgtccagctggaaagacctatagagcttccattctgtccctttgcttcaggatggggaagggaagccactccaccgatgtgtagtgctgtgaggacctttctgaaattgggcaaagagctcagcactttgagtccatgagaaataaaactgaccagacgttaagtagcaggtgaggaccacagtgaaagatcctgcagcctctcccatggatttctgcagatgggtgagttgtgccttcaaggcaccacgtcttacagagatcctctgagaaaggcggaacagcgtatgcctaggatgatgcagaaattgacatgtgccttcctgataagtgttctggaataaagcactaaatagcaatagactaggttggcaaactcaatcagatgggcttagagataacaattccagaatagtatccgaaagggacagggcaccaggtgaactggctgcgtaatccatgtgtctggttgttcattgaatttaagaaacacagtggaggctgggtgcagtggctgacacctataatcccagcaccttgggaggccaaggtgggtggatcacctgaggtcaggagttcaagaccagcctggccaaagtggcaaaaccccgtcgctactaaaaacagaaattagctgggtttggtggcacgtgcctgcagttccagctacttgggaggctgaggcaggagaattgcttgaacctgggaggtggaggttgcagtgagctgagatcacgccactgcaccccagcctggcgacagtgagactccgtctcaaaaaaaaaaaaagagaaacagtggaatcttgtaataaaagccatcactgctacagctgtggaaaatggaaatactcggtcgtattttctggacagtttttgatggtctccgtcttccctggaattgacaggcctcatgcattgtgcgtcagcagcaatgtttatggtgaaaaatggcaacgggaccgcgtgcataatggccaacttctctgctgccttctcagtgaactacgacaccaagagtggccctaaggtaggaaacaccagggcacttcatgcttcccttgtgtgtgtggaaagatgatttttaacatttcaaccaagtctttgaaaaatggccccatctgaacatggtgcttttcctatctgcatatctccttctggtgttgtcagtaacctgcgctgtcatgtgccatagccacaggcacagtaacaaacctgtatatgtgctgcacctcactgttcatcatgaacattttcctttttttttttttttttttttttgagacggagtctcgctctgtcacccaggctggagtgcagtggcgcgatctctgctcactgcaagctccgcctcctgggttcatgccattctcctgcctcagcctccccagtagctggggctacaggcgctcgccaccacgcacagctaatattttgtatttttagtagagatggggtttcactgtgttagccttgatggtctcagtctcctgacctcgtgatccacccgccttggcctcccaaagtgctgggattacaggtgtgagccaccgcgcccagcctatcatcaacatttttctagttttcttttttttttttgagatggaatcttggtttgtcgcccaggctggagtgcagtggtacgatctgagctcgccacaacctccgtctcctgggttcaagcagttctcctgccttagcctcctgagtagctgggactacaggtgcccaccaccacgcctggctgatttttgtatttttggtagagacggggtttcaccatgttggccagggtggtctcaaactcctgacctcaagtgatctgcctgccttggcctcccaaagtgttggaattacaggggtgagccacccctcccagctctagttttcttcgtgattgtcttttataatcataatgtaatactttattatgttaattcaccataatttgttacacactcccctattagtaattggtaagttgtcttgaatctttttcatgctctgtgaatgtggcttttttgatttagagagttatactgcaagaaatgtatataaatggttggttgacatgcaatgcaaacactgtactagtttgattaaaatgttccttagtggttttgttgaaatggctttgtgtttctttgggatgactaaagccttttggaataacaaaatattttaaaaatccaagacatagtaagatcttatctcttttttaaaaaaaaaaaaaaaagccagacatggtggagtgtgcctgtggtcccagctacttgggaggctgaggtgggaggattgcttgagcctgtgaggtcgaggctgcagtgagctatgatcttgccactgcactccagcctgggtgacagagcgagaccatctccaaaaaaaaaaaaaaaaaaaaaaaatccagtctcaaattataaatacttgtcaaagccttttttcttttttctgagacagagttgcactctgtcccccaggtggctggagtacagtgccaagatctcggctcactgtgtcttccacctcccaggtttgagtgagtctcgtgcctcagcctcctcagtaggtgggacatcaggtgcatgccaccatggccagctaattatttgtatttttagtagagacggggttttgctatgttggccaggctggtcttaaactactggcctcaagtgatctgcccaccttggcctcccaaagtgctgggattacaggtgtgagctaccgtacctggcctccaagcactttttttttttttttttttttttttgaggcagagttttgctcttgtcacccaggctggagtacaatggcgcgttcttggctcactgcaacctctgcctcttgggttcaagcaattcttctgcctcagcctcccaagtagctaggattacaggcatgcgcccagctaatttttgtatttttagtagagacagggattctccatgttggtcaggctggtctcaaactcctgacctcaggtgatcttcccacgtcggcctccccaagtgctgggattacaggcgtggcccagcgtacctggtctccaagcactttttatttaatttctacatcacttttttaatgtttggttttggtggttggattttttaaatattctattataaattatgtttcacaagtgaggtcacctatatgctgttatgcactttgttatttcacagaacatgtctttatcaccttgtgtagtttcgtgttgttttttggcccacgttagtatactgcttcactgtagttcatttgacctatctagtttactttgatgaacattaagtggttttccagttgctcgttttgcttatagtagtaaatttaaacatttctgctataaacaccttctttgtttaaagaaacattatttaaatgaacatttctatagtaaaaaagtagtgatagcttttctcaaatatatatctcaccctgaagctggtgtgaattgtttcaatttcaagacgctttaaattctgttataaattatattaacataaaatgaatttatggggttgttttgttttgtttggagacagagtcttgctctgttgcccaggctggagtgcagtggtgcagtcgtagttcactgcagcctcaaacctaggctcaagcaatcctcctgcctcagcctcctgagtagctgggacgacaggcagacaccaccatgtctgattagtttattttgtttttgtagagatggggtcttgctatgttgcccaggctggtcttgaactcctgggctcaagcaatccccccacctcagcctcccagagtgttagcattacaggtgtgagccaccatgcccagctgcaaatttttgattatatgaattattaagccaactttctcttacacctgaaatacttttcagtcttttactgacatgtaatactaacctttttttggtttatattaaaaatgagtacctcagtagtgatatcttagttggaaatgaagtataagtttatatcagacttacagaaaatctctttctttgaacttttaataacctgcatcccaattgggttacatttaattgtgtttattctagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaaggtaagaaccaaaatgggccgattatgaagtgatagaaaattgggttggaggattgtctaaagttacttttacctaagaagtacaggctgggtgtggtggctcacacctgtaatcctagcactttgggaggctaaggcagacagatcacttgaggtcaggagtttgagaccagcctggccaacattgcgaaacactgtctctactaaaaatactaaaattagccaggtgtggtggcgggcacctgtaatcccagctactcgggaggctgaggcaggagaatcgcttgaacccaggaggcagaggttgcagtgagccgagatggtgccactgcactccagcctaggcgaccaagtgagactgtctctaaaaaataaaaaacacacagccaggcgcggtggctcacgcctgtaatcccagcactttgggaggccgaggcgggcagatcatgaggtcaggagttcgagaccagcctgatcaacatggtgaaaccccctctctactaaaaatacaaaaattagctgggcgtggtggcgcgcgcctgtagtcccagctactcaggaggttgaggcaagagaatcgcctgaacccagaaggcggaggttgcagtgagccgagatcacgccactgtgctccagcttgggcgacagggcgagactctgtctcaaaaaaaataaaaaacacataaagtaaactaagtactataagtagtttgcaattgtgattttttttttttaatctagaaatcaagactggaatctataactgacatcagggctaaaataaaaaacacataaactaagtactgcaagtagtttgcaattgtgattttttttttttttaatctagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagccggggaggtaggacgctgacccttggccctctggtgctagtggttgggtagctgggctgcagtggctgcgggtgacctcactgctctgtgtcctggtgctgggctctgcctggaacgcgtgtgcacacagccggcgacgtctctgcagaacgttctcatccttcttcctagggcaggtgacttgtagatgagggtagacacatgttgattaaaaagggtggaatattgaagtgaaatatcccgggacagagacagatgttgtgtggtctcccgtgggagctaaagcagtgggagtcggcggggggcgggtagagagagaggtgatcaccaggggctggggttaagttggtcagaagatagagcgtttccggaagacaggaggaattagtacagcatgtgactgcagttaataatgtattctggcttgaatattgctaagtagattttaactcttctcaccataaaaaagtaagtgtttgattttagctgtcacacatgtaggtgtatttcaaaacatcctgacacacatggtaaacgtatacaattattacttgaaaatgtcagaagggcaaagcagttgaaacctttgtgcttctactggggcagagatgatgggaccagggtcacagatctcttgcagtttgagccagttgccttcacacagagacatagtcttatctccatccagctctggccggccagcttagggacaggtgcagaaagaccaacgctgcctctctgaggaggtcagggctgcgatgatgtacctgctaacccagccgccgggctctggggtcaggcagggtccaggccacctcctagccctgtgatcttgagcagggtagtttacctctcattttctttgcatgtggcatgagattaaaagcctgtcttcaaaggttgttggaattaaaagagaaatgtatgcaaaatgtgtatctcagcatctggcacagagttaagtagcaagcacctggtaaatcctgttacttttgaggagcttctctcccgagcctcacagtccaggtcataggttgttgtcattttgctgaagcgtgagggcctgtgatttgccttagggtgagctttcccggctgatagaaatatgtatggagacatcccttagggtgggctttcctggctgctagaaatatatggagacatcacagccttctctaatcttgagagctactgtggagacctttggtttgcaacattcctcagcagtcttgcttaaaggctgaggagtgactgctgggctccacaggaggatcgtccgtctcactcctccccgaggagcaggtactcttgcaggtcggcaccccatggtgctgggccggtcttgcccacctccaatttccatacagcccatgagctaagaacggcttttcgatttataaatgtaacataccaaaaatcagaaaacgaatatttcttgacacataaagattatgtaaaattcagtgtccataagttaaattttcttggaacacagccacactcatttatttacacattatctgtggctgcttttgtattaacagtggcagggctgtgttgtcttgacagagagccacggcccacaaagtctgaaatatttactgtctgtagctttgcggcagactttgccttccctggtgagtgggtgaaaaggagcccaacttggaaaccccgggtgtgactgggacttgatggggccacgtgggctcccataggggaggcttggaaggaaacacacttaggagctgggtcctctgtaggtgctgctgcctttaatcctcaacacagggccccgggggccgtggtgacagccgctttcctggtgcagcctctgttcacacggagcctggagtcgtgtctgcttcatcaggaagagcgggctagagtcctctcacatgggccgcgtgtgtctgaggacggacgcctggcagcctgtctaggtgtgttcatgctctcagacacacctcagccagagctaaagataacttcagctaggggcagtgctccctaccaagtgggagttagcgtaacacatgggggtgactagtgttcacggttatcgatttccaaattatctgggctccacacctagctggctacctctgggctgcatcaatgtggcttgaagaggaaaaggaagggcacgcactctctgtcagagcttgggaaatgagagagaattggatgctgaccttgtccggggactccctactggctaggcctggacacggttgcagaacgtgtctcctccccatgtcgctctgtgaccgaggggtgcgcatggcatgaccgctcactcactcctgcctggaagtgaagggctgctaggtggaggtcagcaaggatgttgagtgccctgagacgggtggcaggattctctagatgaaaaataaggcttcacaggtccagagaagcttgctaggttcttttgagaaacctgtttcttcaggttaataattacttttaagatagactattttttagagcagtcttaggtttctgtgtattctctgccgctgcgcatgtacagccttcctctgtgtccagatcctggacgttggttccttttttaatggagaacacgcatgtgattccaaatggaaaaaggcccgacagcccagccctggccacttgcccctcctggaggcagccagtgtggagatgccagtgtgcctggggcgtggcctcctagagggagtcagtgtggagatgccggtgtgcctggggcgtggcctcctggagggaaccagtgtggagatgtcggtgtgcctggggtgtggcctcctggagggagtcagtgtggagatgcccgtgtgcctggggcatggcctcctggagggaaccagtgtggagatgtcagtgtgcctggggtgtggcctcctggagggagtcagtgtggagatgcccgtgtgcctggggcatggcctcctggagggaaccagtgtggagatgtcagtgtgcctggggcgtggcctcctggagggagtcagtgtggagatgcccgtgtgcctggggcatggcctcctggagggaaccagcgtggagatgccggtgtgcctggggcgtggcctcctagagggagtcagtgtggagatgcccgtgtgcctggggcgtggcctcctggagggaaccagtgtggagatgcccgtgtgcctggggcgtggcctcctagagggagtcagtgtggagatgcccgtgtgcctggggcgtggcctcctggagggaaccagtgtggagatgcccgtgtgcctggggcgtggcctcccggagggagtcagtgtggagatgcccgtgtgcctggggcgtggcctactagagggagtcagtgtggagatgcccgtgtgcctggggcgtggcctcctggagggaaccagtgcggagatgtcggtgtgcctggggcgtggcctcccggagggagtcagtgtggagatgtcggtgtgcctggggcgtggcctcctggagggagccagtgcggagatgcccgtgtgcctggggcggggcctcctggagggaaccagcgtggagatgcccatgtgcctggggcgtggcctcctagagggagtcagtgtggagatgcccgtgtgcctggggcgtggcctcctggagggaaccagtgtggagatgccagtgtgcctggggcgtggcctcctagagggagtcagtgtggagatgcccgtgtgcctggggcgtggcctcctggagggaaccagtgtggagatgtcggtgtgcctggggcgtggcctcctagagggagtcagtgtggagatgcccgtgtgcctggggcgtggcctcctggagggaaccagtgtggagatgtcggtgtgcctggggcgtggcctcctagagggagtcagtgtggagatgcccgtgtgcctggggcgtggcctcctggagggaaccagtgtggagatgtcggtgtgcctggggcgtggcctcctagagggagtcagtgtggagatgcccatgtgcctggggcgtggcctcctggaggcagccagtgtggagatgccagtgtgcctggggcgtggcctcctagagggagtcagtgtggagatgcccgtgtgcctggggcatggcctcctggagggaaccagtgtggagatgccagtgtgcctggggcgtggcctcctgagggagtcagtgtggagatgcccgtgtgcctggggcgtggcctcctggagggaaccagtgtggagatgtcggtgtgtctggggtgtggcctcctagagggaaccagtgtggagatgtcggtgtgcctggggcgtggcctcctggagggagtcagtgcggagatgcccgtgtgcctggggcgtggcctcccggagggagtcagtgtggagatgcccgtgtgcctggggcgtggcctcctggagggagccagtgcggagatgccagtgtgcctggggcggggcctcctggagggaaccagcgtggagatgccggtgtgcctggggcgcggcgtcctggaggctgggcttcctgcctgggtggcgcttcaccagaaagcctcatgtatcttgtctttttttttttttttttttttttttgagagggagtcttgctctgttgcccaggctggagtgcggtggtgccatctcggctcactgcaacctctgcctcccgggttcaagcgattctcctccctcagcctcctgagtagctgggattacaggtgcacatcaccacgtctggttaatttttatatttttagtagaggggggcgttgcaccatgttggccaggctggtcttgagctcctgacctcccaaagtgctgggattataggtgtgagccaccgtgcccggcccatcttgcctttcaatacatcatcttatctaaaaaagctcggggacctcatagattttattttaaaaggaaatgaagcacaagccacctttgaatggactttcctgttggttttgtaccttccttcctgagtatcttcaaagtagggcacatgtggctgggcacggtggctcagtcctgtaatcccagcactttgggaactcgaggtgggtggatcacctcaggtcaggaattcgagaccagcctggccaacatggcgaaaacccgtctctactaaaaatataaaaattagtcgggcgtggtggcaggtgcctgtagtcccccctactcaggaggctgaggcaggagaattgcttgaacccgagaggtggaggttgcagtgagctgagatcatgctactgcactccagcccagctgacagagtgagattccatctcaaaaacaaaaaaacaaagtagggcagatgactgtcactccagagggtctgagtgcagctctgcctgaggctggagtcagccagatatccatccaaaccggatttccagcccaggcccatatggggttagcagatctacagtgaggctcagccaggcttttgggtttatgagttcaccgggaggagtggggtgtcttcgtcttttatcctcagggtctgataggtgcacgcttgttgaatgaatcagaggactgcctgactcctgttaggagttgaaaatgaaggtcaccgtgtctcatctcccacccaatttggcatgattttttttttttttttttgaggcagagtcccgctctgtcaccccaggctggagtgcagtggcgtgatctctgctcactgcaagctccgcctcctgggttcacgccattcttctgcctcagcctcccaagtaggtgggactgtaggcgcccgccaccacgcctggctaatttttgtatttttagtagagacggggtttcaccgtgttaaccaggatggtcttgatctcctgacctcgtgatccgcccgcctcggcctcccaaagtgctgggattacaggcgtgagccaccgtgcccagctgcagcatttttttttcattcctaggaacagagtctgactcctagcttaaatggaaggaatcgatggtaaaacattggaggtggaggttgcagtgagctgagatggcgccgctgcactctagcctgggtggcagagcaactgagactctgtctcaaaaaaaaaaaaaaagaactaccatcagaaaggcggagaggatgagagtccctcaggacaggtgaaaggggcaggagaaggtcagaggcctgacacacccaacattgtcacaaaaaactgtaagagaggctgtgggagctatgagtcgggaacctgggtgcaaaccaatctcatcctcacagacacccttgagggtctgaattgcagcttgcaggttgatgtgagtatctgctgttgccgggagaggaggaggggccttcagagcacatgagctttggaaaggcccggctgtgtgctgctctccggagggtgctggaggaggtgtgacagtggaccctcaggtctccccagaggctcctgtgccaccatctccccccgggcagcgcagggcactctccagtgcgttccgtgatgagctctccgtcactgtcctccgccctcagcaggaaagactttggtatttagtacgcattcagggaaggagagtgtgggtttgcgtttgtaattcaggtagaaggacgagggcattttatccacacttatttctcaagttccagttttttaaactggtggttagacctgatgatgttttatttgtgtttccagcttcttgtgaccactctacagaaacagggtgggaaatgaatgtgccacatggatcacaggtgaaaaacaattgtcaaagcagcgtaggttacactttttctgtgcgtcgtgtggccatctagactagaatttggacaagactggccggttttgcacatttaacttttgcctgtttaaccctggtctgtaacattttataaaggaaccgtgaagctgcttttttttttttttttttgagacagggtctcccaggctggagtgcagtggcacaataactgctcactgcagcctcagcctcccaggctccagtgaccctccctagtcagccttctgagtagctaggactaaggcgcatgccaccatgcctggctcattttttaaaaaaactttgtggagatgggggtctccctatgttgcccaggctggccttgaactcctgggctcaagcagtcctccttccttggcctctcaaagccctggaattacaggcatgagccactgcgcccagcaagtgaagctgttttggaaaggactggtcaacctgcagcttcgccaagggcagtgagcaagggtccctgagcacatcccaggttgggacggctcccagtggccgtcagtgcctctcacttcagagtttggtgtggttactgcagctcctctctgccatcttgtgctctgtccagaaggggcttttacaccggggtgcgggggcactcctgtgtgtgtctcagaacccgttggggtgcagtcataggcgacgttgcctgtctctttcctgccctgagtagatgggatatgaaggtgggaattggccactgaatgttgagatggaagcggaagcagcaggtgactgatggagttatgagtggcagattccctgcagggttgcccaccctggatatgtggggctcacgcgtggtgactcagcctagcagagatgtggaaaggatcgaattgggtggaaattatataaatattattcttgagtatccacagaaacaaggtggtaaaagaaagaacctgatttcaaggttgatggtgtgttagtgagagtgttggccacagaagactcggtagagctctacctagggttcagtctgtcttgactttgaatataaatttgtgttgtgaacatcttggtgggtgaattgctgaaggacagagtcacattcagactgctgggcattccccaggggtgccatgtgcccccccacccccacggattccctgaactgtgccctcttgtctggggatttcagacgcacccacactcactgccttctccctcgtgaggatgcttgcccatcccccacagccccctccccaaatgaagacccaacacagctggctagccttgcccgcctttgagtctctgctcacacgtggggtcctcatggagactgcctgacccctgtcctgccagagggcctccttggctgctctgcgtcccacctggccggtctgtgtgtgctgcagaccctctgtttccctctgggtagtgtttccagcacgatcctggcgctcacccgacagctcagggagcagtgtctgagtcgtcaccatttcccatggggtgaggtggccggccacgcagcacagcttcctgcgtccactccttcgtgacagcgttcaaggctttctcaccctcactttaggaagagggtggcacagtggcccctgtccagccacggggcttggggtgtggtgggcggtgcctgctgcccaggcagaaccgtcctgggtagtgggaggtggaggctgagggtgccccacgggcctgtgcctaccgccctgagccgtctgcaggacccagctctttcctgcgcgtctagaaaggcattagcgagagccaccttgggagactgagaaaatagtcaccaaggacgccagagtccacagatgtagttttgtttctgagtttggatcttactgtaactgctgatggttatgagaaacccagacctgaatctccctccactgcacctgcagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacggtagggctggggcctcacctgggagagggggacggcacggtagggctggagcctctgctccctgtgcactgagaacacgcgtctctgcacgtcatgctgttaagtcaggatgggagcttagcttgcaggacgtgaccctagaggacaagagctggcgtctgtgtcagtgagtccattttgtaggatcacagccgtcctgctggttccatcatccaaggctggtgtcccagcatggcctattgggcagtgtggcccacagagcctacaacttggcccctgatagaacctaagttttctttacatatttatcatggaaacatttaagtgttacatttttatagttttcttttgaaatagtttttctcccctagtagtgacaggctgtggggttgtgggggtcgacttgcgtgccgtggggtgagtttgcagggctgactgctgcagggggaggtggtgctgctggttgccctccacgcggggacgctgcactccaagagcagctgtcacggggtcagggagagtcatcttgggatcccgaaatctgtactagtgtggtctttcagtgttttccttctggttttggttaaaacaaatgtggccttgaattcacggtttcaggactgtttgtcttttcgagagtgtggaggacctgagctagggtggtgacttgcttgcttgtcttatgcagacggtgacaaggcttctcaacatcaaccccaacaagacctcggccagcgggagctgcggcgcccacctggtgactctggagctgcacagcgagggcaccaccgtcctgctcttccagttcgggatggtgaggctggggcggcacctctctgggggcgcccactgtgtctccaccacatctttttgtgccctgggtctgctcatgggaggcagcgttaggaaggaggcggcctcacttttttctgccttccctttatcctgggctttttagttccttggttcccctcccccctttccattccattcatagatgcagcagatgatgtgggcggggctgctgtgcccacagttggagtggctgcaggggagggcatgcaggccgtgcggccttctggcttcagatgctgctgccctgtggttccgtggtggcatttctgcctgggaggactcctgtgcagttagcaacataagacatgaagcatataattgtcacttgtcagtctttttaaatcgctgtgcaaatgaattaacagttcagtttcttataattttagctttccaaatcatgctttcctgtgctgtgatagctcctgcagtccccgttttccagagactgactctcaagaggtctggaaggaccagcctgggcagcacagggaggctccatttctgcaaataataaaacgagttagctgggcgtagtggcgcacacctgtggtcccagctacttgggaggctgaggtgggaggatcacttgagcccaggagttaaggttgcgatgagccgtgatcactccactgcactccagcctgggtgacagagcaagactctcagagaagggtctggaaggaactaaccaaaattttcattccccagagatacacaacgccttttatagacaagatcttttgcagttttgttctaatactagaaatgtaggaagtcaggtttattacccaatgaccattcacgtttgatgataaatgtgtgaatctactggggttaaagatcatctttctatgaatctgctccgtgattaaagatcatttttctttttaagaatgcaagttctagccggtttttcctacaaggaatccagttgaatacaattcttcctgacgccagaggtgagaacccacaatctctgcgagccccgcccccgcccgcgcgcccagggtattctggagccactagacctctgtgtgtgttgcagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctggtgagtgtcaccgagggcagctgtcgcggggtgtggaggacgtgcttcagactccgcctgtggacgtttagtcgcttccgtgtgggctggggcgacgcccctgttcctctgcaaggagctgtttcttcttgccggtctgagattctagaggtaactccccctgctttagagaggcccagcgtgtctctcagctgggagcccctggtaccatttgagagtaagggaatcattttaagaaacagtggtggcgcttctcccatgaacgttgaatacaacactgtcatctgatgtgcacagaggccctggacgcagcacagctgtccggccacagcccctgattccagacgggggagagacgtgtgtggtttcctcgccgtgcagagagcaccagtctctgcagcggcttccccaagtgacaattccagctagagctggaaccttccgccagggttcctctttgccttttggctgatgtgggggagtggtggggagagaggcctgtttgcaggcccctgtgtgagcagagccctgacaccatccgtctgtcttggcagtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaacatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttatttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttctttt

SEQ ID NO: 35911 - DNA, 36086 bp, Homo sapiens
cgtgcctcctcgctggccgcgctccctcccggtgccggcttctctgagtcaccaacctgaggctgccccggccgcctgcgcacccggcagcaccatgacaggtaccgccgcgcagcccgccgccgccagccccgggaccccggcttcctgcccagccgccgcctcccttctcctccgccctcagccccggagtgttcccggcaggacgaaaccgccgcaaagttgctggctggccgcagccgggcgtgtttctgcctgcgtcagctgccgccccgccgccccccagagtgcagggatggggcagccgggcagagcccgggccctcggccggagctctcgttcctgcttccgtctcctcgtccttcctcttgctctcacggcgaagggccggcgggcggagcagctgcggcggggccgtgtgggggtggggagccggttcccctgggggttccaggcgggagtccggggcgcagcggcatcgtggggagctgccccggcctctggcggcccggaaccccaggaagcaggggctccgaggcggggatactgcggcctccgcccggctcctccgccgcccgccccggccccggccgccacgctgagcctatttttaggcctttggggccgggttgcgggaagccgggagtcggactagcgtccccgggcgcgagccccgtctggtgggagggcgccggctttggcttcacttgttgcgaggcgtccgggccactccacgagttagccccagcactgggaagctccgagttagctggtccttccgtgtcattgaggctaatagccagggttattacagcagttgaactgccacaaagattgcaggtgtaacccagagttcagccgtctttaggaagattaaactcctacccagctgtcattggtctttcttggtcatttgtaatgttggctagtctggtgttctaacctgtgttctatcccttatttaatcttggaaatcatccatatccttgcttccagaaatccttgaatcctgctcaccttattacatttttctccatgatcgcctggaacctggacttcatttgagttagatgatcattcattttgcctagcttaagtatttttggtacagattgacagcgatgttacccatgttataatgggctgaagataatagaagcaagtacaggcggatgttgatgggcctgtcaagggacaggtgccactgttcagagctttcctagagtgtgagtgactgggaagctggtggcccttcgggggtggggaactggtcttcctacaacttagtagttggcctgccgtgggagagggcctaataaaatgtgtgaagatggctctcaggtcagcagccgagggatgcgctggcccactaggcaacccacaacttcctctcatgtctcggtggaatttctactgcttccagcctccaccttggaaaacgggcaagggagaatgagggaaagccaggtcagaaagagaaggacttcatgacaaaatgtcccaactcgctggttaagcaactgactcctaccagaacttgatccgaagtgtcctatgcatttggatgcccaccaacttgctaatgtttcttggagatggaacatggcccagaattgtcccagggaatgactggagaaatcttgaagcctgtgctaggggtcttgggagggtggggactgttcagcaggaggaaaaatccatgtatttaccttctcttctggcaactaagtgattattggagattggggtgcgtgtctgttggtttgggcggggggagggggagggtgcaggatggacctgcaccttcttctccaaagaaaagcaggcagttgtttagggcttcttgggtgatctccaaatctatttatcagtgattgataactatttagatagaagcatcaaggagggaaagcctctttgaggagctgatacttgaggagagactcaatgttatttttcagggatattggggcaggggagcttttgctccacgttgaggaaacagttatgtataagatgcctggagttcgaggctgcagtgagctatgatcacaccactccactccagcctgggtggccgagtgagaccctgtcttaaaaaatacatacatacatacattcctgaggcatggcataaacgtaagcaccagaatgaagaatatggactctgctttcagactgactgaattgagtttgacggttggttttgtgcttgtctgaaaacactgtctacagtaccttgtagaagaaacagcaaatgtactacttgatctcttcattaccatctgttagttgcctggagttcaaactcttggtattaagctattgttttgtctgagaatttagcgtgtcggatttaatttctatagcttaatcaacctgttgaaggttgccatatgtgcctgctatgatcttgaaccattcttgaagtgggcacttggggttttctccccaaagggctacagcttgattcatagagaaagttgatgttagaggaactggttttgctgaattactgtttgaatgggttcctggggaaaaggctttctccagataagatactgtaatgagtgttttttttttctttgtattaagatcaggcctttgtgacactaaccacaaacgatgcctacgccaaaggtgccctggtcctgggatcatctctgaaacagcacaggaccaccaggaggctggtcgtgctcgccacccctcaggtctcagactccatgaggtgaggacctcgctgccaccccagcatccaaggggctctgacatccttctccctgttgctgacatcattggacattgaggccatgctcttttcaggaattgagcaccgggtagagaaaaatgagagatgctgagtgcaggattgctgtatttgaaacctcctcctagcttttgggagatattccaactcaattcttttctggaaggtgttatgctggcccacactttctggttccaactaggaggggaaagaaggagtcgtcttccttcactccatcccctctgggtgatctgaaggagtgtgtcaggcattccctgcttacatacacctttacacagtcacaattcatggacattcctttcccaggatgcagcaggggctacattgtttcatgttgcaaactagggaaactctcaggtgacttagaaaagtagttattttatccattgccagttgatatttgtaagctaaatatctttatttacaatataatacactagaatctttaccaaagggctttccaaactaggttttactaggggaaacacactaaagggtataaactgcttcatgattggttagttcactttgatccgatggaattaagttttgaagtatttgggccaggtgtgatggctcatgcctgtaatctcagcactgtgggaggccaaggcagttggatcacctgaggtcaagagttccagaccagcctggccaacatggcgaaacccgtctctactaaaaatacaaaacctcatctctactaaaaatacaaaaattagctaggcatggtggcgcgtgcctgtgatcccagctacttggggttgggggctgaggcaggagaatcgcttgaacccgggaggcagaggttgcagtaagccgagattgtgccactgcactccagccagggcaacagagtgagactctgtcttaaaaaacaacaacaacagaaaatcgaagtatctgaatgagctacctagtctctagtagtaacttaaaaaatatccgggcacactagtaactttgtgatgtgtttatttttctggtctcctggccctctaagaaattgaaaatgccctttttgtgactttttatttttttcccaaaaagtataagcacaggccaagggtctctaaaaagtagacgttctgtatacatacgtatatctttcacactaatacctttgttcctaaatggtaatttaggaagatgccaaaaaggctgtctcctaatgtgtgtgccctaatttgtagtctattaggatatgtctaagaaaccagatctagtcttgcatttcctgtaaccaccatcagttgactttggtcagtgattctcctaaccatttctcttcaaaaacgtcaagtttactgtgtgaactgtaccatatttttgtacagctttggagacagaatacaataccagttttgttctgcatctctgatgttataaactttcagtatgatacgtttttacccgtgctcagtttagtgtcttacccaagtctaccctaccgatccaccataaagagctttctaaaataaagccttagttaatctggggcatagagaagtgttgtacctcacaaaccaacgtgaatctcattatacttaaacagcgtgctcagcatgtaataaatgctggttatattggattctacaaaatggcaacctgatgaacagagcccttacacatttttgcaagctatttccacaacctgcctgctattcagtgatacaataaaatacaaaaacccagaaaatgtcttctataataacgttttaagatgagcatttcatcctcaccataagcagttcttactactttagtgacgttaactggacatgcaaataaacacagtttgtcctggagtaaaattagaacagatttaagggtacatattctaccaaagcaatacattgttctagtaattgatggagaaggtaataaagcatcagtcttacagcagatgggtcacttgttctgaaaagatgctaagtgtggtattctggattttattttgacagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtgagtgtggctttgagggtagaaaagaaagacatatatatatatggtgatggagacctgtaggcatttgaggaatgctgtcaagacttgacggtaaagttcagatagaaccactgtcatgaaatatgtcaggggatgaaggagaggaggcccaggctgccttacagctgtcaccatcttttgtgttggatgacataggaagaactcaagaagggtattctgcagcaaaaacatttctgtaatgctctttctcccctttgatcaggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtagttttgatggtatgtatttgctatcttcatgtctgataagctgttaatagtaatttctaggggctgctcttctcaggaatataattgctgtggtttattctgcctggaagatataagagatggagcaagcattttaagttgtgctcttctgggaaatattgtgtgtgtgtgtgtgtgtgtgtgtgtgtaaatgcatctttttctatagatgtgaaagattaacctaaactatgataggcaattttataggattgtctttaagttgtcttcctgtatctagagtatgataaatgtactgtgattattcaaaaattcaaaagactgaaaaactttaacatctgtctttaaacctaagtaaacgtaagctcaagagagtttgacagccattccaggaggatcaagcattgtcactatggaaacttgaggaataagcctgataatttgggtctcattctctcaggcggcataaaaaagaagaaagtttgtgtgaataatctttgcttccaaactctcattctctataaggctgtcagagtagtatctgcagggccaaaaagtagaacattggcaaagtcagcatccattttctataacatataaatgtatttatagttatatttatataatggttctgtctgtgatatagggcctcacatcttttggagaagttgatcaaatgaattagtaagtgtgctttcgtttcaggccaatttctgaaataacaagccatgtttttaaaaacaaaaacacacaggacaaaaccaatagttaatatgcagaaggagttctttgaaaaattatttttgatggttcttttgaataaagacccagaatagagaagaaggaggacattctcttagaagccctcccagcagtgcctcactatcagatatgtgacattgtagcagggcacagtgctgtgtgctattcacatggggttgggccagaggcccaagctctgctggagacacagcggggacttctttcctcctctcccctttccaagagtagatctgagatttgcagtaagtagatcttttggaaatagcagaaacagcctttctcatttgacaaaagattcagtcctgggtgcagatatgagaattcatttttattaattggttagaaagttaaaaaaatattaaactttaaaaatgaaaacattagacctataagtttgttagattgctgaggtgaagatactggaagttaaaacatttcaaattatacataaagctgagattgggttttcattgttgctattcacagaaattgaattatttttagttatttggctgaggatttgggaattgtggctatatatgaaatgtaattgaaaataatagggaagtttaagtctcagttttatttcactatttagcttgtttatgctgtaagctaatagttctcaaaacaagggtgattatgtcccccaaaggacatttggcaatgtctggagacatttttggttgttacaactgaagggggagggtgcaaagggcatctgatgagtggaggtccaggatgctaaacatcctacaatgcacaagacgatttcttccaacaaagaattacctagcccagcatgtcagtagtgctgaggttgcgaaactctgctctctacatgctctaaaacagagcaggagtatctgaaccataatgtatggcagcatctaacaagaagtgaagtcttgttttaagcaaccttaaaataagaaaataataatgtgttaaatgttcaccgtggtcaaggccgaatgaaacttcttcgctttactgacatgtttttagctcctgctattttcctttcatagaaggaatgaaagctgtattagcctttaagttcaaaagatgtattccttatttctactgcttatactgaaagttacctttgcataaaagaggagagtgtttttagcagaagtccactgtttgtcttaaccttctcgtcagagtgtagctttcttcacctcctctcctaatttgaaggaagtaagtgtaatcctgccagaaattcggtgtaactcttttcagctttagtaagtgaatcacattctaaagtatatcttgtggcctgccaactgcctgaaatccacatgattttaatcatgtaaagagaatccaatttctaacctagaaaacgattagatgttattgagaggtaagactttgattaccaaacagtagtgtgccgtggtaaattatctaggttataatttgagaatatgaaactaactaacctattctttgttaagaagcttggatgcgtgcagagtgctcgactaggaagcacttcctgctttttcagccagaatctgaaaccaccgtgagattctgtctgtgcctctagcacatttcattattcagcagcaggtttccaggtgctggccatcctctgaggtattccatttactggctcattggtggtgaaggactgaatcttctctgttaatagaaattgaaagaggtaaaaagtcatctatgcagctgagaacttatggttctcaatatgttgtttaaattcagcagaagaatgaattagcagttctcgaatcaaaggttgtgttcacttgaaatatgtgttaagctttacttagcaaagaaagctcactctataccttgggaggctgcttctctctggaggggtttactatccacttgaatcaatgtgtgaactgtgtgacataaagatgtgttggacttatgcttgatagcaataaaatatttctttatggacaatgactttgtctaatggcagtaacctttgcctctggttttcaatatgttattatataaaaattataaatatagtaaaagtaaatagtcttaaatataaaaattaagaattatataaaaataattttggttaggtgttgtgctgtaggcactgatgaacattttcaggtgttcctttcacagttacccacattttctcacaaccatagtttctccctccaccacccccatagtcagttttaagtcccggaattttcagctcagaccagttttacagatgactgtatctcagtgtgaatatctcgcaggtcatgtttttaacctctttcctgtgttcatcagaaactggtggggcctgatgtccactgacaagccacacaggctgttgatggctgagcatttgcagctgcttttgcaacccttctcatgcaaaagaatgtggctgtcattcttctaatcaccagccctctattcacagcctctccacctctctattctgtgactctggccaagagaataatcctaatatggcaaaccatacgaggtacctggacttctctttcttcctaaaattctataatgttagattttagaactggtgactacataaccgaattcatggctggtgtctaattttccataatgaagagtcaaacttctatactgttgtattttcaaactgtcttggcacttacttcatcactgtaattacatatttcccgaaaagttgaacaatagctgttgtgaaatagttctacactagtattgtataggatgtgacaagataaggttagcttctgggcatgttagcactaagaggggaagagagagctcattatattgtaggttctaatcagcagttttgcttctgccacatcggtgaaatgaggctgatgaacttgactctgaagaaatcaacctgaatgcaagttgaggtttattttcttttcccctgtgactaatatatcttaagagtgcttgtatagttgaagagttaagtgcttaaaaattgtctattttgtctgtatgtgttagtttcaaaaacctaagtcagaggaattcatattttgtaatttggaatatccttaaaaaacatcttatactcattttgattactgcagtgtaaatatcctaagcttttgattggtgtactggaattttggtctgtagttgaatttctagaaagaagaaaacataggagagaataaattagtagcagaatattaggtatgatttatttaagtagagtccaggatccgctttgaggtcactatatttgtgtgttccaaattctaagtggtcattgagtcccataagcagagtacagtaatgttttaaaataatgtttaacagaaatgatttggtgctacattgtattaaagtgtaaaattgaccccagagctagattttaaaatctttgtagttaattaggcttcatgttggacctgcccaaaaaaagaatgaaggactgagatatttcaagatggtacttgtccaaaccaaatgagctgagagattttggtgtgcttcacttggttccctgacttgataggtcagcccggacagttatcttcccatggtgacttcccccagccacccaagcactaggctgcctgttctagtaatttatcagttgttttggaaatgactgtgttctcttgcatttgtgtcattttattgatagtttggataataagtatcttgaggaaaagcaaaagccatatcatgtaatggcaaaattaatgagcacacgtaagtttttttaagagctattgttatgtcactgtacccgtgaatatacttttttaacttagccacctgtctccagctttgtaactgtcagagatcatgaaccctgtgagaaatagaggaggaggaagggactaatgtgttatatgtatgcaggcttgtatgctggtcattttacctactttttcacttatttctcaacagtcctgtgaggtaggcattcatacatccattcatataacaaatattaattgagagcctgctatctagctagcactggggacctgccattggtacagttcagggcagcagcttgcctgatgtctctgagctaggcaaagtcaggtctgaaccagggtccttctcaactctggttgggttatgtgttgtggtggggtgggtggtggtggtgggtggtttttccattcccaattctctcatatggcagcattcttgagtatgtatcctgagaataatacgggatggaggaagatccctattaccttggctttatgacagatgaattaagtaatttctctgagtagacagagcagctggtatattcctcattttacaaatgaaggaatggaggctcaagtcttctatctctattgctactgttcctcccctctgatccaaaatacctaaaaatactttgtcgtttaaaatcagcagcacagttcatcgtcttgcagtgttttatggagtctagatgtattcttggaagggttcctctcacctatatttctgtagtaggtccattcattatttcaaacataattttaatttctaatctgggcaaaatcctaaattgaaggggcaaaaatagactggtaaataatacagattttattcctgcctctataaagtttatattctgagaccttacagacatctaacaactaatacacagttatgtaatcatgattctagtaagttcagagtactaagagtccagactaggaggacctgccttagactgagaaactgacatttaagccaagaataaatgtttccttgcaagtatgtaataattaatagcttgatacttaataatcttttaacaaagtagtgaaaaacaaaagctataacatgaagtagtaaaataaatcagttattcttggcttaaatgggttgaggccagtgagatgccgtgatgctggggcccaagctccaagtgcctggatttccataagccaccttgggttaatctaatgatcctcagtaaatctcataaaaatatccccaagagctgggctttcataagctgtaatttattaatccttagcatgctcactataggcagtaatgattatatccaccaagcattttgtaggaagttagttttaaaaagaagtgtccaggcgcagtggctcacacctgtaattccaacacttcggaaggccaaggcaggtggatcacttgaggtcaggagttccagaccagcctggccaaaatggttaaaccccatctctactaaaaatgcaaaaattagccgggtgtggtggcacatgcctgtagtcccagcttcttgggaggctgaggtgggagaatcacttgaaccctggaagcagaggcaatgagctgaggtacgccactgcactccagcctgggtgacagagcaagactctgtctctgtaaataaataatagatagatagatagaagtgagtcacatgttcatgtcagtccttgtctctagctcaattacaatataaagcatattttactataattttttttttttttttttgagatggagtttcactgttgttgcccaggctggagtgcaatggtgcaatctcggctcactgcaacctctgcctcctgggttcaagtgattctcctgcctcagcctcctgagtagctgggattacaggtgcctgccaccatgcgcagctaatttttgtgtttttagtagaaatggggtttcaccatgttggccaggctggtcttgaactcctgagctcaggtgatccacccacctcggcctcccaaagtgctgggattacaggtgtgagtcaccgtgcctggacttttactttatttactttgtccatctgtccctttttggattttgaagtatctgagagttggaacctatctgaatcttcctattatgtgaataccaaatttataaaatgttagacattttttatagaaatgatatttttaaaagttattatcctttgttataataaagaagtcgttcttcaaaagactctagtacttctcaaatttaatatgcagacaaattccctagggattaagatgtggcttctgattctgtaggtctggggtggggctcaacagtttgcatttctgtcaagctcccaggtgatgcccatgctgctggaacccgggccacagtttgaggagcactattatagggggaacattcctttggctgagatgctggggctcatgtctaaaccagaattaactcactgccctgttatccacagtagacaagccagctgccagcaaactgtggaagagcacgcaaagtacacaagcattgaacaaatgcacagatttaaaaagacaccacttaactcttgtttctgtcttaggaaacaaataggcccagtttctgataaatgcatccatggttaccaggtatgtgaccctgctcagaagacctagaaagtaccaagtctgtagttgcaaggtgattacacagcatttgcatttgggcagccgggtggaaggatgattcagaatgagatacttgcttttgttcgcaaaacagatgcgatgtgccccttgttccatttcctttctccctgtctctcacctgtgttaccacaccctggtgtaccggatcacagctgctagtgatgcctgctaatcatgtttgttggctctgagatgagtgagattaaaattatcttaacctgtcagattagataaagctgcctctagaagtctgactaaaatgtatcggacaaaagttgtagggtttttgttatggaaaatcagcagtctttagggcatccttgtatgttttctaatacagatgtgcctagatttgcattctgctttgaactgtcctatcatttaaagatttttctaaagagaggatattggtaacaccatacatagatttttctgatgacgttaaaacatttgcctgaccttaaaatgttgaactgtgcatttgggaaaaggtggttaagatttctagaccgctgaatttaaaaattcagctacggacttctacatggcatttaatttatttttaatccacaattttggactaaatgataaacctttgtagtcacataatgaggtcagtggccctggaagttttatgacctgtgttgtcccctctggagccaaggttcttgttgagtgtttcaggatttgccaatttaacaggcactgttgattcaccagttctgcttcagtgccttttctcttccttgcttgttttctgtacaccccgtgcttcccagccttcctgtggcacacagctgatgggctgatgatgtttgtagggtacctgagggtaaacagaaacggccttttgtggccaaaggcagccagccagggactttgagggatcagcagctctgactcctgtttcccaggctcatgcaggtcggatttggaagttctactttacaactacgatttaggcctctgtggaattagatttctttactgcattatgggtagctgttagtcattttaagtggaattgcttcagttaaagaaggtgttataatgtccaggttctcaaattggataaatgtgtagagttttattattaatatcctttataacctacacatatattttttttttggtagtatacttcataataaaaattaaaagtaaagagtatttagaaagaaaagatctaagcacagttctcattcttgcccccagttgtattactaatattttagcattaaaagaataataggaaaaagaggggggaaggaacatctattacaccaatcccctaatgcaattactattattttatttactttcttgtaatataaatgttaattaatgtttatgttcttagttataatcacaatgtatgtagctgtatatattacacagtgtactgaagttgtctttatagacattagttttaattgctgaatcatattccatgagtagttagtattaatatactaaccattcctgtatggtagaatataagtcgtttaaatttttctgctgttacagaatatcttcaagattcttgcattcattccataaataatttgcctatgtgtaaggcattctgctacatgttagcatcataatggtgagcaaaaggccataatctctgttcttgtggaatttagcatctaattcctgattgtattttgcacattaattgtaagagttttttaaaaacctgttcattttgagagaatttccatgcagttgtaagaaataatacagacagatcccacatatgcttcatctgttttcccctaatggtagtaccttacataactaaaatgtattgccccaaccaggagattgacattggaccaatccaccaaccttactcagatttcaccagttttatatgtattcccttttctgtgtgtatgtgtatatgtatatgcacttttggtttttatgcaactttatcacatgggtagattggtgtgactaccaccatagtcaagatgcagagtagttccatcacaaggacccttcatcatattcttttttttttttttttttttgagaccgagtctcactctgtcaccctgccttgagtgcggtggcgtgatctcagctcactgcaacctctgcctcccgggttccagctgttcttctgcctcagcctcccaagtagctggaactataggcgcgtgccaccatgcccggctaatttttgtatttttagtagagacggggtttcaccatattggtcaggctggtcttgaactcctgaccttgtgatccacccacctcggcctcccaaagtgctgggattacaggcgtgagccactgcgcctggcccatcatattcttttacagccacaactacatctgtcattctttccctctcccctggcaaccattaatttgcttcctatctctatacttttattatttgatgttatataaatgaaattacatagtatataactttgtgagattggagtttttcactgagtgtaattaatttaagattcatccaggttattgtatctctagtttgttccgtcttatagctgagaaatatcccacatggatgtaccatatccatatacctgctgagtgacatttgagctgttttcagtttgtaccattatgaacaaagctgctgtgaacatttccttagcctttttttctgttcccatggaaccgattggcagtattttgatgattatgtgtaaaaggaaattagttaagacttcaggcctctgtacctcagccattagtgtctagtcccacatttgggtatctttgtagaatccaaaataagcctttaatgaatggcatgatgttttggctttgatagtttgtgcctcagaatacattaatttgcctattagctaaaattgtctttggttctcatatctgtcctttgtcttagcctattcaggctgctataatgaaatatcatagattaaatggcttataaacaacagaaatatatttctcacagttctagaggctgggaattccaagattaaggtgccagcagattcagtggctggagagggcccacttcctgggtcatagacagcttttttatttttgtttttttgttataactgctgcatgtggcagaagaggtgagggacctcacttgggcctcttttataagagcacaaatcctatgcatgagggcagagccctcatgacctaatcaccttccaaagaccccactccagataccatcaactttggggttaggatttcaatgtaggaattttggggtatctaaacattgagtccattgcatttttataacagtgaagcatattctgttgccatctttattgtcctttagaacttataagagtgaaactgattttctgttgttcgtcctttgaggaacagagacctgtcaggggtgctgtttaaggaggggtttcctcaagacaataagtgaacgcctttgattcttagagttgattgaaggtatttggaaaggatagaatacgcagagggtggataaggtacacttggactttaaacctaaagtcctgatcttactacttaactccaaaaattaaatagatctctagatttttaaagtctccttgaaaagtaaggaaaattgaatagtaacgacagccgactggacttgctgtatgttgagaaacgacctggattttttggcaaaggagactgaggagaggagtgactatgcagtattcctgcctgatgcttagagcaggtgtctgcctgcctgccatccccatacacactcgcacatatgcactcatgcacatgcacacacatcgtgaactcctgttctgctgcttgggagactctggttctgagtgtgttttctgaaatctcatgagtctaaaatagaaagcacatgaaatatatggaagaatgtgtcttgtattgtttttatttcttttgaatgaatggccatgatccccgctttctgaggaagatatgaagtccaggagccccaagggctgagcagacactttgctgtatcattgtagctgacgctggccacagtggtgactgagcaggatctgcccagagacttttggtcagtggtgggagagtgcaccataggggtaatgtggccttctgggccctctgttgataagccaacagttgtgggccctggaaaacaattccattgttccagtttgctctcttttactttttgattctttttgtcctgttatactcaggggaaagtctgaaatctttaactggaaataaagtgtacaacctgatccctatgtggtctggtccctgccgccttctctgagactcacctggtgccatgcaactcattcccgccgagtccacttactcaggccaccttccaggccttctatccatagcctcatgctcctgcccgccacaggtcggtggtgtgcactatttttgttctgcctgggacacggtcccccgtctttcccccatcggcatttttcaggtatgcctgtgcacccctcagatattggtttaaacacaacttccttgtggaagccttccttcgcccatcagatgtagctcaagccacttccacgtgtgcctgtagtgccacgtacattccttcactgcattcatctccatctgtgtgatgtttgttgatttgatttgctgctgttggtgtctcccacctgacccttgtgaagacagtgaccatatctctttgtgcactgttgactctgcaatgcctagtacagtatctggtacatagtagctgctcaatagatatttgtcgaattaatgagttaaatcagggaaatggccactccttaaaatgtttttaattggtgtgtcaaggaacttaactcaaaaatgagggccgggcgtgatggctcacgttggtagtccttgcactttgggaggccaaggcaggtgtatcacttgagatcaggggttcgagtccagcctggccaacacggtgaaaccccatctctactaaaaataacaaaaaattgcctgacgtggtggcatgcacctgtagtcccagctactcgggaggcttagacaggagaattgcttgaacccaggaggcagaggttgcagtgagctgagatcgtgccactgcactccagcttgggtgacagagcgagactccgtctcaaaaaaaaaaaaaaaatggaattagtgtctatttttaaaggtccagttatgtgctcctataaaattattaaactgtctagagatctgttaactaatttatatatttttttcttttaggtggggaccaaggcatactgaacacattttttagcagctgggcaacaacagatatcagaaaacacctgccgtttatttataacctaagcagcatctctatatactcctacctcccggcatttaaagtgtaagtgcagatggtttaactattgttggagatgttgagggcagagaattggggtgtacaattttggggctgcttcattgtcattccgagggaaataacagatagacactttgaggaaagtttctcttgtaagaaccgtggctgcaatggggagaggccttgatgttatcggttgcctcatgcttgaccctagggtccttagttgcctttgggacaaggttcccatcagtttctggggttcatggccctctggtaagttattaatatgtcatggtcaaaaacacagactcttaagctctgcagacttacaacttggaggagctgagtttgtgccctaactcaatgtcttccccatactggctgctgagctttggtttccttcacctgcaaaaaggtgttaaaagctccctcataattgttgtggggattaagccagatgcaggcagcagtgtgctgctgtggctaagaataagggctctggagctggatgacctcacttcacatcctgcagtgaccacttcctggcctacttactgaacttctttctgcctccatgtcttcatagggttattgtgggtagtaagggaggtaatcatgtagcatggttagaagagggcctggtctacccaactgctcagtacacgttagattgttagtcatttttatttgagagaagcaatatagtgttcagagtaattcgtaaaccagaaaggcagggcatatgtcctcactctgtcatttatctgctacatgacttaagacttggtgcctcagctcctccatatgtaaaacgaggaggaaaatagtacctacctcatagggttgtcaggaggatgaaacaaattaatacatataaagtgctcagtggacatttgttgtttttggtaacgtgcttgtttagcacgcacagtccctggtgcagttcttttttttttttttttttgagacgaagtctcactttgttgcccaggctggagtgcagtggcatgatcttggctcactgcaacctccacctcctggttcaagtgattctcctgcctcagcctccctagtagctgggattacaggcacgtgccactacacacggctaatttttgtatttttagtggagatggggtttcaccgcattgtccaggctggccttgaactcctgacctcaggtgatctgcccaccttgccttcccaaagtgctaggattacaggcatgagccactgctcccggcccctggtgcagttctgatacaccttacaactaatacagccttgctgcactgtttatctcactgttagggacaggatcctattatttagcctctgactcatttgtgtttaactaagaagatgatttagatttcttgaacaggggactagctgtcaggtcgatcctgagacagttgtgagcagcacagcccttcactgagttgggccaatctctgtcccatatggacattcctgagttagcggaaaacaaagggcctttcactcctcatatttcattatccaaagtcctctccgtaagtcttacaccacggtaataagcatgtctggctttttgtagcagcaatgtttccttttctgttcttttctgggaagactctatcaacatcctccagataaggattagaagcatctcatgttctttcctccctaactgttcccttggtatatgtctccaacatattacattctcttccctttgtacaatgggaacaagcagactcttaaacacaccaactgtgttctgagtaaagcagacaacaggattcactgtcaagggaggaataggagaagcattattttcacctctcagtccttggccttgtaaaatacaaacgtgtctcacatggaaatgtgaacctgatccattttaatccttacttataaccctgctagtctgaatagtgttcttgcaaaccatgacagtgtgacccctagagccgaatttgtctataataggacatttgcttatagtttaattgactgaattcagtttagcaagcaaaaagttgacagtgcagaggagaaagacttttgaatagtatgaccattccactcagtcctgcacagtgagcatgtggttctgtttgactccatctgatttccaccttagcaccattgagcacgttgtacctttcggggatagcctggtttatgcagacactgcttgcagtacttttattttaacacacaagaagcaggtggagcagagttaagttttgaggggtaagacagacttaatttgctagaaccttggccctttctctcaagaacccagttgattttatatcctccaaatgaattgcccccaaaaaaccagttagagatctaaattactgaaacaggatggttttcttcttcctggctcaatgaatgagtgctaattttggaaatcccccgggtttattgtaaccatagagaatatgacacactgggaaagttgggaacaactccgtccattagccggatttcagctggcccagggccggctggagatgctgctgcttcagtgcagcttgtgggggtcagctctacgtttctgtgataaggctgctcagagccatgctttgtcttgcccattgctgcctattgaggaatattgaaaccagatcacagaactcattttcccttccctctgccagaaaatatatttgcttttcttgtggagacccatccagagacatttttccttatattcttttatatttgggaaaggctgaaaaggtacaggtagttacatttcttttttattataaggtaatataaaattgtagtccaaatgttttttaaatgaaagtaacccattacaagcatttcggtcatcattgctactctccaaagatccctgtgaatttgaaggcccactcttgggttcagaataaccttggtggtctccaggactaagtagccctatagtatgctggccttccctaggacagcatgggtggtggcaggtggaattagagaccatggagtggtctggagcaacttcggcttcatggaaggaagaatggagtgtttgtcttgccaactccaaataaccatgcactaggatgtccccaaagcagtatttagacaccccagaatcttagagttttggatatctagaactttgtggcctttggtcttacatgaagcttcagctaaaggatgccctggtataaagcaaacttagtatgaatttaagccacaaaatagcacatctagtgcctttctctctgtatcatttggttagaacaaaagataaaggaaacaaactaatagttttatcacttcgaatgactactcaaatataaaaaaacagaattagtattttttttttgtaagggaagatcctctttaacacggcataatttgaaaattaaaatgcttggtttagtaatttttaagttagtttgtagtattgcatcagaaaacaagtcataaatgcattttatttttttgagacggaatcttgctctgttgcctaggctagagtgcagtggtagaatcacgactcactatagcctcgacctcctgaggctcaagtgatcctcctgcctcagcctcctgatgagtagctgggactacaggcatgtgccactatgctcagttaatttgtgtgtgtgtgtgtgtgtgtgtgtgtgtgtgtgttttatagagacacggttttgccatgttgcccagactggtcttactcctaggttcaagtgatcctcccacttcagcctcccaaagtgctgggattacaggcgtgagccactgtgcccagcccataaatgcatttattaataatatttttgaaagtgcttagcataatgtttgggatatatagttaggtttcttaggcttttaataaatacgtttttttaagttttctctaactgaaggttttgtttcatccagatagcatatagtatggtttgtgcatagcactgcaaaaaaaatcttattagtcttttaaaaatcgtttagtttcatttttgctttctattatatccactgactaaacgctctctaggaatctcatgctatataaaacacaccttaaagcagagagacagaattctctggtatttcttcaaaccactacataaattaattggtcaaattgagtacaaagcctcattcacccaatactttccatataaatattttgttttaccctttacttgagtttagatatgactagagacctggcctagtaaaattaaatattttttcatttattctactcttttaaacagttctgaggatattaatatttctttcttttttaagaatcagactcattcactaagaccttatcaaacctatttatcagtattttccccaaagaaattaaaccttcagtgttgtgaattctatcgtccctgtgtagttctgatttggttatttttcttcgctccctgagacacctccttggctccaactctccacgtaactattgttattggaagccgtagtctattttcatttcttttcacactcatacatattcactcaaccctgaggctgactcagaaagagtttgggtcactctttttttccagccatttgttggcctgctgatcgttcattcagttggcaaacctggagcgtgtaccttgtgccacactttctgctcactcaaggcctcagagatgaataagggagcttggagtctaatccacttagccactgcttaggtgtacagtttcttgtatggcacatggcacagtctgtcatggtttgagtgttaagaagaagaatcaagcagtggttgcacagatgtcttgttccctctttctcggtgatagtgatgcctcttggggccccatttcacagagtggctatctggtcattctgacctcatccgaagtgtttatctctatcagatgatctgtcctcagatctcactgctgcatattctggtgccttacctaagtctttatcaccaagagaaaagcttccatatcggacccaacccagcctttagatgctgctctgacaatagcaaaaagggcacaaggagtgagatcgcatgggcagaagtctgggggaggaatgccatctcggtcgaagagggagctcatgggaggttaaaggcatgaggattgagtggaagaagacataacttctttgggaggccaaggagggtggatctcttgagcccaagaagacataacttctttgggaggccaaggagggtggatctcttgagcccaagaagacataacttctttgggaggccaaggagggaggatctcttgagcccaggagtttgagaccagcctggccaacatgctgaaaccctgacactactaaaaaaaaaaatacatatatataaatacataaaaattagctgggcgtagtggtgcatgcctgtaatcccagctactcagaaggctgaggcagaagaatggcttgaaccagggaggcagaggttggagtgagctgagattgcaccactgcactccagcctgggtgacagagcaagactctgtctcaaaaaaaaaaaaaaaaaggcataacttcctcagaagtctcaaatctgtgggccccagactgtatttatcacacaagtatgttttgtttgtgctacacagaattttttttaacttaattgtcaatgctttaaaaattagggaatttcacataaaacccaggtttccaatttctttggaaaaatcaggtatttggtaggatatgtcaaatgtgactgttacaggtttgtggtctaagtgactggaatgatagagttgccatttcctgaaataggaaagaacatgggggaagcaagttcgtaggggtagggattggtcagaaatgaacggaatgtattaggttttagatgtatgaagtctgaggtgcatattagcatcctagtgaaagtatgaaatagctaagtagagataaaagtcaggagctccagagagaagtctggaacatatgagagttgtcagcatataaatgatacttatagtcacgagacaagatgatgtagccaagggagtgattatcagtagaagagtcctgaggattgacccaatggcaggaagataatagggacaagagaatagaagaataggaacaagagacagcaaggcaagtgggaactcagggaagtgtggtattgcagaagccgagcaaggaaaatgtttcaaggaggaaggagtgatctgtgtctgtgtcagatgctcacagatatgaggtcagatacaagacaactgagaattggcactggatgtggaatgtggaggttcctggtgactttggcaagaggacgtctggtggagtggtgggggagaaagcctgacaagtgggtccaggagactgaaggaggagaattggaggcagtgaatgtagacagctcttctgaggcatctgctctaatggggtggcagctggatgggaatgtaggttcgagagagggcggtggtgattgttgtgtaaagatagatgtcaccacagcatgtttttgtattgataggaatgatgttgggggtggggacaatgcagaaaactgtggggagatgctggagtgatgtccttggataggtgaaaggggatggcacctagaacacaagtggagagactggcttcagataagagccaggacaggccgggcgcagtggctcacgcctgtaatcccagcactttgagaggccgcggcaggcagatcacgaggtcaggagatcgagaccgtcctggctaacagtgaaaccccgtctctactaaaaatacaaaaaaattagctgggtgtggtggcgggcgcctgttgtcccagctactcaggaggctgaggcaggagaatggcgtgaacccaggaggtggagcttgcagtgagccgagatcgtgccactgctctccagcctgggtgacagagcaagactccgtctcaaaaaaaaaaaaaaaacaaaaaagaaaaaaaaaaaagagccaggacagtttatccttggtaacatgaaggaaggcaaagtgtatgggcacagatgcttgtaggcaggtgttatgttttggctgaatgaatgaatgagcaatcagccaatagaggctaagaatgacatgctgcctccaggagagtctccctagtggcctggtgttgtaagtccttccctgacctggtctgtgaagagaggccagcctagaagataatgttgttgactaggtcctagtgtaggttattaaagtctgggttcgagtgctgacattgttctgatttccagggtattattgggaggattagtttgcaaggcaaagaaattgggtgggtgtctggtcagttgtttgctgggggtagcagctatcttctagtgatgggatatgcaccctttgtgttcctcaggccccacctcagcaagtccattcctcctctccatgatcaggcccactccttggttacttgggtttgtgactcctaacttagattgtgagtgcgtgagagaggagaggtgtgcagttggttgtgggagaagggcttgtgtgtggctctgcccatgtgggcaagtgagtctgagaaggtgcatgagtgagtcgcaatataatagagaacatgagccacagaagtgggcaagaggatgcttgacattgctgccatgattcccagagaagtgtcgcacaagcagtgccgtctttctcggtatctgactgaacaatgcacgtaaagagcttagtgaggactaaaattgctcctgtgtgtgctgtcataaaccagttccttttctgttctaaacagttctgtagtctcatccacatgttactggctgtttctcaactactaaactagtcatgaaaattctatctgatcttttggtaacatcaggtcacagggataattttaacggctcacataagcagtattattgctggcttgtgttcaaactatgtcttgtgatctggacgacccttttgagattctatcaagttaaaattagaacatttattttaagagatgtatgcaagctgagacaaatccccattactgggtcagaatgaatggctctcagtaatgtagagacaattgtgacatgtactcaacctttttttttttttaattcctggctagtagtttagtggtaagtcagggagtgagtcagtgaatcttatggttatccttactctgggttgaggtcagttcaacgctatcttctgacatcaacatttccccttcttattcattggtgaagtattttgcttttatttatttatttcttttatttaggttttttttttttttttttttttttttttttggagacacagtctcgctctgtcacccatgctggagtgcagtggtgtgatcttggctcactgcaacctccgcctcctcccaggttcggttcaagtaattctcctgcatcagcctcccaagtagctgggactacaggcacacaccgccatgcccagctagtttttttttttttttgtattttagtagagacagggtttcactgtgttgcccacgctggtctcgcactcctgaactcaggcaattctcccgcctcggcctcccaaagtgctaggattacaggtgtgagccaccacgcccagcctctattttgtttttagccatgcaatgtaaattctgactaataactgctggttgcatttggtgggagagagaaaacactagaaaaatattctgggttagccttttaagtgttcccctaaatttgcatttaggttaacttaagaagtagtttctccttttacttatgacgtttgcccttacttcattttggtatggtaattctcgattttcataaatgactaaagggtaaattgattatgatagaaaatgatcttttaaagacatttctcagagaacgtaattgagacataaaaataattacttgaaattaatatctagattgaaactctagatatgaaaacagactagtgttcaagacctgttgctcattctttttgtgtatgatgtgtcttatgaaagcttatagagcaagcccttcaggttcctttgctgtgtaaataactgtttagttgtacagttagagcataatgggagttaaaaggactcctgaaccttcatataaggtggccattgttcggtccaggcagagatccctcatatcaagccaagtgctgccctagatgagttctaggaacattcttgtgatatgactgccttacacaaagttgcaaaatctggcttcacttctctctcaccctcctatccaagccccatttttcccccacttaacagctgccttatttctcacttttctgccctcttcccacccccaaagggctcttgggctggtctaaaccttccgtgttcagtgacttatccaggcctgctcttctcataaaaagctggtcctctaaaacctctgaccattcactaccactatccatttccatagatagtaggtgtgtaacagtttgattaaagtagtgtcaggccgggcccgtaatgtcaggcccacacctgtaatcccagcactttgggaggcagaggcaggtggatcgcttgaatagcctgggcaacatggtgaaacctcgtctctacaaaaaataaaaataaaataaaaatacgaaaactagccagtcatagtggcctgtgcctgtagtcccagctacttgggaggctgaggtgggagaattgcttgcacttcagaggttgaagtgcagtgagctgagattgtaccactagactccagcctgagtgagagagtgagacactgtcttaaaaaaaaaaaaaaaaaaagagaaagtaatgtcaatacctaatgcatctaaaagcatttccattccttactggacagaaacagggctgagcatacctatgatatctgaatcctttgcgtgatttctgtatgccccagaatctttcttacctcctcgctcatgcttctctgtgccttcacacttctgagtctgtttcaagtttgccactcagtaaactggccccaactaatttgtaaagaaacctacttacatcctaacactttgtgatttgtttcattgcaatgtgggtagctgttgggaggctacatcactgtgcagtactgccctccacagtcctgctcacctctcccatctctccccactcaccccctgtcttgctggcacccaagggatttcttgccttagggcagaaaaagcagtctcacccacatttaggaccccttaagatcccagtttctactttaaacagccttaccaagggatttcttaaaatgaaaactgccctgtctatgaaaggactatccagtggatacagttttttcactttgttagggtagaataggtaaagaaggtaatttgaggaaggaggatccttcccctgactacagggagtaacagatttagaattaaagagatactcagggattcatgaaggtagagatcagtgcctgagtcacagtgaaatgcagggtgtggattgtttccaaatggtgttcttgttgacattcaagaggaaggccacaggccatatggagaggtatttaaccggcatggagctggtatccaggagggctgcagaatcctcttgaaccagtcgtgtggcggtccagagccatgctgggatacggacagagccagaggctcaggtgtatattcttgcctgcagcagagggcagtctgtgtgcaggtggattggaccattgtgcccttcctctgcatgagctctgacacccaaatccagagacaggagctggggaggcccttagacaatgtccagcacagtctacttgtgggtcacctgctgatcttaagcaccacccatttcttgttgttattccattttttccttaacctctgttgcaaactgcatccttctgaaaagtctttcttcagtcttcttgaatgctaagttgcttacttcataatatgctttcctattggttactttctgttgctgggaccttaactatacttgggggattgccaggattcttaggcatacctttttcactttcaaattaattgtccataggcaggagttaatccataaattaacaaacgtcactctcagacaatacccttataattctgggaatgtcttacaatagcagcctagtcatggctaagagccttggctctgcagccagactgcctggatggaatcccagccttgtcactcaccagccatgggatcctggagaagttatttaacttcttcatgccttggtttcctcacattgtcattttggagattaactgagtaaaccaagcaaacactaaccaatgcctgcgacatatgaatactttatattcttattatgagctcttattattactactgcttagtcattagtaaactgtcaagagagcaggttagaaaagaatagtttacactatattcatgttttaacttattttaattagtattactatcatgttatgactatgtatgacatttatattaagtctaggcaaatcatgggcggaagcttagcagttaaaacaagaggatcaaacagtttaatacaagaggatctaagtaggtgctgtggctccaggccgggaagttgagtcaggaggggtgggcgtccgaggaggtggaaggaatatctcattcttatgtactctgtttcggttttaggcttatgggtttgtattgctaggatggggcagtgccttccctccactctgcaacacaggtgtcagatctctgtggtgggttcccccatcctcattagaacatttgttgaaggcagtcatctgactctttcccatgcattgtccctgcccccacttcctgcacaaaaccacctctgaaaatcccacctgcattcattactttggaatttcagtagcccttaatgtcagtactgccctgatagccccaacttgtcaccttgcttatttttatgcagatgacccatcttactgtttgaacaaaagccttttggggccacacactgagcatagtgccatatgcataatagttgttatttaatcgatagctttatctgtgcacaaatttgggcattatgatttttatccttttaaggattaaatagagcaagagtgttgtgtgtgttacatatacttacgtgtataaaataaagagtaagcttggggatatcaaatatcctcttcatttatcagaagaaacaaaccgtggaatgatcaattaaccttaagaggaaagagctttacaaataggctgtatttttcttgcatgctttttggagcagcagcagcatggtaggatggtaagtgctcatgccttagaggtaaaaccatgtcaaaccccatctctgccacttagttgtgtgaccttgggcatctcacttcagtctctcacagcctcaattatcacattagtaaaatttaccttgtagaaatattattattccccatcatgtccttaaagaatttggtctccaaatatagtaaactctgatgatagctttttaaccagttcctaactttttttttttttaataaactttaggggataggaaaggttacacgagtttgtattattttgaacggtatatcatgctcaaatatcttggttgcctgtaatataaatctactgaaatctaacacttgagcccagtacctgaggttctgtcccattttacttttctttccctactcaaagcctcctctctggctctaacagaggatacctggtctagcacacaggtgctcacctgatacctgccattgcctgtctggaattccctacattatcatcagctacccagatcacatctgctgtataagcttgaagtcacatcccactatcttagcacctctgctcccattgaagctggatagtgcccttcctgctgtgaattcctgagcacccactgttcctatttttgctttgacacttgttacattcacgtttggtttttgtttttatatacatagatttcctgccagctagaacaggactacgctttactcctacttttttaaagatattctttattgtgaaatggagcatatgtacaaaagaatacatattttaaaatgtgcattgtttaaaaataccacccaagttaagacatagaacacaaccagtgccttagaacctctttttgtcccttcccaatcatagcttcgcctttcccccagaggtaaccagcatcatgaaatttatattgattatagttttctgatctttaaacagtaccttttttcttgttttgccttttttttttttttttttgagatggagtctcactgtcaccaggctggagtgcagtggcgcaatctcggctcactgcaacctccgactcccgggttcaagggattctcctgcctcagcctcctgagtagctgtgattacaggcacgtgccaccatacccagctaatttttgtattattagtagagacagggtttcaccatgttggccaggatggtctccatctcctgacctcgtgatttgcctgcctcagcctcgcaaagtgctgggatgacaggtgtaagccaccgtacccggcctgttttgactttatgtaagtggaatcatatatatgtaattgtttgacccgttgcctttttcaacagaaatgttttaaaaattcatctttttgctgcatgatgtgtatagctatagttcattcattttagattgtattccatgctgtgaatatagcagaacttttcctttaaaaaagatggctatataactataaaatctcagtcatattcaacaataagcaaatatttcttacatatatgttggtgggttggctaggacagctctgatgatctcagcagggtttggagctaggctacaggtttggtccagatctgttccatgtttcttttttctggaaacagcaagcacccagggcatattctgctggcagaagttgtaacttctcagagggtgaacagaaataagcaatgcttctgtaaggcacaatgtcacttctgctcatattgcattagtcaagtcaagccaagccataggacatgtccaacatcaggtgggaaagtgtcctccccctgaggaggctgggagtaatgtatacttgctgagcagaaatctaatacagacatttgggttgtttccagtttttgactatttcaaatagtgctggtgctgctgtgaacattttgattatatctcttgttgcacatacacaagcatttctttagggtatatgcttaggagctgagctgctggattgtacagcatgagcatttttaactttactaggtaataccaaatactttccaagtggtgtgcctgttctgtccacaatggattggtgcttcagtgttgcactgaaccgatgctacatttacattttttgtatgtatttaacacacaactgaataagtacttttaaaagtatctgtctcacaatgtcacagtgaactcagtttgattttgaacccttactgcaggatggaaagtacactgttaaagccacagaatagggaggccaaggcaggagaaatcacttcagggccgggagttcaagaccaggctggacaacatagcaagaccctggctctacaaaaaaatattaaacattagctaggcatggtggcctgtgctactcaggaggctaagggtgggaagttagaggctgtagtgaactgtcatgctactgcactccagcctgggtgacagagtgagacactgtctcttaagaaagaaagctatagaaaagtgctactaagtgctgcttatctttttgtcagtactcagaatccactaactgtttcaacttgcgttcacttggcaggtttggtgcaagtgccaaagttgtgcatttcctgggacgagtcaaaccatggaattatacttatgatcccaaaacaaaaagtgtcaaaagtgaggcccatgatcccaacatgactcatccagagtttctcatcctgtggtggaacatctttaccaccaacgttttacctctgcttcaacaatttggccttgtcaaagacacctgctcatatgtaaatgtggtaggttctgtttcttttcttcagatcatttaatgctgctttttaaaaaaattgttgtatcaatagagatgtggaatatttagcagcattttaaacaaagagataaataaaattttgtggaaagaaaacaataaccatcttaggagaaacattaccagcaagaagtagcagaaataaactgtgtggcagatttctttggatctgagaacacagttatttagaattttctgtatatacccatatattttaactttagaattcttagcccattctcctctgaaaagattttgagattattcctaaagtagtggtctataaaaacaacaccccattgaatgttttaggaactgcaaacatttagatgtatctactttatatttgccatctgcttagaagaatgtgttttcagtgaaaatgacaatatgaacatacagtaaatacttctataggattgtttttatttcctatgtttgtactcctatgattactataggatcttgaaaaagaaatatctttgtaggaggcagatgacatgttaacatttataacaaccctctttagcatcttttctgactttaaaggtcttctctgaggtttgttcttatgaaagaattggaagaggatgaggaacgaaactgttacatattcagatataaataagagaacagaatggtggtgaattataatcagataatcagctaatcacctggctgtgagattgtaatattataagagattattctctttcctgtggtatagattttagcctgaaatttcacttactagcatttactaagatatagaaaggagaaagggagaaaaactaacacttgcattcttactctgagttctttatatggatcatgacataatatttgtacagcagtggtccccaacctttttggcactagacactggttttgtggaagacagtttttccatggaccagtatgggggatggtttcaggataaaactgttccacctcagatcatcaggcattagattttcataaggagcacacaacctagatccgttgcatgcacagtttacaatagagttcacgcttctatgagaatctaaccacctctgatctgacaagaggcagagctcaggtggtaattcttactcgcctgccactcaccttgtgctgtgcggcctggttcctaacaggccatggactactgctggtccgtggcctgggggttggggacccctgtcatacagtacttgaaaccacctggcacatagtaaatgcttaatgaaagttagctattcttatttaacccttaaaaccactatattaagtactattagtaagtattgttaagtatattaagtattatatctccttttataggtaaattaactgaggcttaaagaagttatataacttgtcttagttatgtaatagactagtcaagcagcagaatgggcctcaaacgcaggtctgaagagacttatccttatgaaaatttgagatggactatgcttaaaagtagccatctacagcccagaattaagaaagtaccttttatggcaggtgaagggagagttacactttaaatgctaaactattttaagttatgtccagtatacttggcttgacctcaggggcctctcttttagggtgtaaattcacagcccccatattgtgaacagagaggactctggaaatgcctctgtatcattactgttgccaagtgcaaggcaaaggcaggactaatccaatggaaggacttccttatgttgcctcagctataatgcagtcctatacccaaacatcttaaagttccactgtatttaaatacatacctatatgcttacgtatatacgtaattatgaaccaaggaaaggtgaagatgggaattgaaagttgttcaaaactaagcaaattaacagaagctacaagaacagatgctacttggtaatccaaatgaaagcttgaacaagcagagaagtttggtacctagtctcaaaccagtttaactttccttcttataatgtgataactgagtatgtgttgcggctctctagttagattctttctgaaatgtagcctgttgggtatcattttgtttaagttctcaacctttcagagcccacacagattgagaatttatcttgagacttgtgttcccttgcccatccatcttacactttctaatgaactgtttgcagctttcagacttggtctatacactggctttctcttgtggcttctgtagaaaggtatgcagaacttaaagattaaccctaattactttgttctcccaatgttttcactgagtcaagaagtcttcattttgttaggaaaaaatcatataatctatatttttgtgtcttttttgtttgtttcatgtaatacttttcagtttttgctactttgcatgatgattcatcctggcttttctgtcttcaatttattgcattctttaaaacagtttgattttcagctctcatagagtcaattatgctttcctttctaggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgta

SEQ ID NO: 35912 - DNA, 98911 bp, Homo sapiens
aagcggctcgggctgcggctggctcagagtggcgcggggggcgtggggcggtgctgaggagctgaagccgtggccagctcgacgccggacagtccagcgagcagcacggcgggaaccggcagccggagcagtcccggagcagaagcagcagcagcagcagcagccctcgccgttcgcggagcgcagccgagccggccatggcgttgtcgatgccgctgaatgggctgaaggaggaggacaaagagcccctcatcgagctcttcgtcaaggtgagcgctcgcctcgcggtcccgcccggcagatcccccggctccctcccggctgcggggagcggcgtcccggggctctcctgaggcgcccccgctcggcgccagcacccgtcccgctgcgggcacccgcgcccccggcccattgtctgggggccgcccgcgccttcccgcctccgagggcccgtcgaggggtccgggttggggacccgggcggcggccaccgtctccagcgcgtaggcatcggcggacgccagaccagcgtcccgcgcccgggtgggtcgggaagagcccacgggcgggacttgcctgccccggggccccagcgccgggcgcgcgcgggtcctgtcaccaccccccgcccgggcgccggggcccggccccacccgctccccagcgctccggtccgccgcccggagcccgaactgcggcccgccgcccgatgagctttcaaacgaacttctttgaacgcgtttttgaaaaagcatttgctccccactggtctgaaacggaaactttaattttcgatgcaatcttaaacaaatttaccaaagagcaggtgctcttggaccttcggaaaagaccgagattcccaacttgtgtttttctgtcttgggcatttactggctttctcgtttctcaagcgcggagtgttctgtatgatgcaacattttggcttctccccccggcgttgctgcttcgggaaggattgtgtgtgcccttttgttttgaaagaaattgagggagagaattcttaacttgcttgggctttaaagggttggttttcccttgtgtcttcagctttcatgtgtggaatttatttgcttacacatactacccctcttcctttgcttttctctttaatactttttattttagcaaaggagagagtcgaagttataaacatctggatccagctccttccctcaaaacttaaaaaaaacactttgagcttcttccagccacttaaaaagccaggctcattcagagctaggcaacataccggaaagtaaatggtcatctagaactattgggttcttttttttccccgagtttttactttaaagaaaggacatttcaggatgtgtttaagagatagagaagggctgggcgcggtggctcatgcctgtaatcgcagcactttcggaggccgaggtgggaggattacttgagtccagcctgaacaagatggcgaaaccctgtctctacaaaaaaattcaaaaattagctgggagcgatgttacgcgcctgtactactctggaggctgcggtgggagaactgcttgagcccgggaggtcgaggctgcagtgagccacgtcgcaccactgcattccagcctgggcgacagagcaagaccctgtctcaaacaaaagagatggagagaagaaataatctgcatttacctctgcagtcttcagtaatgactggaacagtgtttgccttaggattttctttcaattgtcaattttcgattttttttttttttttttttttggtccagggaactgaaacagcagacaggtatagaacccccaaaatatcaaagcgtttcggttactttgagtggcagatatagtactttgagatgcgtagaatgtaggaaggaacctgaaatacaagaaaggaaggaggccgggcgcggtggctcacgcctgtaatcccagcactttgggaggctgaggtgggcagatcacgaggtcaggagatcgagaccatcctggccaacatggtgaaaccccatctctactaaaaatacaaaaattagctgggcgtggtggcgcgtgcctgtagtcccagctactcgggaggctgaggcaggagaattgcttgaacccgggaggcagaggttgtggtgtgcggagattgcgccactgtactccagcctgggcaacagagtaagactccatctcaaaaaaaaaaaaaaaaaagaaagaaaggaagggtggtgggtggaaaacagcatggagaagggaaacaagtgggccagagatgagttaaaaaaaatttttactgagtgaggaataggaaggaatttccataaactcaaaaaaagtgcatccatgaataatctgtaaaacatgatacttaacggtgaaactttagaacagtattaaacttagaataagctactatcgggccgggtgaggtgactcacacctgtagcattttgggatgccgagatggggagatcacttgaggccaggagttcgagaccagcctggccaacatggtgaaaccctgtctctactaaaaatagaaaaattagccaggcatggtggtgggcccagctattcgggaggctgaggcatgagaatcgcttgaaccggggaggcaaaggttggagtgagccaagatcaagtcactgcactccagcctgggcgacagagtgagacttcgtctcaaaaaaaaaaaaaaaaagataaagctattatcagttatggctctattcagtattctattattctattggaggagctaatcaaagaagacaagaaaaattaagtatctgaattaggaagagatcagtgattaatgccctgcttactattaatttcatctttcagttagaatagcagaggggcgtgtgcagttttccaaacttgagtcacttgcatcccctttctgtttttcatatttgtgttgagaaccactgaaaatcatccttcctaccactagttgtaagcctttctcattgggcttggtggcagagaatcagggttcaagtcacagttctttactccttggttgggtgaccctaggcagtttgttttcactctttaagccttgtttgtctcatttgtgaaataagaaatgttttctgctacccagtgattcaacataggcaaactttgcactgatacagatcaggttttttgtttttttttttttttttttttttaatgagatggtgtctcgctctgtcaccctggctgctggagtgcagtggcgcgatctcggctcactgcaccctctgcctcccaggttgaagtgattcttctgcctttgccttccgaggagcgcatgcaccactacgcctggctgatttttgtattttagaagagactgggttttaccatgttggccaggctggtctcaaactcctgaccttaagtgatctgcctgccttggcctcccaaagtgctgggattacaggcttgagcctctgtgcttggcccctagaccagtttgtttgaaaggggaaaaaaggacaggtaaaatgtggtaaagggcattcttgatctcttctcaaaacctacgtgtgggaaatgcaaatgggggaaatacccttgtaaatatagttattttgaaagcagtggaccaggtgtggtggcacactcctgtaatcccagccttttgggaggcggaggggggtggatcacttgatgttgagaccagcctgggcaacatggcgaaaccgcatttctactaaaaatacaaaaattagccacgcatagtggtgcatggctgtaatcccagctactcgggagactgaggcaggagaattgcttgaacctgggaggcggtggttgcagtgagccgagatagtgccactgcaccccagcctgggtgacagagcaagactccatctcaaaaaataaaaattaaaaaaaaaaaaaagaaagtagagagggtgcagaggctgtggttgtccagagtggtatgttgaacagtgttaacctgccaagaggtatctgagtttgtaaaagaaaactatttacagttgaagcacatagcatgtatggaaattagaaatttggtggtggcgctaggggaaaggccaagagatgtaatggggctttgagcctacctgtctagctagcactgagcttcacatttaagagagagagatgagcaccttctcaaatagtatgactgaactcacagctgcatttccttccttgtgagtagtttttggagttgtctgcctgtgagcccattaactccctgtcatctatataacagcaggatggtttttttggtttgtttttgttttgttttaccctcaacatctggaggatagataggatgccctctcaaaagtaaaaaaggcagctgggctgtggtggctcacgcctgtaatcctagcactgtaggaggccaaggaggatgaatcttttgagcgcaggagttctagaccagcctgggcaacatggcgagaccctgtctctacaaaaactattaaaaaaattgccaggcacagtggctcacgcctgtaatcccagtactttgggaggctgaggcaggcggatctcttgagcctaggagttcgagaccagcctgggcaacgtagcaaaaccccatctctacaaaaaatataaaaaattagctgggtgtggtgatacatgcctgtggtcccagctgaggtgggaggattcctttagcctgggaggcagaggttggctgtgagccgtgatcgtgccactgcactccagcttgggtgagaccctatctctaaataaataagtaagtaactaagctgggcctggtggcccacgcctgcagccctagccctagaggctgcgggtgggaggattgtttgagcccaggagttcgaggctgcagtgagcttatgatcatgtacctgcactccaatctgggtgacagaacaagaccctgtctcgggaggaaaacaacaaaggcttataatggcaatcatcctcaacagtggagatgctctctaccccactcaggagcctggtaggtgtatatatttccagctgggaaccaccaacagatacggtatatttgagaccttttagcaagggcataaggtcccttgtaatctgggtttctttctttctttctttctttctttttttttttttttttaagacggagtttcgctcttgttacccctcagcctcccgagtggctgggactacaggtgtgcaccaccacacctggctaattttgtatttttagtagagacaaggtttctccatgttggtcaggcttgtctcgaactcctgacctcaggtgatcagcctgccttggcctccaaaagtgctgggattacaggcgtgagccaccgagcctggcctactgcctgagtttctaatccaatatgtccagttactaattgtgtatcccaggatacatcacttaaacctgtctgtgccacatctgcacagttgggatattagtagaacagtcctatgggataaattaatatatgtagtatgcaacaatcttagaacaatgtctagtacacagtaagcaaataaatgctagttgtgtataattttgtatgaatatatatttataggcagatctcccctactagatagacagtaaattccttgaggatagggtgtgcatatggttcagagtgcctgcaacttaagaggatgccaaatgtttgaaatgagattgtgcccttctttcagagaattctgttgttgagcattttgttgtcaatgtatgtctctaccatgctttggaattagaaaccacttactgagatcccgatggttggagcatcaaagcatggttcttcatcctgatttctctagcctccagtctccaaacccagtgtaattttatgtactcacctcttttttttctccatttaatacttccagtcttttttttttttttttttttgagatggagtcttgcactgttacccgggctggagtgcagtggcacgatcttggctcactgcaacctctgtctcccgagttcaagcgattctcctgccgcagactcccgagtagctggggttacaggcacccgccaccatggccagctaattttttgtatttttagtagagatgaggagctaatttgtatttgtagtagagacggggtttcactatgttggccaggctggtcttgaactcctgacctagtgatccacccgctcggcctcccaaagtgctgggattacaggcgtgagccaccgtgccagtcttttatatatttactagtgtttcttcttggctatgtccagaatttggggaaccaagatttttgtttgggtaaaactaaatattaactcttgaaccacaaatgagagtaatagagatggggtttctccatccagcttggccaacatggcgaaaccccgtctctactaaaaatacaaaaattagccggtcgtggtggcgggcgcctgtaatcccggctactcgggagtctgaggcaggagaatcacttgaacccgggaagcggagattgcagtgagccgagattgtgccattgcactccagcctgagggacaagagcaagactctgtctcaaaaacaatcaaatcaaaaaacagaaagtaatccctttgcggagttcagttttatgggctggaatttaaacttgttgttgtgccactgtgaactgggatgatcactgtcagcaagtagtcaccaagctgctgggattggggtggtgtttgtaaaaagttaatctggtgcagggtggcataacacataagagtctgtttcttttgagatatttggcagaggttcctaatgtgcttggactctggagccacactgcttgacttgaatctggcttctagtatgtcaggcaagtttttaagctctcagtgcttcagtttcctaacttctaatatcaggataataataatagcaattttatatggttactgaggggattaaaactgttaatctgtgcatattagttagggtagtttaagttgctgtaataagttatccccccacaaacagtggttcaaatatgatggaagtttatttctcacccctcagtccaggagaatgtcttagatgttagggtggctttcctcctcagagtcattaagggacccgggctctttctagcttatttgtccactaactcccagagcattgtcctcttctgaattgtcaaagttggtgggtgacaagtactgtctgttgccagtggggggtggaaaatatggaggaagcacatcttaagggccccagctcagaagttctacctgttacttccggtcacattctattggagagaacttaatcacatagcttcatctgcaagagaggctggcaagtgtggtctaaccgtataccatcctatgtaaagctttaggaagagtgcttgacacatagtaaacacctgcttttgtcatcgataatagtttattattattatttttttttgagacggagtctcgctctgtcgccagactggaatgcagtggtgcaatcttggctcactgcaacctctgcttcccgggttcaagcgattcttctgcctcagcctctggagtagctgggactacaggcgcgtgccaccatgctcagctaatttttgtatttttagtagagatggggtttcaccgtgttggtcaggatggtctcgatctcctgaccccatgatctgcccgccttggcctcccgaagtgctgggattacaggcgtgagccaccgcgcccagcctaatagtatattatttttaaatgtgggctctattagtaggatcagggagttctgtaaatccttgaaattacagtaaaaaattctaatgtgaggctttttttctggaaattcctaaaccaaggctaagaaccactgttctaaaagaagtaaatagtggaattcttagagtcaagaatactttatataagcaaggtataaaagaagggcttgggctagatgatcacaaaggtctcttctagttattattaactatgacttaaagaatgtaccggcatgaactaagtgctaatactgagttaagtactatggaagatataagaaattattaaacagttaatttctttaggtttacaaattttattggaaagaaaacaatacaagatggtccatgcttaaagagtcaagtggggctcacattaagtagggctaggagacatggggaaagatggaaggaggcttaaacttgaccttgaaaaaggaggtgaataggtgggttcggaatagccaagaatgggaatgtgagttttgacattatgtggaaactccttatgcaggaaacaattggtagattgatacctaagaaggaaccaggagtgattcagatctatagtgccagggagacaagttatttaaaagttgaggatgagacttttaaaacctaacttgggtttttgttaatgtatacattttcctaacttttttcattctccccacactttcctgtgtttttggattgctgtctgtttaataacttttcagtggcacttgggaaggtgcaaatggattgtacagatggactgttttgacagtttaaagtgggaattctttatattgtttcaaggacaggcttcaaacttccccccgtctttgttttttctaacagaaaaaaatgaaataaattttctataggaaatgatgctgaaaactgttctggtaattaacaaaagctaactcaatattcagacaatattaccttgaatctaattgatttgccattcatttgaggtttccggggggaaaattcaggagacagaaatgaatgtaaagtatgaagttaatgaaaacctattattttaactttttgcctgagctgttcctgaagacctaataatgctacttttggcaaaggccaaatttgatgattttggtttaatgtaaaaacctgtgagaaaggagcctagaatggggaagaggcaggaggctttgagcctaggagactgagcacacgaaaagcttaacagagtatgaataatgataggaaagaggcaattgggagaagaacctggctgtcaggaaatgtcacagttggtttgggaagatgcctgcagaggtgcctagaagccagtaagtaaggatggtgagccatccttttccgcttcctgtttcgttagagctgtggagcctccgtgttctgatgtcccctgagtagggaattgtgagtccataaaaggaaaatgtgttaggcaggatgggaagtgtgattaaggcatgagttaagattttggtcaagtagaggagtaagctaggatgggtttgcctgttttagacgcttgcatagagaatggaaagggactttctgaaggaaaatgacattaggtcatggttacctattgtccaaggatgatttaagacatgtaaatgtaatttagggcatcagctagtgaattttctcatggcttttaattatattgtctatttcgagacttgcctcttatctctcagtggtcagttccagatattggtataagaaataagaaataacaatgataggcccactgccatggctcacacctgtaatcccagcactttgggagaccgaggtgggtggatcgcctgaggtcaggagttcaaggccagcctggccaacatggtgaatccctgtctctactaaaaatacaaaaattagctgggcgtggtggtgggcgcctgtaatcccagctactcgggaggctgaggcaggagaattgctttaacctgggaggcggaggttgcagtgagctgagattgtgttactacactccagcctggacgacagagtaagactccgtctcaaaaaaaaaaaaaaaattataggctgggcaaaatagtgagtcctcatctctataaaaactaaatttttgtatttttagtagagatggggtttcaccatgttggtcaggcttgtcttgaactcctgacctcatgatctgcccgcctcggcctcccaaagtactgggattacaggcgtgagctaccactcctggccccatctctactaaaaatacaaaaattagctaggcatgatggtgcacgcctgtaatcccagctactcaggaggctgaggcaggagaatctcttgaacccgggaggcggaggttgcagtgagctaagatcacaccactgcactccagcctgggcgacagtgagactctgtctcaaaaaaaaaaaaaaaaaaattagtctggtgtggtggtggtggtgagtgcctctagacctagctttggcaggctgaggccggaggatcacttgagcctagaagttcaaggctgcaatgagctatgattgtgccactgcactctggcctgggtgaccgacggagatcctatctcttaaaaaaaaaaaagaaaagaattatccatataattagccttatatggtttctgttttttcctttatttaaaataaaaccaaaaaacaaaattaaaaaaaaaataataaaaccaggataatatgttagtctaatttatgaaagtgacaacttagtgcagataaataagactgtatttgaaaactgtatcaaatgtagactaggagtatcttaaattttaactttttttttgagatggagttttgctcttgttgcccaggctggagtgcagtggtgcgatctcggctcactgcaacctccgcctcctggtttcaagcgattctcctgcctcaacctcctgagtagctgggactacaggcacgcaccaccatgcccagctaattttttgatttttttttttttttttttttgagacggagtcttgctctgtcgcccaggctggagtgcagtgacgcgatctctgctcactgcaagctccgcctcctgggttcacgccattctcctgcctcagcctcccgagtagctgggactacaggcgcccgccaccacgcctggctgattttttctatttctagtagagacggggtttcaccgtgttagctaggatggtcttgatctcctgacctcgtgatccgcccgcctcggcctcccaaagtgctgggattacaggcgtgagccaccgcgccctgctaacattagtgttttgaaaaagtaactattagaaccagggccaggaacggacctgagttcaacatgcatatattttgtacctttaagcatcctttcataggtttctttgcttttcttgaagttgaaatacaagctgtttcttgaagctgaaataaactaggagtatgacaggttttctttctctttttttggtaacaaaattattacttccaacttacatgtgaataactcattcttatgaaaagatttagttctcattataatatagttgtaaaaatgtcaatcacttgtaataacttaagtattgaattttaccactgtgcagcatagctatttatttgtgtatgtgggagaagaaaaaagagaatctgaacaaatattgaagaatacaaaaccaaacaatcagatgaaagctgaggtaattaagaactttttttttttgaaatggagtctcactctgtcgcctaggctggagtgcagtggcgtgatcttggctcactgcaacctccgcctcccgggttcaagcgattcttctgcctcagcctcctgagtagctgggattacagacacccaccaccatgcctggctagttttttttttaatgtttttttttttgagacggagtttcgctcttgttgccgaggctggagtgcaatggcacgatctctgctcaccgcaacctccgcctcctaggttcaagcaattctcctgcctcagcctcccaagtagctgagattacaggcatgcaccaccacacccagctaattttgtatttttagtagagatggggtttctccatgttggtcaagctagtctgtacctctagacctcaggtgatccgcctgcctcggcctcccaaagttctgggattacagatgtgagccaccacgcctggcctagtttttgtctttttagtagagacggggtttcaccatgttgggtaggctgatcttgaactcttgaccttaggtggtctgcctgccttgacctcgcaaagtgttgggattacaggcatgagccactgcacgtggtcttaagaacttttaaggatttgtgaattctctgcatgttttcttctgctaacaaccagttactttattttggaagtagagaacaggtggtggattacgagagtgaatattcattaaaaactaaagatggaccaggcgtggtggcacatgcctgtaaccccagcactttgggaggctggggcaggaggatcatttgagcccaggagttcgagaccagcctgagcaacatagtgagaccctgtctctacaaaaaaactaaaggtgaaccaaactagattattgtgctacctaggaaaacagaaaaagtggtagctgtgaaaacagactaattaggaaaaaaaagaaggtgattacacttaagaaattaaatttaagccttgaccataacacacacccaagactgaaatgaatttttttctttttcttcccttcttttttcttttctttctttttttttgagacacagtcttcctctgtggcccaggctggagtgcgctggtgcaatcacggctcactgcaaccccaacctcctgggctcaagtgatcctctcacctcagccttccaagtagctgggaccacaggcgcatgccaccatgcttggctgctttttatagagatggggtttctcagtgttgcccaggctggtctcaaactccagggctcaagcaattctcccacctcagcctctcaaagtgctgtgattacaggtgtgagccaccgtgcccagccctatttagcctttctctgttttagtttaaatattggtcctaagtttgaaaaggtaatgtcatttccttctgctttctagtatattcattgtgtgtattatgctctttttaaaaaagtgtcttttttccagttataaaagctatatgtatttactctagacaacttagaaaacaatagaaaagcataaataaaataaaaattacttataaccccttgactagagatagttgttgctattgtatgtcctagtcttttttttttttttcctcgttctttctccctggctggatgcagtggttcaatctcagctcactgcaacctctgcctcctgggtttgagcgattctcctacctcagcctcccaagtagctgggattataggcgcctgccaccacacccagataatttttttttttttgaggcagagtctcactctgtcacccaggctggggtgcactggtgcgatctcggctcactgcaacctccacctcctggttcaagtgattctcttgcctcagcctcccgactggctgggactagagacacgtaccaccatgcctggcttatttttgtatttttagtagagacagggtttcgccgttgttcgccaggctgatctcgaactcctgacctctggtgatctgcccgccttggccttccaaaagttctgggattacaggcatgagccatcatgcccggcccttagtctttttcttaataagtttgcatgaattattatttatttatttttatttttatttttttatttttgcttgcatgaattattgagaatttatatataatattttaatgctgttcatgacagaagacttgaatgagtgaaggatgagcactgatctgatatgtaacatgtattgaattaagtgagttggtttaaagaaaatttatttaggttttataaaagaaactcagattttgcctatatcttctttagaacatttgatctttggtggaagaaagcaggtcatgaaagtatgacatgaaatgtgccatcacctagaatggatattgattaaatggtttgaaggtagatcctcctcttgtgctctttaggagaaatctattctaaaaatgaaagttatttttcagtattaatttcttccttcaatatctatgtaataggtaagatatgtccattttatagttcaagtataataagaaaccagtctttgcctaggaacagttgagcacagtataggggatcataatagaagcaaacatcaattgaatactttccatgcactaagtgctggagaggtaaaggagtaagaatgagccccttgtgttcaaggagctctattataaccaagtagacagtcagatggtgagtaaatgagccatggttgttggtggtaggttcttagcaccatctttttcctatacaatacgtgacttttttttttttgtctcatgcacttttttattctagctgaaatagaagcttaagaaatgatttaagtgggaaattaaatgagataattgatttagagatgagttaaatgtttgtgttgtattctaacagtttaagggttgctagtattactgactctattacactgcttattatcagttgtttaaagaaacttttgaccaggcatggtgactcacgcctgtactcccagcattttgagaggccaaggtgggtggatcgcttgagtccaggagttcaagaccagcctctgcaacgtggggaaaccccatcgttttgtgttttgcaaaaacacaaaaatctgggtgtggtggcacgtgcctgtattcccagttgcttgggggctgaggcaggaggatcacctgaaccttgggaggttgaggccacagtgagtagtaatccataatcgtgtcactgccctccagcctgggccacagagtgagaccgtgtctcaaaaaaaaaccaaaccaaaacaaacttttatcttttccctcaataattagttgcatgttatatctgctaattttgatctatctaaaataaaatggatacttcttgcctcaaattttaaataggggccagatgtggtggttcatgcctgtaatcccagcactttgggaggctgaggcaggtggatcagttgaggtcaggagtttgagacagcctggccaacatggggaaaccccgtctctactaagactacaaaaaattagccaggcgtggtggcgggtgcctgtaatttcagctacttgggaggctgaggcaggagaattgcttgaacctgggaggcggaggttgcagtgagcctagattgcaccactgcactccagtgacagagggggactccatctcaaaaaaaaagaaaaaagaaaaagaaaagaaaatcttaaatagatcctgctttccctagttgtttattgaattagatacaaagtctttgatctggcattgatctaacttgtatttccactcttaacccccaccgcagctgcagatatgcctcatattgtatctagattggtcttaaacatgctctgcacttctctgccttcatggaagacttttgctgatatttccttcacttgatacacttttggcttttccaccctctccctgcccccaatttctgcttgccagaataatatctgttcttctttcattcatttatttaacaactattgagacactgttgtaggtgcttggatacacctagtgaacaaagttcttgtcattatggcagtcatattcagttgagggaggcaaacgataaatgctggtgattaaatgctgtgaagaaaatgaagtaggttaaggaaattttttgaagtaggttaaggagtattgacaatgatagggggtgctattttcagtttaacggggcattccattatccctgtggagaatgacaattaggaaggcaaggtcagaagcagggagactaattagaggtgacttttccagtaatccaggcatgagatgatggtggcttggaataaggtgggaagttgctggattctggatatattctaagatggagacaacagaatttcctgagggactggatgtggaatgtgagagaaagaggagttaaagatgattctgagatttttgttctgaacagccagaatgatggagttgtcattaactgaggtggaaaaggctgtgggaagggctagttctgatggggaggagatcaggagtttagttttttgacgtgttaaattcaaatttattaatacctcatagaacctatcatctacttggagaggcatatgttaaagaaacatataaataaggacagtaggttattatatcaaagaaaagaacagggcaacttgagaaagaatggcaggaaacccaatttagatggaggctcagtgagagcttttctgagaaaatgacatgtaggatgagtagtaattagaatgaggggaaaagcgttctaggttgaaggaatcagcatgtgtaaaggctggaaataatcagttaagggtgtgactggaaaacagagaacaaaagtgagcagtagagtgagggattgacaggggccacatcatggagggccttgtatgtcatgtgaattttgtccttagtagaaatggcagttctcagatgggtttaagtgagggagcttcaggattagagttgcatcttaatatgagtagcctggctctgtggaaaatgaatttaagggaggcaagagtggcaataaggacaactatttggaggccattgccatcaagaaaggtgatggtggcttggattaataaggtgatggagagaagagaatggatttgaggtagattttggaagtggtgtcaataggaggatgttaaggaggtatgtgagagagaaaagtgtgagaaatgacttgggtttgtaattagagccactggtcaagagttgccgttcatggagagggaggaggagcagacagagttcaagttttgacttgttgagtataagatggctgagatgtcaagtggagatgttggtagaaagttggacctacagatctgttcagaaagaagtctaggcagggtagagatatttgggacttgatgacatacatatatgtatatatgacatacacacacacatagaatatttggtatttaaagtgtatgaggctggatgtggtagctcacacctataatcccagcactatggaaggctgaggtggaagatttgcttgaggccaggagtttttgaccagtctgggcaacatagcaagaccccatccctgcaaaaataaaaataaaaaatcagctgggcgtgatgtcacatgcctatagtcctagctacttcaggaggctgaggcaggaaggttcacttgaacccaggagttagaggctacggtgagatatgatcatgccactgcactgcctgatgacggagtgagactctctctaaagaaaaaaacaagtgtatgagatcattgtgtggatgagtaaagagtgaggaaaatgcctagaagcaagttctgaggaactctaaacacttaggggttgggtaatggaggagaagctagacaaggagaacaaagaggaactgtgggggaacagtagtgagtggtgagaggaaaactactagagtgaggtaggaagaagctaggagaggtttgtaaggagggagtgaccagttgtatcaagctgagtgtttgttggatttaacaccctggaagttactggcaaccttcgtagtaacagctttggtggagtagtggtggtgggaagtcataatacagcgggtagaagaatgaaataggaagtaagagactggagtcagtgtgtaaagccaactctaacaagaaacttggctatgtagaagacacaggttgatagctgcaaagggggatacatatgaagggaaggctttaaaaagtatgagctgtaagagctgggttgaatgctgatttattagagaaagaagtggaaaattaaagagagacatggtttaatggatgtccttcaaggaatctcccaaatggccacctattccactaggtccccctcagtggtatgtattgcttcttcgtatgaattttcatacaaccttccctcctacttctttacttgaggccaagtaaactctgtgaggaagaaattttgttcttcatctttgtataagccagactgtccaacactatgtttttttgaagaaccagctaagacaggttcttccttttcctgacccccacactctgcaagtgcaaaaaccattttgttggtctctactaaagaaagaattggctgggcatgctggctcactcctgtaatcccagcactttgggaggctgtggtgggcagatcatctgaagtcgggagttcgagaccagcctgactaatatggagaaaccccgtctctactaaaaatacaaaaattagccgggcgttgtggcgcatgcttgtagtcccagctacttgggaggctgaggcaggagaatcacctgaacctgggaggtggaggttgcagtgaatcgaaatcatgccactgcactccatgacagagtgagactccgtctccaaaaaaaaaaaaaaaaaaaaagaattaagttcaaatctatagtctggcattcaagtctatgaccttcatagtctagctctaattaattggacaaatttatctcctacttctcctgggtcttacagtccagctaaattgaactcttctttgtttccatatgagctatcttgtttccctgaagcaacctttcccatctcttccattcccatttgtttaaactccataatcctgtaaatctccatttaaatgtgtctgcctttgttaatccttcaagattcatatttcatgcctcttatatgactcttcggttatctattttgttgatagttttgcatgtatgtcttatctttgctataataaagtaagctccaggagagtagattccttgtcttattcatctttgcgtccaccacgatatttagtagattgtctgcctcataataggcattcagtaagtcttattgaatgagtaaatgcacttaagtatagttgatagaccttaacctactgctagtaaattatagttggctaaaaatattctttataagtgctgtgctttggaaaaggatcatctgcttagcagcactgtttggtgggtagttgttgcccaggctggagtgcaatggcacaatctctggctcaccgcaacctccgcctcccgggttcaagcgattctcctgcctcagcctctcgagtagctgggattacaggcatgtgccaccacacccggctaattttgtatttttagtagagacggggtttctccatgttggtcagggtggtctcgaactcccaacctcaggtgatccacctgccttggcctcccgaagtgctgggattacaggtgtgagccaccacgtccggccaaggctcacacttataatcccagcactttgggaggcgaggcaggtggattgcatgaccagcctggacaacatggtgaaaccctgtctccacaaaaaatgcaaaaattagctgtgtattgaggcacacgcctatggtcccagctacttgggaggctgaggtgggaggattgcttgagcccaggaggcgaagtttgcagtgagccaagatagtgctactgtactccaccctgggcgacagagcaagaccctatctcaagggaaaaaaaaaaaaattcatactctggtatcttctggcatttcacagaagggcatctggattcctgccaaaattgattcttttgtcttttattaaaaataatctttcaagcaaatttgagattcaccactaaagccctaaatttgtttttatttactttgtgttttaactctctctcactgcaggtttgttgttgttgttgttgttggttttttggtaagtacagagactacaaatttaaaaaatctttcattaaacatgtctttactaagtgcctactaggaactgctctaagctctgggaagcaagaaaatgtaccctcaggtgtcagtaatgaatgagctataaggaaggcgtactatacacaattatcttagatgggataatattttccactagagttattgtaactcactgcctgggaggccttttcacttctaggaagatctggttttcctatatttagaatagatactgttcccattgactgttttctgttggatttcttaaatgcatgagatagaagaagtatatatggaaaagcatttcatatttaattgaaataatatatacatttatggagtgctttctatgtgccaggcactgtgttgactacatctatgaaatattaactcatttgattgttactcaataaaatgtttgctgaaggaatatatagaagcttttatttttttccgtgcacaggcttaatttcagaggaggttgggaggaaaagaagaactaaaagatcacatgattgggaaaaagcaaatgcctaacaagaagccagagaaataggtcgagagggtgatgcaaatgactgggctcagttcatattttagattgaaataaacagatttacttgtttttccttgcaaagtaaaaaagttttaagggagagtctgcaactgtgttttgaccctgagcatgtggcttgatagccattaagattaggagtgttgagagcagctattgtcctgatgactcagcaggaacccctgtgttagattataccgttgcctccgtattgcatgtaaaaagttctttatatcttttgaaatatttgagatcatagatcccaaaatcagagccagggatgattgtttacttgaagtatcatttgtatttttctttccttctttttcttctttctttctttcttttttttttttttgagacagagtctcgctctgtgacctaggctggagagcagtgacgccatcttggcttactgcaacctccaccttgtgggttcaagcaattctcctgcctcagcctcccaactagctgggattacaggcgcccaccatcatgcccggctaatttttaaaatttgtttaaattttaattttagttttttttcttttgagatggagtctcgctctgttgccaggatggagtgcagtggcgcgatctcagctcactgcagcagcctccacctcccgagttccagctattctcctgactcagcttcctgagtagttgggactatagacgtgccaccacgcccagctaatttttgtatttttagtggagacagggttacaccatgttggccaggatggtctcaatctcttgacctcctgttccacccaccttggcctcccaaagtgctgggattacaggtgtgaggcaccacgcccggcctatatttttaatagagacagggtttcaccatgttggcgaggctgattttgaaatcctgacctcaaatgatccacctatcttggcctcccaaagtgctaggaatataggcatgagccactgcaccttttttcttttttttagatatcaggtcttgctatgttgcccagacggttttttttttttttttttttttttttttttttttttttttttttttttgagacggggtctcactctgtcacccaggctggagtgcagtggcacaatctcagctcactgcaacctccgtctcctgggctcaagtgattcttgtgcctcagcttccctagtagctgggactacagacatgtgccactgcaactggctaatttttttgtatttttagtagagacatagtttcgctatgttggccaggctagtcttgaactcctggcgtgaagtgatccgcccaccttgccctcctgaagtgctgggattataggtgtgagccaccacgcctagccagtatttctgtctaggtgctgaaatagtttcttttggaattgaagaccatttgaattaatatttcaagtaggcaattgagtcatcataatggaagactggatctttagtattatgctgttagagtatgcagtgtccagtcttttggcttccctgggccacactggaagaagaattaccttgggccacacaaaaaatacactaacaatagctgatgagctaaaaaaaaaaaaaaaaaaaaaaaagaaaaagaaaagaaaaaccaaaaaaaccttataatgttttaagaaagtttatggatttgtgttgggcttcattcaaagtggtcctgggccacatgtggcccacggacctcaggttggacaagcttgatgtagtggctaagagtgtggactcccgagccatgtggcctgtgtttgaatcctagttctacccttcactagttgccttggtgtccccactggggtaatcttgggcttttgtaaagattataagagttaatataagaaaagcccttagagtctaactcatagtaagccttgtttgcttactattttgcctttaggaatgcagaattaagaccatgttggcttggcctatggttagtttattatattcaatataccatatgtggtttcaaccttcaggattagaagcatctgccagactgccactaccaccaggtgggaacttttcattctttatcaaaagagcagggttagtacaaaaaaagttcaaggttaagcttgagtttgctcttgaattaacttcagtgaaccctgatcctgttgacacttactaggtaactaaaggacagtcagattggactctgccatcttagtccatcggcctcagcagctcttgctggacttgtagctaaagcttgagagtccattagtagtgagaatgtttttctttttttcctctctctcttttttgttaatgtgaaagtgcaaaagtaaagaggaataatctatgacataggatcttattggttctgtacaaatactcttaattaaaaatttttaattaaaattatatatatatatattttttttggcatggagttccgctctgtcgcccaggctggagtgcagtggcatgatctcggctaactacaacctctgcctcccaggttcaagcagttctgcctcagcctcccgggtagctgggattacaggcgcttgccaccacgcttggctaatttttgtatttttagtagagacgggatttctccatgttggtcaggctgatctcggactcctgacatgaggtgatccgccctccttggcctcccaaagtgttgggattacaggtatgagccaccacgcccagccaaaattttcatttttttaagatatggggatcttgccatgttgcccaggctggtcccaaattcctgaactcaagtaatccccttgtggtggcgtcccaaagtgctgggtaaaagtacttttgaattatggattttggcttcctgtgctaccaaatttcactatttcttgatttttgtggtattcacctttacaactgaacaggtcatatattaactagcctttatctaatgctttctttaaaggaaatgtagacgtgcttatatttttaacacatctacatttctcttaaagagaagagattaagctctttttatttaatttgtctggaagaagttgagatagtgtagatctacaggttttatatttagtaatttttaaggagtaaaaatgaagtcttctaatttttctagactctatctaagattattgtttttagactttttcatcttataccacaatgagatgataaagcttaaaacattaacatgtcggccgggtgcggtggctcacgcctgtaatccctgtactttgggaggctgaggcggtcagtcaggagttcgagaccagcctggccaagatggtgaaaccccatctctactcataatacaaaaattaggaggcatggtggcatgtgcctgtagtcccagctactcgggaggctaaggcagaagaatcacttgaacccaggaggtggaggttgcagtgagccgagattgtgccactgcactccagcctgggcgacagagtgagactctgcctcaccaaaaaaaaaaaaaaaaagaaaaagaaagaaaactttagcatgtctgtaattggtagatataatctctatcatttatttaatgataattaaaaatagcggggcatggtggcacatgcctgtggtctcagctactagtggggctgaagcaggagattgaggctgtagtgagccactctgattgcaccactccactccagcctgggtggcagagtgagactctgtctcaaaacaaaagaaaacaaacaaaaaaacataatgtaagaatcatgaagtgactttaaaatctttattttataataatgttataagttttctgaagctacttaatttatcactatacagaataaacagatatataaaaaatgatcagtaagtttttgtttccctactaaagccagaataatggtcatgaggtaatagatagcattgggtgcttactatgggccaggcacagtgtgccagccgtttgcatgtgttagctaatttaatcctcatataaactttgaaataggtgctatcaatactgtttaacacatgagaattagagagatcattgtttgggtatggttgcagggccagtaagtagcagtactgtgatttgtactaacgtctttgggatttcagaacctgaatcaataactttgtttatgttatttttctctatttatttgaaacttgaatgctttcctaacagaatttcttatgttctgttttcagtcaccctgaaaaaaaaattctgagaatatttaaggatatttctaaaacatactaacaactagtgagcctagatggttcattagatgactttggttgctttcagttctcttggtaaaatttgaaaggcaactaaaatttccattacctcacctcgttgcattttgggggcctggttaattagtattttataaagcactttagagggtttatttataaacttgttaaggaacctgacttgaatgtcttttttttttttaaggcagagtttcactgttgcccaggatggagtgcagtggtgtcatcacaggtcactgccaccttgacctcctgggctcaagtgatcctcctcctttagctccctgagtagctgggacttgcagtgccaccatgcccagctaattttttttaaattaatttttttgtggagatgaggtctcactgtgttgcctaagatggtcttgaactcctggactcaagttatcctcccactttggcctcccattacaggcatgagccattgtgcttggcctcacatattttgattttaggattgttttccaattgagaaatgtctaaatggttcaagtttaacaaaaatcatatactaatttgttaattatttttctgtgagttcttttctttctgccctctccctttctcccttcctcccccttcagaggttggtagaaaaaaaaaaaaaaggcaaggaagtttctttttgtggagagaggaaatgactgttggttcaagactttatccatattaggtataaactaaatatagacgtgtaatccaggagtgaagtcacatctataaagtttcttaagcaaagctaatgagatcagccagtgcttttggatctgttttttccccccttgcttttggctcacttaccaaactgattagtcttatagtctgcctgcctttgcttctttaaaaaaagaataaaaaaattataaggaatctttctgtaaaacaagcacacaaatttttaaaaagttgctttgtatatgaagcatagtcacttatgcctccctttgaggggaggttataaataaattagcttctttaatttcttgaccttgtcattttcctcacaccaattcttcttcttttttttttgttttttgagttggttttatccttgagtctttgtcacatatttttactgtgaggctggactcatctttgtaagttgtaagaaacgtgttttacttagtattttcttggtttattccatttttaaccattaaagcagatctcagtatggctaaatggtaataggatttcttctgattggctggttagagagattgtaatagaacggaatgatggaataaatctgcttctggtcacagcacatgtccttctcaaataaggactttgaaaagtcccccaaagcattcttacaataattatttccaactcttgtgttccttcttagagccctttgcaagcattcctaaacactcaagcccttacgaacgtgctatgcttctgaagagaagaactatatacacacatctgtggcgcatcttactataaatactttggaatacaactaattgtgtaaaaagtttagcttaacatatttcggggttttagggatcagttcatgaaactaaatgttctccaagcctaagttggaatctgttctgaatccttctctgaccatgttgttcccttagcagaactactctttcctactgtttggggcagtttgtgcatttttatattctgccactcatctgaatcacctttaattacatttttgttccaggctagaatgtaaattccaggagatcaaggataagggattattttcttttttcttctttttatattttaaatttaaaaaattattatgttcttctaaagactaagggactattttcttcatcttttatatctaccccctaccacaaacctttatatataggagataattcattaattcagtaagcatttattagtgttttttggcaaattggtgtgcatagtataggaatataagcatgtaagagagaatatattaaatattttctgttattgtgttctatattacctcatagtaaaataccagagttaaaagtagtattcagttattgaacttgagacatgtaattggggttttgtaactagctactcactatatagctattggtctaaacctaacagattggtttagagaactagaatattatgtaactggaaggccaggttcaagtcctatgtgtatcctaattgatctgctacctcatctgtcaagtgggtgtatttcttggaggtgatgttcagtccagtttgtattattttatatgccaaggtagccttaggcttggcttaagcttaggcttaggcagaaagttgagccctgagattccaacgtcagatccagagaattaaattctcataattagaagcaatctattagataacaaaaatagagccaatacaaattcttcatgataatggaggcagtttgccaaagaaagaaaaaatatttcaggagtgaattctttgacccgaaagaatatattttatttcccaggtgagctcctgaaagaaagtttaaggaaagattttgtttgttgtatctaaaataaagcagacacagaaccattcttcttcttcttttttttttaaagccagtcaaatttatagaattttccttcatcatatttgagtaacctgtgcattgaaatccgaagtaaaatatttcagtaagaaacatcctgctatgttatactcttcagatatttgaagttttaggccagcaaagaagatagacaagaattctgaatattaactttcacagctgaaatacagtgttgaatatataatttttgcggaaactaattttgtaatgtatatatatagagagagacggagtcttgctctctcgcccaggctagagtgcagtggcacgatctcagctcactgcagtctccgcctcccagattcaagcgattctcctgcctcagcctcctgagtagctggaattacaggtgcccgccaccgtgtccagctaatttttgtattattagtagagacggggtttcaccatcttggccaggctggtcttgaacccctgacctcatgatccacccaccttggcctcccaaagtgctgggattacaggtgtgagccacagcgcccggctgattttgtaatatattttaatgaacatttaaaaatacataatccaaaattaaaacaaatgaggaagattcattaatttattcatgtttgttgagagctaatattttatactattaataaaatattgtatagcattttcatgattgcagtttttcattgtttatggtcatcttcattaatccattgttcttagtcatttagaggtctgaaatttggctttaagcaatattgtgatatatatccttacagccaattttctgtgcatgtcaagcaattgtgttttaaaagtcccccacatatctcatttaccctctgaattctttattttccttttgtttacttaaactgtaatctctcttttttcacacttcacctggaatgtaatctcttaaaaagaaaaaactttctgcagaatttaggttttttacaaagggaaaattggatttttgactctactactgaactcttggtggagtgtctagttaaaattggtctgagaacttgatgaacagaaatagctgccttaagcatagatggggaagaataatattaatttcttgaacatttcattgttttcttgtactcttgggattctttgtgaatctagtttatactacagtataatgtgtatacccttaaggaaagtgggttgctgcattttgacttgcagaagcatttcacctatgtcccaacatagttgtctttagttgataaacaagggaagaccctggcagttagtgaatttatctttggttagcagatattttttaaaaatgagggctagacaatgaaaaagtttgagatgcacctttttttttttttttttttttttttgacagggcctcactttgtcatccaggctagagtgcagtggtaagatcatagctcactacatccttgacctcctgggctcaagtgatcctcctgcttaagccttctgagtagctaggactaaaggtgtgtactaccatatctggctaattttcttatttttcatagagatgggggtctcactgtgttgtccaggctggtctcaaaactcccagcttcaagtgatcctcccaccttggcttcccagagtgttgggattacaggtgtgagccattgcacccagccagagatgcacttttttttgatgtaaccaaagtgagaataattataaaggagcatgtttcttttttattttaattttaattttttttgttgtataaatggagtctccctctgtggccctggctggagtgcagtggtgcgatcttggctcactgcaacctctgcctcttggagtcaaacagttctcctgcctcagcctcccgagtagctgggactacaggtgcacactgcgacacctggctaatttcttttgtatttttagtagagacggggtttcaccgtgttgcccaggctggtcttaaactcctgagctcaggcagtccgcctgccttggcctcccaaagtgttgggattacaggcgtgagccaccacgcccagctaagtaacttcttttttaaataaaataatcatggattaatataataaaaacaaattagtgttctgtgtttctgaaattaagtcatttagtgccaaactttcacattctaaatagttgtatctgaaaatgtcttgacttctcttccattctttaaagatggttttgttggaaatagaattttgagttgatttttattgttgttattgttattctttcagcaatttaaaaaatgttcttgactgggcgtggtggctcatgcctgtaatctcagcactttgggaggctgaagtggaagatctcttgagcccaggagttcgagaccatcttgggcaacctagtgagaccctgtctctacaaaaaattgaaaaaatagctggacatggtggcaggtgcctggtcccagctacttgcgaggctgaggtgggaggatggcttgatccctggagatcgaggctgcagtgagagctgcgcttcagcttaggcgacagagcgggaccttgtctgaaaaaaaaaggaccgagggcagtggctcatgcctataatcacagcactttgagaggccaaggtgggtggatcacctgaggtcaggaattcaagaccagcctggccaacatggtgaaaacctgactctactgaaaatacaaaaattagctggatgtggtggcgcatgcctgtaatcccagctactggggcagctgaggcgggagaatcgcttgaacccaggacgcacaggttgcagtgagccgagatcacaccactgtattccagcctgggtgacagagtgagactccatctgaaaaaaaaaaaaaagaaagtgattccatgttttctggcctccattactccaaatgataattcaacagtcattcaaattattatttccttgtatgcaatgtgttgtttttttctagctaccgtgaagattttctttttcttcctttctttctttcttttttttttttttttttttgcttttcattatttcaattatgatatacttaggtatggcattatttgtattgaatctgcttgatgttcatgaaacttgaatctgtaaatttgtctttttttgggaaaattttggccgttatttcttgaaatatttttttcctcattgtctccttctggaactctaaaatataaatgttttagtattttcccgtaggtctttgaggctcttttttttctgttcttcaaattgaataatttcttggttctgtctttatgttcacagacctctttctttcttctctctctcttttctttctttcttttctctttctttctctttccctctcttttcttttcttttccttctttattctactgttaagccaatctagtaatatgaaaaaataatttagatattgtagtttttagttctagaatttacatttttgtgtgtgatttctttccctactgagatttcctatcttcctttattttgagcatatttttctttcgttatttgaacatagttaccataactgccttaaaatccttgactgcaaactgtagaatctgggtcatcttagggtagtctccttgattacttttttttttttttcttgagaatgggtcaggtttttccatttcttcttatagggagtaattttggattatattctggatattacaaatgataaatgataatttatatatataaattttgttatgcccgtcttaaaagcattgattttcttttctaaagcaggcaattgattaacttacctgaattcaagctgcaaaactgtccccccatagtaggtggcagtgtacatttcagttcagttctcttagctggcctacttggagcctgctctgtgcatgtgtgtttcacggatcagcgagagatttagacagatttatgcagattttagggctcccctgtgctggttctctctctctctctttttaatggtgtcttactttattttctttgcagtggtgatggttgctctagactgttttttggcttttaaagtcagcagaactgtgaattttccattggagttttagctgccctacatggtgcaaggctaaaagataaaacttggggaaacttgtccagtgcagttcctttcctccaagtgccaactcccctccaatatttgcctgcttttgtcactctccagtgccttcaggtgtttttgtctggaagttatagctgttatgataggcagagttgatcctataggaggaactgcctggtcttactagaagactcaaacttatttttttaaaaacagaaacctttaaattttagaatagttttagatttgtagaaaaattgcaaaaataatacagagttctgaaatttattttaaatgaaagtatttctaaaatatattaatgcttccttgacttttgaaaatgctgagtttggccaggtgtcatggctcatgcctgtaatcccagcactttgggaggctgaggcaggtggatcaccagaggtcaggaaaccctgtctctaccaaaaatacaaaaattagctgggcatggtggtaggggcctgtagtcccagctactcgggaggctgaggcaggagaatcccttgaacccaggaggcggaggttgcagtgagcaaagatcatgccattgcactccagcctgggcgacaagagcaaaactctgtctcaaaaaaaaacccgaaaatgctgggtttaactgccaattaatgtcaacattctgaatataaattcagtaatgcaacaatggcctcgggagccgttgaggcatgtaagactatttttgtctttctgctaaatggcctcagctattgtgcttttcgaacctaaatctcctttgtgtgtgtgcatgtgtggatgggtgcatgcgtgcatgtgtgtgtgtattttgtatttcttcctttgccaacttagctctattgatgcagcccatttccgttaattttctattgtaatttgttgtggctcagtacaccagataaactgttaaaatttgtttgaaataggaataaatggtttcaggccaggcacggtggctcacgcctataatgctagcactttgggaggccagggcgggcggatcaagaggtcaggagttcaagaccagcctgaccaacatggtgaaaccctgtctctactaaaaatacaagaattagtcaggcgtggtggcatgtgcctgtaatcccagctactcgggaggctgaggcaggagaatcgcttgaacctgggaggtggaggttgcagtgagccgagatcacgccgctgcactctagcctgggtgatagagcaaaaaaaaagaacaaatagtttctgagagcttgaatgttgagttaatgagtcaggtacatcatctttagtatctggtcttggtgacattggtgcccagaggccttttctctagatgcctgctgtcaatacaattgtcgctacctatacatggctattcagtgtttgaaatatgtctagtttgagttgagatgtactataattatgaaatatacaccagattttaaagatgtagtacaaagaaaagaatgtaataactttttatgttgatcatgtgttgaatgatgttagatatattgggttaaataaaaaaatttaatcacacttgtttcttttacttttaagaaaatgtggaatgcttcacaaatttgtgcgtcattcttgaacaggggccatgctaatctgttttgaattgtcccaattttagtattcatgctgtcaaagtaagtactctttttaagtcttcaatatggctgctagaaaatttaatataacatttgtggcctacattatattggtcgtagctctggcaatttatcttacttgatagtagtgtctatgagtgagatggtggtggttctgtaagaatcttgagatcaagcaggtgagattctagcatctccttctttgctctggtgtaagaaactatcatagtggttggtagatagtatggaccttggagtttaaacctcagttttgacactcctcagttgtatgacctatgacaaattattgagcttctctgaacctcagtttcctcatctgaaactcatatgaaacgaggaaaacaacccctaatttcatatggttattgtgaaatacataaaactagttttatatagtgcatgtcaactgcaaaatacactactcaatacatagtagcttttaacttgtttctggaccattttggtaacattttgatttattgtagttgatacttatagggaatataatcaaggtagatccagactaggaaaaaaggactgtagctttcgtccttttttttctttctttcatttgttgtcattcagtttttttccaccactaaagaatatgtctttgatgaagaatttgtaagaaaaaaggatggaccctctgtaaaaagaagagatattgcctccggacagtcaatattttaaattatatgatttattagttattctgaagagataatagacttgttcctccttttaggcttttgataagtaaatgtgaacaagcagaactcgttttcatcatgggtctattgtgcctagatggaaagtctggtcattgtacatctgacagtttgttttaaaaagtggttctggctgagatatttcagatttgattttcctacagattaaagcctttctttacatcttcagcatatacttcaagcaagtaacaaaagtactcaaaagaaactcacgacattaattccatttgttatttcatctagtagtttttgaatgactactttgcatttagcatttattcaaaagaagttctattatatttaagcagtttaacattttggcactgattagagacagtaatgagattatcatgtataaacattaaaaaaataattttcttaaatctacaaagaatagaaaagaaaaacatgcttgttataaaaagacaaataggacacaagtatataaaattaataccccaggctgggcatggtagcttacgcctgtactcccagcacgttgggaggccaaagtgggcagatcgcttgagcccaggggttcaagaccagcctgggcaacatagtgaaactctgattctacaaaaaatacaaaaattagccaggcatggtggtacgtgcctatagtcccagctacttgggaagctgaggtgggaggatcgcttgaacccaggaggtcaaggctgcagtgagccgtgattgcgccactgtactccagcctgggtggctgagtgagtgtttgtctcaaaaaataaaataaaaataatctcctgtccctacctctccccagatctgtcccgaggtaaacaatgttaattttggtttatagccctccatacttgagaagtatttccaagatgtaaattccagggttacagatctgtggtatctcttaaagggatttatttccctttccatcctctagcaaagtataggctcacccttactcccatcttgaggtttccttgacccagttgctcaaagcagatagtaggaattacttgatttctttctcccgctttccacatccaaaccatccacgcgtctttaggattatgctaccccaattcaatttaatctacacttttctttccatgtccattgcttttacctaatccaaagcacatttcaccacaactaccacaagaggccacccagcttcaattcttcatcatttgatgcctctgatctgttttccatatggcagagtgttatttattgtcttaaatggaaatcagattttgcccttatcttgcacccatcaaaacccttcagtggtatcctgttaccctgttctggcattccttaccccctttcccctcccaccagtggaagctccatgaagtcaggaatatgttctctggcacatactgttttattgagcacttaaccacatgctggacaatattttaagagcttttcatctattaactcatttatattcatgataaccctgtgaagtaggtattcttcccaaccattatgtgtacaaagcaactaaggcccagagaggtttaagtaacttacccaatatcacactcatgcttaagtagaagaatcaatatctcaaaccaggcactttgccttcagtccttgctgttaaatgttgtattaaatgctttttttcgacatagtaggtacttggtaaacatttgttaagttaatgaataaattgttccctctttgcataaaattcaaacacttaatttggtctagaaaatctttcacgatctggcccctgccaacaccactttctcatgtactcatggcaatcttgtcacactggctctttgcatggctgtttccttctcattctttatgtctaagaggtcttccatggtcatctcatctaaagtaggtgcttcttgtcctctctctgagtactttgttttactttaggcaaatcatgattaattgttaaatacatggtataggcttgctattccctgggaatttgtaagagatgcagaatcttggttgtcaccccagatttactgaatcggaatctgtatttttacaagatcgtctaataagttgtgatgacatcagagtttgagaagctgggatagaaactgaaaggacagctgggcacggtgtctcatgcctgtaatcccagtgctttgggaggcagaggcgggtggatcacctgaggtcaagagtttgagaacaacctgaccaacatggagaagccctgtctctactaaaaatacaaaactagctgggcacggtggcgcatgcctgtaatcccagctactcgggaggctaaggcaggaaaatcgcttgaacctgggaagtggaggttgtggtgagctgagatcgcaccattgcactccagcctcggcaacaagagtgaaactccatctcaaaaaaaaaaaaaaaaaagaaagaaattgaaaggacaggtaactgaattttttttttttttttttgagacagagtctcactctgtcacccaggctggagtgcagtggcacaatctcagctcactgcaacctctgtctccctggttcaagcgattatcctgcctcagcctcccgagttgctgggactacaggcacacgccaccatgcccggcaaatttttgtattttttttttttttagtagagatggggtttcaccatattgcccaggctgatcttgaactcctgacctcgtgatccatcctccttggcctcccacaatgctgggattacaggtgtgagccaccgcgtctggcaaggtaactgaattcttatagtgagacttgagcttgacctgaagcacgggtgtggcagtgatcatttcagggaggttaatgtgattgtagtcacataagggtccagatttatgtggccttattgtacaggatgaacgggagtgggggtggagcagtgctgtgggtcctcaaggacatcagtggggaagtcattctaggaaaagaagatggagaactttgtgagacctattttttttttttttttaaagacggagtctcgcactgttgcacaggctggagtgcagtggcgcgatctcggctcaccactttaagggaatctcctgcctcaacttcccaagtagctgggattacaggtgcccgccaccacgcctaactaattttttgtatttttagtagagatggggtttcactatgttgaccaggctggtctcaaactcctgacctcgtgttccgcccgccttggcctcccaaagtgctgggattacaggcgtgagccactgcgccgggccttgtaggacctaatttttaaagactattgtacgctttatggtttttatttttaatgaaactattatgttaggtaattgatcataatttggtcatttactgaaagaaacagcaacagataacctttgaaaactactggaaggtgaatcatctctcccattcaacatttgaatgacttcaattcacagtgacttagactaaagcaagagaacatcaaatgtactgttataagctgaactactaactcagaggaggaaccactggcaagcccataaaactgaaactcacaaaaccatgatttattgggagatgtttatgtcacttttgagaaaatattaaacaggtgcttttttatttgtagtaaggtcatggagtatattttgagtttcattgtattctaaattgaaattttgtacttttagggtattctgaaattcttaagtgattcagattagactttggatgctataggtaatgcaaaggcagaaaccatttcttctcttattcatcaccagatctctggtgtttcgtataggtcctcacatggctggtgaatgaataaaaaaaaaaaagttttaattttaaaagattgatatctatctgctcttgaagataatatataaatgatggacaataaaagtgagctgtaatgtatttagaaactattaggactgaagtggaaactagattaataatttaaaaaacactttatttggaaataatttcatacttacagacaagttacaagcataagaggtaggacacagtggctctgtaatcccaccgctttcggaggctgaggcaggaggattgcttgaggccaggagttcaagactaacctggacaacagagcaaaactgtctctacaaaaaagtaaaaaaattagccaggcatagtgatgtttgcctgtattcctagctactgcagaggctgtggtgggaggatcactacagcctggagagttcaaggctgcagtgagctatgatggcaccactacattccagcctgggcagcagagcaagaccctgtctcaaaaaaaacccaacaaaacaaaaacaaaaaaacagttcaaagaatactgtttacctaggtttacctattgttaacattttactctatttgctttattatttgctctttctctcataagttgcatacattgtggcattttatccccaaatacttcagtgtggattccctaagagtagggatatatcttgtgtatgtaatgttgttacgttacagttataatttcaataaattaatctctctccccacctgccttttccagaaaactaagacccagagaggttaagtgacttgccctgtggttagataggttccaaatggaaaatccagcctactctgctagtcaggtattagccctggtccctaacatcacaacagaatcttttttttttcccctgacacgccaaattatttagtagtataatacagtaataaaaatttgtggccggtcgtggtggctcacgcctgtaatcctagcacttggggagactgaggcagatggatcgcctgaggtcaggatttcgagaccagcctgggcaacatagcaaaacctcgtctctactaaaaatacaagaaattagccgggtgtggtggtgcatgcctgtagtcccagctacttgggaggctgaggcaggagactcacttgaacccagtgggtggaggttgcagtgagttgagattgtgccactgcactctagcctgggcgacagagcaagagtctgtctcaaaaaaataaaaaagaaaaatttgtaattgtcttctgaaccagatataaccatctaatagcacttgatctgtaaaggactttggatcaccaaaattgtccttgacattctatttggcttagtttaagtatgagtttgtccaaatttaagacatgatagcgtgaagggaatagactgttatttaccaaatttgaccctaacaaacagtgaccagttactggcctacagatagctgagtccaaaaggcatcatgaggaattcaaagtttaaccatggggcaaacttcttcattccagttttgattttttttttttttttttgagatggagtcttgctctgtcacccagattttgtttatcttcagagtttttccacattcattctttaacttgtgtttcactctattttcatatgtttttgatgggagggtttttgtttgcttggttttttaaaatgaaagattcatgtccatattacaaatatcaaaaagtgtgaaaggtacacaacaaacaactcccctaaccccgtcccttgagtgttgtgctgttctaagtcctttatatgtatgaactcattcagttctcccaactatccaatgaggttattattcccattttatagaaaaggaaaacaggcccagtttttcagtcacttaggtaggaagtagtggagttgtctgagagtctggctctaaattagtggtcttaaccaccattctctgctgagcaagaggatatcaggattaactagattaatacatgtgaagagcttgttttggacgagcagagagatttgtcttcaataaggtaaatgtgagtgaagtcttaatagtctgtcctggagtttcttctagccctggtaattgggcatcctgatgtaatttcaagctaatcatttcctctctaaatggcaaaagcttttatctgaagagcagatttcatgaattggtgatgctgagtaaggaaatggtagcaaccgaagtctttgcagtatcctctgcttagctgttttatttatacagacagagctggacacatagtaattctgtaatcccagcactttgggaggccgaggcaggcggatcacgaggtcaggagatcaagaccatcctggctaacctggtgaaaccccatctctattaaaaatacaaaaagtagccgggcatggtggcgtgcatctgtagtcccagctactcaggaggctgaggctggagaatggcgtgaacccgggaggcggagcttgcagtgagccaagatcgcgccactgcactccagcctgggcgacagcgcgagactctgtctcaaaaaaaaaaaaaaagaaaaaagaaaaagaatatctttgcttttttctatttagtgaacatttaaactttatgtagaccttttttttttttttttaaagcatcgggtcgtaatctatgtcagttggaataatttaatgtggaagatatttagatttttttcccttctctccttgttttccaaaagaataaagcaatctagggattctaaccactaagtgctggaactgaagaatctgttgttaggccttgagttctttgcatggaacgtctttaagtcaagtaacattttaaaaactcttaccatgtgccaggaactgtgtgtatcctaacttatttgatccccacaataacatggtacatagtaagtcaagtttcacagatgttaagtaacttactgaagattacacagctaatgaactagggaagtcaggattcaaacctaggtatgtgtgattctaaactgtggtttctcacatgctctgcagaccctgtagaagaacagcttataaaacagctagactccaaacttggttccagcatgtgtttagcaaaaattctgaagaaataggctgggcgcggcggctcacgcctgtagtcccagcactttgggaggccaaggtgggcggatcatgaggtcaggagtttgagaccagcctggccaatatggtgaaaccccgtctctactaaaaatacaaaaattagccagacatggtggcaggtgcctataatcccagctacttgggaggctgaggcaggagaattgcttgaacccaggagtcagaggttgcactgagctgctgagatcgtgccatttcactccagcctgggtgacagagcgagactacaactcaaaaaaaaaaaaaaaaaaaaaagaaaagaaaaaaagaaaaactgaagaaataggtaatagaagccagatgactttgcccatttgtcacattgtttttggacttttaagttagtctaaatcaaagcaaccattttgtgtattttgacagctaatttagatgaattcatactaaaggtaaatgaggtattaaagttttaaagttcattctttaacaacacattactctatacgctccccagaaaatatgtcgaggaaaataatttaatggtcaggagcctgtccttactttcagatcctaacttctctcttcccctagtcatcaccaccccttaccctcagttccataaacataaataaagagaagaatgaagttaaagcttttcttcttaggtgtttaaaaatctgactattctaaagactgattaaactaggttttctaagtgagcagttccttaatcttgacttagtaaaacattaaaatatttggcatctgccattgacccctattctgcaatattggagttaatccagcagtttctgattaaataccagtattatgcaattcaagaattaccacaggggtgtgaagggaagagggtgaggctagtgaggaacacccagacagcaaagtaaagaaaatactccttttataagaataaaacccaaatgaatgctaagactctatctagagattcattgttatttctgtcagtgggattatttaagttttctctttaatcattcgagtttaaaaaaattatttttatttttttttatttttcagacggagtcttgctctgtcgcccaggctggagtgcagtggtgctatctctgctcactgcaagctctgcctcccaggttcacgccattctcctgcctcagcctcccgagtagctgggactacaggcacccaccaccacacccggctaatttttttgtatttttagtagagacgaggtttcaccatgttagccaggatggtctcgatctcctgacctcgtgatccgcccgccttggcctcccaaagtgctgggattacaggtgtgagccaccgtgccaggccaatttttatttttattttctggagatggggtctcactctgtcacccaggctagagtgcagtggtgtgatcatggttcactgcagccttgacctgccaggctcaagtgatcctcctgcttcagcatcctgagtagcctgggaccacaggcatgagccaccacacctggctaattttttaaaattttttgtggtgatgggatctcactatgtgtttctcagactggttttctaatttttaagaaaacagtagacatgtatgtttttgtaacatgaaatcataactttatgtaatccaggccgggtatagtggctcacacctgtaatcccagcactttgggaggctgaggcgggtggatcacaaggtcaggagtttgagaccaacctggccaacatggtgaaaccctgtctctactaaagataccaaaacaaaacaaacctatgtaatccaaattaaaatcttcttcagcatgtatatatttatatttataatctatatgtatatatttaaaaaacaagttattggatgtaattcatatacagtataattcacccatttaaaatatacagttcagtggtttttagtatattcacagagttgtgcaaccattaccagggtctaatttttttctttttttttgatacggagtctcactttgtcacccaggctggagtgcagtggcgcgatctctgctcactgcaagctccgcctcccgtgttcacgcattctcctgcctcagcctcccaagtagctgggactacaggcgtctgccaccacgccaggctaattttttttttttttttgtatatttagtacagatggggtttcaccgtgttagccaggatggtcttgatctcctgacctcgtgatccaccttcttcggcctcccaaagtgcggggattacaggcgtgagtcaccgtgcccggccattttttttttttttttttttttttgggagagacagagtcttgctctgttgcccaggctggagtgcagtggcatgatcttggctcactgcaacctccgcctcccaagttcaagtgattctcctccctcagcttcccaagtagctgggattacaggcacgtaccagcacgcccagctaatttttgtatttttagtagagacggtttcaccatgttggtcaggctggtctcaaactcctgacctcgtgatctgcctgcctcggcctcccaaagtgctgggattacaggcatgagccactgcgcctggccaatttttgtattttttagtagaaatggggtttcgctatatgttggccaggctgatctcgaactcctgacctcaagtgatccacctgctttggcctcccaaagtgctgggattatagatgttagccaccacgcctggccaccaggttctaattttaaaacattttcatcacctcaaaaagaaaccatgtacccattagcagtcactcctcttccccatcctcagttcttggcaacagatagtctactatctgtatgaatttgcctattttggacatttcatataaatggtatcatattcagttgtcccctggaatccacgggggattggttccaggactcctctgtggatgtagaagtccgttatagttgtccctgtatctgcgggttctgcatctgtggatacggaaggccagctgtgatatgtggtgttttgttcctttcacttattcaagttacagcatgtatccatacttcattgcttttaattgtcaaataatattccactgtatggatatgtcacatattatgcatttttaattttgcttttaaatctaatacttctgagagacttctccttctgggaatatagaatttcctgcttttttgcctcctatattcctgacttggagctaaagaagccagcaacctggacacactagcaggcactgagaagaaaaactccaaccaaatcctgctgcctcttgcctgagaaccagggaaggggcagcctaaacaagaccacaaacttttagataattactgctctactataaacaccacagaaaaagctgtggctccatcctcaccatgccagcaaaggctgaattgggtggcctagacttccatcctctgttggtggtctataaatttaaccaatcttttactgatgggcttcggtggtctctagtgttttgctgttacaaacaataaggcctcagtattcctctctcttgtatctttggacatctgtatgactgtttctatagaataaatttctagatataaaattattgggacaatagatggcatccagtgaagccttcaggaatggcagttagatggatgatctcaaaatatagaaacaggctgggcgaggaggctcacgcctgtaatcccagcactttgggagaccgaggtgggcgaatcacttgaggtcaggagttcaagaccagcctgaccaacatggtgaaaccctgtctctactaaaaatacaaaaattagctgggtatggtgatgtgtgcctataatcccagctattcgggaggttgagacaggagaatctcttgaactcaggaggcagaggttgcagtgagccgtgatcgcgccattgcattccagcctgagtgacagagcaagactctgtctcaaaacaaataaacaaacaaaaaaacctggaaatatataagaagtattacattttcagtgtagtttttctctgttgtttagactaggtaatttttatgccttcattttactgattcttctgtccccttcgtttggcttttgaacccatctactgagtttttaaatttcagttactgtatttttcagttctaaaatttccatctgggacttctttatatcttttttttttaactttaattatcgtgtttatcttctgacatacatcttctattttttttgctgaggctttctgttttttcatttgcttcaagcagatcattccatttgatatgattcttggtatgacacgttcagttgaaacatggacattttcatactatgttaagagactctggatcttgtttaatccttctctttaaacttctgacactcaagtaagactcctttgacatttctgtggagggaaaaggagaagggagatggcactgctttgttataaccaggtagagacagaagtccaagtgccgcactgggttatctcatttttatttttttatttttatttttatttgttttgagacagtctgctctgtcgcccaggctggagcgcagtggcgcgatctcagctcactacaacctctgcctgccaggttcaagcaattctcctgccccagcctcccgagtggctgggattataggcgtgcgccaccacactcggctgatttttgtatttttggtagagacggggtttcaccatgttggccaggctggtcttaaacgcctgacctcaggtgatctgcctgccttggcctcccaaagtgctgggattacaggtgtgagccaccatgcctagccccactttttagatttaatacttcttgcttccagaatgtgattttaaggaaaagaaaaataaataaataaatttaatacttctgagagacttctgcttctggaaaaaccgaattagatggtagtgagtttcttagttttttgccttatacatctcagacttggaactaaacaagccagcaaccatggtgaagaggctccttattactgctggggtgggggaatgggagttgcagctccctgtgtgacctccctggtacactagtggaggtggcctcattaccactggttaatgttcaaagtcctgactctgttaggcctcctctgaccccatcccaggggcaggggcttggcagggtttggaggccctggtttcctccctggccatctctgacagtattctggcagagacattacagcctccagaggattggttacattaagttggaaataaaatatataaactaaaaaaaagttatatatatgtgatcatatttttcaaggaataaagtagtatgggccgggcgtggtggctcacacctgtaatcccagcactttgggaggccaaggtgggaggataacttgaggccaggagtttgaaaccagcctgggcaacatagttagaaccccatctctattaaaagaaaaatagtagtatgtagatagaaaataaaaatgtagaagaataagtagcaaattaatggttcaagggtaagggaacgctgactttctctagtgtttcagtttttatttattttaaaaataatgaatataactgttagaagcagtgaagagtattttttaaaggcatacttttctcagatgctattgttagataactatatgttaatttttatggttactaatacaaaactgggtatagaataaacgtatcctggctcccagtgtaggatgctttccattgtatcacaatgccctcagtcagctgtagcaatagactgtattcagtgtagttcatactaaacagggtaattttgattctataattttgttgaaattgaattttatatttaacttggattaaaggagaaggtttttgacttgtgaattctagaaatttgaattttttgccaggcccagtggctcacacctgtaatgccaggactttgggaggctgaggtgggtggatcacttgagttcaggagtttgagatcagcctggccaacatggtgaaaccctgtctctaataaaaatacaaaaattgggccgggcggcgtggctcatgcctgtaatctgggcattttgggaggccgaggcgggtggatcacctgaggtcaggagttcgagaccagcctgaccgacatggtgaaacactgtctctaataaaaatacaaaaatcagctgggcatggttgtgggcacctgtaatccgagttactcgggaggttgaggcaggagaatcacttgaacctcggaggtggaggttgcagtgagccgagatcacaccattgcactccagcctgggtgacaagagtgaaactccatctcaaaaaaataaataaataaataaataagccagccatggtggtgggcgcctgtactcccagctgctcgggaggctgaggcaggagaatggcctgaacctgggaggtagaggttgcaatgagccgagatgacaccactgtactccagcctgggcaacagagcgagactccacctaattaaaaaaaaaaaaaaaaaaagaaatttgaatttttccacagttttactgtatatacataaattatacatatatatgtgcatgtgtgtatatatatgtatttatatgtatgtgtatatgtgtatgtgtgtgtatatatataatatatatattttaaatagtgacagagtcttgctctgttacccaggctggaatgtagtgctataatcatggctcgctgcagtcttgaactcctgggctccagtgatcctcctacctcagtctcctgaataactgggactataggagagtgccaccacactggctaattttctaatttttttagtagagatggggtattgctcggttgcccaggctgatctcaaactcctggtgtcaagtgatgctcctgctttggacttccaaagtgttgggattacgggcatgaactattgtgcgtggccttttctatactttaaaaattttcaaaaataaaaataaatatttcatctgactagtagctcccaattttctgatgctattaagactttggaaaaagttgttcatggtgacgatgacttttcttatttgacttgtcattagtggttagtaaaaaagggacttttttcaggtccgtcttgaagaatatgcatccttttatttatgtgtgcatgaaggaaagtgcttattaggcgtatgagatgtgtaacgagcttctgatatacctgaaacaaaagtaaattgagaaaatttgctagaaaattttagagaaaggaggcagtcacctgtgaaaggaaagaggcatttctgtcctgaccaggtcttcatgaactgttccgtattctgagattcttttgcccatgctcaaggactggctctgcagaccactgtaggagattatgtatggtgactgatctgtagccagtccccattcatctttagcctgcttttagtttaacgtgtttctaagttcctacatgtaatatctttattatgtctcgtttaccaacttaatgattttaacactgctttgacaggcagcttgggaaattttagttaattttatagattaagtggaggaggataaaggccttgagtcagactagttctttgtgtaccaaattactgttgtttttttttttttttcagtaaatctcaaatttggattatcaggctaattggaaaggtagtgtattaacattttcttgtctgtagtaaatccacttgtgtgttatcagtgttccatgctattaatggtcagtatcttcaaaaaggcaactttgggcaccagtttgttatatagtaggatgagttagtgctgtaaattgacttgggttctgagaatcaaatatcatcctaaccttcccacaccagtgtttcttaatgtatccagcaggcaggtgccttacttcagaatctccttgagtgcctataacaaaataaggattcctgggccccaacccgggagttctgctgaatcagaatctctagatatgaggccctggggtcttcattttaaatgttttccttaggttatttgtaatcacagtaaaatttaagaactaggccttttttaggaagtacatttttgtacaagttatatgtagtattaggaattaatatgattcattctgccctcaaattctgtgtatattttgttactgataaagaatgatcggattttttttttttcttaaaccaagctctgttgtaactgttccatgctgtctgattagggttctagaatcttcactataagcccactttttttgtttttgttttttaaactccctttacctctccattagtttaggaattaatgactttttactgatgtggcattttactgaaatgcttctgaattttttgagagttactttaggataatgaacagtacttttaccagcatctttgaatgacttattggagagttatttctggcactttccatggacgtcatagtcaacaggctgtgttgatctctagcaatgtcagaacgttctcttccagcattccagctctctttccttcccatctctccttttccttcagtccatctttcctttttaaacttggggctgattccatgtctttgctatcatgaatagtgctgcagtgaacatacatatgcatgtgtctttatggtagaatgatttatattcctttgggtatatacccagtaatgggattgctgagtcgaatggtagttctgtttttagctctttgaggaattgccacactgctttccacaatagtttaactaatttacactcccaccagcagcgtatagtgttcccttttctctacaactttgccagcatctgttttttttttttttttactttttgaaaatagccattctggtgtgaaatggtatctcactgtgcttttgatttgtttttctctaatgatcagtgatattgaactttttttcatatgcttgttgggccacatgtatgtcttcttttgaaaagtgtcttcatgtcggttgcccacattttaatggggttgttttatatttgtaattttgtttaagttccttatggatgctggatattagacctttgtcagatgcatattttgcaaatattttctcccattcaacctgcattctgtaggttgtctgtttactctgttgatagtttcttctgctgtgcggaaactcttaagtttaattagatcctgtttgtcaactttcgttgcaattgtttttggcatcttcgtcatgaaatctttgccagttcctatgtccagaatggcactgactaggttgtcttccagggtttttatagttttgggttttacatttaagtctttaatccatcttgagttgatttttgtgtatggtataaggaaggaatccaattttaatcttctgcatatggttagccagttatcccagcaccattgattgaatatggagtctttgacgttgcttgtttttgtcagctttgtcgaaaatcagatggttataggtgtgtggccttatttctgggctgtacttgagggtggaggatggaaggagggagaggatcagaaataactattgggctctaggctttgtacctgggtgatgaaataatctgtacaacaaactcctgtgacatgagtttacctgtataacaaacctgcacataatacccctgaacctaaaataaaagttaaaaacaatagcaacaaccaccttggggcatacatgatgggactataaaagatttgtaccactctgattttaggaaaatctacctcatcattgccattcattaagtaggattagaaataggttattataaatatatcttttgctattttcttgctctctgaaggaatgtgtacaacaggatatgggccgggtatggtggtgcatgcctgtagtttcagctactggggaggctgaggcgggagtatttcttaagtccacgaatttgaaactgcagtatgctgtgattgtgcctgtgagtaaccactgcacaccagcctgggaaacatagtaagatcctatctctaattgaaaaaaaaaataaaaaaaaaacaggatataggatatttatttttatttttgaaatggagtctcactttgtcgcccaggctggagtgcagtggcacgatctcggctcaccgcaacctccacctcccgggttcaagcaattctcctgtctcagccccccgggtagctgggatataggcatgcgccacaacgcctggctaatttttgtatttttcgtagagacggagtttcactatgttggtcaggctggtctcaaactcccgaccttgtgatctgcccgccttggcctcccaaagtgctgggattacaggagtcagccactgcgcccagccaggatatgggatgtttataatgaattttttttggaggcgggtacacctacaagtttccctttttactttgccttacgaagaatactgtctgatagaatgaaaaatgatttttacatttcagaaaacccataacagactttgcctttgccctgaggcaagggtttatgtaccccctaggaattactgttctgtccaacatagtagccattagtcatatgtggctatttaaattatgaaaacatattgtttatgttttaaattataaattgtagtcatgtgctgcatatgccaggggtctcaaaagattgtaatttgcttttattttttatttttattttttgagatggagtcttgctccttcgctaggctggagtgcagtggcacgatgtcggctcagtaaaatctctgcctcccgggttcaagcgattctcctgcctcagcctcgcaagtagctgggactgcaggcgcgtaccaccacgtccagctaattttttgtattttagtagaggtggggtttcaccatgttggccaggctggtctcaaactcctgacctcgtgatctgccctcctcggcctcccaaagtgctgggattacaggcgtgagccactgcacccagcttataattcgtatttttattctactttttctatgtttagatatgtcttgatgtacagatacttaccattatattccacttgcctacagtattcagtacagtaacatgctgtacaggtttgtagcctaggagcaataggctataccatgtagactaggtgtgtagtaggctatctcatctaggtttgtgtcagcataccctgtgatgcttgtaaaatgctagaatcgcctaacagcacatttttttcagaatgtgtccctgtcagtaagtgattcatgactgtaatttaaaataaatgaaacaaaaaaattcagttcacttgaactagccccattacatactccctagccacatattgctagtggctaccatattggacattggcaatatggatcatcgccatcatgcattaaattctcttgggcagtgctatactagactggtcatttttattttttattttatttatttatttattttttttttttgagacagagtctcgctctgtcgcccaggctggagtgcatggcacgatctcagcacactgcaacctctgtgtcccgggttcaagtgattctcctgcctcagccttttgagtagctgggactacaggcacccaccaccacacctggctaatttttttatttttagtagagatggggtttcaccatattggccaggctggtctcaaactcctgaccgtgtgatccacctgcctcagcctcccaaagtgctgggattacaggtgtgtgccaccacgcctggccctagactgatcatttttaagaaaagaaagaggctagcgctagctgggtgcagtggctcatgcctgtaatcccagcactttaggaggctgaggcaggtggatcacttgagcccaggagttcaagaccaacctggataacatggtgaaaccctgtctctactaaaactattaaaaattagccgggatggtggtacgtgcctgtagctccagctgcttgggaggctaagatgggaggtgaaggttgcagtgagctgagatcgcaccactgcactccagcctgggtgacagaaggagaccctgtctcaaaaaaagaaaaaaaaaaaaaaaggctaatgaaagaacaaaataataaagacccaaatttctactcttccttccacaatgtaacttttcctggcttcttgtactcttgattaaaattcagaaaaagttatgtcatgttgagtatcatcactttgaccttgtttttaatgtttaattctgttttccaggctggcagtgatggtgaaagcataggaaactgccccttttcccagaggctcttcatgattctttggctcaaaggagttgtatttagtgtgacgactgttgacctgaaaaggtaagacatggtcgcagtttgcaatcaacttaagctgaactatcttttcagtttgatcctattttcaccttgatggcacatattctctaaaggaaatatattgtattaaagttctgctggtttatggacaaacaacttgtatataactattttggacaagtcacgctgtcagtatactgcgtggctactcagtcttttttaggaacttttgtatgtttaccttaaatttcatgagtagcactaggagctaagtgttagtgtggatgcagtgaaatccttgacttcttttttccagtgtaaacatggagtcatgaagagctttctaagcagacatcatcttggccccaaatgtgttaagcatgtgatctttataatctggatcttcaaagacaaggatttttaggaggttgaataccgttgttgtcaatttcatttaatttatttttcagagaataacagtaattttctatagcattttagctataatgcaagtattttaatcatatttgtttaaatgtattgtaaaataagagcaattatctgtggcccggtgtctgttcttgctaagtgaagagttgtttgtaggtttctctcctggatgactttatggcttattttccatagtggagagggctgagaagagccgtgatgagtagaaagctctgttttattcaggaatgtctattcacctttagcaaacaggtctgaggtgaagaacattcatacatccccttccccaaaagatttaaatcaagggttaagaatagttgtattgctcttcctctccctctccccacggtgtccctctctttccacggtctccctctctttccacggtctccctctcatgcggagccgaagctggactgtactgccgccatctcggctcactgcaacctccctgcctgattctcctgcctcagcctgccgagtgcctgcgattgcaggcacgcgccgccacgcctgactggttttggtggagacggggtttcgctgtgttggccgggcaggtctccagcccctaaccgcgagtgatccgccagcctcggcctcccgaggtgccgggattgcagacggagtctggttcactcagtgctcaatggtgcccaggctggagtgcagtggcgtgatctcggctcgctgcaacctccacctcccagccgtctgccttggcctcccaaagtgccgagattgcagcctctgcccggccgccaccccatctgggaagtgaggagtgtctctgcctggccgcgcatcgtctgggatgtgaggagcccctctgcctggctgcctagtctggaaagtgaggagcgtctccgcctggccgccatcccatctaggaagtgaggagcggcgcctcttcccggctgccatcacatctaggaagtgaggagcgtctctgcccggccgcccatcgtctgagatgtggggagcgcctctgccccgcctccccatctgggatgtgaggagcgcctctgcccggccgcaaccccgtctgggaggtgaggagcgtctctgtccggccgccccgtctgagaagtgaggagaccctctgcctggcaaccaccccgtctgagaagtgaggaagcccctccgcccggcagctgccccgtctgagaagtgaggagcctctccacccggcagccaccccatctgggaagtgaggagcgtctccgcccggcagcccccccatctgggaagtgaggagcgtctccgcccggccagccgccccgtcggggagggaggtgggggggtcagccccccgcccggccagccgccccgtcggggagggaggtggggggggtcagcccccccgcccggccagccgccccgtccgggagggaggtgggggggtcagccccccgcccggccagccgccccgtccgggagggaggtgggggggtcagccccctgcccggccagctgccccgtctgggaggtgaggggcgcctctgcccggccgcccctactgggaagtgaggagcccctctgcccggccagccgccccgtccgggagggaggtggggggggtcagccccccgcccggccagccaccccgtccgggggggggggtcagcccccccacctggccagccgccccgtctgggaggtgaggggcgcctctgcccggccgcccctactgggaagtgaggagcccctctgcccggccagccgccccgtccgggagggaggtgggggggtcagccccctgcccggccagctgccccgtctgggaggtgaggggcgcctctgcccggccgcccctactgggaagtgaggagcccctctgcccggccagccgccccgtccgggagggaggtggggggggtcagccccccgcccggccagccaccccgtccgggggggggggtcagcccccccacctggccagccgccccgtctgggaggtgaggggcgcctctgcccggccgcccctactgggaagtgaggagcccctctgcccggccagccgccccgtccgggagggaggtgggggggtcagccccccacccggccagccgccccgtccgggagggaggtgggggggtcagcccccagcctggccagctgccccgtctgggagggaggtggaggggtcagccccctgcccggccagccgccccgtccgggaggtgaggggcgcctctgcccggccgcccctactgggaagtgaggagcccctctgcctggccaccaccccgtctgggaggtgtgcccaacagttcattgagaatgggccaggatgacaatggcggctttgtggaatagaaaggcgggaaaggtggggagaagattgagaaatcggatggttgccgtgtctgtgtagaaagaagtagacatgggagacttttcattttgttctgcactaagaaaaattcttctgccttgggatcttgttggtctgtgaccttacccccaaccctgtgctctctgaaacgtgtgctgtgtccactcagggttaaatggattaagggtggtgcaagatgtgctttgctaaacagatgcttgaaggcagcatgctcgttaagagtcatcaccactccctaatctcaagtaatcagggacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaaagaatagttgtattaatgggaaaaactagggtttggcagtggattcctcttgatgcaagtgtcacaacatgatttgctattatactgatttttaaaactattagtctgttctcacattgctataaagaactacctgagactgggtaattcataaagaaaagaggtttaattgactggcagttctgcaggttgtacaggaaacttgtctggggaggcctcaggagacttacaagtatgatagaagtcaaaggggaagcagacatgtctttcatggccggagaaggaagaagagagaagggggaggtgttacatatttttaaacaaccagatcttgtgagaactcactctctgtcacaggaacagcaagggaagtctgcccttgtgatccagtcacctcccacaaggcccctcttccaccattgaaaattacaatttgatatgagatttgggcaaggacagaaatttaaaccatattatatatcaagtcatgaacagtgtccaggaaaagatattgacagcctatcacttgataaagtggcagaattaatctatgttatccctctgagcatcacatgctgatagttacctgagagctataattccattccaagttctaggttagtgtactcagatttctgtcattcccttaaaatacatttttacttactgctagtgcatatatttgaaattttacagactttaaaatttattgaacataagccataaagtcatcaaggaacccctttagttatgtatataaatgtagaaataagcctttgggaatagtgagttaaaactacaagctcttgggaagacattaccttattcatgttgggcagagatgtaagaatgaaataagtcatgtagttacccttctattactgttttttttttatacatgtgtacacaaagcaagtttcccaatataactcctaaaaatagagtgtgccaccaggcacacacccttactgtgtcctaaaatacatgaatttctcctattccatttttggcttggagcaagtgagttgactgccattctttgaaaaagctgtcattgaatagtttaatacagtgctttaattgtgatacataccagtaatagtgccataaacatgggaatctgggtcagaaaaggaagtaaacccattatagctatttcagagttgtctgtttcttttcatttgcagattttttaaaggcattattcctataggttgattgatatttgcagatttgtatatatatgttaaagtgtgtatgtggaaatatgtgtaagtgtatatgttaagtgtttatatatataaaaagtggcgcatgggaggtaggcattcagggccttataattagaaaatatcaaagaagatatatgtttattacctagggctttatgtaaaatcaatggtagagagcacttaaaattgaagcttatattttttggtctttaacaatcataggtctccagtaaatataaaaaatgcttcttagggcaactaaaactaagcaagtagtacgtgataatgagtctgtaccatccctaccccctagtcatcaacttccccttcagagagataatttattttaggtttggtctttattcttccaaatcttttccttttttctttttcttttttttttttttttgagacacggtctgcctctgtcaccgaggctggagtgcagtggcacgatcacagcttactctgtagccttgagctcctgggctcaagtaatcctccagcctcagcctcccaagtagctaggactacaggcatttactgccatacctggctaattttttatttttaagagacagggtctccctgtgttgcccaggctggtcttgaactcctgggctcaagcagtcctctggccttggtctcccaaagtgctgggattacagactttagccactgtgcctggcctcgtccaaatcttttctatgagtttacacacttgcagtcttgaacaaaattttaaagagaaagtacctcaagaaagtgagcattggttcaaaaaacaaaaacaaacaacccaccagtatatatgaaagttatcacagaggaataaaacatccctgtagtacttttcataatatattcttaatcttaaaacattaaatgtgactctttttagaaatcttgggggagaaaatatgcctacagtgcttattttcctgcttttcctggtaattgcctaatatcttggtgagaagtactgactccagaacaaaccagtggagaacaatagaactcctctgagagttacttagcagctcactctatgatttgaaaaaaatgattgttacatgacatttcatccataagaacaagcccatttctagttctggcactgtatgacatgttctctttgaatctcagttggcattaatgactatgctggtagtattcatgtgtcccttgtgaggctgtgaacaatctcccattacttgcctgccagagcagccttcgtgctttggtgggagtcatttccaaatctaattttctgttcatattgcaatttaaagaacgtttagatagaaaaaaaagggcccaggcttcacaaagaatttcaatttacatcaacgatttgaacaaaagcttcagataatataagtgaaaatactaaaattggggcagagttaaagatgttctggcatgtcatcagttgggaaacaaccatggcatagtatagaaaatttcaggagtgagacctagctgtgtatggagagagctctatcactgatttcactgggacctggggcgagctgcctcatcttccttggagttagttaccttatatttaaaatcaggagaaaagggaaaaaaacttcacttttgtaatagtttaaaatgttacaatggaactatgaaactgatagttctgcatatcttaaaaggcagttagaaactcagaaaaaaatctgattcccaaatagactcttcagatagttttatcttcatgatcatgtctctgtggttccacctttctgaaaacagtcttcagtaacttaagaaatcatttcaacttccatgatcttcagtagcagcagcatgaatgacacatgccaagagactaaatggaatgagataagcctgtctttcagagacatcatctatttcctgctgctgtccagacaggaaagtcagactccatttttcccctttgtaaagttgacttgagctacatgaagcacttgttagaacagtccaattcaagataattgtgctttatgactgcattcagaatcacatgtgtacccactgtgtgtgtggggggtgtgtgtatgtgtgtgcatgtgtgtgggtgggtgggtggagggggtgtgtgtgggtaggtgggtggtgggggtgtgtgtgtatgtgtgggtgggtgggtggtggggtgtgtgtaggtgggttggagtgtgtgggttgagggtgtgtgtgtatgtgggtgggtggggggatgtgtgtatgtgggtgggtggggggatgtgtgtacgtgggtgggtggggatgtgtgtgtgtgtgtgattgagaggggagggagatatagacacacagagagggagtattttgttgctatgtctttatgttcttttttaagacgatttcaaagatgatacatcctgttgaggctgctaagagctgaattaatagaattattagtgaatgtttttctaaacctgttatcagtatacactttactcctaaactgttatcaagatggtaaaaattatagactctatatttgggccaggcaaagtggctcactcttgtaatcccagcgctttgagaggccggggcaggtgatcacttgaggtcaggagttcaagaccaccctggccaacatggtgaaatcctgtctctactaaaaatacaaaaattagtcgggcatggtggtgagtgccttagtcccagctactcaggaggctgaggcaggagaattgcttgaatccgggaggtggaggcaaatcacgccactgcactctagcctgggcaacagagtgagactccatgtcaaaaaaaaaaaaaaaaaaacacaaaaacaaagacaaacgaattatggaatccatatttgaaatcttttcatgggtactattttttttgaagtattcctccacagattgacaataaaattgacattaaaagtagacagattaacaatatttaatccaaatcagtaaaattctttaactggttgaactgggacaaagacaaattcttagtgacaaggggtcttggtgtgtgtgttttgttgagtccatgattaatttgttcaattagtgacttgactatcagtcaaaccagaatatagcaaatctagtaaagaataattaatagtagtaaagcgttctgaaacaaataattctggttctctggtgttaacttttgtgaggttttttgttgttgttgttatatgtttatatagtgtccagtagtgtctttgatatgtgtgaattaattttatgccctgaaaatcagcaccttcaaaaaggaactcgatttttttttgttattgttctctttctggagaaaaaaggagctccatttaaaagataaggcctacatacctagtacttttttcttcgttgggcaagtcaacttgttacagatgggtcatcttcaagagccagctccggtgttctctagctatgctgcactcatttcataccaagcagctggaactgagtcaccagcccagcttcctccaattgttgcaattgtactgaactacattttaatagaaattaagccactcaagtctcttaaaatattagctcctataggattcctccttttcattcgtttcttttccttttggtttttgtttttatttccttttcttcatctagaaaaaaaatgggaaacaacagaataatttatttcatctgaaagactaccatgatacatgagggtaaaaataatacaccccaaaacactggagaatatttgcaccctgttgcaaggcatgagttctgtgcactttgctcttgatgtcacgtaagggaaatatttgaatgagttttaatcaagtgttgagtatttactgaaggcctttttggaagtaaaccaaagatgtcttgaaattttttgccattgcctattggctcagtttcatttatctcaaactgcaattcttacagtgttacatttctgtgaaacatctgtaaaatgagcctttgtgggtcaaacagaacacctgaggcctgagagggcaggtgagaactgcaagttgaagaatcttagattctgttttgttgatacatagcttgtgagtgaatcagattactgtttagaacttgtccatttatttgaagtctactaatacgtttgaaggcactaaagtttcttctcagattcttcatttggaatcaggacctgccatggttgtctgtcatctcaacagttaatccttggaaacagttttatcgctttatttatttaaaaaaatatatatatagcctttcaaccaaaacaagatagactattcactaatcacaaatattaatggaaaattggtaatcatatgtcctttaaactttccttggttgtatatatgactctaaattaatcagattttgtttattaccaatcagttaatgctaggtaaccatttatgaaccatcagctctattaaagttaaaactgccaatctgatttcctgcataatgctttgttaatatgatactaaaagtggtaatggctttcatttgcatacttttagttcactttcacgtgccttatttgatttaatctttacagacaaagcagatcttataaagaggaaatccagacccaaagaggttgtaatttacttagtcatgtagctggtaaatggtagagcttttccatttgggacttcaagccagtcccttttcttcagccttggttcttttttctctgatacgctagttttctccctctcccaataaatatttttatttgggagccgggtgcagtggcgtgctctctagtcccagctacttgcagctgaggatcatttgagaccaggagtttgaggacagcctgggcaacatagcaagagagagagacccccatctctaaaaaaaaagaaaattgaataaaaatttaaaaaattaagaatctttctgtttagagagcttaaaaactttcataattaattatagaagtaataggtgttatttattttgtcccacatgccctacccgacctacccctttgggtttgttttttttttttaaagcattgagactgttacaaataaatttttggtgctgcaaaagaaataacacttgaatataaaattttctttttaattctcagcaaggcaagttacttctatagaagggtgcgctcttacacatggagcaatggtgagcacacacttggataaggtaggggaaggggtttttatccctgactcacgtggcccctgctgctgtgtctttcccctattggctagggttagaccgcacagactaaagtaattctgattggctaatttaaagagagtcaccgggtgagtggtttggccagaaaaatggttatgacagagcaggtaattggaatgagtcagggtggagcaggtaatcgaaaatggtcactttatgaggaagttaaatttaaaagcagaaggtgaggaattgaacatactgacatattgattatttgaaaagaaatttagaactcatatctaacaagaccttcttcccctttatctaatctaccgtgttcttaaaaaaaactgtttgtgaaaaacagacttatattattaacttacagttaggcatttaattgactgttcattataaaaatgttaatggatatgttttatgaatttggagtgagaaaattgttttccaggtaatcacaatttatatatgacaagattaaaaaacattccttttttttttttttgagatggaattttgctcttgttgcccaggctggaatgcaatggcacaatctcagctcactgcaaccttcacctcccggattcaagcaattctccttcctcagcctcctaactgggattacaggcgtgcgccactatgcctggctaattttgtatttttagtagagatggtgtttcgccatgttggccaggctgggctggaactcctgacctcagctgatccgcccgccttggcctgccaaggtgctgagattatagacatgagccactgtgcccggtctacagtcatctcttggtatccatgggggattggttcaaggacccctggtggataccaaaatccacagatgctcaagtttcttatataaaatggaatagtatttgcatattaacctacaaatagcctcccatatactttaaatcatctctaggttataatacctaatacagtgtaaatgctatgtaagttgtcattacactgtgtttagggaataatgacaagaaaaagtctgtacatgttcagtacaactgcaaccgcccccgcccccgccctgccgcccttttttttgagacagggtctcattctgtcgcccaggctggagtacagtgtgtgatcatggctcgcctcagccttccaagtagtatgtgcaacacgcctggctaatttttgtattttttgtagagatgggagatctatctatctatctataaaattttttttttttttttgagatggagtctcactctgtcacccaggctggagtgcagtggcgcgatctcggctcactgcaacctccgcctctcgggttcaagcgattctcctgccttagcctcccaagtagctaggactacaggcacccaccaccacgcctgactaattttttttatttttagtagagacagggtttcacaatgtcggccaggctggtctcaaactcccgacctcaagtgatctgcatgcctcggcctcccaaagtgttgggattacagacgtgagccactgcacatggccttttaaaaaatatttttgatcctcagttggttgaatccacagatgctgaacccatgaataaggagggctgacttatttcattttgtgaaaaacttgagcttgtcagactaaagaatgttcagtgaaagcatcagagttgaaaatcaaatcaggttttgacttttaaaagtcctcttttggaggttaggttcttacagaagttgataggaaatatgtcttatttttctttgtttaggaagcaagataggctctagaacttggactttgagttaaaaattttaaattaatgagataattaaataaatctttgtttctttggttggaatgtagtcatagaaacctgaggctttctaacctaaattgaaagatggagccagagagagaatatgaataagaccaagggaaattgatagattataaactggttatagatttttgattcccctctatcttgaaaattctgatgacgaagtatttcactttcatgatatatttaaaaatactatttttggagacagagtctcactctgtcgcccaggctgaagtgcagtggtgcaatctcagctcactgtaacctccgccttccagcaattctgcctcagcctcccgagtagctgggactataggcatgcactactacacccagctaatttttatatttttagtagagatggggtttcatcatgttgcccaggttggtctcaaactcctgacctcaggtgatccacccgcttcggcctcacaaagtgctgggattacaagcatgagccaccatgcccagccaatattctttattttattcaaattctgtgcatttatggtcaggaaggaaggaagaaggaaggcaggcaggctaacttaataacaagataaacagctctgggctataataggaggcagaaacattctttgaaactatatgttgttgtattacttttcttgaagtacacatttttatgtttgcttttataattatgaaagttttcaaacatgcataagaatagaataaacttctccgtaaacccaattcagttatcaagatcttgccacatttgctttgccccttttttctgattttctttgctgaaatgttttaaagtaaatgctagacatcatgtcgtttcatccctacttaattcagtgtatgtcttcaaacaatgtggacattttcttccctaaccacaatgctctgatctcctgaagttcctagtatacaatttgggatttccctggttatctctaaaatatctttttatttttggttggtttgttcaaatcagtatccaagtaatttctactttttatgtttgattgttatatctcttaagtttttcttaatctataacagtcccccacctgtgtctggtaaaaataccattcagctgaaaggtagattgtcccaaatccagaatttagcagttgcttccttgtggtagcatttaactttgtcctctcattttccccctccctgcatttcctgtaaataatctcaggacccctttgtactcttaaattattgaaggcctcaaacagctttcagttatgtgggttatatctacctattttactatattagaaattaaagttgagaaattagcctaggcaatatggtgagatcctcatctctacaaaaaattttttaaaaattagctgggcttgatggagtgtgcctctggtcccagctgcttgggaggctgaggtaggagaattgcttgagcctaggaaatcaaggctgcagggaaccatgattgtgacactgcactcctgctttggtgactggtctcaaaaaaaaaaaatcctgagaaattttaaaaatgtttatttatggccgggtacggtggctcacacctgtaatcccagcactttgggaggccgaggtgggcggatcatgaggtcaggagaccatcctgactaacatggtgaaaccctgtctctactaaaaaatacatcaaaaattagctgggcttggtgtgcgcctgtagtcccagctacttgggaggctgaggcaggagaatggcgtgaacttgggagatggagcttgtagtgagccgagatcgcaccactgcacttcagcctgggcgacagagtgagactctgtctcaggaaaaaaaaaaaaaatcatttactaattcattaaatatagaacaataatgaacccactacttattaccataaaacatttttaatgtaaaacaactatatttcccaaaacaaaaaatagtgagaagagtggcattcttttacatttttgcacatcttagaagaggtttctcgtgtctgcttctgcattcattaccttgtgatatcttgtaccaagtagccaagtaaatttggaaaattttactatatgtgcacgagaggagaatgagagtgaaaaaggcaaatgatgccttagtattataagaatagttctgacctaatggatcacctggtgaaagggtctcctggcttacaatttgagaaacagctgccccagaggctgctttgttttggtttgttgttgttgttgttttgagacagggtctcactctgttgcccaggctgaagtgcagtgatatgatcactgttcactgcagcctcgaccgcctgggctcaaccaatcctcccatctcagcctcccaagtagctgggactacaggcacatgccaccacacccagctaattaaaaaaaatttttttatagagatgggatctcactatgttgcccaggctggtctcgcttgaactcctggactcaagcaatcctcctgccttggcctctcaaagtgctaatgttacaggtatgagccactgcacccagcctgccccagaggcttgattagattcagggtcaacttctttggtaagaatacttcatggtgccataggaaacacaccatatctggtcatctcattttttgatcctaaaattcattggtgggtttgggtgagccattttgcttttttaacaagatagtacaaacacttcttgctgttagtagttgtcagcataacagtttcaccatctttatcagtgttttgtggtgttttcaatttttcctaatcaacaggaggaagacatcttattgtttacttttaaattccctttatagttgtgctattttacatttttctgtgtgttcacttgttttatctgtctctcatcaatttcttttgacccatacctatttgatttttttgatgacctttggaatgaatttggacaaaatccttaggtaatgtagattttaagcttttctcactcagtactttgtccattctttgttgctttttacccttcattatgccatcttttatgtattgaagtaattttgatattagatagtctaatctggtgatccttttccttgtcaagcctggacttctagaataatgggaaagaaatagcaccagaatttggaatcttttgaagttgaagatgactgcaggattcagctgcttttctcttttattttgccaaaaagaaaaaaaaaggcctagggaagtcatgacttacccatctttacacaattagttggggccagagttgaaaccagacactaactctccaaaatcttttttccctcctcattctatcactatctctaatgagtgacttagttaatttggaatgagaatgatggattttgtattttggttaaaaaaaaaatcaaagcattttcttaccataaattatgtattttgtggaggcttgcttcttattagaatactattacagctattatatctagtggaaaagtactatttctttcttttttttgagacagagtattgctctgtcaccaggctggagtgcagtggtgcgatcttggctcactgtaacctccgcctcccgggttcaagtggttctccttcctcagcctcccaagtagctggaactacaggtgcatgccaccatgcccagctaatttttatatttttagcagagacggagtttcaccatgttggccaggagggtctcaatctcttgacctcatgatctgcccaccttggcctcccaaaatgctgggattagaggcgtgagccaccacacctggttgaaaaatacctttctttctttctttctttctttttttttttttttaagatggagtcttgctctgtcgcccaggctggagtgctgtggtgagatctctgctgactgcagcctctgcttccgggattcaagcgattctcctgcctcagcctcctgagtagctgggattacaggcacatgccaccacgcccaattaacttttgtatttttagtagagatggggtttcaccatgttggtcaggctggtctcaaacttctgacctcgtgatcctcctgccttggcctcccaaagtgctgggattacagccgtgagccaccgtgcccggctgaaaaataccatttcttattcagttttatatactttaaattttagaaccactttgatctcttttctttttctttttctctttttctttttcttttctgacagggttttactctgtcacctaggctggagtgcagtggtacattctcagctcactgcaacctccgcctcccgggttcaagtgatcctccttcctcagcctcccaagtagctggaactacaggtgcgcaccaccatgcccagctaatttttatatttttagcagagatggggtttcaccatgctggccaagctggtctcaaactcctgacctcaggtgatccacccgcctcggcctcccaaagggctgggattacagacatgagccaccatgcccggacaatttatttattttctttttgagacagggtctctctgtcgcccaggctggagtgcagtggtgcgatcatggctcactccagcctcaacttcccaggctcaagtgatccttccacctcagcctccctggtagctggtactatagacacgcaccaccatgcctggctaattttttatgttttgtggagacaggatcttaccatgttgcccaggctgggtctcaaactcctgggctaagcagtgtcccacctcagcctcctgtagtgctacgactacagacgcaagccaccgtgcctggccaactttgagaatttaaagtattattgttgtttaagagtaaaaaatgatctgattttgaccaatattttgcccaacaggaagccagcagacctgcagaacttggctcccgggacccacccaccatttataactttcaacagtgaagtcaaaacggatgtaaataagattgaggaatttcttgaagaagtcttatgccctcccaagtgagtatcaaggaaaatacgtatgaaaatattgtcacttctttgaagcttgtgttatttgtcagtagagatctttctcgcagcattaatttggaatgactaggactctcttctatgtttcttataattaatgctacacagatataagaattggcttccagctaggccaatcagccatactaagaaaggtggggatttgtctaagctgtagaatatgtggtagaaacagatttgggatgtgtctgataggtcaggaaagactggttatttgtggactgtaggtctcaaactgagagagaagtttaaagaggagaaggggtggggaaagacacattccaactgaacccagtaagaatgtcttagcaggagtgtggcacaggactgcaatgagatttgatttcagttcattttaaaggtaactttctaaagctataatccaaggacattgacttttccgactgtgtccctaggattcagagtttttatttacttacttctttgaggtgttccagatctctaggtcctggatgtactgtaatgatagttacctaaattgcagatatgcagctttgcatcatactgtaatattggcatagattcaaagcattatttgtttcttttaggcttttccagtttcattatcctgaaaattgacatgttttgtttctactgaccaaaacctttcttactggttaacttgactgttgccctccatgtccagatatattttccaggaatgggattattgagatggagggttctaaaataattataggcataccctgaagggtatggttccagaccattgcgagttaggttccagaccacagtgataaaatgaatattggaataaaatgagtcacgtgaaatttttcgtttcccagtgcatgtaaaagttatatttacagtagtatactgtagtgttttaagtgtgcaataatagcattatgtctgaaaatattgcatgtaccttaatttaaaaatacttcattgctaggctgggtgtggtggctcatgcctgtaatcccagcactttgggaggctgaggcggatggatcacctgaggttgggagttcgagaccagtctgaccaacatgaagaaaccccgtctctactaaaaaatacaaaaaaaattagctgggcgtggtggcaggcacctgtaatcccagctactcgggaggctgaggcaggagaattgcttgaaccagggaggcagaggttgtagtgagccaagatcgtgccactgcactccagcctgggtgacaaaagcaaaactccgtctcaaaaaaaaatcattgctaaaaaatgctaatggttatctgagccttcagcgagtcaatctttttgccgatggagggtcttgccttgatgtagctggctactgaccgatcagaatggtgattgctggttggggtggctgtggcaatttcttgaagtaagataacaatgaatttttctacattgatggactcttcctttcatgaaagatttctctgtaacatgcaatagtgtttgatagcatttaaaaattttaaagtaaatattctttgcctgaggctaatctcaagaggtcctgagaacatgcacccctgtttgatagtgtttttacccacagtagaacctttttcaaaattagaatccatcttctgaaaccctcctgctgttttaacaactaagtcgatgtaatattctaaattccttgttgtcatttcaacaatgttcttagcatcttcactaggtatacattctatctcaagaaaccattttctttgctcatcataagaagcaactcctcatccattcaaattttattatgaaggtagaacaatttgattacattttcaggctccagttctaattctagttctcttgctattttcaacacatatgtagttcctccctccactgatgtcttgaacctgtgaatgtcgtccatgagggttagaatccacttcctccaaactcctgttaatgttgctattttgacctcctcccatgaatcatgaatgttcgtgttttttttttttttttttttttggacggagttttcgttcttatcgcccaggctggagtgcagtgatgcgatctcggctcactgcaacctccacctcccaggttcaagcaattctcctgcttcagcctcctgagtagctgggattacaggtgcctgccgccatgaccagctaatttttttgtattttttagtagagttggggttttgccattttggccaggctggtcttgaactcctgacctcagatgatccgcccgtctcggcctcccaaagtgctgggattacaggtgtggtatgagccaccagacctggctgaatgttcttaattgcatctagaaaggtaaatcttttccaggtcactttgctttgctcagatccatcagaggaatcactttctatggccttatgaaatgtgtttattaaataataagacttgaaagtcaaaatttatggactgcagaatggatgttgtgttagcaggcatgaaaacaaccatgatctccctgtatatctctatcagagttctggggggactagtgcattgtcaatgagcagtaatatttagaaaggaatctttttttcctgggcagtgggtctcaacagtgggcttaaaatatttagtaaaccatactgtgaacagatggatgtgccattatccaggctttattgttccatttatagagcatctgtagagtagcttcagtataattcttaagggttcttcaaattttggaatggaagatgagcatgggtttcaacctaatgtcaacagctggattagactcttaacagagtcagcctgtcctttgaagatttgaaaccagacgttgactttttctctgtagctatgaaaatcatagatgacatctttcaatagaaggttttgtctgcattaaaaatctgtttagtgtagccaccttcatcaatgatctatctagaagatcaattctagatagatcattgttgaaggtagatcagattttctagatagatcatcagatgaaggtgatgaaggaagatctagatagatcagctagatcttctagatagatcagctagatcttctagatagatcagctagatcttctagataactggctgcatgcagcttctgcataagcatttgctgcttcatgttttacttttatgttacaaagatggcctctttccttaaacctcacgaaccaacctctgctaccttcaaactttcttctgtagatttgtcacctctctctgccttgatagaactgaagtgagttagggccttgatctggattaggttttggcttaagggaatgctgtggctggtttgattatctggaccactcaaactttctccctattggcaataaagctgtttttctctatcatttgtgtgttcactggaatagcactattaaatttccttcaagaacttttcttctgtatatgctgtttggctgtttggtggaagaagtctagctttcagcctatctcagcttttggcctgtctcagctttcgacatgctttcctcactaagcagaatcatttctagcttttgatttaaagtgagagatatgtgactcttcccttcacctgaacactgagaggtcattgtagggtcatcaactgtgggctaatttcaacattattttgtctcagggagcaggaaggcctgaggagagggaaagacaggggaacagcaatcactggagcagtcagaacacatatgatattaatcagttaagtgtgctgtcttatatgggtgtggtttgtggtgcccccaaaacaattacaagagtaacatcagagatcactaatcacagatcatcataacagatacaataataatgaaaagttttgaaatattgcgaaaaataccacagtgtgacagagacatgaagtgagcacatgctgctgggaaaaatggcgccatcttgcttgactcagggtgccataaaccttcaatttgtaaaaaacgtaatatctgcaaagcacaatgaagcaaagctcaataaagcaaagcacaataagacaagttatacctgaagttactcaatttggtttttttttgtttgttttgttttttttgagacagaggctcactctgtcacccaggctggagtgcagtggcacaatcttggctcactacaacctctgcctcctgggttcaagtgattcttgtgcttcagcctcccaagtagctgggattacaggcacctgccaccatgcctggctaatttttgtatttttagtggagatggggttccaccatgttggccaggcttgtctcgaaatcctgacctcaaggtatccgcccacctcggcctctcaaagtgctgggattacaggtgtgagccactgtacctggcccagttactcagtattcatccattcatttatttattgatttattcattctgcaaagcattaatggactacaaagcactgtgaatatattagtaaataaaacacagttcttgccctcaacaagtacagtcatgtatgggtggagaggtgtttatggtggtgggacggggaagtgaatggaatcaggaaaggctttagagaagagagaacacttgaactgtcttaatttaaaaaaaaaaaaagaaaaaagatgttcagcagttgaacaaaggagtgacaggtattccagagcagaagagtcattttaaatcaatagtataaacatatatgttatacacatactatacagaaatagtatgtaatgtatattattattaatattatatgtatatttgggggagacttggagtggctggaatgtgatgtgcatggttgggatggtaggcaggaaggctgatgagcaacaacacctctgtctataactagcttctcatctgttgtgagcagaattgccctctggttaacaatcttgtgctaagcctaatattttattttcttaattctttttttctactaaaattctacaagcctatcctctactatccttcctgcccttctaagagcctggagcttctttttttctctaccttcccaggagtcctaaccttcctttcatccccagtaaagtatctccagaccaacattaagaaaaccatgtcttgatttttccttcaggccatgcatataattagaatgccaataaatcaaagctaggatatttgtgaatataaattgaagctttatacgtctcagtagggtactattgtgaacatgaattcaacttagtggaaataactttttttttttttttgagacggagtttcacttttgttgcccaggctggagtgcaatggcatgatcttggctcactgcaacctctgcctgtcaggttcaggagattctcctgccttagcctcccaagtagctagaattacaggcgtccaccactatgcccagctaattttttctgtttttagtagagatgggatttcaccatgttggccaggctggtctcgaactctggacctcaggtgatccacccgcctcggcctcccagagtgctgggattacaggcatgagccaccgcgcctgaccataactttttttcttttttttttgacagagtctctctgtcgcccaggctggagtgcagtggcacaatctcgactcactgcaacctccgcctcctgggttcaagcgattctcctgcctcagtctcttgaatagctgggattacaggtgcccgccaccatgccctgctaattttttttgtatttttagtagagacagggttttaccatattggccaagctgctcttgaactcctgaccttgtgacctgcccacctcagcctcccaaagtgctgggattacaggcatgagctaccgcgcccagccatacttcaaaaaaaaaaaaaaagtatgtatatatatatgtatatatatatatatatagacagtatcttgtactgtcgcccaggctggagtgcagtgttgctgtcctggctcactgcaaccttgaactcctagcctcctgcctaggatgatcctcctgcctcagccttccaaataagtgggaccacaggcatgcaccctatgtcccacttctaggtccctttttggtctttttttttttttttttttttttttgagacatggtcttgctctgttgcccaggctggagtgcagtggtgtgattatggctcaccacagcctcgacctcctgggctcaagcaattcccctgaggcactgggagtacaggtgtgtgccaccatgcccagctaagtttaaaaaaatttttgtagagatggggtcttgctatgttgcccaggttggtctcaaactcatggacacaatcagtcctcctgcctcagcctcccaaattgctgggattacacatgtaagctgtcatgactggtccctttttagtcttaaaagtgtcagctcagaggtaggttccatatttgccaacttgctctcagacactaactgaaaatgatcttcctctcatgtcactgtagatcattgtatcaacattaaattataaatggagaagtagtttgaattattattcattctctatgaaggaaactattttgttttaaagtattgtctgaagtgcttattatataaattcttccaagtatatataagtttttaaaattagtgtgctgaaaacatacatatgactttagttaaatggacatttcctcatattctcttacatccttcagcaacaacaacaatgaagacttttgggctgggcgcggtggctcatgcctgtaatcccagcactttgggagactgaggcgggtggatgacttgagctcaggagttcaagaccagcctgggcaacatggtgaaaccctgtctctacaaaaaaatacaaaaattagctggatatggtggcaagtgcctgtagtcccagctactggggagcctgaggtgggaggattgcttgggcctgggaggcagaggttgcagtgagctgagatcatgccactgcattccagcctgcacgatacagcaagaccctgtctcaaaaaagaagaaggaaaaaaaaaaagaattttcattattcttgctcatttctctctgagggaaagtgacattaagagaaatagtaaagttaatatggaatattctggattcttagcatctaatgctctgtaagacatcatagctttaaattggaccttgaaaacaaacattttcatattgcttttttatataaaaattctagccccattatatttgagcatattcatagaaacattgtaaccagagatggtctttttcattcagtttaaatacataggaatctttgtgttataaatgttcatagtgtgccaaatcccctgtaggggtaaaaatttttacttcttctttgttttttctttgttttgttctgtttttgtttagagacagggtctcactccttgctctgtcacccaggctggaatgcggtggtgcaatcttacctcactgcagcctcaacctcccaggctcataatcctcctgcctcagcctcttgagtagctgggagtacaggtgcacaccaccacgcctggctaatttttgtattttttttgttgagagtaagatcactttcaattggagtctgagaacagggtctcgccgtgttacccaagctgtggccttgaactcctgggctcaagccatctgcccacctcagcctcccaaagtgctgggattacaggcgtgagccaccgtgcctggccagggattgtttttgatgctgcttatccctctgctgttattaataacactcaagtactaattatgcaccatgcattgtgctttgtgggttattttgtggattatctctgttaatcctcacaaagactttgtgaagaaactgaagatgtaatccaaataatttgtccaaggtttcacagttaatggtggcagagcagggatacttttgaagccacatcaatatgacttcaaaaatctgtgtttcatctgttctctgctttctgcttcttattttattgggtttggcttttgtaaaagagggaaaatgttaagtctttaattgggattgtgctttaatgagtacaaaattgaaagctagctcaagtttagaggaaaggtaggagagaaatcaaagatagtttacttgactgtgaacaagtgggaccaaaggtggttattaaacttaattcagtgaattctttttttttttttttttttttttttgaggcagagccttgctgtgtcgcccaggctggagtgcagtggcagcatcttggctcattgcaacctccacttgccaggttgaagcaattctcctgcctcagcctcctgagtagctgggattacagatgtgcaccaccacgcctggctaatttttgtatttttagtagagacggggtttcaccatgttggccaggctgggacttcaagtgatccgacctccttggcctcccaaagtgctgggattacaggtgtgagccacagtgcctgcccttacttaattcagtgaatgctttgaaaaagcaggtgaatcttaactcttctgatgaatttttatttatttgtatgcattgaaacagcatgtttgaagtgggaatgtcgccttcttagtgggctctatggacccagaatgtgaaatgctaattaattagcataattttcatcatgcagaattgtttctaggggatgagtgggaggaggaagagtttctgggatcacaagctgcatttattttccttccctctattgtgctatattgttctagggcacccagggaccattctgtctcactgccttttccttccagaacaaggaggtctcaggtctttattgctagtcttcttcaggctctgcttgtaagactgtttctaaataggataaggagaaaaaggagaagaattgtgcaagcttgtagactggaatctagcatttctaataacatgtttttgtcatttgatgtactgagaactgagtggttttttgtgaacacttcctgatttaatcatgacaaatataaatacaggcaattgtctattctagagttgcttaacattgagaggctaatgaaaagctcaaatcagataacttttactggtatgtgtggctataggttttaaagtgaactttttcttcttctctggggaaagtatttttgtgtatgttttatagttcttgcttgaatgaagaaaccactttgctaaaaaactttgagacttggatttttaactgaaacagcctagatatacttagctaacttactgataaaaggataaaatagaaggaagcgagataaatttggaggggcatgctataaaatgttattaaaccttttttaaaaatgagacatacaggccgggtgtggtagctcacgcctgtaatcccagcactttgggaggccaaggcgggtggatcatgaggtcagcagtttgagaccagcctgaccaacatggtgaaaccctgtttctaataaaaacacaaaaaattagctgggcgtggtgacgggcgcctgtaatcccagcgacttgggaggctgaggcaggagaatcgcttgaaaccggaaggcggaggttgcagtgagcggagattgcgccactgtactctagcctggacaataagagcaaaactctgtctcaaaaaaaaaaaaaaaaaagacatacaaaaaaggaatttacaaggctaatcagccttcatttttatatttacaccagaaaggagaaaatgcctgagatctttcctaaaagcatggaaacattcttagctagtctaaaatgttaagagtctgtgatgtaagcagaattaaggacttatctgaaagtctaaataccctgggtgctcatgtctattctgtcattgacacttagccttttattatttgcctcccttttgctaagtgttaaaatgagttctcacaataattgaaaaccattgcttgatcaagctatttgctaaagccaataataatgcataaattacaatgtaatgtttggggaagatgcaaaaaagttgattttgaacctactggtttagaatttgatttatcttttagagataatctaatctgtaatagaaacaaacaaacaaacaaaaacactagacctggggacaggagatttcagttttagtttgtcaatactttttttttttgagacgcagtctcgctctgtcacccgggctgagtgcagtggcatgatctctgctcactgcaacctctgcttcctggtctcaagcaattctcctgcctcagactcctgagaagctgggattacaggcacccgctaccatgcctggctgatttttgtatttttagtggagacagagttttgccatgttggccaggctagtctcgaactcctgacctcaattgatccgcccaccttggcatcccaaagtgctgggattacaggcatgagccactgtgcttggtctcgtttgtcaatacttttaattagctgagtgatttgggggccaagtgtgtaagctttctggaacataatttccttttaggtaaaatgagagatctgaggtgaacattctcttatagctatactattctgtgcattaaattaatagtacaggctgggtgcagtggctcaggcctgtaatcccagcactttgggaggctgaggcaggaggatcacttgagcccaggagttcaacactagcctgggcaacatggggaaacctcgtctctacaaaaaaatacaaaaagctagccaagtgtggtggcacatgcctgtagtcccagctactcaggaggctgaggtgggaggatcgcttgagcccaggaggttgaggctgcagtgagcaagatcctgccactacactccaccctgggtgacagagggagaccctgtcacacacacacacacacacacacacacacacacacacacacacaaaagtacaaaattagtaatacatctcagagggacaacagggcatattacaagaattacactgtatgtatgaatgatgaatatataaatgatctgtaattcaagcctgccttcccgaaaattattttaagaactatgaggcttacttcattagtacaattaggtacagctaaatagtggttgcggaaaaggagaatttgggaaacttggctataggaagacatagatgtattgaaaaggcattatgttcactgcgctattttttgtttgaaatgagtcaatgatggtcctgtatcacaagcagtacaaacatttaaactggaggcttgtttgtatagtcaaggaaaatccagggatggtggatctgtgattaactgtttcagcccaggcagaaacaaagaaaatggagagggtaaagggccctatagttggcgatgtgtggttaatgtatggctagatagatatagatatctaaattcaggtgaaactcactgtaatttttacagaaaaactctttatgtaaataattgtgtttataagataaatctttaagcttaaaaaatgagagctatctagagactaggtacacttattaaaaaagatgtcttgagcatataggtgttccatagatattttatatcttccttaccaatatagtactctgcccaatatttagaagatatatctcttcctgaattcaaaatagtaaacagaagatacatgaatataaaagctgaaacacaacttgcaactgaactgaattttgaaaactacttccccttcgtttttaaagaaagctggcaagacaatgtcttcaaataaatgagttgaaataattagtacactgtaaggttttttctaaagtcttattgctcccaagtccattttctagtgacgttttgcaggaccttcaagctgattaatcttccctaaaatggggctaagaatctgaattcttctagccctgactcctggggctgacatgagtcctcctaaagggaagatgaataattgagctttttcatatattttccagtttgaagaagaaatatacacagagtatgtgtgttttaaatctaaacagtgaaatatacatttttgtgtgtgttttagaaagctggtgtattacatctgttctaaaagtagaaaaatttgacaacacaatagaacacttgtcagtgtgctttctgacatctcattttgttgttgttcggtgctaccctcataaatattctagggaatgtgtaatataagggaggttttgggaaatcccaggtgtaggtttcaagcgattgatccgcctccttttgtttttgtccttaacctgctatgggtgatcatgatgcttgaccagcctaggcgcttttcctgccgttggggttctctggctggtttagtgcaggacatactaaggatctggttggcactgctgtttgagaaggcgcgtgagctgtgctgtctggtgactactgagcacttgaaatgtgactagtgcaactgaggaagtgaatttttaattttgtttgtgattaatttaaattcatattcaaataggtacatggcactagtggctactgtactggacaatgaagatagagaacatttccatcatcacagaaagttctcttggacagcactgctctagcaatctcattccaagactcccattggcctggcagaaatctctgaacaagtcaactgtttccccagcattctaatttatcagatggaggtggagtgcacatgccctgtggttgccaagaatattaatatgtgaacaaaaacatagtgcagagctttgtctcgtaaggaaaaaacagtttttaaaaataccatagaaaacaaatgatggtatttcttatagtaataactattaaaagacgtctagtaactgctagcatggtggtttgagagaacttatgctaattcatctttgaaggatctataatccatatcactttttctatttaggtacttaaagctttcaccaaaacacccagaatcaaatactgctggaatggacatctttgccaaattctctgcatatatcaagaattcaaggccagaggctaatgaaggtaaaaaacaaaaacttgaattaacattgcaacaaaaaaccccaaacaacaacaggctgttattatgacagtgattataaatgagtactttagagtccagccattcccataagtaataaaaactgtctttcagagttggtcagaaattggacaataaactggaataagtccctatgttgctatttttccatgtttctagctagtagcacagtatatagtaagtgtgtgataaaatgcttcttgaatgaagtttatttcatcttattttgagaagttactgtgaagggagctaggcaaagaattaatggtgcatcagaaacagtggattgtgtggttgtggtggtttagcatagattggttgagcttaatttaaactgtaactaaatgtttattgttgagtgcctgcagcctagagtcagtctgaggtttttttttttttttttttgctttgttttgtttttgttgttgttgtttttgctaattacccttgagcaatgtttggagttgctttaagagggtaattagacatactatccttccaaatttctctgcatcttcaagctggaatttcattttcaagtcatgttttcgcggtaagagttgtttaggtagtacagatgcaattttcttttatttattaaaggacactatttttattattttattcaccaaatgaatgtatagtgtagggaggtctctttggaagaggttccattcagtgaaccttgtcttaactacagcatttagtaatttccttttctcttcgggatgttaagcagagttctctctggggaaaactgtgtagcacacattagtgtttatttgaaagtaacccaataaccaaaaatgctagcttctaaaaatatttatcatagttccagatagtttcctagcttgagtgggattcttttgagaagaagtttatgtcagcaaatgaacaagaataccaaaggggaaaatatcagtgctggttaaacaagaatgaatatctttttaaaaagtgaaatacttgctaatttccttatgttatttcagtactattattataaaatgctgcaattttaaaatttagtattggattccaatgtcttttgctcttgatttttggaataatacttaactacatgaaatgtttttctacagtgaagggaaaaaagggaaaaatgttagtgctcaggtctggcttgtatctgttaataatgtattccagtagctgccatggtttggaagcaattttctttagtaattggcttttttttttcctgactaatgtttctgtctaagcaatttatacattaagcaagtggttatgttggagcccctcctttccacagacagtgtcttttctgttctgcgcttcatgcgagctaactgttcttttcataaaactacccttttatacttagatgcccctgctgcatacttctttgaacaatcttagttacagttatgtttttatttttccatgtggttttttgggagttggagggtggttaaatttcttctgacacttagtggggaggagaaaggaataaaatgtgtttgcttcccctttgagggatgaggatggggcggggtgggggtggggcgggaataaaaaggttagaaagtgactcatttaagtataactttgtattctattttttccctatcaatttgttattatcttaagtagccacctactcttcctgtcctcagaatgctgtaaccaataagaacaaacaacataatataatacatggtacataatctagaaggctttatattaaattacctgctggtaaataaaagttccagttgccaagcaacttctctccacagggacctgttgaggccatgacactttagaaaacaatatttcaaatcactttggagcttaatgggccctccttatgtatgtttgccgcaggcctcagatccatttagtgcaatcaaatgcctttagtagtcctaggaaattagtgattctcctttttatttcccccaacccccacccagatgctgacaatttacacagagatgaatttgtcgttttacatggtaaatcagagtagacaagtctgattagttttaccacctattaaatattttcaaaatccaatatgtttggacaattttaagaccttttaggacttaattctaagtaagggattcaatgcctgaatgctacagttttgggctaatgaaactgaaatagaagggctagtggttaggttggggtacaaagtaaacaagtaaaatgtgaagaataaagggagagacactgatgatagatagataacacatatataattcttttgataacacgttcaagttgattgggagtaaaagtttatgtaaccatttaggcagtcaaagagaagctcatgggtaatttcttttgtggggatgtattaagtatgacctgtccccagatctcctactttttttaagttctgtgatggcattaatttatgtaatttgctaaggtcccaactgtgactagtcattgatatttataatactcagtcattgatatttataatactcataaaagagatgtgaacttagcattgttgaatgtactctgaggcatatttcatgatgtccaaattcctatatttagatggaggcaaggaatctagaggttctgattagttcctttttattcaggatcctctcctttctcctctccccactactcctgcctttctctctggaaaagtgttggaagtcagaggatggttgtgcattattgtagcagtaagcctgcattgtatattgaattatctttaaatacccattacctctttctattttccactgatgtgtaacttagccttaaaacttgtttgtataaggttaccctttattaagactgcggtaggtagcttgaaaatatggttttatccatgtcagtgcttacaatttttagtctttgttttagtcattgtaaattatcttgtttttcaataaccgaagtgctcttattacatttaatgttttctgccttgaattttactcattcaaatcatacaaataacagagaatacatgattgttgaaaaagttaaaatagtatagaaataaatttaataaaacttaattgcccctctttaatcacattacatgacctcttcaacaatttagtgttcttttttctatgtaattttgcaaacatttctgtaagtacgtattatgtgcatacattatgcagttatacttttcacttatatggtagaaatgcttctatatcaaaatatagatctacctcaatttttagaaattctgctttgtattttataatatggattttcatttaaccatttccatgttgatagacatctagattgtctcaagttttttttttttcttcactataataaacaatgctgctggtgaatgtccttgagctagattccaaatagttcaaaaagtttgtgcattttaaattttgctctattttgctaaattgttctccaaaagtctataccagtttatattcccacaaacatgaaagtattcattaccctacacttaggaccctggtgtgtgttaatctttgtaattttgctgtgttctcttagacaagaaagggtgttttgactttcataattacttttaaactgattttgttgctctgttgcacttaaaaattttttgagagctttatgaaatagcttcttagggataccagcattactacatcggggtattggagaataatagtgctacttattagctataagacagggagctactttgtgatggcttgctactgccttctagtggttaattttgacattttctttatatttacatactcctttgtgatgattggtcttgaaaactgtattgtgtttattgaatgatgctgtttagtactttttgatatttctgtttgtgtttgttttattggccataccttatgttgatacatataattgtatcaaactaattcatcattctttgttttcattaatatacccttgttatgacattcttaactatgaaaaattactaacaccgtagtcaggtatagcaattcgacttcatcagaagtgctttgctaagtacaaaattatagagaaaacagtcattgtaatgttatgctagactcttaattttcttttgaaaaaaatttatttaaatgagacaaggtctcaccacattgcccaggctggtcttgacctcctggactcaagcaatccacccagcttggcctcccaaagtgctgagattacaggcgtgaaccactgtgtcttgcactgacgaatactatgttataaaccttgtaaatttaggatatttgatttttatatatataattcaggaaaaacattaatttagagcaggtctaaggttaaacatttgctcaaaaacttgtcaaaacactcaaatagcatttgagacaataattcaatgtttgaattcaggcaacattatcttccccacagactgattccattcattgtaatctgatcaaagaacaagtccttgtactctaatatgttcttgttctgcattcactacttttatttttttggttttttgtttgttttgtttaagagtcttgctctgtcacccaggctggagtgcagtggcacgatctcggctcactgcaacctccacctcccgggttcaagtgattctcctacctcagcctcctgcgtagctgggactacaggcgtgcaccaccatgcctggctaagttttgtatttttagtagatacgaggtctcatcatgttggccaggctggtcttgaactgctgacctcaggtgatctacctgccttggcttgccaaagtactgagatgacaggtgtgaagcaccatgcccggccatgcattcactgcctttaataagaagcatattaactcttgttttacaaccttgagattctgctctctccttttctcttttttcctcttaaatatacccatagaaagtgtttcatcgtttcctggaattcttactgacctagctgtttctcacattgtattctcctgttaatttataaactttacatttcagctaactatatgcattattgctggcctgaatataattaataaaaatttatgtttattattttatgtttttgattttttattttttttattttttattttttttttcttttgagcagtaacgttttattttttatttttttattttttattttttttattttttatttttattgatcattcttgggtgtttctcgcagagggggatttggcagggtcataggacaatagtggagggaaggtcagcagataaacaagtgaacaaaggtctctggttttcctaggcagaggaccctgctgccttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacatgtctcagagagcacagggttggggataaggtcacagatcaacaggatcccaaggcagaagaatttttcttagtacagaacaaaatgaaaagtctcccatgtctacttctatccacacagacccagcaaccatccgatttctcaattttttccccacccttcccgcctttctattccacaaaaccgccattgtcatcatggcccatccccaatgagccgctgggcacacctcccagacggggtcgtggccgggcagaggggctcctcacttcccagtaggggcggcccggcagaagtgcccctcacctcccagatggggcggctggccgggcggggggctgacccccccaccgccctcccggacggggcggctggccaggcagaggggctcctcacttcccagtaggggcggccgggcagaggcgcccctcacctcctggatagggcggctggccgggcggggggctgttccccccacctccctcccggacggggcggctggccgggcagaggggtcctcacttcccagtaggggcggccgggcagaggcgcccctcacctcccggacggggcggctggccaggcagggggctgatccccccacctccctcccggacggggcggctggccgggcggggggctgaccccccccacctccctcccggacggggcggctggctgggcagaggggtcctcacttcccagtaggggcggccgggcagaggcgcccctcacctcccggacggggcggctggccaggcagggggctgatccccccacctccctcccggacggggcggctggccgggcagggggctgacccccccacctccctcccggacggggcggctggccgggcagggggctgaccccccctcccccctcccggacggggcggctggccgggcggggggctgacccccccacctccctcccggatggggcggctggccaggcggggggctgacccccccacctccctcctgggcggggcggctggccgggcagaggggctcctcacttcccagtaggggcggccgggcagaggcgcccctcacctcccggacggggcggctggccaggcggggggctgaccccccacctccctcccggactgggcggctggccgggcggggggttgacccccccacctccctcctggacggggcgactggccgggcagaggggctcctcacttcccagtaggggcggccgggcagaggagcccctcacctcccggccggggcggctggccgaccccccccccccccccccgcctccctcccggacggggcggctggccgggcagaggggctcctcacttcccagtaggggcggccgggcagaggagcccctcacctcccggacggggcggctggccgggcagggggctgaccccccccacctccctcccggacggggtggctgccgggcggagacgctcctcacttcccagacggggtggttgccagacggaggggctcctcacttctcagacggggcggttgccaggcagagggtttcctcacttctcagacggagcggccgggcagagacactcctcacctcccagacagggttgcggcccagcagaggcgctcctcacatcccagacagggcggtggggcagaggtgctccccacatctcagacgatgggcggccgggcagagacgctcctcacttcctagatgggatggcggcggggaagaggcgcttctcgcttcctagatgggatggcggccgggcagagacgctcctcactttccacactgggcagccaggcagaggggctcctcacatcccagacgatgggtggccaagcagagacgctcctcacttcccagacggggtggcggccgggcagaggctgcaatctcggctctttgggaggccaaggcaggcggctgggaggtggttgtagcgagccgagatcacgccactgcactccagcctgggcaccattgagcactgagtgaacgagactccatctgcaatcccggcacctcgggaggccgaggctggcggatcactcgcggttaggagctggagaccagcccggccaacacagcgaaaccccatctccaccaaaaaaaaacgaaaaccagtcaggcgtggcggcgcgcgcctgcaatcgcaggcactcggcaggctgaggcaggagaatcaggcagggaggttgcagtgagccgagatggcagcagtaccgtccagctttggctcggcatgagagggagagggagacgggagagggagagggagacgggagagggagagggagacgggagagggagagggagacgggagagggagacgggagagggagagggagacgggagagggagacgggagagggagagggagagggagacgggagagggagagggagacgggagagggagacgggagagggagagggagacgggagagggcgagcagtaacgttttatattgattttttatttttaagtggcttgtttctcttgtcacttctgtagttgagctctgctaatgtctcaactttattttactgggttccagtgccctctgctggttatgtttcatctaagaaataagctaacttgatcattggctatggctagcatgatcctttaataataaaatgggtagatctttgaccttgccacttatcacttaggtaggtaacacattctaatttgtttgatattttcctaagtaaaaaatattaccgggtcaggtgcggtggctcacgcctgtaatcccagcacttggggaggccaaggcaggtggatcgcttgaagccaggagttcgagaccagcctgaccaacatggcataaccccatctctactaaaaatacaaaaatcagccaggcgtggttgctcacgcctataatcccagctactcgggaggctgaggcaggagagtcacttgaaactgggaggcggaggttgcagcgagctgagattgcaccactgcactccagcctgggcgacagagtgtgagaatctgtctataaataaataaataaataaattttaaaaatgtagaattaaatacataacaataatagcatataggacagaaaggaggttaatggggttctaaggtctttgcattatcctggaagtggcaacagttataattaaactttaatgagtcaaggaaacaaagactagaaaaggatgtatattaagctaatagaggtggaaatagaggaataatttttaaaaatgtaatccataggaaggtaggagagaagaaaagaacacagaacaggtggacaaataagaagtatatagcagatttgaaccagagtttttagtaatgacattgaatatacattatttaaatattccaaatgaaaaaacaaagtttaccaactggattaaaaacaatgttgcttatgtacaagactgtatctatctgtctatctatgaaacacacaaatacatacatgaaatgtggatccaggagagctaaaaatgaaatagtataaatactaacctaaagaaagttgacaaagccacactgacattggatgaagtagactttaaggaaagaagcattatgagataatgaagcgtgttccagactgatttaaaaaggttaatcaggaagataaaataattctaaacttatcttaccaaataactaacctgaaaatataagccaaactgacagaactaaaagagacagatcaatccacagtcatagtgggggatcttaacttacccccttagtaactgttagaatcaaccgcaaaaggaaaaaaatgagaagataaaattgaacaatacagtgaacaaatttaatctcatatatgtatatacatatctcactgtacttcagaatatacttttgtttttcaaatgcacatggaacaaaattgatggtaaagctgggccataaaacaaagctaaaaatttttccaaaaaaattgaaaacgaggaatgtttctcaatcaaagaaaatatgatagatatcaataacaaaagtacagctagaacggggcacagtggctcatgcctgtaatcccagcacttagggaggctgaggtgggcagatcacttgagctcagtagttcaagaccaactttggcaacatagctaaaccctctgtctacaaaaaatacaaaaatttgacaggtgcagtggcatgtgcctatagtcccagctactcaggaggctgaggtgggaggatcgcatgagcccaggagttcgaggttgcagtgagccgagatcgtgccattgcaccccagcctgggtgataggagtgaaaccttgtctcaaaaatgaaaaaaacaaaagctacagctagaaagtttctacatgtttgaaaattaattagtatatttctaaataatccacagattgaaaaagaataaagtgatgaaaatacagaatgtctacatttgtgagatatggctaaaactgtgcttagagggaattttttagttccaaaagcctatattagaaaagaagagagctaaatattggtgaagtaaaagtttagaaatactaaagagcagaatataaggaagtagaaaacaaacatgacattgaacaaggaagctaaaagctggttctttgcaaagtctaacaaataaaaaaaatggataaatccttgaaaagaaaaatcaagaaaagtgagagaagacagcaaaaaccaatattggaaataaaaaggaggattgctacagatcttacattaaaatgatttttggaggatattatgaaaaaatttatgcttataattttgaaactattggagaaatttacagaaagtacagtgtaacaaaattgacacaaggaggaattaaaaatgtgaatattcttatatcatttaaatttcttataattaaaaagaaaactccagatccagatggcttcactgttgaactcttccaagcatttgaggaagaagtaaggttatactttcatatacctttccagggaacagaaaagagggaatgctttctaccttgctttttgagggcagggagccttgataccagaaccatacaagaacatcaaaagaaaggacaatttcaagccaatctttctttaatatagatgcaaaagtctgaaataaaatataccaaatccagcaacataacaaaaggtagtacaaccaagttgggtttctcaggaatggaagattgtttaaaaattcagaaatctggccggttgcagtgactcacacctgcaatcccagcactttgggaggaccaggcaggcggatcacttgaggtcaggagttcgagattagcctggctaacatggtgaaacccggtcttctccgcagactattcctcctacctatcctttaaatgatgttccttagggctttctctaggccctctgcttctcctttactccatggtttcggtgttcatttatgttctcataacttctaaacacgttgctccagctcagtgcgtgacacttgaaaccatatttgtctgtctattggacatctctactcacatgtcttacaggcacctcaaactcagcatgaactcatctccgtagcccctaaatcggtttctccttgggaaggtaaatggctcagtaaatgacaccagcattcaccctgggagtctttagtttgttgaccagcttctctatactaccctctgtccccaagatctaaactctctgaggataggaatgtattaggttttattcaacagtgaatttaacaatccttagaataagacttggcatgtaggaggggctcaattatattttgttgaatacatcttcccccctttctccatattcactttggtttctgaactctgttagtttttatttcctaaaatccgttcattcctttttatgcctatagccccttacctaactaagactaccatctattacctggactaccatgaagggaccaagggctgagtgggtggctgcaatttggaagaagaggtttggggttaggacatatgtacattgctggtaaaatatctaagatgcaggcctttacctttttccttaaaggacacaactgaattcagacttaaaactacatggtttgccacctcatgatatttaactttcttttatggccagttaccacaatcatctgtgtaagttcatctattctgagagtgagggggaaggtggctttggaaggaaaggataagaaaggataatagaagatctgtctgttgttattccatatttttaatgacattcctaccccctttctgctgagggccactaaccttgactttccagatatacagtggtgctctgtcccactttaatgaatgccatcaaaatatggaataacaacagacagatcttctattatcctttcttctgaatcatgacaatcagaatcatgacaatctgaatcatgacaatcagagcatcttaatctatttggttaaagaggctcccagttcagtattgtaaattgaactccttaatctgacctttgtgttttttgtataagatagtgctattcttggcttcctgtgaattataagacagttttgaaaatctcaggttttctgtttggattgtttgaattggtatttcttaacacatttcttactgataaatcaaaatattcctgggggagcaggaattaaaaatgagggcaaaaatctgcctctaagatttttttaatccctagatttgaattaatatgcttgccttttctcatccatttttccagtttaaatgtcaaatgtgttggaccatttgtgttcatgtgtgggacatttagttgttagcaagttttttttgagacagagtctcgctctttcgcccaggctggagtgcagtggtgctatctcggctcactgcaagctcggcctcccgggttcacgccattctcctgcctcagcctcccgagtagctgggactacaggcgcccgccaccacgcccggctaattttttgtatttttagtagagacgaggtttcaccgtgttagccaggatggtctcgatctcctgacctcgtgatctgcctgcctcggcctcccaaagtgctgggattacaggcgtgagccaccgcgcccggccatttgttagcaagtttttacaaataccactgcctgacattattatgcttatttatacttttacctgaacaaacttgtttcatcccctgccccacctaattgagctctaggagagcaggagccttgtctgttttgttctacagtaccttgtttcagagtaaacatttttaaacagttattgactcaaagagtctgcttctccttggggacttgagtggttttccttcttacagtattctcatctctttttttcccccccaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtaggtctgtaggggttgatgtcgcattgccattaccttgtattgtatttactaaagtggcatttcctttgtgctcaaaacatttctgattttatatgactagttgtttaactcaatgctgtttaggcaatagttgaagcaccctagagttagttaaatggaaaattatgtcttaaaattgaggaatataagaaagatgaatatttttttttctgtgactgcatacaaattcaaagatataatgcgtgactttgaattggagtttgccacactgacttatgttatcaaattctgttctgtgatcacaccttgctttctctattgaaggcaaaaagtattgagcatttattatatgagacactgggctgggcacattgttaaatagaataataataagcgctagttgtaaataaagacctaagataacaaaaacagatctaaaatagcatatgtgtgttgtgaagtattttccagtgattatacttggctgtctttctggatgtccaaggcagttatttgcagtcactgtcacacttctaaatccctggtgtagcttgcagtcttggtcattatttaaaactctggttagaatgatggtgatggactttttttcatatagaagcagttctcaaagatttagagcattaattatttgctccaaaatcagagatatgtctagtttacaagacgtggaaataagtctgttaacttttgatctctttgtatttcaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgtaaaagagatgtcttcatgtcttcccctaagaatacgcttttcctaacaggctactccttcctgtagagcagaaattgtattttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctctcaggagccctcaccattgtgtccattcactgtgtatagatggcagaacttttgaggtgcaatgtttaattgttaaaaatagtagccacgactttatcaggcagccccaaactggtgcataatgcatggtacaagaaatatttatgtattttttggaattttgtaatatttagtaagagtatatgaaaggattgctactgtatcagaaatattgtttcaatttagtctatcctggatatgtactaacgaatattaccaccagagaagagagctttctacaaaagtcactacagattttgctatattgctttgtagatagatttttacttttgcctaaaagcatttatccttcataccaattgtaacatctgacaccatgtagaagctaaaagtttagagggagtgagggttttctcaagaccttcctcaagcattttatctttagaagagaaactgatgggcacctgatactctgtctaaatacgtttgttatatgtgttttgccctgtgccattcatttggaactttattgcattctttattttaaaaagcttgtttttacgtaatcatagagcttgctatttgtacatctgttgagcaacactacataactgatttttagttgacttagctatagcagtacaatgattagtaatgtaaaaattaacacagaaattaacctaaggaatgaagggtgggtttgtcaaaatatcaagtaaatttttgtttctaaagtacatttaatgtagatgacctaaagaatgcgttatccatcctatataaaagaaagataaaacacaggtcaccaattttctcatttcaccccatttaccttgtatagaggattgttcattcctttgggactaagttatagttatggtgagtgtgtatttactgtagttttgcctgatctcactcattgcacttcctggagttaaattttccaacagccatgttgaggaatagcactctgcatgtttttgttttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtatgaaagataagaaaatctccatgttgtatccatttggctcaggaagattctttgccttacctttcttagaactctttattgcttatcaaaagtttgagtacccgcttggtttttttttggtaattaaatattgtatgatttatctggttcaaggaagatgcactattcagttatctattgagaaattattttgcagtggttttagtgggtgaaaatgtcccatctgcaccagtacacaggcaggcattatcattcttcacctactttttaaatagtggcaacttgggattcattctggtgattctgaaccttgcctcatagcttaaagtataaaaaagattcaagagcagtgaggtttgttctttccagtgaatggtggactgagtggtgcgaggtggagggctaacaagaggaaagaactacattcttcagaatacagtgatgaaaattcattttgaaactcaaatattttcattttggatattctcctgtttttattaaaccagtgattacacctggccatccctctaaatgttctaggaaggcatgtctattgtgattttgatgaagacagaattatttttctctgtagaaacacagataccactttatcagggaagttagtcaaatgaaatggaaattggtaaatggacaaaagctagctagtaaaaaggacgacccagcaacatgctttaaccccattgtatgtttgtggaaagagcatagtttaacatcttgagaaatttgggacataaagttttcatggtagacagttcatgcagtatatgaattgccataatggaaataatctgattttatttttacaactaacatccattccccttcatttaaacaccttttgtgttttacttcagtgaggagattggagtctgaatggatctgttttccaagagattctgagaaatttttgtattcagcagttggaaagctctctattctagttgataaaacttcccttttttgatgtagatgcagatattctatacagttctgttgtcttttactaggactgtaaacttttgtgataaaattcaaataagattttatttcttggtaattttggctttcacaatttatctttaaatccttgagcaatctgtatacaattaagagatttctgacatttattcttacactaaatggatcaactctaggatttaggcatgttaacttctgttgtgttttgaatctctccagagttgcatgtagatagcatttatttctgtgcccttaaacccatttagaaaataactacaaagtaaaaatgtagaggaaatagaaatgtattttttcatgaacattttgatacaaatttcatcatttaatgattcaccaatttcttgcattaatttgaatttaagcatttaattcaaagagaggggagcatccattattgatacatgtgggcttttaaaaactccatcctttataaatagtcaaggtttgggccacacaaagtatatttttatcatggaaaaatttcaactcctcaagccgtaatgttgaacagaattggagtattttctttataatttcttgaacaggcaaatgaaagcttattatagaatgcatgtattttcttttatctttggaacatcagcaccagtatattgctggcagctattgtattaaaaaataaagtatattttcactatc

SEQ ID NO: 35913 - DNA, 98911 bp, Homo sapiens; identical to SEQ ID NO: 35912

SEQ ID NO: 35914 - DNA, 1033 bp, Homo sapiens
ccggatcggtgactgtggagggcgagctgagccctgtgcgtgagtggggtctggttgtgcagtgttcgtggaccctgggaggctaggggcgccccgctgggctgggaaaggataaggagtgcaggggcaggagtctggggttggggatggacccccgcggggactgcggcgcttcgcgaaagcgagccaagcgcctgtccaccctcggtcctgcagggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcgtgagtgccttgggcccgcgggagcgggaggctggaccccagcagcagcagcagtcactgcgcctcccctctgagcgctggcggccgggcaggcgctctgtaacttgccgtacacacctttctcattgaatattcctgaccgcccttaagctggtcatattatcctccccatcttacacggggaaaactgagctacagaactgaaatgactggcccaaggtcactcgggtgattccagcatgttcctctgaggtcacctttatttagttcttaccagtggtgaaatgctttgtgttaaacgtgcagcagatagtgatgatagttgcatggccttggatatgctaagaactactgaagtgtatgctttaaagaagacaagaggactgagacctttttttttcttctatatgtcttatatgtgtgctctctgtttactctcttaatttttaaagagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtagtgtctcaaagacacaataaacttcctatggtctg

SEQ ID NO: 35915 - DNA, 27248 bp, Homo sapiens
cggggacgagcaccggcctgcgcgcggagccggcaccggatggtgggcgggggccagccgtgcgggtacgcggcccgcgcgcccctagccaccgccgcgtggcaccgtcccgagcgcgtggcgcggggcgctggctgccgggcgggggcctggggccgcggacgctgggggcgcctcggccgcgctcagcctttagatcggagaatgcgggcggggtgggggcgctcggggtccccgcagtcactccagggtcgatttctcggcgggcgccgcggcctgtgcgaggccgggccccttggagtgccccgggaggtggtgctgggcgtctgaacaccacatcccttcctgcgcccgtgtgtgggttgggaatgccgggtgtaggccctggatcagagctgacggggttgcgagcggcgtggggtgtgcctgggacggtgaccggatgtgtcttcctgaatcgttgtattcgagctccagttctctctgtttctacagctgggcctcagtcctcacagggctctagtgggcgttcagccacaccaggagaaggcgcccaggggattaacaggacccttccctctcctgctcttccctcgccccccatggctccccctccctcctatttagtaggtacttctccagcaccccacagcgatgatggatgctggccctaaagccaggtgggaaaccaggctgattcagcacctgtcttttcctgttaggggggttgccaggcctctcagatgtggggcagcgtaatcagtgggtgaccgtggttcccagcacccactctccactgcatccttgtcttaggcactgccgccctgcactgtagcagatgcctaaataaagtgtggagcctgaagcagaagttttgggagatgcttgccttcctttagaccacattcctcgcctttctcaagatttctccgtggtacccaccccgtttttgtgttgtcttccttccttgcccttgtttcattccttttgaaagcgaccactcccctgaagtcctaggacccccttcgtgggctctccctgccgtagacagtctctgcttgcccctggtaaactacgttccaaaaaccttgctttaggagtagcacttgacgtttttcatagtttcttctcatgtaattcattactcggagttgataacttctgtcccatctggattattgaggagaaagggaagggaaaaattatctggttaatatcagagttgggaaggcttcagatgttttctttgaatccgtctggcatggatgataatcctgtgtggtttaggttaagttacctaagttctctgagtctgtgtaagatgggatggcactgtctaccttagctaggagtaaggcttgagtgacatgatgtgtataaactttaacaatgtctggaatctatagatgatcaataaatatttcttttttccaccctcctcctgtgctgactccgctttgtaagggagacaggtaaaggacacaacaatttgtaggctggcataaaaaatcctatgagaaagcagtaaatagatgaaatatttgggaacgtgaagctataggtttcaaattcaaacttctgaaataggaaatttcttaagtttttacttaagaccagagactgtttagggcccatgtgctgtgatttctgattgataaatgtagctgaagttgcccatgtttagagatttaaaggttcagtgtggttgggttgaactggaaaacagacttactaaaatgcttctctcaacttctgttttgtcatgtttttcttctagacccaacatgagtgaagtttcctgcaagaaacgggacgactatttggaatggccagagtattttatggctgtggccttcttatcagcacagagaagcaaagatccaaattcccaggtaaatgaatttcacgggagaatgcttagatactcacaggcaaagagattactgcacatgagcagaaaggggagactcagtggacgcctgtcaacttaaaagtgcagggtcggtctgccttttgtgctgcgtttctacaagcttagttcttcctgtgagacagaaaattgtcacatgccattgttaactgcctcttgtgccccttctgggactgggggtgcactttccttggcttgtgggtgctgccacaaaaaaccaggcaaggagaccgacagctctcagcacctgcagcagctatgcgtctgttttgagttctgcagtccccctggttttattccctgcttccacagcggcagaccagccagttgcaggcaccaagcctttgggcatgtttccttctaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacggtagggcaagttttatgtcccattctgcttagtgacatagcctggtgagtgcctaattaagaaagttggtcagaaggcatcatctcccttttgtcatcaacaactggaaagaaaagtatcctactgaactaccccaatttcctggccttgtctcttaagttccaaagagagccacggagagaagcatggtagtggccacacaggctggccctgagatccagggctctgctgcctgtgctgagcctggcaggcttcactggcaacctgctggcctgcaccacaccagtgcactgatagtcggcgtctctgcagagggtcacagccccttgcagagatagctgagggatgtgcatggtgtctctgtgggttcctttttttactacttggaagcagggtcggctaaccaggggctggctcgggctttggtctgatgagaagcaggcttcattcagcccatgtgcctgatgagaacatctggctcaagctcattgctggcaagcaggaatcaaactgtgaactagacatcaggagatggaggatccagttgcttcctccagttacaggggatgctgcaatttcacagtaggctgtggtcagaccaaaagccagaagtgaggctgggcacgatggctcacgcctgtaatcccaacactttgggaggtggagacgggcagatcacctgaggtcaggagttcgagaccagcctagccaacatggtgaaaccccatctctactaaaaatacaaaaattagctgtgcgtggtggcaggtgcctgtaatctcagctactcgggaggctgaggaaggagaatcgcttgaactcaggaggtggaggttgtagtgagccaagactgcgccactgcactccagcctgggtgacagagcaagactctgtctcaaaaaacaaaacaaaaacaaacaaacaaaaaacaaaacaaaaacaaagaaaagaaaaagctagaagtgtagaactgtaaacctttggcttgactgtctctggattttccccttgaaattagggaaggctgcttcttagagtttgttgcctgtctaagccccagggaaaattccttcagagattgcctgggagggtccagccatagctttacttttccttgcattccttggagaatatgcaagcaatgctggaaaagaggcaaatcatgctgggtatgcaggttgctgatttttgtaaggttaggccctgtattttatgtctgagaatgaacagactggcgctgttggaagtgaagggagagtaaggccatccaaatgggaaagattgtgtcttcaggccaaggcgtgatgtacgacctttcttctttgttgactctcctggtaggttttcttctgggtttttctcatgaagaatccaagtcaacatttagtctaatttatatatttttactaatgttcctggacctcaatcatgttaaataagccccataaatttctttctaaattgcctaggggcaacttctccatgtttgaaagaaaaagttaagaggtacctggagagagaggaggaactgaggactgcaaagcagtctgggtttccaggatgtgaaaagtagtttagggatgaaggggaccgaatcctcagatccttgatttaacctcaccctccctcgtcggagtgggaagagaggatggagttgggggagggtaagactgtcttctcagcacagcttcagagccggtggtagtggatgactaattagaaaaatgcgcggactcagaaactgtcaccctgattttgattctataagcttttgatggtaagaaagaagggaagtgattagttgtttttaagtccatgcaaagataatttttcacagtgcggttcaaagtcccctataaaaatggtgaaagtggagggtcgatatgttaaaggtctgcattgaactgtgtgacggccacagtcagtatgtcaccgagtctgggcagtgaaatattggccctggggctggactttgatatggaggaattctggggggatggcggtccgtcatactcaagctggtgcaaaagatacccgtggttggacagtgcggaggggtcctgggtgagcactgagtgggcctcccaatggggcctgtgccttcttcagtcacccagagcccccagcagatctttaagcagtgacctggaagccaagggccatgcagtacatttgcagcacctgccccacaccccagacttcccagctctcctgacttcccgtgtagctgattttgttggttatgagacactgccttttgtccaaattgaggagagtacctttcagagcccctttctagaaggaatttttttaaaaacctgcataggtatttgtccaacttcaccgattgttttttattgaatagctcctgagctcctgggcactggttgtctgtctgcattattttttattatccatatgatacctctaggttttcaaagctctttgctcttacttatcaattattcatttatatgtagctgtgttagaatgtcgacagttttctttcacgagagtaagcttgtaatttgatgtaccataaaagttgtagaaggtattaaatggtttctaaaaggcatttagtattactgccgccataatacagtaaagatgggcttaaagtctaaatgacgatgactgtgtataaactgtacacttgttgtcttctcaaggtttttcaggccacagagaagtaaatgtttggattgcctgggatgtcacagaaatgtttgctgataattgactcaaatgcaaagtctttttttttttttttgctttcgttttaagattttcaaaattaatttaaaaaataaggggatactgcctggagttggatagctcaacccattctttcctcatctacattaatggtgactgagctgctgtagcaggaagggtaaattcataggttaatccctgtaaaggagctttagagattatctcgagttctggacaatgatttttaactcttttgaatgtacaggaccctcttttaaatgctgaaaaacttccaggacccctgcataatgctaaattcttagtatcttttgagtaagaaactccacaatgacaaaaactacttcgtatcagtaacattttttgttaatctgaactttattaattggatagcatttatgtatgtttgggaaaagtttatgtatgtcctggacatgggatttatccagttgtggatatgcttggaccccttgcaataccttagtagtgtctcagggttctatgcccacaggatctaagcctcctcctttcttgtaagtaacttctataatgtcacacatgcagggtgacatctcctaattccaaggtcagtgctcttcctgctacctccctgtgtctctcctgtggggcacatgaattcagctgtactgaaatgccaatcattgtctcatttttttttgcagttgatcagactgaggctccgataaaataattactcctcagagatcaggagctcggggaggggtggcctgtgtccggcatcatgcagaaagccacatgcgtggctcactgtaacatttcttcaaaggggagtgcagtggactgaatgtgtctccccccaaattcacatgttgaaaccctaattccaatgtgctgatatttggaggtggggcctggggggacgtaattaggccatgagggtggagctctcctgaatgggattagtgcccttctaaaagggaccccagggagctcagttactctttttccatgtgcaaggataggcggagaagatggctatctgcaaccctgaaaggagaccttgccagaatctaaccatgctggtgtcctgacttccagcctccagaaccatgagaaataaatgtccattgtttctcagccacccagtctatgggactttgttatagcagccccaagggactgtgacagggagcttgagaactgtgtaaatttgagtttaccaaataacatacagcttaatactgctttattaattccgtaagtcggaagtcattagtcctgattgatgccttgtggggaggagggaaacacacactacttgtaacataataggaagatggagcttttcctgggctgtgtctctagagagttatttttaaagggtgtttttgttcttccagtcttgggatcaaaacttcataaaactattttattataatgtagtattaatgtggaaaatgaaaattccctctgctaaagaagctttttattccatccttttcctgaaaaatccaaaagataatatgatgtcagtaacattaagtggcaggaagaaggcaatgttattatactaagaatcttttcagatgaatgacaattaaaaaagaggaagcagcagatttatctaatttacaagattaaaaaacttgggaagatttttattttcatgagggggtgggttgctaaacctgtgatgaagtattcagttgacatttttcattcctttttctttgtggaattcattatagtgaagcacatttaatcaaaataccaatgttatcaaatgaggtaaaatactcttggtgattcagatatcactctttccttgggttttcgtaaccgattttgatgatatagtttacaaattagagagttggagaattaacttgttcccgttgttaaacttaagggaatttttagtaatgcttgccacatgtatccagctgcccagcacttgtggccttgctgatttctgctggcaaagggctctgggttttggtgagtgcctctgtgcttggcctcctatcccacccaatggaccagggagccagggttgcttggcctgctgcatctcactgcaccagggagggaaccgtagcatctcagtgtccccaagagtcgggggaggcctcactctgagtgcgttgggtagaagtggggctcttacccgagtcagttcctatgtctacagggatactctaaaaaggatgtaatgctgggaaggaaaatgctgaaaaacctggaattaattaaggcgaaagagttcagcagagcatcttaaacacctttgccagtgtggggcagtgcctctttaaattctctatttaaatttcatctttatttttcagacttagcatattgttaagcatgcatagatgtcacttttgtgattacttagccatttactttacccccttgaacactgacattttcctgactgccatgcacgtgatatatttctttggcatctgaaaggttagtgttgagaaactaatttatcaagaagttaggaggctgatccttcttaagatatgacttcctcacaacttgtaagagcttcttagtaattaagatcaaatttgttctttccgtcctgaaattgaatgtcctctggtttcgttagtcagtccatgaatttgataacttgctgtttcttttcctgcagaatttaatttcacttaaagcttcctgccgctcctcccctgcctggccttctactagttgtggcccgacagcaggtctaattagggacttttgtacaaaactactgttataatcaatggaaaacctttgaacaactgcatagaaaagaaattaagtagattatttttacgaatcaaggggcaaactcagctgtgatcgtgtggggtttcagataaacagagggacacaccagtgtatatatgagtcttctcccacccactaaaatcaaccagctccatgtaagcatgttttactttaagatataattgtttataaacagttttcagaaaggaataaataatgatattttaatataatttattttgatatttatgtatttttatagttacagagttaattatttttaaagtgctagagtttactatttcattatgaatatctatgaaagacatatagtaacaaaataactccttgttttgaagagcacacatgttaggaaaagctgaaatgtttggggattggacctacccatgaaaatacacatatctgtctcctttctataaaaagtgacttttgagtcagttcacctcgtagaagtttgaaataaaacttaatctaaagtagtggttccagggttcccagaagtgggctgaagtttatctttgtactgtaatctctcaagataaaaggtttgttgaaaaattagtagccttgataaaatgtcaggggcacatgcaaactaatttagaaaacagctatgttaagtatttgagcacattaatgatctgaatgcaaatggatattccttctttatttcttcttcttcttcttcttctttttttttttttttttttttttgagacagagtcttgctctgtcacccaggctggagtgcagtggcacaatcttggctcactgcagcctccacctccaggtttcaagcgattctcctgcttcagcctcggagtagctgtgtgattacaggcacgtgccaccacgcctggttaatttttgtatttttagtagagatggggtttcaccatgttggccaggctggtctcaaactcctgacctcaggtgatccacccgcctcagcctcccaaagtcctgggattacaggcttgagtcactgtgcccggccacttctttatttctttaactttgctaagtctttgcttagaaacacagggattgctgtacagtgtggttacctgagaatgattactctcatagtcttgattctggtgatctgttctatgtcagttgtgctgattttgactgatcttctctgaaattggctgaaatgactaaagctttattgtattttgagttttttttaatccggaatctcccttcaggagttttgttaataccagctatattaaagtagaatatgaatatattgtttgctcccagaaatacacaataaaacctagttcttagagatttttgcaaatgtttgtattgctttttacttttacttcctgaagacttttttttttttaatctggatagggatatgcatgtctgtaatacacacattagctaagtaaagccccatagtgcttaaaacaacaattgccatattcacacgaaagaatcctggagccgccgtaaggagccaagggttccaggtttggtatgttcatgcccagtgactgtggggctgttagaggcatcacctgacatttatttctcaatatctctatgaagtaaattatcactgaagattcttccagttctcttattccaaggaaaaatataagtattatagctttgatggcattagattagtatctttttctcagcttacggagttctgaaagcgttctcggtcaaatcagagctgtaaaaagctgttggaggcaatgccacagggagaatgtgcatgtgtacatatggataaattaatagaaacaggcgcctttccctccctcctctaacgattaaagactggcgcagttctaagatgaatatagaccatatggagataggatgcatgaataggaggggacagtcagactgtaggttactccacagacatgcagattaaaagacattggatgagaaaaggttggataacagcaataaagaaaaagatcctagctgagtatggagtgcacgcctgtaatcccagcacgttgggaagccgaggcaggtggatcgttcgagttcaagagttcaagaccagcctgggcaacatggcgaaatcccgtctctacagaaaatacaaaaattagccgggtgttgtggcgtgcagctgtagccccagctactccagggaggctgaggtgggaggattgcttgagctcgggaggccaaggcagcagtgagccaagattgcaccactgaactccatcccagacgacagaatgagagaccctgtctcaaaaaaattaagaaaaagatcctatgtctaagtgaaagaaaatgtatgattacatgggacacgctgaaaactctttgaaagagacaagaggttaagaccaaatagaaagaaaggactttagaaattctttagagaacaagtcagcatgacaatatttattcaaacagagatacttgcttgacattgggaaatccctgtgataaatgcaggatactggtgaaggcaagagagttgcaatgcaagggaatgggcgctccccttgctgatgctgtctgaagggtcggtgccaaccaattagtggaggtgtaaattttctctgtgcttctttcaaatgatagatgccatagtaaatttaaaatattgaatatgataactgagcatgaattttttaattctgcaattaaaagactttgttcaaaatgccattaattttgagtttaggtgaataaagggaagcagaattcttctgtcatttttccttctccatgtgagttatcactttttaggaattaaaataagtactaacgagtcacctgttctcttaccagtttcagttgtctgctggtgatggggatgatctctggagtcatctttctttctttttaaaatcctaactctattttataatgcgttggagtttttcagacaccatcacatgtggtcatttgttcattcagcagacacttctagggcatttattatgtgttttacatgccgggcactctgcagaggtcaacagaatgccatgggagggtctctgtttttgaagagtttgcagactaattgtggaggaggtagacattaatgaaacaaacagatatgattgaatattcctttctgaggcagtcactttttttttcttttttaatgagatagggaccagaccccgaatctgccagccccttgatctcggacgtcccagcctccagagctgtgagaaatacatttctgatgtttagaagctacaaatttatgatatttgttagagcagcccaaacaaactaggacaggttgtgtgtatgaactggattgttctggggcaagagtggaaacagcgactcgccagccgggaggtgacgtggtgtacgatgcgagggccttggagggggtgggtgctggggctggagaggcctggctggagatggggtgtattttaggggcagcatcaggaagatggcgtgataaagggtggaagaggtagattgactccccccaaatggttctggttgcagtagctagacaggcatgctgaggaggagaagcaagattttggaatgatcaaggaagatttagacacctgaaggctgaggtgcccatgagcgctccctgcaaagggttgggtggtcaggtgggtgtatgagttggggattagtcccgactggctgtagcagtacaggtatgtcagtgccagcgacctgggtggctgatgaagggagcatgtgcagaggcagtaggagtagctgtggctgagccctgagggctccagcgcttaaggtggttggagaaagaagggcccgtgagaaggagcacacagagcagtgctttaagaaagaaggcctcattttgggaggccgaggcggggagatcatgaggtcaagagatcgagaccatcctggccaacatggtgaaaccccgtctctactaaaaatacaaaaattagctgggcgtgttggtgcgtgcctgtagtcccagctacttgggaggctgaggcaggagaattgcttgaaactgggaggcggaggttgcagtgagccgagatcgcgccattgcactccagcctggcaacagagtgagactttgtctaaaaaaaaaaaaaaaaaaaaaagaaggcgggcttgtcagctgtatcggaggctgccaagaggcctaagattaaaagtgttcatggggttcagcaacgtggaggtcagaggtgatattgccaagtacagtttcagccaagtacagtttcagcggagcaatagggttgcaagccacattggagcctcttgaaggagaacagagggtgagacaatggggacagctttatttagatcgggctttgggatgtgtggctgagaagagagcagagaagtggggtggtggctggaatggagataaggccacgggaaaggattgcattgtttgtaggataggagaatctggttttggctttggtttttgcttttctgtagcagacatttgtttgttgatgggaatagtccaagacagagagagtgagatagagatttctggaacagaggcaaggtgctcaaggctgtgaggatcggtctctcagacaccctggttgataataagaggaaggactgagaggggaggtgggaggacagcagacacagggtcctggagcgaaaggcagagtgtgatcagttgcaccattccggtggaggaagcagggtcatcggttgagagagctgggagttggagcttggatgccgggagaagagaagagctgattgtgtggggtgggagaagaatgtcctaggaatgtagggcagtgtcaggagctcacatcttatctgagaatctcgagttgggcggttgcttcccattttctacctgcagacccaggatcagtgcgctgcctgaggcaggccagggagagctggaattaattagaacacacatcccagctcctcttccagtgcccagtgctcaggcccggttcccctctaaacgctattaacacacaaaggaggcttttaagctccatcacagtactatcagcgctgattagcgctctgtttctcttggtgctgttgtcacgcattttaggcatcacgtgtgcatttcacatgaacagtgggaagggagttggcatggcctaccgtggatgcagtacagctatttccacatcctcctcctcctgacctgattgtgtgcccttagcccatagggaggcagtgtaattagagttctgggggctttattaccaataatggccttaccacagtcagaaatctctttagccctgagcactaccattggggctaagtggctcccctgggtgccgtgagttgtcatccgcagctttagcaagaggcattgaggaagggggcagggatggggagcagagtgggagagagggaaaaagaaatgggtattctcacaggcaggctggattgggcaggccaggacagcctggtctcaggtgggcacacgtgggagaggatgggaagcactcacatgtagcaagtagcttgtctgtgctgtgctcttgacagatgttagtctttctaaccgttcttggagagggacttttctctctatttcttaggtccggaggctgaggctgaagaagatgcttgactggtaggttgtggacagtgtgtgaggacatggtagggaggaagcagagaagacaggcagaaccaggggtctccaagacccctgagtgcattgttgcaggagcggagacggaagttcttgcctcagctttcagggccctgggctgtgggcaggcggatgggcaccctgggtgtggaggcttccctcagagcctgcaggatgggctgccttttacgtgagtgacccaccactttctccccagaccttggtagaattcctttgcgctgtcattttcttctagcagagccctcctctctgggcacagggtggaaacagaacagagcccacacattttccacgcatgcggcgggtttctccacatcacccccgtttctcgtctttattttcacacacacacttacactgtcatgcctatcaggtggaatcatgtgtccctccatggcgggagggctcagttactttatcttctgagtagaaaggccacactctgcctggggctgggctgggggcaggagtgtctggatgccaaggacaggtaggctgtcgggtgcagcgtgatcggggaggcagaagcgctgtcacttgttgtctctgatcaggaagacctggttcctgccagccagtgtctttcttaggaaacaggtcctgttctgagtactggtgacaaagtccccatttgcagagttctttggagttcacacagcattttcctactgtgtccctcacttgctgttcgtgtgaccctgtgagatgggaaggggcgggtgtcgttattcctattcgtagctgagagaggctggaacttgaacagggtattacctttgtgtaggcacatcctaggatttaaatccctttgtcctgaaaaaacatttgtaatccacatacatttttctacagaaacaatgttacttgaagattcagttccccttgcacctgcgagcagtgcctagaaccctcgttttctggattttctcagcactccttcagcagtcctactgtgttgctttagcttgcactcgggccgctgctgatttccatgctggggcatcgcagcccagctggtgtgagctctgcagggaccagacccacctccatcccgcagcccacacacccagccctgttagctctccacccagtgcaggccagtttgcaaccagaacttaccagaacatacctgggaaactgcgaaagttttaaactgttttattttcttgctccagtcctgttactaagggctgctcccctgggtgggggacagggctctgtctgagcaggcttagagggacataggctttggagcagtccagcaggctggcaggaggaagacagggccttagccaggagaggggcggggagcaagaggggcttgtctggtggaactatcttagagaagtgatatctgttgatttctatatggtgctcccttccccagttccacctttatttcaaatcatttgaaaaccttgataatgagccagattgctgctttactaataggaacttcatgcaggagagataagatagagaggtgacattatttgggaccaaattctagaaatctttgctttagattttggggaagccataattgggaacacttcataagcttttgggagagtgtacttggtgggggttgtggggggcttaactgtcgcggctattccgttgttaaattattgacgtgcaggatagggactgcggaggctggcagtgacatatgaggccctgtcaggatatctttcaataattaagaaacaagtagttgaaattccattttagttccagaagctgtgaagcagttccataaatggatcagttagaggagtaagtgtgtaccccatccctcagcggaagtttccatcaggcatctgtgggcagtgggggccggggcaggggtgcaggtgctcccagagacaacatgtccaggtttagcaactctgataactataggaccccagaagtaaaagcactcaggccctaacttcaggaagaaatgacaaaaagctttgtcatcagaatggaagtagaaaatcctgtaaattactgagtttttttttttttttttaatgcacaggtcaaccttgaacttgggtatgccatttcatgtcacttgttaattgcagggtgggaacccagtagaaataatagagggtgatgcttcccaccttttcattccagaaggccatgagcagacgcttcttagctcgagtcctgacccttgtcttgtcagtgaacagaactgtccgtgctctgaacggctcagcctggggtggcggcagaaggcgttgcaggtctgttctcagtggcagcaggcactccatgcctggccttctgaccccggtcctagcgggagccaccacaccaggctgccacctgttcaggtcagctttggcagaacaaccctcaggtctaaggacatcgttttctttaaggaaaatcctgtgtcactaaaaatgagggatttttaagcaacctggagagttcagaactagaactagagttcagaactagatcagaaccttcattttcctgactccaaattttctcaggccccagtagttcctgtcacatctccatagcagatgaagatcagttgagggtagaataacactatcactgctaaattatttaggcagcaattagaatttgttcagcattatttagggtttttaaacaaacctatctgagtaaccttataatactaccgtctaaaatagatattgtatcagtcttatatcagatgaggtgaaagtcacatctataaaacgctgaactcttaaatctaaccagggatggaatatatcctgttaatttgtcaaacttctagagaaccgcctacatgagacagtaaggattaatcaagccctactaagagagaatttgaaaaatacagttttctaattatacagtctcttctccatggtccaaggttaatgcagttctgaattctgacagttagtaatagaaaagaaaaaaaaaaaaaaccaaagcatatgaattgtcttataattacctgaaacagaaagtctcttctggcaatcaaggccttctaagcattaatctgatattttcagcatttgattcttttccttttaaacaaggttgggaataactggagggttgtgtgtcactctttgtgcttatcaaatatatatgtactgtttgcagatttattttgcttattgcttagctgtagatgtgtaattctaggttgaacattttatctttttttctttttttttttacaatttagactaacttatgaatacttcctagacactgtatctttgaaatacttgatccttattcctactacgaatataaaaactaacaattacttcttggttagttttggttagttgtagctcttgctgcagttcatccaggcaacacaacaaaaatgtgcactctagggaaaggtaaatttattccttcatttattgctgtcaaatatctgtggaatgtttattgtacaggttgagcatgccaaatccaaaaatcaaaatctgaaacttttttttttttctgagatggggtcttgctctgttgcccagactggagtacagtggtgcaaacacagctcactgcagccttgacctcctgggctcaagcagtcctcccacctcagcctcccaagtagctaggactacaggtgcacgccaccatacctggctaagtttttttattttcagtagagatgagctgtcactatgttgcctaagctgttcttgaactcttgagctcaaacgatctcccccacttggcctcccaaagtgctgggattacaggcatgaactactgcacctggcccaaaatctgaaaccttttgcacaccagcatgacacttgaaggaaatgctcatggagcactctggatttcaaatgtttggatttgggatgctcacctggtaagtataatgcaaacattttaaaatctgaaatctgaaacaattctgctcctaagcattttggataagagatatttaacccatagaggaaaggtacatggaagccccagaccacccaaaagaaaaggcctggggagaagatgggcagttatggctagacaccagatttcaggttttacagatggatctggcatctgagaatctatgaacagatggattcttaaggtcagtgactggccgggcgcggtggctcatgcctgtaatcccagcacttttggaggccgaggcaggtggatcacctgaggtcaggagttccagaccagcctggccaacatagcgaaaccctgtttctactaaaaatacaagaattagctgggcatggtgacgggtgcctgtaatcccagctactcgggaggctgaggcaggagaatcatcgcttgaaactggtaggcagaggttgcagtgagccgagatcacgtcattgcactccagcctggacaacaagagcaaaactccatctaaaaaaaaaagaaaaagaaaaaaaagggcagtgactatgggagaaaaatcaaagaccaatattttaccttgggaagtgcccacaaaggcaggaaaaataaaaggacctacagaaaagtaaagcagaaagagaacacaagtgtatggtggtcctgagaggttttagaatagagaggagtccaaagagagcaggtgaatcaaaaggttccaggccagaagagaccttgggttttcatgatgacgagaccctcctgtggcctgtggagctggctctcatcaggtcatcagagccaactgtgcgcattgcttcccaagtacacgtcatgttgggagtgggagattggctgtgtgaaaaaatgtctacaccacggaaattggcagatatatggtgacccagcaaacacagttgacacctgaaacataatttttaggaatagtatttaaccttgtatgcgggatccattctgacctctatccttcccttcttacctatttcattaaaacagaagaaaaagctggtgtaactcattgaactgatttcatgacctgcagtttgaaaaacattattttagagaaaactggggattatgtatgccttacaaagtcagaagacaattattttaaaaataaattatagtaacaattgtagataggatgatttcatcttgaaaggaggaaaaaaagaatcctaaaaggctgacaagatgacctctctagactaaggactaagtatgcatgcttacaggagaagaaaaacgagcagagagaagcgggagccctcagagatggagggaggaaggggctgggagcacggccttgtgtttgcctggggagaggaggccgtgttttgatagtgaaagcttgttttagagaaagtcacctgttctggaggattgaggaatgaaactggaaaccttaggaaaaaagcaaagacatcggatgtacttggtattttttaaattgcttttatttagttagctggaaatgcactttctcagatccactgtcactcctgcaaattacaagagcgctcagccaccctgtcgaaggtcatccggcttccaagcagcaaattggaccttgagccctcgtgctgcccttgttgcaaagctctttgtccacactcgctggcagaggtggagagtacagaggggaggatgcttggcctgtggtggtctggccagccagggcaggcatgagctcgtcacaggccaggcagtcatcgagtgctctttgtggcctgaagtggatttggcaggtgcctgttatttgatcagtgtcgatggccagtcgacacaagtaaatgaatccccaaactttactctgacccacctgctttaaacaaattggaggaagtcatcaagttagtttccctagtttcctctctgaggacagtctgggggctgaggcctggctgagtcctgtctcctcaggacaggcccaaaaggaggtacagggcggcctgggggacagcaaggttcagagtttcagggctatggagatcctggagctgatagacgagtgtcagccacaaaggtgaagctggatttcaggaccacaacaggcggcagctgggagttacgaagggggcagggctgggttgcggcctcaggtgctcctctgggttggggcttctctcctcagccccgcaggtgcgggtcgggcaagcctgtgatcataagacagggctgagggggtctggggaagggtacgggaaccagcaagagagaccagggtggggctgatcttacaccctccaccgaacacttgagtttcctgcttgtcagtgtccacttttgcgtatgtgggattttggattgttccttttagagtctcatgtgtacccgacacactactgttcatattgcccagtagctttatatatatgtaaatatatatatatatatatgggtgctaaatatttatcaaatgaataaaggaggaaatgcagattccagttattcatggtgatgttgggaagtactgaaagtcctcttaaattcaaatatcagaaatatgctctcccatctaataaatactttttgatggtgctggtattaatattcagatatgatatatatttaatatttatttttaatattaatattcatatatatatattttttaacaagaagctttacattcttcatcttgtgattttttggttaaaagaaaggaagtctgtttataatgctgtgcattatttctataaatcgccctctgtacacagggatgtcagatgctgcccaagagaatctgtttcatatggtaattttcactaatgaatccagacctatactgttaaattttgccccaaactgcctgggatgaagtagaggaagctcatggcagtgagcgtgacagttcttagaggacgctatcatagtgtttcataacagatgcagaggctctgcagttctgaatattaataccagcaccatccaaaagtatttattagatgggagagcatatttctgatatttgaatttaagaggacttccagtacttccgaacgtcaccatcaataattggaatctgcatttcctcctttattcattcgataaatatttaacacccattatgttcatggcatcacattagactctgggggagttacaaagaacctaggctgggctctgccctcaagggggaaataaaagaaacaattacatgtaattgtttttaacaccaagcagcgtgaaacccagctctggagcagcctggtcacaagggggagaagaggtcacgggagcccctccaaggccagcgcacatgtggccataccttgtgccttcccaagcccgggccctcgcacccttctcttgtctttccttgtcctcccatgccgtcagggtttatgagacctgcaagtctcggggcatggctctggtcactctgggcagcgaagatgattctctgatgggctgtggtcagtgaagcacagcttgtttgcctcttttgattttcctgcaatgccaggagagattgctcagttttaggcaggactgagatctcctaaaacatggaatttgtagacaaaaatgaatacttcctaacatttcctgagagagcttttggtcagccttatgcctgcaacattgcattgctgctgggggacccaggcacacagaggtagctgcagctgcacccgaacacgagagggtggctgaggagagtggccaggccttcatctctctgacccagagtacgtgctcagtaaatgatcatcgatgaagcaagtgagtcgggactgaaatgtatgagcgccataagtttaggccactgctcatttaaggcctcagaactcctggaagtgttacgtgtagaaggttggcaggctggagagggtaggggagaccttgaagattcccatatttatattctaggtggcttgtgtgatgtgggccatggccggatgtcattcattaactcgtttgacaaatatttattttagcacttgtgtgcatagcatgtgctgggaataccaggggagccagaaggcagtgcttccggaacttgtctgcacgttggaatcacccggggaattgcttacaaattcaagcccaagccacagcccaggccatcacactctgcaggcacagggcacagatctctgtattttggaagcgcctaagggtgttctgatatcagagaggtttgcaagtcacggctgttaggatttataatagagttttagataacacacccaggaaaattcagtaacgatacaagacggccatccagaaacctcctgggcaggatgagggagtcaaacccaggtgtgtgctgtgggcaccactcattccccctcaaggaggatgtcgcctgtggattagggagcgggagcatctaggcaaactggacctctggggtgtgtgttggctttgccaggttcgagagagggaggaaggggatccccttgactctgaactcaggcaggtccggatgtgacccgggatcatgggtggaatgcactggtctatcaagagctcaactagtcattgccatttaagtggatgaatgtttttcttataaaagacagactgggctgggcatggtggcccacacctgtaatcccacagctttgggaggccaagatgggaagatcacttacggccaggatttcaagaccagcctgggcaacatagtgagactccatctctacaaaagatacaaaaaattagctgggcttggtggcacgtctgtactcccagctacttggaaggctgagttgggaggatcacttgagcccaggagctcgaggctgcagtgagatatgatcatgccgctgcactctgggcaacagaacgagacccagtctggctgctggcgtttttccttgtgcgtatgtgggctgagcacgatgtggtaaagcagatccctcaggatggacacgctcagcttcgtcacttgttgattctcttgctcttaaaatcccctagccctcttaacagccacggtgaacttccccatgtgtgcgtgtcagcacaccaatgagccagctcaggtgggcactttcatgccccagggtcttgtggagccgtgaagcggagctgcgcttagggtggggaaggcacttgacctcggccgtcctggccgctctaggtgccttcaggcctcactgctcatcagcaaccagccagaccacgtgggcctcatttggtattcttaggacttgccatttctaatcaatgtttttacttgagtctgttatatgttatttcagaggggggaatggaatgtgttaacacttagtaaattcttcatgagctgcaaccaaagtttttctttctttccctttcaacccacagtgtgccatgcggagctgaatgccatcatgaacaaaaattcgaccgatgtgaaaggctgtagtatgtatgttgccttgttcccttgtaatgaatgcgctaagctcatcatccaggcaggtaggaaccgggtctttccatttgtcacatttgcattgctgcctgctcgtcagtagctcattgctgatgtgtttgatcttaaattgctattgtttagatctaaattaattgcactatcagctttgcaagatatttcccgtgttttgtttttgaatggtgccaggtattctaagactaattgcatcctctgtgattcttagcatgtttttaatttagtttgcaacttcttaaactgcaagctgccaaaaaacaacacaggcattgcatataattactgtcaatttactgttctctgacatattgtgcatagatttgggggagggaagaaatgaacttctgtcagaaacaaggtcagctgggagtctgtatatgaaattttaatttgtatctaatacatggtagatatttgaggatctcaacataccttggcatataaatgtcataagacccaaatggcactaccttcaggttttcttattttacggttcccataaatctacaccattgtattctgaatatttcgcctttttcaaactgtcacatctaagattcagctacactttgtctccataaaactctcggctggagatttaaagacttaccatgtttagccaaatgtgtggtttgaaggggccgtttatcaccagtcctgtggatctcagagcagaagcggcctgctggtactgaggagtcgcgtgggctccctggctgtcgccgtcaccgttcctgggaagctctcctcgcggtgcccaggtgtggaggcggtggcaggcctgtgggccgagcagtccgggccccacactgcagcctcctctgccttcagaggctgatggagcagcggccttcagtgcggggcccttgggattcctggctgccgagttagcgctgcctgctgagatcaggacaagaaaacagatctgccctctgtagagctggtttgaagtggtctgcaaagccatgctgggaagcacagtggtgcccacctctgaatttgccagcagcccccactccctccattagtcctcccactagtaagagaagctaccttgtgcatactgccttgattacctgtagtaagggaaattggttaatcggatcaaggcttgactacttgacatgttttccctttgcatttgtttaaaaaaaaaatccataaagactggagggaagattagatagaatccaccctctgctgtattagaaagcagcagatatgtatttcagtgactggacactgtctgcaagcacactcagaaaaggtcattaatcatagacgctgaaagtgctccagctgcttccgcctgtcttttgcagcatctgtaggtgcgtacactaagggagctcccattgttaccttacaggtataaaagaagtgattttcatgtctgataaataccatgatagtgacgaggcaactgctgcgaggctcctgtttaatatggccggggtgacattccggtaagtggggagaatgcgggcggggggacggggtagggtgaaggctgatgaagagatgtatttgaccttgtctcctccttgtgatgcctgacttccacacttggaggtgtctttagaaatgcaagggcataagaatttaaagactattataggggtagatatttaagagcagtgacaggaaaatctgaagaccatttgtttaatgattgtactttaatttcagtaactttccggggtaattagactaattattcaagtactgagaagtttaaacattcacaagttttataataggaatgccaaaccttggtgaattttgcaaatgtaacaactttggcatagaaaatttaggatgaaagtagcctgccagattgaaacattggggattctctcttttttttttgagacggagtctcgctctgtcaccaggctagagtgcagtggtgcgatcctggctcactgcaacctccgcttctcaggttcaagcggttctcctgcctcagcctcccctgccacacccagctaatttttttgtactttcagtagagacggggtttcaccatgttggccaggatgacctcatgagctgcctgcctcagcctcccaaagtgctgggattacaggtgtgagccacctggggattctttttacagcaacattttgcattgagatttgaagtcttacagatttttatgattatctttgctaagaaatggttgtgagctatattttacttgcaagtaagttcaactacctttgattcatggcagaaaattcctttgggactgtaaagttttccagcgcttcatggtattggcgttcagcagcagtgggaccatggtcataggtgacgtgccctggccccttgtgctggtcattagggatacagctcagtgtatctcatgaactcaaccgtggtgccttctgagactttaaattcaaattatttgtatactctcttgttcagtgattcttaaaagaatttgttttgttcccaaatgtcttctttttaattgttgtagaagaaatgaggaacaagtgaaaagttaatgagcaaaaaaaaaaaaaaaaaagttggtttatgtttgcatttttagaatgtaatttgaaaaattactcctcactaaaggtagtcgttttttgctatatataagcggcaaaagaaaatttactatttttttgcattagagagactccaagttggctgcagaaatttttctagaaaataagataaatctgatgggaaaactagtaatcggatatcatgttgtgcagctgacttgttagaaatcctttgactccccaataattcgtgaactcagagagctgaaaacatacaaaccacaccaccccatgcatctttttttgtcttagtcttttctgctctgtgtttctcttggtatggtgcactataattggctcctatagagagaaaatagcaagtgaatcccaggacatatttttctctgcacagaaaatatgagttaagccaaagtaaacaaattgctttcactactcaccagataataattgtattttgtttttatttttaggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttagggtttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagaaaattaattcctatcccgtgagtggattgtgagaaattccacccacgtggagacagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaaggctttctttatcctaaagattattacctttttaaagtgctcttatattttcatgagtttttattttgtctctgagattttgtattccacattctagggtattctgtaatttggctccttaccaatattattaaaatcttattaaaatct

SEQ ID NO: 35916 - DNA, 100525 bp, Homo sapiens
aagtgacgcgaagcggccggcctgggcgccgactgcagagccgggaggctggtggtcatgccggggttcctggttcgcatcctccctctgttgctggttctgctgcttctgggccctacgcgcggcttgcgcgtaagtctgcgggacccgggtacggggaggcattgctaggggacaggctggcggggaaccgggctggggtcgcagccacccgcggtcccgcagggcggggagcctgagccccgaagtgccccccagcaggctcgcggccggcggaacgcaggcagtggaccggccttcccgtcgggggcgggccgggcggggcgcgcgtccttccaggcagctcggtcgcttgtgcgttccgctccggccgccctttgcgcttggatccacttccccatctgtaacgaggtgttgagacgaggtgcgtgtaaacatttcctaagttggctttccgggaggggattccaagttgcgcgggttagagggtgcctccggctctggtttggggcgccctcgctttcccagttggtgctctgcggagcgctccggaaggagaaaaatggggtcaggagaggcccttgcagtgggaacattgggttatttcccctctgggtgctctccctcttcgtgcatcttgttcctttctcaccactccccgtcgcctgccctttggcttgggtttttctttgtatttgtgggaccgttttccttcggcgtttgggggtccaggttgagggggggaataggcaggctgccgggggatgccatcgttgatcggggcagggctggcgaggcgaataggtgaggtgcggggcgtgcacagttggtgggagaggaaggacagcttcactcgctgcgtccgagctgaggcgactggctgaggggctccaaagcgctgcctggggaggtttgcatcacacctgcggaaaggagagtgggtagttgcaagctgctcctctgcacgttccgcggaccaactttggttcctccagggtgtaggtgggctgagcctgcagtatgctttaagtaagagctggtagcatttgacaccgttgacttgtaagttacaccctttaataacgctttcaataacgtgcctagggcagagaaaagtggtacatttatctacaaccaagattgaacatcttaagtatttggaaaacagctgctgaaaatgttttcattttgggaaaaagtcagcacagattatttgctgctccctcttcaccccgtctgtggttcccctaccccagtatgtagacagagttttcttgtccagaaggcccgtaggaccttaggagtcagagctagccagctgtgagaaccactggggaaggtggaactggggcacagttcaggagaacagtggcagggtaaggggctaggggaaaggcagatcttaaccagtatctgggagtgggggtagggagagagagaaggatttatgaaccaggaacaggtggacagggtcaatctgtctgatgtgagctcatcagtcttgtgcagcgtcattgggtcagggtggatgccctgtggctgccatacctgaggcccacacagggaggctggcatcaccccaggaattctcatttcaggtgcctaggtgtccctcttgggcttctgtgcccacagctaaagaaagataccagcagtctagctttccattatctccttgtttacatttctttagggttcacgccattctcctgcctcagcctcccgagtagctgggactacaggcgcccgccatcacacccgactaatttttttctttttttgtatttttagtagagacggggtttcaccatgttagccaggatggtctcgatctcctgacctcgtgacccagcggttctcaaattttaactaaattttagctgtcctagaaattaagagaatattcctttttttttttttttttttttttttgagacagagtctcgctcttttgcccaggctggagtgcagtggcacgatcttggctcactacaacttccacctcccaggttcaagtgattctcctgcctcagcctcccgagtagctgggattacatgcatccaccaccatgcctggctaatttttgaatttttagtagagacagggttttaccatgttggccaggctggtcttgaactcctgacctcaggtaatctgcctgcctcggcctcccaaagtgctggaattataggcgtcagccactgtgcccagccctagagaatattttaaactatttgttaagaaatactacatcattacacgttaataaacaatatatatatttgaaaaacaatagtatttctccccaaattttagggtgaagagttgcactgttttacatttctgcaaatctctttcaatgtctcttaatagaagacagtcaaattttcatgtttatttctgcattaaatctgttgccatatcacatgtcacatagcctctggaagactccaccccctcaggacagagtgagaatggaaaaggcagtaatggcttggaattataataaaaatagttttgactaattggacccctgaagggctctctccagaccacactttgaataccgctgatttggaatgtttttataaaacaagtacatgcttactgtagagaaactttaaacgtatagaacatgtggtaagaaaatgaaaactgcccatcatgtcacaatgctgtgagtttctttttgaataataaagtatagctagcaactgactggtatttgagtagcttggattcaaggtgggttgggcagatgtaagtggcctttgagttttgaatgggtacaaggacactctaatatcccacaaagctgatgctggttcctggttgcaggcggagttgacctggaaacctctccttggccactgtcctttctaaggaactcatttccagagtccaccagcacagaactggtgggggagcctactaggagcagagaaaatggccatcttcaggcagctgtccctaggcgcgaaggccaccctggctgctgtcactgtcttcgtgtccatgatcgcctcccgctcgtatctggcagagagccttgagctcagggcctggcgttggctgcttcgcttgcagcttgccctgtttgtcaactcgctcttgctcattggctccctctacatttggcgcagcacagtgagcaacctctgccactccccagctgcagagtcaacctgttttcagctttggaaggtggtggttctggcatttctggccctggcccattccagtttctttaccatgttctttttagtggccgaagagccctatctcttttccttggcggcctactcctgcctgggtgcttacatcatcatgctcttcttcctcttcatcctcagcggcatggagcaggcctaccagctcttggcctggcgcagtggtagggtcgtgggcagccttgagaagacaaggaagctcgtgctcaggcctgccctggcagtgggagtgactgctgtgctcagcgtggccgggattctgaatgccgcgcagcccccggctgtgaaaactgtggaggtgcccatccatcagctgcctgcctcaatgaacaacctcaagatcgtgctcctctcagacattcacttgggccccacagtgggcaggaccaagatggaaatgtttgtgaggatggtgaatgtgctggaaccagacatcacggtgattgtgggtgacctctccgactcagaagcctcggtcctgcggacggctgtcgctcctctgggccagcttcattcacatctcggtgcctacttcgtcacaggcaatcatgagtactacacgtcagatgtcagcaactggtttgcacttctggaatccctgcatgtccagcctcttcataatgagaacgtgaagatttccgccacacgggcccaacgtggtggtggtggcagtggcagtgggagtgaggatgaggactggatctgcttggctggggtggacgatattgaagcagacatcctgcactactctggccatggcatggatcttgacaaggccctggagggctgcagcccagaccacacaatcatcttgctagctcaccagcccctggctgccaagagagctctccaggctcggccagatattaacctgatcctttctgggcacacacatgctgggcagatcttccccttgaacgtagcagcctatctcctgaatcccttctttgctggtctctaccaggtggcccaggctacattcgtgtatgtcagcccaggcacagcctactacgggatacccatgaggctgggtagcagggccgagatcacagagctcatcctgcagcggtctccctgaactggccctgccctgtgcacctctgccctgcccttgtcctcgaccctccatcctgcttcagagtggtttgcctgcttttcccctccagccttgcccactcatccttgcctacacacccttggtcacaagcctgactcaaacagtgacttatggtgggcctgcctggcatgttcaggctggtttaactatttccttggccagttgctttttttgatgcacttgtgagatcactaaggtcacatatattagcactcccctctattttccagatgatgtggaatggggaccttctcctgcagagctcccagggatgaacctcccctcggggttgctagaaaggcatacctctagaaggtggggcggggaggagcaggagcatttttctcctggtgttttaaaattgtctttaggacttaagtggtttccagaatcattgatccagagcctttctggggaaggggtagtgttgccaggtaatttgggagaacaggcaagatggaagggccctctggctgctagagaagaatattttcttttcctctgattctatcaggatcacctctattgagggcatcagcaaaatctactggaatgcaaagctcctcctgttccaggccttgagggatgctatttaactgtctgtgctcctgggcctttgggggcaaggtcaggggagaagaacggtgggcgccatggtcggtgatggtgagaacatggctgcttaggaattcagagggctttgcctcccttgtctcattttatacaacccttcggggagctcactggggacaggctgcttttccctatttggagataaggaaaccaaggcaaagagagatagggcacaggcagtatgacaagatatgtaggagatttggggctagaaaccaggtcttgtacctcccagtaaaagcggtgcttttgcccttttgccagaagcaatagatcctttgatcctgagatggagataagcacccgtgttagaaaaggcctcactgagaagacagggctgggctggtttcctgctgggtgatttaggcttgtgatggaaagtcttcctccaatggggagtgaagacactcgctctgactggagaggctaaccctgctgctcactcatagggcagcgttgggtgggtgactttccctcactcagccttggtttccatcaaccctaaaatggggataattatcgtatctacctcaagattgttttgtcaggagggatccatcaagccttgtgcatgagttccacatggcacagcgtgcacagtaaacactcaatgttaatttttcaacgttccagtggagcttgctaaggaactctgttgggcacaggtgcccagaggattcatggagcagccagtcctggggaatgtgagtgggtagcgagctgcctgctgctggggcaggtgatgtgtcaaagcagcaactgctaggggtttgccttccttccctcatgtgcattctggcaggcaaagggggtttcttcctttcctccttgtcctcctggtgtatagtggggttctgggggatctggagaccaccctttttgttcccaggcagccacggtattgacagtgggccataccatgcagtttaaaatgtatctttgagttgaaattttggtggtttccttattcttttttctctcttcactgtccttccaaactcacttttcttgtgtcccgaccgcattttgtgaatcatccttactccctttaagttctcgctttggatttcaccaggtgggctagatggtgccatttcacttccactgtttgatgcggctggtaatgtttgactcacctgttacgtgttatttcactggtttcttgattttacatctttctcatcagtgacctgggcttgatgaaattagctttcattaagtcctattttttttttaattttgcatccttacctcttttctttctcttgaatgccatcattgtgtggtcttatgtacccttcatccactctgaagtccttgcttgactgattgctttctattagcagaaagaaaacaggtccatcctatgtatctgagaaacaacatcaacaccctctcgtatgtggtttgtattccctgacgcggcggacatttttgcagcagaaatttctccatcactgtccagattctggccctggtgggcaggtctccatgacacctttagtccctttgttcaacattcttaaaccatggacctttttgtttgtttgtggccgggggaggtggtgagaaacgttacttgaagcttgatcattctttcaatttcatttgtttctttatttttaatctgttagatgcaaattgaaatgcaatgctttttgaaaatcagcaatagtgtctgtagtatatgatgctgtcacaaaatctcaataaattgatcctgctgccattccttccaaatacccatccatgcttttcttcccctcgtgttttgtttggtttgttttaaacttttcgtacatgtacctctctcccagctttaacaagcatgacgagaccactctgccatcctttctcagctacccctgccccacctgtactctttattttttggctggagtatattaaggtaaatcatagaaaacataatgttaccccaaaattacttcagtatgaatcctttttcaaaaagcatagctatagtgtcattatcatatccaatgaaattaacagtgattcttgaatatcatctaatagctagttaggagatttggggctagtagccagatttttgacctctttaaagaagtgttctttccactctctgagtattaagtagctgtatctgtcacaaatgagtacagaattcaaatgcagttaactgtgtgaagagttagtgtttagtttttcctgattatctcaactatattttttattgtggcaaaaaaattactatcttaaccattttttttgttctttttgttgttgttgatcttaaccatttttaagtgaatagttcaacagtgttaggtatattcacattgttgtgaaattgatctaattgatctgtagaactttttcatcttgcaaatctatatacccattgagcaacaaggctccatttcccccttcctccagcccctggtgaccacaattctactttctgtttctatgaatttgactgctttagatacctcgtataagtgaaatcatgcagtttttgtctttttgtggcgggcttatttcagttagtataatgaccttaaggttgtggcacgtgactggatttctgtcctttttaaggctggactacagtaatactcttgtattttcatgccacattttgtttatccatgttgagcatgttttcatgggcttgttggccacctgtataccttctttggagaaatgtctattcaagtcctttgcctatctttaaatcaggttatttaatttattgttgtggagatgtaggagttctttatatattctggacattaaccccttatcagatacgtaatttgcagatattttcttcagttctgtacattgccttttcactgattgtgacctttgatgcacagagttttaaagtttaatgcaggcccatttctctatttttgcttttattttggcatcatatccaagaaatcattgccaagttcaatatcacgtagcttttttccccatgttttcttctaggagtgttatagttttgggtcttacgtttaggtctttaacccatattgaattaatttttgtgtatggtataagataagggtccaacttcattctcttgcctgtgaatatccagttttcccagcactgttttctgaagaaattgtccttttctaacatcaagagatcttggcatctttgttgaaaatcatttgaccatatacacaagagtttgtttcttggtgttctatcctctcattgctctatgtctgtctttatgtcattaccatgctattctgattaccacagctttgcaatatgttttgaaatcaggaggtatgagtctttcaactttgctcttctttttcaagactttagtctatttggtgtctgttgagattccatatgaattttaggataaatttttctatttctgcaagaaatgctattgggatttttatagggattgtgttgaatctgtgaatcactttgggtagtatgaacatcttaacaatatgaaccttccactccatgaacataggatgttttttccatttgtttgtgtcttctttaatttctttttaacagtgttttgtagttttcagtgtagtctttcaccttagttaggcctatttctaagtattttattctttttgatgcttttatatatggaattttttgaaattccatttaggattgttcatttttagtgtatagagaagcaactgattttggtatgttgctttttgtatcctgcaactttgctgaattcatttattagttctaacagtttgtgtgtgtgtgtgtgtgtgtgtgtgtgtgtgtgtgtgtgtgtagtctttagggtttcctacatctaagattatatcatctgtgaatcgatcattttacttctcctttctaatttgaatgccttttatttctttcttgcctagttgctctgactaggacttccaaaactatgttgagtagaagtggcaaaaacagacatcttgcctttttcctgatcttagaggaaaagcttgcagtctttcactattgaatatgatgttagctatgggctcttcacatgtgggctttatgatgtggaggtagttttcttctattttgcatttgttgagttgttggtttttttaatcatgaaagggtgttgaatcttgtcatgctttctctgcctcaatttagattatcatgtggtttttgcccttcaatctgttaatttggtgtattatattgattgatttttatatgttaaaccattcttgcattttaggaataaatcccacttgatcatagtatataacccttttaatgtactgttgaattcagtttgctagtattttgttgaggatttttgcatcaatattcaccaggaatattattgttctgtagttttcttgtagtgtatttgtctggctttggtattaggataatattggtctcatagaataaatttagaaatgttcctcctcttcaacttttgtaatagtttcaggaggattggtattaattcttctttaaatgtttggtagaattctccagtgaagccatctggttctaggtttttctttgagtgtgtgtgtgtgtgtgtgtgtgtgtgtgtgtgtgtgtgtgtgtgtgtgtgcgcgcatgctgagacatggtcttgctctgtcgccggggctggagtgcagaggcatgatcttgggtcactgcaacctccacctcccaggttcaagcgattctccttcctcagcctcccaagtagccaggaccacaggcacgcgccaccacacccggctaatttttgtatttttagtagagacggggtttcaccatgttggccaggctggtctcaaactcttgacctcaagtgatctggccgcttccccctcccaaagtgctgggattacaggcgggagccaccgtacccggcctctttgaggtttttgatgactgattcaatctttttaatagctattggtctgtatagattttctgtttcttcatgattcggtcttggtgggctgggtgtgtctagaaatttatccatatcttctaggttatccaatttgttggcatacagttgttcatgctattctcttacaattctttatttctgtgtcatcagttataatgtcccctcttcatttctgatttatttatatcttcttttttttaaatctagttaagtttctcaattttgttgatttttttttcaaaaaccaactgtttttttttcctactatctttctattctcttttgtttatttctactctaatattttatttccttttgctagctttgggtttatttttttcttcttatggaattgtctttttatagttattttgtttgaaacaggatctaaaaataggtctatattttgcctgtggtgtatttcttcagtctccttaagtctataacatccccttttccttattttttatcatttatttgttcaagttatctgggtcatatgtcttaaaattttatacattttagattttggtgtcatttaacatgttcatattttctgtgagctcatagagctaaagctctctaaaggttagagctagaggctggttggattcaggttcaactttttcgctttttgggtaggaagaattcattgcttcactgatattaagattgacctgttggtccaggtgttgtcagcttgatccctccactagaaaattccgcattatctttccatttaatgtttcagcagtcattggtgattgttgcctaatgtcattatttcactaaagattgcagaatagtgatttgtaaaattctaccctttttttcctgcatttactggctatggatcctttacaaagaactctcctcattaattatgtggttactctgaaaaagcctataacaaaggcaagacagataccagattctttcacttgattccttagtttatagcataatgatctgataccacagcaacctccaagaatgaccaataagcttttcttctgggtgggtgaaatattgttaggaatttagatatttagatattttatatatctgatgttttttagttcatcaaagtgttacatcttttaatactcaaaatagcccatctttggccagttgggaccttttcatttttcattttttactttttagagtcttagtcttgctctgttgttcaggctggagtgcagtggtgtgactgtaactcactgcactctcaatttcctgggcttaagcgatacactcactttggcctccagatagctaggactacaggcatgcaccaccaccaccactcctggctctttttttttttttttggtagagacagagtctctctttgttgcccaggctggtctcaaactcctggcctcaagcagtcctcagcctcccaaaatgctgggattacaggtgtgaacctgtaatcagcctcccaaaatgctggcattacaggtgtgaaccactgcacttgagctggttggagccctgtcatcttgtcattttgatgagaccctaatagttttgtttttttttttaatctagccctgttttgtacatcttatgccacagacttggattaactaatttcttgaagaagcagctttggttacttttagtgggaaatgtttgcagatcacaatttaggcgctatatgggttagattgctacccgctgatatcatttccaaactgtgtctttgggtattgctaggaaatgcaatacttttttagagagaaaaaaaatcataagtgtatactagtatttacaattcaaataagagattatggattttattgttttttaatggactatattttttagaatagttgtagccttatagcaaaattgagtggaaagtacagagattttcctgtatctcctgattatggggttcttaattttgtttgattttatgtttgtttctctctctctcgctttttttttttttttttttgaaacagactcttgctctgtcactctgattggactgcagtggcaccatcactactcactgcagcctgaaccattctgggctcaagcaatcctcccacctcagcctcccaagtagttgggaccacaggcatgtgccaccatacccagctaacttttgtttattttttatagggatgggatctcattttgttgtccaggctggaacttctggggtcaagccatccacccgcctcagcctcccaaagtgctgggattacaggcatgagccactgcacccagcctgtttctcttttacactgaaaaatttggttcttagtaacctaatgtagttacttacttcttttatcctactacatatataatagaaccaaaatagtaacgtcaatgtggttattaagatgaagtctactgaatgcagtttgcttttgtttttttccctgaatgcagtttaagctgtatttttatccttaggccaaatatggtcaatgtagtgtggaaagttagatctgtatgtttttaattttaaagaaattacatattttttaatttaatttttatttttttaaactgcacatttaccttttctctgagatgagggggcacatttaaatctgtgtatgtccagagtccgtgaggattgggaatcagtctaaagctgtgctcgcttctcctcttccattgcgatttgccttctttatccagtcttttggaatgctgaacaaaaatgtttttggcacaaggcaggcgtgaaaacataaagttaataaaaatcgaatgcataagctagagcagattatccacagattcttccatctccatatagattatcaccattgcctgcacctgttttccttctccagcctatctgatggaatggtgcttccatgacatgtggtatttggaaggctcttagctctgatgtaatcagggtttgacccatagtcacctgaaatagttcttctgtttctctttgttctatgaactgaagggtctcagaagcccgtgttatgcaaatacccttccatccccttccctctccccttgcctctatccatgttccctcagcctcagggtgcttgcaggctaagaggattgggtctctggcatcctggagctgaacagctcgtgtcaggaattccccaggcccttgagtctctggggtgagttgtaggggtgtgtagggtgctggggattaagatctgctgagtaggtgcttaccagagttatactgaaggacctgaagacagatcatcttcacataatcagcatgacccataatctgtgatgtcactgagcttcttttatttctgtagtcaaggaatgtgcacaagtaatgcaaatataattacttttagtcctgaggattagggaacttgggggatgttcacattacctgatgatgtcaatattgtgttatgtttaattttttttaaaaaagatgcttatttattactgaaataatctaaactgaataaataactttttaaaaaattacattggccagtattaggttcctgatacgtatttggtgttttgtttgtactgctgggttttttctctccagtattggatgcgttaacggggagccttgagaagttatgaattttggtttgttcggaattgctttttataagttttctgtgacctcatgcactaaatactgatgctaccacactcctgcaagtatgaaataaaagtatgtctcttcagtattgcattcctgcgccaattcatttagaagggtagaatttgcacacaggtcaaatcttgcattatttgcatttggggggaatacactctgaaggcagttttctctctctctgtctcctttttcctcctttcttcctcctattcccacttttttttttttttttttttgagacagagtttcagtcttgttgcccaggctggagtgcagtggcgcgatcttggctcactgcaacctctgcctcccaggttcaagggattcttctgcctcagcctccaagtagctgggattacaggcatgtgccaccacacccagctaatttttgtatttttagtatagatgaggttttgccatgttggtcaggctggtctcgaactcctgacctcaggtgatccacctgcctcggcctcccaaagtgctgggattacaggcgtgagccactgtacctggcctattcccactttttttgatcgccttctgtcagtagttccacagctcagaggaagctcaaaggaagctgggtcttttttttaggtccgtaacttttgagaggggtcatcttgggtccatgaagtggactgtccctgtttactttggctgtgacagtcaacaatgatgaactgtcttttaagtgatactgcttctgcagctgtccatcttgatcccctctctgtggcttttctaggtttttgtttcagagacatgtcccctgctctcctggttcaaataacatggtgatgttcatctctcagaccatgacagtccatgaatgcacagacagtccaggtctcgtgtgatacagcagggcagtggacacagccccgggcaagagggagaatatactgctgtcctgcccactcacgaactgttttcaatcctttttatcagtaggatttgaaaagattagaacattaatcgcaaaccaaatatcagaggctgtgttgttctgtcccagtggtaatcccatacctacatggtagctgcttttggagctactactcggttaattaagtggccaccatcatgtactgtgatctgttttttctggcagaggctcacgggcaatttgaatgaacatgatggaaatgatctttaagtctttgtggagggggcactaatagctacaattcccagaggattgtggtcttgcttcagatttatcttgagtgggagtggggagtgggcagttccagagcttccacttgatccatgatggctcctactcattatgagggttctgcaggccattatgtaaaaccatcccactttgaactcatagccagggaaataaccgtgtgatggatcctctgatttgttggactctctgtgaaaaggactggggccaaggctcccattatccctggcctccctaagagtgataagggagagtgatggcatttcaggttccctggtgctaccatgtcagttcagactgtatccagtagtcctcagaaggtggtggccttggggtgccccttttcttaggacacagttaccctgagtcttgttgggaaggattggaggaatatttactgtgtggacttggggtggtaatgcaggatccttcctcaaggggatccatccaaccttccatcaaattttgttgactgtatgttagagaactggctcaaagctgggaattggatgaaggaatctcaattttccatgcagttgttgacatcagccttttgctcacaagtttttaaacatgtcaagcagtactcttgctgattgcctggccaactcaccccacagaaacgtgtggcttatgagccactgcataaggtcactcctggtccacaggtcagcacaccctggttgccactgtgaccttgctggttgttgtggtaattgtgccttcctgcttctgatggttaagcggtcccatgctggttatgccagaacctcatcatccccagcgacactagggcgccccttgcctgcagaggatggccccactgggggggcttcccaagtatgccagggccctcctcaccagtgccttccttcctgaagggagagttctctgggctctcctggggaatagagccaggtagtggggtctctggtcaccctttttacattcccacctcttgagccattccatacctttctcaggatgccaaggcagtcctggcatcctcacctcatttcctgtagaccagcgtcatgtctaggttccaaggatcctcccaacagcatagggactgggctcttaccaatagaatataggtcatgggagaatacaccctaccagtaacttccccatatccggcctgggattttccccctcaagatccattcccagtgacccccatagttaggtcttacttttctggcctgagatgtgagtctctttaaacattgccacagaagcctctgatattcataggatgccctgagtggatggctcacctgagcccatcaaaccgtcactgtcttcaaagcttccaaatctgttaataaaagccagctaacctcacactcctttcaatgaccagtgacccccacctctgccccgctccaggggtggagccagtgcagataccgactgctccccctctctccatgcctcctcccggtcccacagagttgagggccttggtatttgtctttgaggcgttaccaccccacttagcaccagctataaggttcttgctatttgacattcatgagacaacaaggtgcagactcacatcctgatgatctgctgttgaggccactcctggtatcaaggtcgtactttgggtccctctagaagcagaacattgggtgcaagtggtttgagaagtgatccaagagcataggagcaagggacaggtggaaagaagggacagcctgggtcagaatgcatattgtagttatcactctgggaaccgggacatgattcttctgagacctcctgaaaagtgcacaaagtgtctccagaattatttgcctaaaaaacaagagaatgcagttctccaccctctttgtccctcattggctgaaggttgccctcaggggcatggactgcctggtgctcctggacttctgggctgaacccattcccccagtgttggggcagaaaggcaaaaagacatgagatctgagtgtgagttgagacaatcagcacaaagcatactgagcttgcacaagaccattcacagagctacagctgatgtaggcatgtttttaaaaacttttaaagaccaggcgcggtggctcacgtctgtaatcccagcactttgggaagccgaggcggcggattacctgaggtcaggagctccaaaccagcctggccaacgtggtgaaaccccgtctctactaaaaatacaaaaattagccgggtgtgggggcaggaggctgaggcaggagaattgcttgaactggggaggcggaggttgcagtgagctgagactgtgccattgcactccagcctgggccacaagagtgaaactccatctcaaaaaacaaacaaacaaacaaaaaaaaacagttttcaggctgggcacagtggctcacgccagtaatcccagaactttgcgatcgtgaggtgggaggattgcttgaggccagcagttggagaccagcctgggcaacatagtgagatcctatctctacagaaaatttgaaaattattaactgagcatggtggcgcacccctgtggtcccatctacttgggaacagaggtgggaggatcgcttgagcccaggaggtcaaggctgcagtgagccatgatcatgctgctgcactccagccagagcaactgagcaagaaagaccctgactcaaaaacaaaaaactctctcctctgccttctcttttcaccctatatccctcccaaagtgctgggatatccatcggagatcatttcacaatggcaagggctacatactctccagagctgcgtaacatttgatcatgtatgtgtatttgtatatatacaaacatgcatgtacaatacacatacaatataaaccataattcattttatcagtctgcatttttatttgtgtcaacattttgctaggaaaatttttcagagagggttgaaagattataccattaacatattactatcagtccattcctccatctatcaattcatcttattttttgaatgtatttcaaaataagttgcagatatcaatgccctcctcttgctaaaataaatacttcagtaggcatatcattaactagcagtcagtgtttgttagtagcccctttttcttccaaggtaaaatttacatacaatgaaatgcacatatcttaaacgtaccatttgatgagttttaacaaatgcctacacctgcataatccaaaacccttatctagctatggaatattaattaccattaccccagaaagttccctcacgtcccttcccaggcaatacctacctctactctcccagagttaactattctgattttttcttccaccatagattagatttgcctttcccaggacttcatataaataggttcatgcagtatgaacccaattgtgtaaggcttctttctctcaacatttttgagatttatttacattattacaaataccagtagtttgttcttttttattgctgagtagtagtctatcatatacatatgccatagtttgctgaagcaggagaatcgcttgaacccaggagttcaagactgccatgagatatgattgagccattgcactccagcctgggtgacggagcaagaccctgtatccaaaaaatcttaaaaaattataatagtaaataaaaagtaataaaaataaaagaattaggatccaaaccaggttcacactgacctaatgaatatcgtatcatttcatattacgaatattgtaccataccttattacacatatcatatcacatataatgatctaatgcaatcattaggccattattcctctgaagttctttcatttccaaataatactccctttctttcttttaataccattgatttgttggaacaactgaatcattggacttttaaaatgtcccacattttggatttggcttattgcttccttatggtattattagattcgggttcaattgtgattttgattcaataatgaggactactttctagatgagactgtacttcgtgttaaatcataacatgagagacataatgtctggctattcgactttttttgaggctgaaattgagcagatggagcacaaaaaatatgcccaatccttcacacaatttccatcagtgtttctaatggttttagcatctattgatgattatagcttaaatccatttcactaagtgttggggaaaaggtgttttcagatgcttttattccttctgcatttattgttattttgagacagggtccctctctgtcacccaggctggactgcagtggccctatcacatctcaccatcgccttgacctcctgggctcgagcaatcttcctgcctcagcctcctgagtagctaagactaccagtgcctgccaccacaccagctaattttgtttgtttatttattttaaacaagaagtttaaacaacaagcttcttgacttgaaggaaaaactatctaggattcctttttttttttagactaatttatccctacttaaagacaaattgccctacatttaacaactatgtacaacaaagttataaaattgtccttggttttacaatgataaatgaaaaacattaacattctacaattgaataaagtatgcaaggatttttatgttttttttttgttaaaacagcaaaataacttactgaaatataaagataagagctgaatgagcatgccactaatgaagaaaagggagtatttttacagaatcggtatttttccccatctcatctccacttgatatcaatcaaaacgtaccattggctgtttagttaaaaaaaaaaaagtaatatacttgtgcacatttaccagttactttatgtacaataaaggaatggggaagggggaaatgaaagaatagagaaaactatactgtagtagtcaggatgtggtggaaccaaattgcagttttctatttgagaatgtgatcttggtctgtaaagaacagagttctggagtgaagtgggaggttccctttttagtagacaccccctgactgctgttggaacatatcggttgtatcttcatcctccatttccaactgagcaggtgtgtctctttcattgattggttgcctgtcaaattggaatctgatctgtctcattgaccatccctatcgttcacaacaggctttcattagtttactaagtggtgtatgcctcttaatcctaaactgcaccacagaaccctcctgccctgccaccttcaaattaatatgatctttgttctcagtctcgattccttccttgggcttttcatctgccacggcaagcgcctaagtctcagctgccgcttcacaaaagaggtaccaagactgcaccgaatgagcacgcaagcagcaacaggagtgggagaagaaggaggcggcagcagtgggtgagggagacactaattttaatttttttttttatagagacagggtctcgccatgttccccagactggtcttgaactcctgggctctagcaattctcctgccttggcctcccaaattgctgggattacaggcatgagccattgtgtccgggcccttctgtatttaattaactgggatccagtggagaattttccattgtcaatgttttgataaccctgaaatacagtttttatgtgaaggggaagtaaactgcttgactctttctctgtatttatcacttttcatagtaatgagttggtactctagcagtctccaaaagtgaccaatgaattttttctccctgtaaattacgatgaactgataggtgttaatatacacgtagtcatattttttaaattgatatatctcttaagtctctcacatgctcgctctctctgtctctcattttgacactcagatttctccccaagaacagtgggagcctcttcaggttcgcgcctgtgcctcacatctaactggccaccatcctggaatgtcctccttctgcctcctgcccacctcattgtcaccaccgtgggccatagccacatctcttctgccttttttgcccattcaggaaaaagccaaacatttgaaaacacatatctggtcctatcattctttcatttcagttgctctccatggctctcagcataaaatccgggcccttgaatctggacttcagggctcattcgatctggccctggcctcctcctctgcctcagcagctgccatgtttcaactatattgaggctctgtggctcctggcctgtagtcctgccctccctcccccaggcctcacacgcagttttctccatctgtgtcaccttcccccatggctaacttcgctttatcctaggccttggctcaggccagtggttctcaaccttggctgcacattacatcatctaggcagctttaagaaattccaatgtctgggttcctcccaagaccaattaaaacatgaatgtctgggggtgaggtcaactttgctttttttttttttttttgagacagagtctcgcactgtcgcccaggctggagtgcagtggcacaatctcggctcactgcaagctccgcctcccaggttcacgccattctcctgcctcagcctcctgtgtagctgggactacaggcacctaccaccacgcccggctaattttttttttgtatttttagtagagatgggatttcactgtgttagctaggatggtctcgatctcccgacctcgtgatccacctgccttggcctcccaaagaactttgctatttttaaaagcttgcgtagatgattttgctgtgcagccaagattgagaaacacagtttggggtgtttcttcctttgagaaacttgcccttgcccctcccctcaaccctgccatgcctgggttccctgccatttatttctgctgcagcattctgctctaacccttactttaccgcctcgacctcactgtgttaacccttgggtttcttctaggctagatggaagctccatatgggttgtggccacatctgtgtggttcttgtctgtgattactcagcacgtaagaggtgcttggtaatactatatttgtaaatggatggtagggagatatttagactagactgaggtcattggagggtagagacagtgtcccaccatgtatgggacaaaggccagattccattgtctcccaccatcattttttcccagccttatctcctgctcctctgaactttttcacttagacaggtggatttcaaacagctctacccttttccgaattctgccagtagttgcttggcctcctttctacctgtctaatgaatgttcccacctcatgggccacctttgaacttaggaaacttgtgaggaacacttatttgacacttagccatgtatatactatgagaatgttttcaagagcatccattgagacacctggtgtaagaaataatttttctatttttgtgagtttaggggacttttcctttgaacagaaattaaaaccttatttactagaagaataaagtgatgttaaattgacacttgcccttttaaaaatgattcttagttgtttgtgtttatttagctttattgagatgtaattcacttacagtgaagctctccatttgcccctatgaattcttctctgagttgtttaacttccgctcgccagttggatttcaggcatgtgtgatctaggactcatgctgccacagttgcttccaaatacagcttcaagggcaacccccaaagccaccatggactatgatgctactgtgactagagctagtattgtgacctttgaaagcctaaagatgcacaaggaatctgacccataatggaaagcactagttagttggcttcttaaaaccctggttctcttggctcctgtggcctgttgctgccttatccaccagagggcagtgttccactcggcttaacagtcgaacccccacccccaccacccgttgaggtcttgcctttcaaaatcctaacattttagctcctgaagtgaccccaaaacagtgtttcttaaaatcgtgcttggtagaaataaatcttacattgcaaccaaatatacatgcgtacatatacaactccacatatgtatatataacaaaagttttataaagtaatactttactatgtgtaatattctttctttctttctttcttccttccttccttccttccttccttccttccttccttccttccttccttccttccttccttccttctttctcgttctttcttttgacggagtctcgctctgtcacctggctggagtacagtggcatgatctcggctcaccgcaacctccacctctccggttccagggatgctcctgccccaatctcccgagtagctatttttttttttaatttttggtagagacggggtttcaccatgttggccaggatgctttcgatctcctgacctcgtgatccacctgcctcagcctcccaaagtgcagggattacaggcgtgagccaccgcacccagcctctattttctttcttgccttttttttttttttttgagacaatgtcttgctctgtcacccaggctgcagtgcagtggcatgaacacggttcactgcactctcaaccttctgggctcaagcagtcctcccacctcagcctcccaagtagctgggagcataggcgtgtgccaccaagcctgcttaatttttgtttgtttgtttgtttgtttttttgtagagacgaggcctcgctgaattgcctaggctggtcttgaactccttagctcaagtgatcctccaaccttggcctctcaaagtgctagcattataggcataagcaacggtgcctgctattctttgatttttatttttatttattttattatttttttgagacagagtctcgctctgtcgcccaggctggagtgcagtggtgtgatctcagctcactgcaacctccgcttcccgggttcaagcgattctcgtgtctcagcctcccaagtagctgggattatagacgtgcaccaccatgcccggctaatttttgtatttttggtagagatggggtttcaccatgttggccaggctggtcttgaactcctgacctcaggtgatccacctgccttggcctcccaaagttctgggattacaggtgtgagccatcatgcctggacaattctttcatttttaaaagatgcttattgccaccaaaaatgagtttattattcacaaatcaggtcatggcccacaattttacaaatattgccttaaatgccttaaagttcttttagtctaataccctggatagttatggatgaagagaggtagggttagagatgggacttatccaggtcactatgggattcagagcaatatctaggatggggcgtcaggctctggagttttaatccattgctttttgccctgtattttacacttagaattttgttaatgggtcttggttatcccagtgacattgttgttgaggtgcatccagtgctcaggcaggtcacagcaacaatggcgtgtgtgcgtgcatgcgtgtgtgtgtgtgatgttccccagccccatgaacagcacagtggaatatcatctcagccactgattgtcagctcagtgctggcctctagaagctaagccttatggaatcctgcatgtggatcctcttagatgatttctcttacctgagtacccctggtggacctggcttagcaatggtttgtatgatagctcagaaaacaagcattaagtccatcagcacattatacaaattcaataggcagagagtcacttgctactctcaaaggatcggcttctgaaatgcagaaggtggaagttctcatgtgaccccatccttgctctgtagaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacgtaagtaggagggcatgtggctctcacctaggcctgaacacccactctggagagaagatacaactgtatttctcagggtggctattttattgctcagaaatgggaaatggtccagtgtgatgttctgggaggggcttgtcatgagccggactggccctttttcaaataattaactacttcttccaatcttcaattttaatcatcagaaatcattaaataaatagcttaaaaaggaaaaggatgggggaagcaaacagaagtaacaatgattgagcacttaccagatacagggcactttatactaatgattccatttcctcgagataggtattattgttcctgtttatagctggtgaaactgaaatttgcccaaggccatatctttggtcagaggttcagctagtatttgaagggaagggaaggcatgcaggcagctgtagcacaggtatggctgtagtcatacaaaaagctaggttaacaggagaaaagcataacagatatgtaagttttatctgacatgagagtcttcagaaaagaagacccaaggaaaactttttacacttagattccatgaaaggttctgacctaatggtggtggactgaagtgggaaaccctcaaggcctgcctcaacagattcttcttggcctttctgggtggcattccttccttctgggtatggagcaggacccctctgcaatgagggtctagaagggagaagggagaggtgacctttctaggttttctggcttgctttgggagagaggggttctaatttctatgacccacactgggggaagatgaattctggtttgacttgcttcaggggagaaggaggggtgggcaacagaagagcaggagaaggccagagaaagaagatttgcttctaaggccttccgatctcctttagttcaaagtacttagcatgccaaggtgccatactttggggtattgttttctgagccccaataacagaataagccttgtgcttaggtagatttctgaaacccagtttggctttgtggttctgctgcggtaattgtataacttcagggtgtagaattatcccaatagctatctctctgcatctcttttgctattgcaaagtaactaactaacaggcaagaaagttggtgtggctggctgctctggctcttgcagtgctgatgtggattgctgataacttctcaaagatgaagagtgagaaaacccagaggcagattccgaagatagatacttagggagaatgcgctcattattctggttctaaggccactggcagagtgaacccaagttcacctgtttataattccgacagtgagttctggaagaccaagactgttccagggaaccctgaaatcatgggatcacacacacgcaaaatgacacaacccagggtcttcaaagagagctttgtgatggtaatggatggctccatatttaactttgtatcccatgctgtctgtaggtagacagaggagctggtagaaggttttgtcattttacctcctgccacatgattcctgacaaaatcttttgtcagaggatctagggcttggagtttttcctacacgtactaaaaattatttcttcaaaaaataaatatgtctcttactacttttcagcaaaatattcttatttttcctaagcctcacatggacatatataatttttatttttatttattaaaacaattttttagagctggggtcttgctctgtcacctggctggaatgtagtggctcaatcatagttcactgaaaccttaaagtgggctcaggtgatcctcccacctcagcctcctgagtagttgggattacaggcactgctaccacaccagctaatttttttgttttgctttgtttttagagatgaggtctcactatgtttcccatggtggtcttcaactcctggactcaagcgatcctactgctttggcctcccagagtgcagggattacagaagagagctactgtgcccagctataatttttatgtaataggaattagtgctgatataactctggagttttctgttgttgttgttgattttaagaagtgtccccatgaagtctgactagcttggggagctgctgtaaaaattcataacaaggcccctcccaagaggctgccaagcgggaaggtctatgtgtcctgtggtttatggttctacaccatatctttctctatagacagtttagaaatttatgtaggatactggatttttgagctctttccccttccacagagcacctcaattcaattatttatgcaaaatataattacaaaaagctaaaaacctgacttacaaacaagtatataatggacatatgtcagaaatttatttaactggataaagaaaatgtggtacatatacaccatggaatactacaaaaatcacaaaaaagaatgagatcatgtcctttacagcaaactggatgcagctggaggctattatcctgagcaaacacagggacagaaaaccaaataccacatgttctcacttataagtggtagctaaacatcgagtacatatggacacaaagaagggaacaacagacaatggggcctacttgagggtggagggtgggaggagggtgagttcccctatcgtgtactaggcagattatctgggtgactaaataatctgtacaccaaacccccatgacacgcaatttacctgtataacaaacctgcacatgtacccctgaacctaaaataaaagtttttaaaaatttatttaacttattactgaggaaactagctagatggtaaagctaattcaaaggagaatttgaggaagggaggtttacggtcagtcaagaaagtcatgttcaaataaagttatctttagagataaaactggttagtatcataaagggcaatgaatgaaaaagcaacctttagagttgtcttctctgtatgacaatcatttgtttctctctcaggcaataatctacaaattaatctgtaacttcaaagttcttcccttaatcaatagtaaatagtaagtcaaacaaaatatctcccctggagaatgaaggaagcctcagtgggcccattggacagtcctccattataacatggaaaggaaatgcagtcacccttttgccttatatccaaattctggataatttttcttttcttttctttctttattttgacacagggtctcactctgtcatccagtttggagtgcagtggcacaatcacagctcactgcagcttcaacctccctagcttaagcaaacctccacctcaagcctccagggtaactgggaccacaggcatacaccctggctaatttttttgtgttttttgtagagacggggtttcaccatgttttccaggctggtgtcaaactcctgggctcaagccatccacccaccgtgacttcccagagtgctgggattagaggcctgagccactgtgcccagccttggataatttttctttcaaagcgccttctccctcttatccatgtgttagcaatagtcctaatgaggccctttccccacgcttctttcttcttgactctgccaagtatccaggaaggggctgtgtgtgtcttggcaggtatgtgccctggaactttcatgagccctggccaggacagtaccagttttctgaggaccatgatgtggaatattttcttcggctggctcatgagctgggactgctggttatcctgaggcccgggccctacatctgtgcagagtgggaaatggtgagtgtggctagactgggctctacctggtgtgtgtgagctggcaggcagcagctctggggcaaagggaattaaagcagacctgcattccagagagcatggggcctgggactgtacccagcacaggtgtcttttaccttgacaaggtgcccaggcagagaaacaggccagggtcagggcatgggctctcctcttggtggtcactcacatacctcagcttgctcatctgtaagaagcagttaatggtgtcttctctatctacgtcacagggtatttgtgaaattaaattgaaaaatctttatgaaaagggctttggtccttaaaacattgcattcatgcagagtgatcttaattgtcctacattccaatttctaatttctctgcaagttataaaccaaaaagcccagctcaaataccccttgtcccttgaagcttttattcttttccataactactaatagtaatttctatctcctctgagcacccttcacggaacagacattataatggcttgttttccctgaactagggaggattacctgcttggctgctagagaaagagtctattcttctccgctcctccgacccaggtaggttgttacagatgtcttgagaagatttataaaagcttcagcctaggtgcggtggctcacgcctgtaatcctgacactttgggaggctgaggcgggtggattacctgaggttgggagttcgagaccaggctggccaaaatggcaaaacctcgcccctactaaaaatacaaaaaattagctgggcatggtggtgggcgcctgtaatcccagctactcaggaggctgaggcagaaggattgcttgaaccctggaggcggaagttgcagtgaaccgagatcgtatcaatgcactatagcctgggtgacaaagcgtgactctgtctcaaaacaaacaaacaaacaaaaaagcttcaacaatttatatcaaaagggggaggtattttgaaggctggggtacctctgcacaaatacttttgaaagtttagtgaaagtctgagtgtttatcactgaccagtgcatagcaacaaactaaacctctaggaaattaggctttgaactacgtaaccagatcttactgataaactggtaattctttgaattggtattgaaccctgtttgcggttgaccaactgacttcagtgctttctcttcctatttacttagcatattccacagccaatgatagcacctcgctaatcaaaatgacaagtcaggcatggtgactcacacttgtaatctcagcactttgggaggccaaagtggagggattgcttgagcccaggagtttgataccagcctaggtaacatagcgagaccctatctctataaaaattagccaggtgtgctggcacatgcctgtagtccgggaggctgaggtgggaggattgcttgagcctgggaggttgagactgcagtgagccatgattgtaccactgcactccatcctgggcaacagagagggactttgtctcaaaaaaagaaataaggtcgggcgtagtggctcatgcctgtaatcccagcactttgggaggccgaggtgggtggatcacctgaggtcaggagttcgagaccagcctgaccaacatgaggaaaccctgtctctactaaaaaatacaaaattagctgggtgtggtggtgcatgcctgtaatcccagctactcgggaggctgaggcaggagaattgcttgaagctgggaggcagaggttgcagtgagcccagattgcgccattgcattcctgcctgggcaacaagagcgaaactctgtctcaaaaaaaaaaaaaaaaagaaataaaaacaaaatgacagtttctgggatggtgtcattggattgcttggtagctgcaatgccttctatattctggccacttttatagagcaatgtgtaaatgatagtttttttctttgtcttactccagtaccttcatgttttgcacgcttagcatattattggtgttttcactgtggtaactcatttaatctttatgccaactttatgtggcatgtacatttattattcctatttgacaatataaatatagaatttattagaacttcattttatacggaaaaaaagccttcctgtgactgagaagaggatacactgttcagtcactcttttcttcattcagcaaacattgcttggatatgttctatgctccaggctttgtgtcctgtggcaaggatggtcttagtctgttttctgttgcttgtaacagaatacctgaaactgagtaatttataaagaaaagcatttatttcctacagttatggaggccaagaagttcaaggtggaggggctatatctggtgagggccttcttgctggtggggactctgcagagtcctgagggggcacagggcatcacatggtgagggggctgagtgtcctagctcagatctctctccctcttcttataaagccaccagtcccattcccatgatgacccatgaatccattaacctattaatctattaatccatgagtggattgatctacttatgagggctgagccctcatgactcaacacctcttaaaggccccacctctcaatactaccacattggggattcgatttcaacatgagtttcagagggacaaacattccaaccatagcagatggatacaggcacactggtcctcgtcccctgaggagctcagctgaggagacaactacatgcaggacaacttttatgagacttttacttcagaaggtacttgtcgagtcctgtatatcctgatctctgctgccagccctggtgtaataaggctgcactggtgtctctttgtactaaatcataattttttttttttttttttttgagacagagtttcactcttgttgcccaggctggagtgcaatggtgcgatcttggctcaccgcaacctccgcccccccgggttcaagcaattctcctgcctcagcctcccaagtagctgggattacaggcatgcgccaccaagcctggctaattttgcatttttagtagagatggggtttctccatgttggtcaggctggtctcgaactcccgacatctggtgatctgcctgcctcagcctcccaaagtgctgggattacaggcgtgagccaccgcacccagccagaaaactcagaatgtttttaaaaagtttacgaatttgtgttgggccacattcaaagccatcctgggctgcatgtggcttacaggctggggttggacaagcttgtgttaaacttttcttgttttccagattacctggcagctgtggacaagtggttgggagtccttctgcccaagatgaagcctctcctctatcagaatggagggccagttataacagtgcaggtaaccctggagttgagcatggatggattgggggaggggttcccatccatctacattacataaatgatagaagtgatgcagacatgagcctcataggtctgtttctttaagaggtaatgccacagatagtgcttttagttcaattgcatttgggaaggcattgccatttttgaatgcctgctatgtggcaggctttgtgctgggtgccttgtaaatgctattcaattcttccaaccaccttcttttttcagtgaggaagtttgaaaaggttaagtgacttggctaaggtcacccagccagcaggtggcagaattaggatagcaccctaattctgtggatcccagagtttgtctctctgtttctcctgcaatattgttttctggcagcaggcatgcagcgtggactgaaacactttggtatcggcactgccttgacagtcagataaccctggaatggaaaaggatatggtcaattggggctggctgttatgtttcctctcttacttcctgccccattctccttcttctatgtgttcttggctctgcaaggactaatatactgtggggtacattgaactttaacagtttttggtgttggtaaaattacttaggtgaaacataaaaccatgttcattggacattgaccaaggatgccatggatgctcttttttttttttttttttttttgagagagagtctcattccgttgcccaggctggagtgcagtggggcaatctcggcttactgcaacctctgccttctgagttcaggcaattctcccacctcagcctcccatgtagctgggattacaggcgcatgccaccatgcctggctaatttttgtatttttagtagagacggggtttcgccatgttggccaggctggtctcaaactcctgacctcaggtgatctgcccgccttggccttccaaagtgctgggattacaggcgtgagccaccgtgcccggctatgaccaaggatgctcttatggaaaagagtaaaggttttttgtttttttttttaggagacagagtctcgctctgtcgcccaggctggaatgcagtggcacaatctcggctcactgcaacctctgcctcccaggttcaggcgaccctcctgtgtcagcctcccaagtagctggcattacaggcgtgcaccacgatgcctggctatgtttttgtatttttagtagagacagggtttcaccatgttgaccaggctggtctcaaactcctgacctcaggtgattcacccacctcagcctcccaaagtgctgggattacaggcgtgagccaccgtgcccagctatgaccagggatgcttttatggaaaagagtaaagttatgtaaaagtggctgcatcctggacatcccagggatgcaaagtggcactccctaggggagtgtgggccaggcttccttcttatgaacagtactatgggcagcttgtggggatggatcatagtagggtgggagcatgggcactgctttgcctttcaggtgtcggtggacagaggtgctgagagggctgcactggccagggtgtccgttctgaggctttgtggtgggaggagatgtcttcttgagagaggccaggttgctgctcacagagggatgtgtgagtcaccccacgtgcccctagtttttaccatcttgtgtctgtactggttaagctaataggaaccacattttcctacatgaagatatcaagtctgaaacttgggtgcgtctttgctctgcatggctgtgtcttcttcctttcttctggcctcaggtgcaaaccctcttttgatgccctctttttttcagtctctgcctctccttgaatcactttcaatttctgctcacaacttttctgccccttttggttttggaaatgccacaaaaagtataatcaagtattaattctgcaaaggagaatgaagttgactgtgtggagatatttcttcttgtgtccatccctagcaacctcagatgactttaacttgaccctgggtcctgccaggtgactctgtccccctcctcctcctcctctccccttcccatctccacatgcttgaatcccactaatcatttttgccccttgtttacaaaataaacaagtatagacataagaaagcagaaaaaacataattgttactcaaacctcaggagccatagcaaagctcttcacattttgggagtttccttgaatattttttatgccttttttttctgctttcttacagagtaagttcattctgtgtgacctattttctgtgtggctttttttgcttcattctttgtcatgagcactttttcatatcgttcaaaattctttcatcatctttcatggttgtcctacttaccttctgacgcacagttcctatacgtgttccttctgtctggaagccatcccagttgacatattggcttccgtaggactttcagaaccgtcactgtcgcctccttttgtgaagcacatgtgggagcagtttcatccctgacacactgtgtctctagtctcctggccttccacgcctctgcctggtagccatgagggcacatcatgcatttgtgcacatcacatacccaccgaacggctctggaatggaatagaagctgattgctttgataagaaggaaccgggggatttgtagacagtaattcttttcgttgttgttattgtttttgttttttgagacagagtctctctctgtcaccaggctgagtgcagtgatgagatctcggctcactgcaacctccacctcctgggttcaagtgatcctcctgcctcagcctcctgaatagctgggactacaggtgcgggcaaccacgccagctaattttgtgtatttttagtggagatgaggtttcaccatgttggtcaggatggtctcaatctcttgacctcatgatccgcccacctcagcttcccaaagtgctgggatgaaagccatgagccactgtgccaggcctgtaaacagtatttctgtgtgtgaagatttctgtaaaagggccaaggctgatggctcaatgcccgtaatcccagcactttgggaggccgaggcaggaggatctcttgagcccaggagttcaagaccagcctgggcaacatagtgaaactccatctctacaaaaaatttaaaaattagctgagtatgctgccatgcacccgtgttcccagccattcagggggcagaggcaggaggatcacttgagcctgggaggttggggctgtggtgagccgtgatcacaccactcactgcactccagcctgggcaaaaaagtgagactctgtctcaaaaaaaataaagatttctgtaaaagctgatttctgtctctgtcttaattcatgttgaagggtagaaaatggtggctttcctcaattcttgatgctggttttctctctcagtgctcagagtttgagatggccagggaggagctacgtgtttgcagccagggtaaaaatgagtcagaccagaaggcttaaatccctgtctgagaacatttagggccctcaacactgttgtgttacagatacaggaaaccaggtctgtgcttttattcatcgtcatgattcagtcagatatgcagatgtttctcttttggggggattagctgagccagtgccacctatgatggtttgcatatgtggatgtttatctcagtttctacctgaaaaagctaaagccattgataatatccaaggtgaaaataattaggagtggacgaccttccacccacaacttaacttcatccaattaacagggcattcatcatgaggtaataagcctatttatgactgtttggaagatcaacatctttaaaagtctctggtgcttaaggagcttacagaatggagacagttactctaaaacaaagacctgcaaattatggctgccacctacatttttttgtaagtaaaagtatattggaatcgccacaccgtttatatatcatctgtggccgcttttgtactatagtggcagagttgagtagttgagatggagacctctatggctgcaacacctaaaatatttactctctggtggttttttgtttgtttgtttgtttgtttgttttctctgtcacccaggctggaatccagtggcgcaatctctgctcatggcaacctctgcctcccgggttcaagcaattctcgcacctgagcctctcaaatagctgggattacaggcacctgccatcatgcctggctaattttttttgtatttttagtagagatggggtttcaccatgttggccaggctggtttcaaactcctgacctcaagtgatccacccgcctcagcctcccaaagtactaggattacaggcgtgagccaccacgcccagcctggtgttttattcaaaaagtttgttgactcctgctctagaaacatcggtgttcctctgaacctagccatgactttttctatgggtttttcaagccttttcatttgtgtgtctcacctacccccagccttcacccacctttttttttcctaattggtagtaacatagaacttgagtagagtcttagctgctaacattttgagcacttactagatgccagatctgtgcaaggttctagtcatgtattgactcagttaatcctcatgataacccatcgagttaggtacactttacaggtggagtcccatgggtaggaagtggcagagctcagatttacatgtagacagttgggcccctgccagccgtgcctgtgactagaactctaagctgcctcgcaattgtgcttttctcgctctctcaaaacctaaccaaattatgtgtacgcattttttacaagcctgtttattttagagtatatgatacaatgatgataatggataaataagacctggaaaagcaagatgataagaaaaccaaggttgggtttgggcatgggggtgagctcaagagaacatgaggtacagaggctgtgagaccatttagttgctggagctaacttttaagatctttagctctgaatttcttgacagccagatgataaaaaggagacacagtcatgtaagtagcacttataaaggaggagaaaagaactttgccagtatttacaaagcttttcttagcatttatctaaattattgcaaaaggaactttcatggaactcatcaatgggagttttctactcttgtaagcagcaaatacttcctcttccaggatggtttcatgaccagtgaagtctctgtcctgggcatgcgtgctacagtctgttttacttcttgaaccccaaatctgaaagtattgccagagggatcctctctgagagaaggatcattcatgaaaccttgtgggaggcaggactgtgcagataacgacggcagcatttaattcatttttgtcactcaccattcttctcccactctccaactctgcacgtggatgaaattgagctgttggtgatgtcaaatatgtaggaatatcctctacccattcccttcccaagttcagagccttttcttctagagctacctcgggctgtccctccaaggaaccttccctaacaatctctcccaggcactcaggctaagcacctcttttctgggactcacagtttcttgtgcttacgtttaaagatcatgtattcccaggatcacaaatatttttgtattatgtgcatgttaaaatgttatggttgggtattttttaattttttataaatgaaatatagcatacatacgtaaatgcgcagtatgatgaatcactatggtgtgaacacccacataaacaccaaccaaggtcaggagacagcacgtggccagtgccctagaagcttcccaggtgtccttgttgatcatacaccatttcgtcccactgtcctgacgcttatgaccatcagttttctgcttttctttatacttttaccacctatgtgtgtactcagactttatagtttggttttgattgttttgaattttctctaaaggggattgtactgtatgtatttttcagtgtcatgcttctttcacttcacattatattcctgattctttggtgtattgggtagagctgaagttcatttgttttattgcttcagagcaatgtttcttaacctgattttttcatcattgcccccaaggatcccttttaaactttttttctaattgccttctcctctccaccatgaaattttattacctgagatattgtatattggtttatttgctctgtgtgtgtgtgtgtgtgtgtgtgtgtgtgtgtgtgtgtgtgtgtgtatgttttatataaataaggaataattttttttatccccaaagcatcaatttttacccccttggggatgctacccacctcactgggaatgcatgcttcagagcagggaccccaccctcagcactattgccatgttgcacctgataattcttcattgtggggcttccctgtgcactgtgggatgtctggcagcatccctgggcctctacccactggatgccatgagcatgtctgccgaggtatgacaacctcaaacatttccagacatagccacatgtcccctgtggggctaaagagctcctggttgagaaccaccgatgttattgagcacaaactgaacaccggtgtgtgtgtgacagcaggtcaaataaacatgctgtgtctgtccctggcattcacccttcttcttattgccatggagattttgcatagtatattaagggaaaacacaattacaattggtgcatataatatgccagttttgagggaagaaaacactgctgtatattatttgcgtatatttggggagtgtgtgggtctgtgtaaatctagacggctgtatactaaaatgcttgcagtgattatctctgggcaatggaattaatggatacttttcctgttttcttttcatttttctagcatttctaccatgggaaggtattatttatgtgatgtttaaagtatctactttctattctagggaagaataccactacaatctgaacaccagtttggtgttttttgtttttcttatttctcagtggtgggagagggttaataggaggtaaacttttatggtgaattgttggtgttttttcttttagtcagttttgaggtctgagtgaaggaaatttttccagcagtcattaagccttgtcatcttagcagatgctcagatattttcccacacaaaagcttgcattagggtggctacattaggatctcctcatttttccctgctcttttttcactcacaggttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggttggtgtttgtagtaacagaaattgcagcttaaaatcagctttttactcagtcagttgctctgggcagctgttgttataagtgtcatgggcagattgagatttttcatgttttcatttttcaaggaacaggtagaatagaatacttgcacccctcagtaacagagggttatctgtaggccaagagcttccagggtagctgcattttcagcactggtggagctagcctggaaaatggagtactgctatctcaggggctaggctggcccacccaagatgaagaagcaggtaggcatctccagctgtgagaagctctaccttgaggcagtcaccttttaggctgtgtctggggcgcgcttctctgctctttctgccctccctgtcctcccaccttggcaggacactcggggttatgccttggctgtagccaaccttgaggtcagccactggctgggaacttaccttatgctttgttgtctttctgcataacttagaacactgaactgtcagggctggaggtggtttggcagatgctacaaaggctatgccagattccttacacagtgctgtgtaaactgtggagatgctgcaagtgaaggttacagatgggtgggcaatgtggttaggatgcttctggccataagtaatattaagagagacttcatttaggagagtggctttcataaaggatatgacagctgtattcgtccattcttgcactgccctaaataaataccagagactgggtaatttacaaagaaaagaggtttaatggactcacaggctgtataggaagcctggtggcaacagcttctggggaggccttaggaaacttaaaatcatggcagaaggcaaagggaaagcaggcacgtcttacatggacagagcgggaggaagagataggaagggaagtgctacatacttttaaacaaccagatctcataactcattcactcactatcaggagaatagcactgaggggatggtgctaacccattcacaagcactttgcccccacgatccagtcgcctgccaccaggccctacctccaacactggggattatagttcgacatgagatttggtggggacacagatctaacacagatccaaaccatatcaacagctaaatgtctgactggactttttttgtgtgtgtggctatgaaagacattattgagaaattgcaatctttgaataaagtctgtagattagataagagtactgtatcagtataatttcctgatttttagaagtatattgtgtttatttaaagaatgcctttgttctgagagaatgaacactgatgtatttagggataaagggccatcacatctgcaatttattctcaggtggctcagaaaaatgtatatttttatagagaaactgatagtgtatatctagtaaaatgctaacaattgggaaatctaggtgaagggaataggagagtttttttgtactattcttacaacattctgtaagtttgaaatcactgcagaataaaaagttacaggctaggcatggtggcaagtgcctgtagtcctagctactagggaggatgaggtgggaagatcacttgagcccacgagttcaaggctgcggtgagctgtgattgtgccactgcaccccaagctgggcaacagagcaagaccctgtctcaaaaaaaaaaaaagatacacacacacaaaaaagaccagttccttgagtagcataaagaccctgatgttctcccctctgaggtaaaaggcacttcatgtgcattgcacagccaatgtttgcctctcttaagagggatgtacagaagactgaaatgaggaaattagcctggtgttgctttttttttttttttttttttttttttttgaggtggagtttcgctcttgttgcccaggctggagtgcaacgacccgatcctggcttactgcaacctctgcctcctgggttcaagcattctcctacctcagcctcccaagtagctgggattacaggcacctgccaccacgcctggctaatttttgtatttttagtagagacagggtttcaccatgttggcccggctggtttcaaactcctaacctcacatgatctgcctgcctcggcctcccaaagtgttgggattacaggcgtgagccaccgcgcccggtctgtagtcacattttttaagaggttcttctaccttatcaaaaaagagaagaacagaaaagaactgaccttaagtgaatggagtgtttcgagagcatttggtgataaaaggactcatccgttaggttggttaggttggtgcaaaagtgattgcagtttttgccttttaaaaaaaaaaaacgggcccagcgcagtgcctcctacctgtaatcccagcagtttgggaggccaaggcaggcggatcatgagttcaggagtttgagaccagcctggccaacatggtgaaaccccatctccactaaagatacaaaaattagctggtacaaaaatcgtggtggcgcacttttgtaatcccagctacttaggaggctgaggcaggagaattgcttgaacccgggagccagaggttgcagtgagctgagattgcgccactacactccagcctgggcaacagagcgaaactccatctcaaaaaaaaaaaaaaaaaagaaaagaaaaccatgacaaaaaccacaattacttttgcaccaacctaatacaaagcgctgcagaggaagtgacatgccggtttcctcctgctttggccaggcttctcatcacagcgatgaaaaagcacggcatttttctgttgggaggaacaaattgaaggtgattatgattgtgttttaagcataatttgtatgtgaggtgacagcgtgactgtcactgctaggggttggagaatagacaaccacaaggccagggtgcctggggcagatgggccctccagtctgaggcttttgccagcttcattgctttgtgtgggagaggggcattgcccgatgggtctcatgagaacagtgtttaaagagctgaatgccacctaatgcttaatagtgagaaagacagccaatgagattctgctctttctcaatcagcatattctgtcctgaaagctggccttacagagaagccaaaggcccatctcagagcaagtggttatcagagggtcttggctggggccacgtccaccctgggatacctgctgtgggaactgggttgtgaagtgtggggccagggcattctctgctcgggttggtgtggacactgctcatgcttcctctttccccagtgtttggcagcccattccttctctgtggagaaattcttttttgttttagaggaggaagggaaaatagaagacacgagaggcaagacaagacacccctaatgggacatttcatgaggaaaacttgagagcaagtggtttggaatggctgatgtacaaattagaatccagagtatattccattattcaggggtaaacacaattagagcccccacatccctttgatttcttaattaactggcaaatatttgtggtagtatcatgtgtatggtgttattgaggctgtaagtatcttcaaaccaggctcatcctgtggggtgcatccaggtcaaccagatgttcttgtgaagagataagcccacaagatatgtgtccaggccctggggaaacacagataaagaagacaggcctgtgaagggaactcttgtgcagacaggaaaggccacggggacctcctcagagaggaagcaatgttctctggtccacacacatcttcaaatgggtccaatcagaagctagcttggaagtattccaggcccatggggtgtgggaagggaaaggggcctgtcttagtcagtgtgggctgctataacaaaatatcttagactgggtaatttataaacaaaagaaatttattgctcacagttctagaggtggtgaagtccaaaattaagatgccagcagattcagtgtctggcaagggcttgctctctgcttcaaaaatggtgccgtgccttcttgctgtgccctcacatggtcaggaagctccgttgagcctctttttatttatttattattattattttttttaataaaaaaaatatttttgagatggagtgtcactctgttgcccaggctggagtgcagtggcacgatctcggctcactgcaacctccacctcccgggttcaagcaattctcctgcctcagcctcctgagtagctgggattacaagtgtgtgccaccatgcctggctaatttttgtatttttagtagagatggggtttcaccatgttggccaggtggtctccaccatgccaggctggagtctgtttttataggggcactaatcccattcatgaaggtggagcccttatgacttaatcacttccagtggcctcacctgttaatactatcatcttgggtgttaagttccaacatgagaattttggggggatactaacattctgaccgtagcagggcttcaggcccgagtcccatgaagggctcttgttatttaacttcttgtcatttccacgactgacctaccttctccctcttacaattttcaggcagcaacatcacagatgctttcctaagccagaggaagtgtgagcccaaaggacccttggtaagaatcgagggtgaggtgtgtgtttgcagctgttaagagagaaaagttacatgctgctgaaactgggcagtaggcccttgatgtttttggctctggagtcagcagctaatgggattgtggagtcatagccattctggacatgtgaatgacagcagaaacaatgtttctatttgaaattgagctcctgcactggggtggaacagactggggaccaacatgaatggcctgttacacatcaggttctgtgctcctgcatcctggtctcatctggtcctcagggcaactctcataagtggtcttattgtctccatttttattgaggctcagggaacctatgtcacttgccagggtcatatagccagtgtgtggctaagccgggatggttggcaagctgcaggtgggtgtcaacaatctatcaatccttctctctccgttcttcccgtctttggctgaagttgctattcttgttgtcactcagcccagtttaaggggttaatatcctgcgccttctctgcactaggtcagactgccccacctgtgtacaagcctgatttataaaacagccttttctgagtctagtctctgcttagtgagcagtgcagaccctgcattcatagactttgggtggagctatttcctggaacctaaaacaagaagtccccacaagaaggtccagacttcttttttgttctctagaccaaggcttggcagggcaatgcccaagaaaaacatgaagtgtttgaggcctgctttgcagaatactgggacaagccttcctcgttataaatcaacctgagatctgaaaatctggattcatacaaaggttgaatttggagctgttatttatttatttatttttaaatggagtctcactatgttgccagactgtagtacagtggcgcgatctcagctcactgcattctccacctcccgggttcaagcgattctcctgcctcaggctcctgatagctgggactacaggggcgcaccacgatgcccagctaatgtttgtatttttagttgagatggggtttcaccatgttggccaggagggtctcaatctctagaccttgtgatccgcccacctcggcctcccaaagtactgagattacaggcatgagccactgcgcccggcctggagctgttattctataaaaatattttgctacccagtttctttgcccaacaagactttcctactgtgtttaaacaggggatcagctatctaaattttaatataggcaccacttttcaggaatacttgcattgtataagatgagatctactttaggttagaacctgaggactgaacataggcattgctggtattggaagtgctcactggggggcgtctctgggttaagcagtgcatgtcagcatgtcaaccccctttacacctgtcatagatggggcattgcagggaagccctggcattggaaggtcataagtctatcctaagggctacgttctttttttgttttagatcaattctgaattctatactggctggctagatcactggggccaacctcactccacaatcaagaccgaagcagtggcttcctccctctatgatatacttgcccgtggggcgagtgtgaacttgtgagtgttcattgcctgaggggagggtgccctcagtagccatgggctcacagtgaagtaccgtgttcttttgtttccttgtaggtacatgtttataggtgggaccaattttgcctattggaatggtaagagcactttaatatctgtagaaacttatgctagaatgtttctgttgattaatttgaggaggggtgtgcccacagacaattttattttcctttttttgtttatcctctcctaaattttctttttttttctttttcttttttttttttttttgtagacagtctcactctgtcacccaggctggagtgcagtggtacaatctcaactcactgcagcctccacctcccaggttcaagggatcctcctgcctcagcctccaagtagctgggattatgggattacaggcatgcaccaccatgcctggctaagtttttgcatttttagtagagacggggtttcaccatgttggccaggctggtcttgaactcttgacctcaagtgatcctcccactttggcctcccaaaatgctaggattacaggcgtgagccaccatgcctggccctaaattttctaacatataaggattacctatgtaattttaaaaaataatatttcttactttttttttttttttttttttttgagacgcagtctcgctctgtcgcccaggctggagtgcagaggtgcaaatcttggctcactgcaagctctgcctcccgggttcacatcattctcccaccgcagcctccagagtagctgggactacaggcacccgccaccacacccagctaatttttgtttttgtatttttagtagagacggggtttcaccgtgttagccagggtggtctcgatctcctgacctcgtgatccacctgccttggcctcccaaagttctgggattacaggcgtgagccactgcgcctggacaaaataatttttaagggaaataaatgtgagcatttagaagccttactgttttaaaccagggtagttgggcaggcttcagtcacagtctataactgtagcttatttgttcaaatattctactgtggtctctttcttttaacgttttgttttgttgaggtataattcacaaaccataaaattgacaatttttaagtatatgatgcagtggtatttactgtattcacaaagttgtgtaaccattaccattatctaattcagaaacattttatcaccccaaaaagaaactccatacccattagcattcattccacactctccctcctctcagcccctggaaataatatactttctgtccctgtgggtttgccaattctgaacatttcgtataagtgaaccacatatatacacctgtatgacttctttcatttagcccaatgtgttcaacgctcatccacgttgttgcacgtactagtgcttcattcctttttattgctgaatagtattcccttgtgtggatgtacagtattttatttatccattcattggttgatggacatttgggttatttgcacattttggttatagtgttgctttgaacattgatgtacaaggatttgtttgaattcctgtttcagttcctttgggtgtataccaagaagtggaacggctgtgtcatatggtaactctatgtttagagtttcaggaactgccatagtgtttcccaaaaaggccacaccactttacatttctgtatttttttgtgtaggaaaaattatgacaaaatttttctgtaacgtctttgatttttgttgtttttttgcaaagacagatgatgctgtactggcttttcgctaagcttcatttcccacctgtctctttatttgcatttttctctctgaatcatggaggatgcccagctgttgagttttgaaggcttagtttgggcctaaatctctcaggatctgaaattggatactatcagctcttaatgaagtttctcctttgaactgctatcttttttgcaggctgagatgggctaggagaagacatcgcttacaagcattatcaattttaatactattagtagagccaagaaatgaagatattgcaaaactcaaatgtcactgcatataagataatagtgtgcctggggcgtgtctgggtgggtgaggggagggagagcatcaggatgaatagctaatgcatgcagggcttaatacctaggtgaccaggctgggtgcggtggctcacgcctgtaatcccggcactttgggaggctgaggtgcgtggatcacgaggtcaggagtttgagaccagcctggccaacatggtgaaaccttgtctctactaaagatacaaaaaattagctggttgtggtggcgctcacctgtaatcccagctactcgggagactgaggcaggagaatcacttgaacccaggtggtggaggttgcagtgagctgagatcgtgccattgcactccagcctgggtgacagggtgagactttgtctcaaaaataaaataaaataaatacctaagtgaccagttgataggtgtggcaaaccaccatggcacacgtttacctatgtaacaaacctacacgtcctgcacatatatcccggaacttaaattaaattaaaaaaaaggaaaagataatagtgtgccaaggttggtcactgatattttagataatccctctgtgttcatcttatgagaaacagttgagacctggtgggtgcctttttcacttagtagatggggattccccctagctgccattgatgggatcgggaccaatcatccgatccaggaaaaaaggcatcgtttttggaactttatggttcatgacacaattttttaaaaatcttactgttatacttaaaataacacattcatcttaaaaaaaaattggacattatagaaactgtcagaacataaatgttgtccttaatcctctctcctgcccctccctctgccataatccatagaattcccctttcttcctctgttgccttatttagcctgcatattagcctcatcttaattagagattatcagcaccacttttcagataagaatagctgaatacaaaaaaaagtccacacgttttctgttcagctggcaaggggtgaagcttggactggaactcaggtggtggtgagccagagtcactgcgctttggatcaccctttgcaccctggagcccctgagccagcccccacacccaccccactgtgttctgccaagcctccctgaagctgctttttgccctgtctctttgaggaagtgagagaaggccagtctgtacttagcagctgttcttcaggccagcttcctagaggagagcagggagagaaaggcatcaggagtggggagttcactgcccatcccacccacaggaacatgcacctgcctgtgcaggtgtgtgtctccttcctccacacctgtgtgtgtccacagctgtgtgatggctgcctacagggtccaggcgctcctgtacttctcacacaatgtggaatgttgatgaatgcaaagtctcaccatttctttcaccttcccacctcacaccctcttaagtggccagaggaggcttgaatctgcaccatttctctgcgatgctgccctttggtggtctaaaaacacccaaagtaagattctgccagtagaactagaacaaatacttagtcttccaatccatccttaaacccactggacagcttcccagcctgggctccctcggcctgtaaagtgtgcttctagaggtcacactttcccaactcaacctggcaaccccctccatgctgggctctggctaaggactcaagggcaagtgaggcacagtctctgcccctgaggtgcaagcagtgtagcatggagagagacataacaaataagaaacacagcacagcatgggtgactaccacattagaagcagacgagggccacaaagaaggtgagttccttgcagcaacggatgtgggtttttttttttctttgtgtctcacaggaagggatgtgttttaacctatgaatcccttaaggcaggcagacctgttggctgtgagttgtctctgattaataagaaatgggggaaatggtatgactagatcagttcagttggttgagtggtccagatctttcaaagtttagattctgtgcagagaactaatgaaaaagtctttggagctgacctgcttgatctgatcctcagccttgctcatctgtcacctccacaaccagtaggtcacccaaggtggctccatcattggtgagctgcatccaaggaatttattactaatcctaggtaaactatcatgttttgtgcctcattgatgtacaaattaggttggacaaaagactattcctaaaataacttcattctcacacacttgcattgcaatatgctctctgaagtagaggaggaaggcacaaagccttgctggtctatggatggcagcatcagcgtcacctggacacctgttagaaatgcagtttcaggccccactccagacctgctgaattagaatctctgggatggggcttaggaatctgttttaacaagctctccatgtgacacttaagcatgggtaagtttttgaagtaccacccaatgttgcagacaacctcatacctgtgaacatcatccctgacaaggtcgggatcctctggtctagaccccgccccttgcacagtgactgcaggggcatttgtttttctagtccttttgtatactcagtgttggcattatccattggtctttgttgtaggtcaagttcccagggaaacagactctgagattacctggtagaaagcttattgattgtgctctctggagcaatgcctgtaggatagagagggagaagtggggctatgatgcagcttcacaagtggcctcatccaatcttagagggagctctgcagctgggttggctgttcgaggcacattggtcagttgttggatgtgggctatccctgagggttgtaaccttgggtgaggcagctcagcacaggccagcacccagagacggacacatctgagaaatgtcagcagacaacagccctagctgctgggagaatgagtgagtgccctggttctaaagggggatccaagaggtgcaccacagccccatcgacagtctttgtagatgcaacaaaggccctcggattatgtttgaacctctgtggctgatgtgggtctgctgtcatctcccgctgtgtttggtttaataagccctgggttttctgctgatccatggcctagtcatctgtgtcttcaccactgagcttttctcagccacagcttgaggacgtgaaaaagttcagagttgacaggattaacagtcagagatgggggtcatatcataagccctgccattactgcttgtgaggtgttagcagatttttgtggggagcttcagattccctgcttgtccagtgggggtgatacctgctagaatcacagctgtgagcttctgtagagagtggatggaaagagtccttggtaaactctaaggtgcctggtaactgctacctgtagaaagaaattccttcctctaaacgttgcatcctgagggtcacgtctgtgtctcccaacaagtggttttaatgtgtcttctagttttctctctctacagtgctgagctcatggatcccaaagaacttgtcccagagctgcaccatcagtaataactagtggcacatttttgtcttctaggggccaactcaccctatgcagcacagcccaccagctacgactatgatgccccactgagtgaggctggggacctcactgagaagtattttgctctgcgaaacatcatccagaaggtgggtgctttgtatgagctgtggtgggctgatcttggacagagcctcttttgaactcactgtggctctgtggacaacttcctgcctggagccctcctgtttaaaaggatggatgaagggaggcatcagctagacttgggtttgcatcttgtacccacgtggttaagagtgagtctatgagcagatgcttataggagagtaggagatataagacatgtatttaaaaactgcaatatataatacagtgttaaatgctacttacagattcacttcttatatggtgagaattcacccggggaaatttctgtctccattttcttctccttccaggccagattatctttccaaaagttcaggtgagaggtagggtgatgggagagaatgcacagatcctcttgagactatagcccctattaaggcagcatggatatatgggagcccctatccttgagacacagctaatgtacttcaatatcaaaagaggtaaagctaagctctggtttctttatttaatgcatcatctgaaaaaagtaagtttccagtaaccaaagtgtataagaattatttctcactagaaaataactccgtccttatttgcaagagagaagaagataaactattttcctttttatgtgtggcccaatatacagactatgtgatttcagaatgaggaacaccagattttgaacctggacactatttcttcaaccttaagccaattgtgtaaattccctttatataaaagtagaggtagccgtacttacctcacagacttgtacagtttaaaaataaatggcactcaataaatgtttgttttcttctttcatagtcaaataaatgaacaataattatttatttacctaaaaaaaaaaaagagtgagtctatgagcaaatcagtctactgattgttaatttgtaaaactgggattacagcatctggttgtgctgtaaagcttgaaaagaacgtatgtaagccatccaggacagttcctgacacatatatgtctaataagtggtagccgttaactattatttatcttaaatgtaagaaaatgtgtgtctacttaaatagctgatgtacataggaaaaaaaatcttcagatactgtgaagcatggtgcagatgtcagctgtcagtgaagcttcatttttctatttggagcaagtgattgctgtttctggactgcatctgaactgcttagtcctgctagcgttgtacccttttgaggcacctaatgcacctaggtggggtttcctgtctctgctgtgggttaaaagaaaaaacccacagtttttatgctcagtcacctgagttttgaagttaaaaaaacaaaggttttctgcctataaatggtatggttttttttgttttaagtatgatgtcgttttaattttaagcatgtgttaaaatgaatattacaaattttttaaatataaaaaatacaatctagacttaccacacttataatttgtccatttcatctaaattttcaaatgtattgttaaaatgttgcttatgttattcctttattatgggtttaatctccacagaatttatagtaatgtctcccaagctctcccttgtatgtttgttctgttttgaagctttctgttcctatctttattatttccttcctttatttgaagcttagctttttaatgcagcctttcttcttttctaatataaatatttaaggttataaatttccttcaagtactgctgtggctttatctcgtaagttttgatgtgcaatctatttcttactgtttgcttctaaacatatctattttgatttctcttcaccattgatatgtgttttttaaattactggaaataagtactttcctgtttttttgatttctagtctttttgcattctggttagagaatatagtctgtgataccaatcccttgaaagctgctgagcctagtcttagagcctgacatacaccaatattaatggtcaatgtgcgcataaaaagaaagtatattttacagttgttgactatattctacatacatgttcatcagattaagtttattaatggtgccattgatatctttgatctgcttcctaattttttgtcagttcagtctactatttagtgagagttgtcctcatgtatttccctttgtagctctgccagttctgaggttatgttattaggtgggcaaattgagaattacatccttcagtacttaatagtaaagggattatataaccctctatttctaataaggctttttgcctggaagccttttttttttttttttttctttttttggtctgttattcattaacaccatttacctgcatacttttgcttggtatttttctgaggtatctttcccaatgctgtaatttcatcctttttatatcctttgttctgtttacatgtgtcccttataaacaggatataatcgaatttttaaaatatctagtttgaaatttcttgtcttttaactgatatatttatacattctcattcattgtacttcttgatatacatagatgaatttcaattatcttattttataatttctattcgtttacctttttggctctttctttccctttattgctttcttttagattgaggttttttgttttgttttgttttttcctcttatttctttcccccctcttctactttggaagttattcactgcattctaatttttttagtggttaccatttaagtgtgacatctatacccccagaaaagaacaactcgtagtacacagctcagtgaatttaggcaacgggagcgcagccctgtgacaaacacatagctccccggaagcccctctaatgtccctctctagtcattgacacacatacccattcctgagctcacagctgtcctcacctctatcaccagagattcattttgctcgtttttaggcagcaagttcctacaatatacactcctgtgtctggctgtcttgtaatagtttaaaattaatcaatatctttactttctccatattgcatccctctttaacttactgtaactccaattacagccctcttgatttgtatgttattattgtcatgtattttaattctctgggtttagttttcatgtattttagttctctccttaaaaaataaaacccatggggcattactacaatggcttcagatagtatttcacttgacccacatagttcatttattggcaaatgatttaacaaacattcatcaagtactctgcatgcgccaggttgcagttttaggtgcttggtggctgtaggctttcctgaaaaggtggagctcaaacaaaaattttaaggtggtgagagagccatgtggcatatctccgcctggacaagagcattccaggcagaatgcagccagtgagaacttgggaaggtatatggcatttttaaagactagcaaggaggccagtgtggctggagcccagtaaatgaaggggtaagaagtaggagaggctgtgcgcggtggctcacgcctgtaatccaagcgctttgggaggccgaggcgggcggatcacgaggtcaggagatcgagaccatcctggctaacacagtgaaaccccgtctctactaaaaagacaaaaaattagccgggcatagtggcgggcgcctgtagtcccagctactccggaggctgaggcagaagaatggcgtgaacccgggaggtggagcttgcagtgagccgagatcacgccactgcactccagcctgggcgacagagcgagacttggaaaaaaaaaaaaaaaaaaaggaggagatgaggggtcagggatatagatggggaacagatcacatggagcattacaggccattataagactttggcttttactctgaatgtaatgggaatccattgaggagttgagcagagccgttgttaaagcattctattaaagcagattccagctgctgtgttgagattagaccctgggaggtgcggcaagggtagagtaggaagaccagttagaaagtttttgcagccatctcagtgagaggtgattgtggcttatgaaggtagtaggaactaggcagtttcagaatatattatgaaactagtgctaatataattttcagatggggagtatgaaagagaggagagtcgggtgactctaaagtgttttaaatggcaacttgaaggacagagttaccatttatgtggggggaagatcaggagttcagttttggctgtgcaaagttagacttgtctagtatatgtactagtggagatgtagagtaggcagtggatatatgaatgcacagcttgagacaaaggtctggtacctttgtcccaggaccacacttttctttatcttctattgcttcttctgcctgaagtatattctttagaatttcatttagtaagcaagttatattaattcttctttgtctgaaaatttttttttcaccctcattttcaaaatgcagtttttcttttctttctttctttttttttttttttgaagacagggtctcactctgttgtccagaatgagtgcagtggtgagatcttggctcactgcaacctctgcctcccagcttcaagcgattctcctgcctcagcctcccaagcagctgggattacaggcgtgcatcaccacacctggctaatttttgtatttttagtagagatggggtttcaccatgttgaccaggctggtcttgaacttctgacctcagatgatccatctgcctcagcctcccgaagtgctgggattacaggtgtgagccaccatgcccggcctcaaattgtagtttttctaaactgatagttttctctcagcatactgactttgggcttttattgttgctgctgagaagtcagtttactgtactctgtcactctcttgaagataatctatctttcctcttggacagcttctgagattttctctttatatttgacgctgtatagtttctctgtgatgaatctaagtgtgactttcttttcgtttatcctgcttggtagttttggaacttgtggcttggtatcttttttcactagtcctaaaaagtttatgccattatgtcttcaaatatttatttctattagataatttgttagaccttctgattctagccttcacagctcgtaatctctttttctctgtgcagcattctgattgtcttgaaatatgttcttcaattgttgctttctctttagtagctataaattctaagattaaaacctttccattgaattattaaattatatttttcattctataagttcacattagcagttcgaattttactcagccatttttaaattctcttgctttttccttatgtatacatgttcttcttttatttctttaaacatactagagatacttctgttatatatctctatttgatcatttcagtatgcagagtctttctttgtctcattctgccttttgttgtttctgtgacctcttgttcatggtgtcttgtttctgcgtgtgtgttgtgattttgactgagctgaatttcttggaactttttgttgttgttgttgttgtcattgttcttagagacagggtttcactctcgcccaggctgagtgcagtggtgcagtcctggctcactgcagcctcaacctcccgggctcaagtgattctcctgccacagcctcctgaggagctgggactacaggcatgtgccaccatgcctagctaatttattttttattttttttttgtagagccagggtctcactatgttgcctaggctggtattgaactcctgggctcactcatggaacttttatctttaggaattatttgagatttggggtgaatgtgggttcttccagagagaattagcatttgcttctggcaggtaccagggaacattacgccttaaattaaaatcttaaattgagggattttttttgtactacagaagcagtgtgaattttagctacaaaatatatcagagggctgactgtgcatatgaattttcaaaggagatttattttctccctacctattgccatgtaacaaagtacccctaaacctagtagctcaacataacaaatatttattatatcacagtttctgagggtaaaggatctaggaacagcttagatagatgttatgtctaagctactcctagggctatttttttatttctatcagtttatgcagtcttaaaaatcagcattttcaaaataccattccatatttgtatgtatgacctccatcatttcttttgaaaaatcacctgtcactggttttcctttgatggtataggtctttttttctctagtgcttttaagatttccttttcatctttgatttttaggaattttcctatggtatgcctatgcatagttttctttatatacatcttgtttgagggtgtttgaacttcctaaatctatggcattatttcttttgtggattttagaacattcttggctgttatctcatccaatgttatgtttacttcgttctcccaccttgcctttcagaacaccagtgatatgtgtgttagacgttttttcctgtgttctgtgtatctcctaagcgcttccattgtttctatcctttcccccgaacatattttagtttagattttattctgacctatcttctagtttattaatcctcttttcaactgtctgagtgaaacccatattatagactcaatttcaatgattgcatttgtcagttctagagcttccattagattttaaaaattgtttccagttctctgctgaaattcctcatcttcttttgttgtatgtctattggcataattttaagctttcttcagattattccaataccatgatgtcttatgggtctgtttcaatggcttttttttcctttttttttttttttttttgagacagagtcttgctctgttgcccaggctggagtgcagtggtgtgatctcagctcaccgcaacctccacctcctgggtttaagtgattctcctgcctcagcctcctgagtagctgggattacagctgtgcaccaccacacctggctgattttcatagttttagtagagatggggattcaccatgttggtcaggctggtcttgaactcctgacctcatgatctgcccacttcggcctcccaaagtgctgggcttagaggtatgagccactacgcccggccctggcttttttttctattcgtttttgatcagatagtgttgtctcctatatgttgggttttttctcatctagaggtcaataaaacaaaaaagaaagagataatttgggttatatatgttttttcttccaaaagagatttacttttacttctaccaggcagttagagtagacagagatcatcttcatgcaatcagggattaagctaatttgaaagtgggcttctgtcttcttgagggttggtccgcttctggttcactttcttaggggtctcaactgagagcttgaagtatttaccagggttctttctccgttctgatctctgaagtccaatttttatcttctcagccctagaagactcccagaagttgtgttcggcttctagcctctcagttggcccttgtgaattgacaaataccttgatgggaaaactagtaacaaatatcagacttgcatcatgacattttccatttttttggaattgtaaccacttaattcctttctgctttggtagctttctgatgctttcaaaaagatattttaaaacatcttgtacaattgttctagatgttttccacagcaagatttgtcaacaaaaacctagtttcagagatttacttactccctaagagattctccagaatttgctatacacaaaggtgttaaccttcagagcacagggcaaacctttcacaaattatttttctgagatctgtcgatcatccacttaatcattatacaaacattcaacaccagtcttacaatttccgtgttaaatgctagaggtgagtgataagtctaccatggtcctgtgttggaggggctcacagaagagataaatttgaatttttctctttaagcatccctcttactccagagtttctccaaatagaatgaaatcatctttaagcaagttttaaagatatggcagatatgcaatttgttacctctctcaccaatctgagcctttttttttttttttttttttttttttgaagagtcgcccagtattgtgtgagaggtagagtcacagattggagaagctttggagagagacagaacaaaacttgagtgttgactccagtactcagtgggcaaggtaccctccttccacatctgtgcaatacggttagcatgtcttctcagagaataatacatagcagttatttttattactgtttttcttcacttatgtcattgtaaaatttcaaactagagttaaatattcccctggaaacttgtgcccacttatgctcaaagcctctgttgacagtgccctttagtagctgcagtaatcaccattgctcaattgctcccaagaaaatcaaggaggaagtattattctgccattctattagtttttatgtggtgtccagacccaaagggtatcctgttacagagagtgtgacatgagcactgtagttttttctaggtaagagttactgttccatgtttagtttgggtgtcttctatcagccaggactactgatttacttgatttgattataatgcctgtggacttgtttcttttatagactattgcttcatttcacaatccacttcaggtttatttattttctaaacagatttgttgaggtataattcacatacatttctcccattcaaagtacaccattcaatgttttttgttatattattaattttttaggccaggtgtggtggctcatacctgtaatcccagcactttgggaggccgaggcaggcagatcacctaaggtcaggagttcgagaccagcctggccaaaatggtgaaatcccatctccactaaaaatacaaaaattaggctggcatggtggcgcacacctgtaattccagctactcgggagactggggcaggagaatcgcttgaatatgggagtcagaggttgcagtgacctgagatcacaccactgcactccagcatgggtgacagagcaagactctgtctcaaaaaaaaaaaaaaattaattgtggtaaaatatatataaaacaaaatttgccattttaaccatatttaaatgtaaattcagtgccattagttatattcacaatgttatacagccatcaccattatctattttcaaaactttttcttccttccagacagaaactctgtaaccatgaagcaatagctccccagtcaccctctcctcagcttctagtagctcctagtctactttctgtctctgtgaatttgcctattctagatatttcatataagtggcatcataaaatattggtccttttgtatctggcttatttcacttagcacaatgttttcaacgttgtaacgtgtcagaatttcatttctttttatggcttaatattccattgtatgcgtatatgatattttaattacctattcattttgttcatctggtgatgaccatttcagttgtttccatcttttggctatttgaataatgctgcattgaacatcagagtacaaatatcaatatggataagtctctgcttgtcattcctctagggacatacctagaagtggagttgctggtaggcttatttttagaattattttctttctgaaatagtgaactttcctaatgtggaaaaaatcaaatcaagttttaaaacacatatttacataagctttattgcataaaatatcactttacttttggcctcattataacagcacatttttattctctcatacttctagctacttcttcctgccatcccctatccctgaaactccacacacttttcttgaccttcccttgctcttctgatcgatggctgggataatcttacaccatcaccctcaatccttctgtatgcagctgtttaagaggccctgctctatgaaccactgctgggaccattctgactgtcacactctggaaccagagccaggcagaagaattttaaacttcagtattgactggccaggaagggatcttacttccaatctgatttggatctttcatgatctctagttctctttttgccctttgtcattccttcttctcactgtatggtataaaccatcacccttacactttatcctaatgtacaggtgacactgtctcctacttcaccaagaaaataaatgctattgaatacaccaagttaaggagcttgaattataggtaatggtgcctttgaagtagtttaaagaagaaaatgatataatcggctatgcatttcaaaatggctattggatgaggcaacaaaaaggaatgtgtagttagaatgaatcaagaaatcattacaaattccaagtgtcttagtcagtttgagctacaataacaaagtaccatagactgggtggtacttatggttctgagggtgaaaatgccggcatggttaggttctggcgagggtcctcttccacattgcagagcactgacttctaattgtatccttaattacaaaaagggggctaaagagctctctgggatctcatttaaggcactaaccccatctcaaagtccttaccacataataccatcaccttaagaattagaatttcaacatatgagttttgggaggacacaaatgttcagtccataacaaaaagattaaatgattaatcacaaatatcaccttttttttttgagacagtgtcttgttctgttgcccagggtggagtgcagtggtgcaatcatagctcactgcagcttcaaacccctggactcaagcggtcctcctgcctcagcctcctgagcagttagaactacaggtgtgcgccaccacacctgtctaatttttaatttttttgtagcgatggagtctccctatgttgcccgggctgctctcgaactcctgacctcaagcaatcctcccaccttggcctcccagagtgctggcattacaggcatgggcaactgcgcccagcctacaacatttttttaaaaacatcatttggttttattaactgcttgaaacttctaccattcttcattccttaccttttgtttatttttttaataagcaatatgactttatttagtgactttggaaacaaaacctcccaaataatgcctgaacccaaagttacctaaaaatggctaaaaatattttaaaataatagatttgaacatcatttgtagtttctgcctcataacatgaatgctttcagctggacagtagattacaaaccatctctgatcatgttaaggcagattagatgatcagtcagtcctggagctggcaggtgggaggctctgcctgtcttgtcactgcttgttatgctggccctctatgactgaagctgacacagagccctggcccttgttgacatcactgatacacacccactgcccatcaaccaactgcttcctcagggtcaccttattgtctccaccagagatggccaatatgttggctgtgatggacctgcccgcatgctacatgacatcattgaacttgtgcagcaatttgggagaccatatatttcccaaggcatcatcacaggtccagatgaacacacgaccatcccaggagcagctggcaatggtgctggtgggcaggctgatggagggggcccaggccacatctcaaacccagtcactgtgcttccagcttctgctctccttccactggccatccttgaagaggttgtcacagccacctgatggaaacttcttgatgtaattgggtttctgcctgaacagctggtctatgaggcttccaggtacaacagcaggggcctagctgatggcattgcagccaatggtgtaagcgttgttgatctttttcacttcccattggccttcccctgtataagtcagcaggaagatggccccatctgagctcctacaggccaggatcaggccgtagtcatgggggacctagcatacagagttcacggaggagtcatatcctgaggggtcgtgggtcttctcccaggtgccgttttcctctttccagataatgactttccaatcataggagcacaatgccaggatattgccatatgtggggtgagcccaggccacttgccacataggactctcatgacttctgaggttggcaatgaggatctgccctctgttgtgcactttgaagattttgacggatttttctgatgagcaggttgccaggcgggtgccatagtagtccatctgggcatcataaatcatatccttatgggaggtatccacagtgttaattactgacaccatgataccagcgtgactgctctagggacgtggcagctcctggtggtgcctccccattccttaccacctttttttttttttttttttgagacagtctcgctctgtcacccaggctggagtgcagtggcacgatattggctcactgcaacctctgcctcccaggttcaagcgattctcctgcctcagcctcctgagtgactgggattacaggtgcacgccaccacacctagctaattttgtattttagtagagacggggtttcaccatgttgaccaggctggtctcgaactcttgacctcaagtgatccacctgcctgggcctcccaaagtgttgggattacaggcgtgagccaccccgcctagcctcttatcaccttttttagcaacaatgtttgcctcttcagatggccacaatgtttgtaatcttttcctctagagagaatagaaatctttctttttagcctggctgattgaaatttgtttagtattgatagtttagaaaaacaaaagcttcacattttattactgataatattatataaatgtttaagattgtaatcaaaattggggaactatctctccagtttgttcatatatgagctataatttttggaagaaattttcacagacaggttctggccccatacatttcaaaccttgcttctccacaacccatgtacttccggggctgggtgcctttaggcataattgtattgcactatgatgctaagtgagtcagcacattgggtgaagggatgatccattattcataacttacctactcacggaagtaaccaggaatcatatcagtatatcctactgtacccatgtaaagtaaatccctactttaactgatttttacttgggtccccaaaatgcctatagcaacctgtaaaacctcccaaaggaagaggacatttgacacagggaagctggaacagaaagagacaaggatcttagcttgttatggtcaaattatattacttttgcaagttttacaaaaacatatgacactatgaacatgctggtgggattcctcccttggggcacttctggatgcagctgccatggtagcctaggaatgagatgacggcaggggcatcagggagtggagaggaagaaatcaatttgaaaaacatttagggctgggcacagtggctcttgcctgtaaccccagcactttgggaggccaaggtgggaggttcacttgaggccaggaaatcaaggccagcttgggcaacatagtgagactgtctccacaagaaaatttaaaaatttaaattaggaaagaaaagtgttcaggaggtaaaattgataggatttggtgattgactgaacacagatgtgagaaagaatgaggagttgttgatttttccaggttaaaaccttagttagataactaggtgggtactgggatcggcacctgagatagaggattgcagaggaggccctggcagggacaggggaagcaagttcaattctgggcttattcagctcaatatttccaggaacatccaggtagacagatttctccataagcaccaacacttaatagtaagacactccagggagaagtcggaaaggttggcgcagattctggggcgatcagtgcaaatggaagccgaagtccagggagaggttgagactgcacatggggagctgactgaggagggcaatgggccaagcaaaagacaaacccaggggatcccaagctttaacaactgggcagagtaagagaacccacaaaggagacagagtctttagaaattgccaggctcagtggctcacgtgtgtaatcccagcactttgggaggccgaggtgggtggatcacctgaggtcaggagttcgagaccagcctggccaacatggtgatactccatctctactaaaaattaaaaaattaggtgggcatgatggcgtatgcctgtagtcccagctactctggtggctgaggcaggagaatcgcttgaacccaggaggcagaggttgcagtgagccgagatcatgccattgcactccagcctgggtaacaagagcaaaactctgtctcaaaaacaaaacaaaacaaaaaaagaaatgaatgtaattcaatagcttatgatagattgcagcttaacatgtcatattttccctctttttttgatatttctggtttgaaagagaaattaactacaagatttagtggagattatatatatatatatatatatatatatatatatattttttttttttttttttttttttttttttgagacagagccttgctctgtcacccaggcaacttccacctccctggttcaagtgattctcttgcctcagcctcccgagtagctgggattacaagcgcacaccaatgcacgtggctaatttttgtatttttagtagagacggagtttcgccatgttggccaggctggtctcaaactcctgacctcaagtgatccacccgccttggcctcccaaagtgctgggattacaggtgtaagccaccgcacccagccagtgggctctttcttatgagactttgtagacattccattagctgatttgttaaatgatcttcaaaatatttgcttgcatcaagtaaaggaaattggatggtagatatcccctgtatatagctctacctgcctccttccttcatcaaagactcaaaaagcggaatatgtctcctctgtaatccatttcaagaacacattaggtggtgatgggcaatatatttcactgacatggactcctggggataatctcccagcaggctgcataagcctgtgctcagtggtgaaggcccccaggcggttgtcttcatatgaatcttcaaggcatggcaaagctcatgacatttgcattttaaaaggtatttgctttggtgtgggtaaaactcaaccaaacatggttaacactttgacctcgaggatgaaccataaaaatatagggcagcgacctcctcttccctactgattcctgagaggggcagtggtgagtttatttttgtatgctgtcaaatcaacttaagacccattttaagagttttgtttctgttctttatagggattccatcaacgtaagagttccgctgatgttttggaaatgggtcactgtagaaattaatcaagtggtagtgaggaccttgataattggagtggattctgggattcccaaaggtagtaactgggctgagtggtgaagaggggatgggagaacagccacagtgattttttctgtacttcaaaagcttaatgaagtttgaaatttgatccaggatttgtctacactggctgattgatcatcctgcactgtttatgactggaatgacattggcttgatacgcagacacagctgtctcttgctgatgtatagtgctggtgaaaaccagtgttttatgtctgatggttacagatgagaaaggcaatattacttagcaactgttaaatagtcttttaaagtgtcacctgctctcttgtagtactggtctcttcgtttcctgtagagttggcttttctagtccctctcccagagtgatttctctaaaacactgatgtgatcgcttctcagtcttttggctaagatcaagtgtagtatctaaaacactgatgtggtcaggataccttccatgacttggcccctatatttttccagcctcatctttcaattctcccttcttagatgtgacttcctggccttaagttggagctatatacaattccatgaatgaaacagcactgtttatacctcctggtctctgcaccctctgcctttattcacctggaaatgaagacacacctcagttaccttatctgcagagtcttctttgacccacttgtcagccaagttagtcacattttgttttctatcacttatgttgtagaaatcttttaaacattacttttctttttttttttttttcttaacttttaggttcatgggtacatgtgcaagattgttgtgtaggttaactgtgtgtcacaggggtttggtatacagattattttgtcacccaggtaataagcatagtacctgataggtcattctttgatcctctgcctcctcctacctaccaccctcaagtaggccctgatgtctgttcccctctttgtgtccatgtgttctcatcatttagctcccacttataagtgagaatgtgcagtatttggttttctgttcctgcattagtttgcttaggataatggcctccagctccatccatgttgctgcaaaggacatgatcttgtttcttttttatggctgcatagtattccatggtgtatatatgccacattttctttatccagtctaccattgattgtcatttaggttgattccgtgtctttactagtgaaaatactactttttgtggtgtattaatataactgatttatacacatttctcactctctggaataggtttataagtctagtaccaagcataggacctgacacagagtactttcttaataagagtttgttggatgaatgtatgaaaacattagaggtcttggtgaaggaaaagctggtcaccattgaatctagtggattccacagggaaaagagcagcttcccgtgttgaatgtgtccggttaagtatgagaagcaacatttctgattgctctgaaaagtatgattaaagcacaaattattatggaaaaataatggtttagaagtatagcattttggtatatttgttcatttcttttctgaaacattaattagctaaggtaaagatgaggattttgctatatgataatcaaactagtatcaatgaaaatcatcaatattaaaatgaaaagttagaaaattgtagtaaatgggatagacagatgaaagcttaatatctgtattataatgagctaatatcactgatcagaatatcaagatctacatagaaaattgggtaaatgatgaccaggcgcagtggctcacgcctgtaatcccagcacttaggccgaggcgggcggatcacctgaggtcaggagtttgagaccagcctgaccaacatggagaaaacccgtttctactaaaaatacaaaaaattagccaggcgtggtggtgcatgcctgtaatcccagctactcgggaggctgaggcaggagaatcgctggaacctgggaggtggaggttgcagtgagccgagattgtgccattgcactccagcctgggcaacaagagcgaaactccgtatcaaaaaaaaaaaaaaaatttttgggtaaatgacataagcaagtatggatacttgatgaaaatgtgagtatacactattttaagagtcttatactcatatcctttgacctagtcaccccacactcagagtgttacttttaaaaaataaaaatttaaaaggataatgctatagacatgaagtttgagactccatctcaaaaaaacaaaacgagaaaaaagaggcgacatagggtaatatgctaattgatggaactaataaataaagatataaggatattattttaaaggtacaaagataactaggagagaagctgaaaatggtgatataaccataatagcaagaaaggaagataaactttctttatcttctgggctgtactctcatgtgttaaagaaatcaatgataagaaaaagcagtacacatatattacttagagaccagaagaagcaaaaataggaacaattaaataatcttaaaatgtgctgggcgtggtagctcacacctgtaattccagcactttggtaggccaaggtgggaggatcgcttgagttcaggagttcgagaccaggctaggcaacatagtgagaccccatttctacaaaaataaaaataaaaattagcaggtcatggtggtgcatgcctatagtcccagctactcaggaggctgagacaggaggatcactggaactcaggaggttgaggctgcagtgagccgtgattgtgccactgtacttcagcctgggcaacagcctatctcaaaacaaaataataaaaaatgataatttttaaatggcttcctctgaaagaactaagagaaaagtgaggcaggggactgttgcttttcactataacagtcttttgtcctcctctttttatttattttattttatattttattttttgagatagaatctcactctgtcacccaggctggagtgcagtggtgcaatctcagctcactgcaacctccgcctctcaggttcaagcgattttcatgtctcagcctcccaagtagctgagactacaggcatgtgccaccatgcctggctaattttgtatttttagtagagatggggtttcaccacgttggccaggctggtcttgaactcctgacctcaagtgatctgcctgcctcggcctcccaaagtgctgggaatataggcgtgagccgggtgtcacttttctggctggaaacctctgtggcctgtggcgcctttgcccgagttttgctcgggcccactgggttcgttctgcccactcggcctggcaggctgcactcggttcatgcttcctgcctggatcccatacctgccaagggcaagtcaggcataaagcggcaaggggtgtgtgagcaagcgtggggttgagccactgtgcacggtcagacacgctggctgctgctgctgcagggtgagcagctccaggttgcccgcacaggcgccagccctctgcaaggctgcagctggaccaggtgcactgcagacagcttctctggctggcatcagggtatgcaatagtgcccagaagcttggagatgccaggaaccacagggccccaaagagagagtcacagccccagctcgggtagctcccaggtctgggctccccaaaggaccatagctcttctctccttttcccccacaacgtggtgagcaaggggcatgtttcagccctatttgtgttacagctcttttagcctcaccattcagcggatcttgagttcttgtcctacatccaggaagaatgaggtatacagacaagtggagggtgagcaagatgaagagtagctttattgagcgatagaacagctcagaggaggcccacagtggatagcttgtctccatagccagggtgtcccagcgagtgttcagctctcagcagagagggtagtgcctctctgtgggtagattgtcccatcctccctccatcctctcagcagagaggatagtttctctctgcagctgattgtctccccttgtctctccatcttctggtcttgctgagccagcagttgttatgggcttcagtggggaggaggtgctgcttggaccatggcggccattggcaggcccagggaaaagcaccacaagttacccctctggtccatgagactagtggcccgaaccccaggcttcgggccctccccagcttgaaggtggggcttcaccagggactcgcccccttccacccaggagcctgtctaccttctgccaccattcatggcgcccgggctgtttgtgccaagggacgcctacaggccagtgctgagctgccctcagcaccccctcggcctccctcctgtgctcatcggtgcccaaagtccagagggggctgaggtggcagggggctggcatgtcagtgctaccctgaacgtttgcacacccagccagcgtgcgacagcacgtgggctcagccccatccttgctccgaggtcggagtggcgctgggagaagagagaggctaggcagcgggagcagacacctcttagccttttgggggagggggaccttcctggatccccaagagtgcagagatgtttccgtctgcagctgcagcttggtagctgcagccacgcccagctcctgcttggctccatggatcgtggcactgccccgggcacagctctacctcggggcccttctctgtccgcccctccgtgcccaaccacgctgctcccccaccagcgggtgactcggcccagtcccatcgtggcgggcttcagggactgaccacctccttcctgctgcaccctttccacagcagcagcaaggcaagagcagtgacgcggggccagggtcaacagcggcagaggctccgggcctgggagtgggtcctgcctggccccgtgaggctggggacggcacagtcagctgcctcggggacatggggcacaggggtcctctccgccgccactactggccctgcagctgctcccaccgccacggcccacgacctccttccgccacagccagcgtgatggcagcagctgctcccaccgccacggcccacgacctccttccgccacagccagcgtgatggcagcagctgctcccaccgccacggcccacgacctccttccgccacagccagcgtgatggcagcagctgctccgggctacaaagaggcgatgctgccagcattgtgacttttagaaagggaaaccaaaaaaaaaagaaggaaagaaagaaatagaaggatcttgagaactcacagtacactctacttgaaaagccggatggctacagacatttctaagacgtgggactttctcccagatcttcttactccataattgtatacatacatgcacatatatgtgtgtgcatgtgtatatgtccagatataatatttaacatttaataaggatttattttgaaaaatagtttcagactttcaaaaaagttacaagaataaaagtagtttaaaaaaagaggatttgtggccaggcgcgctggctcacgcctgtaatccgagcactttgggaggctgaggcgggcggatcacctgagatcaggagttcgagaccagcctgaccaacatggagaaaccccatctctactaaaaatacaaaattagccaggtgtggtggtgcatgcttgtagtcccagctactcgggaggctgaagcaggagaatcacttgaacccgggaggcagaggttgcggtgagctgagatcgtgccattgcactccagcctgggcaacaagaccgagacttcgtctcaaaaaaaaaaaaaaagaggatttgtatattctccacccggacttatctgtgtcaacattttactctacatgcttcatcactcgtgcatagacttgtttcttctctctctctgtctgtgtgtgtgttttctaaatcattggaggattgcatacatcacggcctttacctttaaatacttcgttatatgtttcataacaatatggagaagtattctctcttgtaaccacagtaaatttaacattgatacagaactttagcaataagattaatatttttcctatgataggctgtctcccttcagagtctgtcacgtacctgtttccttttttcctcccactcccctagccttctgctgtttaccctcattctctctacttgtttttgctcttttgttttgaggtctttcggtttataattatttggatattcctgaagcttaaaacacagacatacacttagaggtaaaaaatttaccagatcctgctttggaagaagtctctagttcctttgattttccaaaaaagcagtggcactgttgagtctttgaccttgctttcaaataataaattttatgaatatgtttctgaaggtttaccaactttttttcttttctctctttttctactctggtttatagtttgaaaaagtaccagaaggtcctatccctccatctacaccaaagtttgcatatggaaaggtcactttggaaaaggtaagaaaaaaaaataacagaaactttgaaagtgagagatgggagtgagaaagtggaatttagtagcagtgagtgaaagtgctgtgctggaggaattggttcgttatttttctgcgaatttgttttctgcaagcctaatggggtaaatgatgtttctgggaaaatggggagagagaggtgagaagatactcatgcctgttgacaggatgagcagatgagacatgggtgggagtagtaggcattcttggatcatttgggtcatcttggttcctttatcagtggtttaaacagtgtcaagtgcctttgtggaaataacatgccacctcattgttatggctgccaaggctctttgtcgtatttaccttttttaggagttccccaaaatcacaggcattttgatagacctctgccctaaattatatacttacctccatctcaaagtcatgtcctaatttttatggtctgtggtttatacgttaaatggggacactgggggaaaagctagaaatcaatcataaataggagttaagggcaatgtattctaggaaaagcgaaaaagaagagaggttttacttaatagtcagaggagtgacatagccaaagtcaatttgttttgaccatctgtgtcttcaggttttccccttttataatccctaactcctacatgtattaactcacaagaaaaaaaaaaaagaaccgttacctatttcttaagaatctcgatatcctaaaatagtatcgtaagtttttatcttcaagcaaaatgccaaacatgattatgtaatttttccatccaagaagccctttgacatggttggttggttgagttcttataacattttccacctagtgtcagatacctgtgctacattctacaaagaatgtggtctttctgtctgataaggatctttctttagattaatcagacttcagtcactcttgtaaagggagcaccttctacttgttcattgctacagctacttaaggaaaactttggtttgtttgtttcagagccatgacaaatctatttttatgcaacagaaaatagctccaaatgttcaaaacaacaacattgctaaaaccaagctagcttattaccaaaagcacattctgtttaccgtgaaggaaaattgtgtgagcagaaatgactttttatttttaaataaatatatacagttgaagatagcaaatcagcatataactgaattaagtttatgtagaacacagttatatagaaaataagtttttaccgtgagttgaatttcttagtgttcaggtgggaaaacacccatatgagtagctggcttgatgaaattgtaaatgagatttttttccttgatgctgcacatcagcaaggtaaccatgggaagtgtttatgaaattcctaactgggctgggcatggtggctcacgcctgtaatcccagtactttgggaggccgaggcgggaggatcacctgaggtcaggagttcaagaccagcctggccaacatggtgaaaccccgtctctactaaaaatacaaaaattagccaggcatggtgacacatgcctgctcaggaggttgaggcaggagaatcacttgaacctgggaggaggaggttacagtgagccaagattacgccactgcactccagcctaccagcctgggtgacagagtgagactctctcaaaaaaaaaaaaaaaaaaatcctaaccagtattatagtcatggaaaatcctggggtttggagccaaatctaactacaaatcctggctctgtcattactcaagtggacttctgtgagtctccacaacacagggacagtagtacctgcctcacagggtagctgtgagtattcaatgagctagtgcatgtaaaacgctgtatctcatctggagtgtgtagacaggcaatgactggtagctgttattattattgttgttattgcatcagaataagtatcctgggttgcaagaatacacaatcctttgtattgaatataataaatacttaccaggcatttactatgttctgggcattggggctgagaatggaacatatcttatccttaaggagctgacagtctggtgaggaagacaaagatgagcaactgaaaagtgatacaggcatggaagatatgccacacacaagttcagaggagggtgaagtaactaggaagtattaaatattaaggtgatataataatagcatgtctaatcttagttgaatgtaactggcctctggttactacttttacttcttagttgttttactcgggggtgttcagagagggtttataaggaggcagcatctgagccttcgttttcattcattttaagaatcttttataggtctctgagcaggttggacttccgaataggtatgtttgaaacctttttaagactactatcattcatagttttcatcaggagttagggagtagatggagaggactgaaggagactgggaagcaatactgagtggaatttgaatgatttaggtttatttaggggtttggtcaaacccactgatgtctttgataattagggaatgactctgtaacctgatgaccagtgaggggtgcagtgtgtgaatgctgcttttgtttcttttcagttaaagacagtgggagcagctctggacattctgtgtccctctgggcccatcaaaagcctttatcccttgacatttatccaggtgaaacaggtaggccttcaaaggtaatgcctcgccttttttctacttgcaaaagtgtgctttctgcactgccttgcagtgcccattctgaattcaggggccaaaatggtaagcaaatgcatcagatcccaggtaaatgaaccatgaatttccaggctctctttagcttgaagtgctgcgtggtgggctgatcatgcctatattttttgccccacttcttctcactcatacaggaggtagcccaacctgcttcaacataattctgtacaagttataaattgagttcactgaccaatctaattaatctttattactaggcatcagtggaagatcactgttttaatactcaaaacagacagtttaattatttgttcttagttcaatggcataaggactgtgttttttggtagactaggttctttgagattctttttcctgcttttgaagagaacagagcacatctttttttttttttttttcagtgtttgtatatgtgtatgtgtttgatctccagacactgcctcatctttatttttttaaagtttttcccagcattttgttttggaaaattttaaatccaaaaaaagttgcaagaatagtacaataaacacccatatgctttttacctagattcaccaattgttaacagtgctttaattgcctttttctctctgtgtatgtagtcaactgcttttctttttctaaccatttgagttatcagcaccatgtcactccacagcatacatcttttaagaaaaagaacattatcctgcagaaccacaatacaatgatcacacatgagaaatttaatattgatgcaatcctattatctaatataaattctatagtcaagtgtccctggtcattgcaataacgtcctttacagcttaatcttttctcaatccagtttccaatccataatcacacattaattatattctccttagtcttcttccgtctgaaactgttcctaagtctctctctcatgacatggacatttttgaaaaggtcggggtgtttgtagactttgcctcactaattagattcagtaagacattttggacatgaacacaacaaaggtgatatgtccttctcagggaatgatagcaggatgcccgtgagaccagcttgtcccttaactgcaatgttaagcttcatcacttaggatctcagccccatgttttgaaatggaaggttatccacgtcctcctttctgattttctgtggcaaccaccttctggaaggagtctgaacagtaaggcaaaataataacagcatatctaatcttagtttagtgaagtttgctgtcagttcctgtttttacacctgtgattttattccaacaattctattttgcaataaaatgaataattaagtccccccaccacacacacattcactgtttcatgaacgttgtatagggtactctgcagtcctagcacccacatctataaatggaacttacctgcacttagcagagctgttgagcacttcagacaatgatcccagagcacgtgtagcctggggagggagttccaggttactatatgaacacgtgcagccattgttctttctcagaccccttctgctttctgatctttggccaaggtagtgctctcagattgggtggggcttcctgggccctggctctttcagatctggggcaagtccacagaatatctatttccagcaaaaaaccccaaagggcacagacttcagggagtggggctcagcctactgtctctgcagggatcccctgagcctcagccacacctgcctggggagcatcacagcttctacccctccttctggaagcccttgacaaagctttcctcagcccttgaggaaacttaccactttagctagttttcaaaataagtaaataaatgaaccagaaggagatggagatgtggagcctgggcgggaggtgttcttgcgctagaaggtttgtgtggtcttagtagcatttcttgtgctcagctcattcctgcaacacaggaaggtggattagtgctctcctcagctcctcccagtcacctttccacttgcctgaagtttactttctttctttctgggccctagaagtagggaaacttttctctgttccatgctggatctctatttgcattctgttccataactggatttatgtcccagctcagccctgctaataatgtccacagcaggaagtaaataagcaaagtcaataactataattctgtggattattatgtcaataactataatctgtgaataattccgttactgctgaggctgattgtttgaggctttccttttggaccagggatgtcagcatctaaaaatattttctgacttagtggttggttacaatctagtctcttaactgtttctttcccccgttcctccacttaaaacagttctgatggactttgttgttattattattattattagagatgaggtcttgctatgttgcccggactagcctcaaactcctgggctcaagagatcctccccaagtaactgagactacaggtgcatgccactgcacccagctcattgccttttgttttgtatgttaaagcagatttagcccatgaacttggagacagttttgctgagcagaacttcatctcttggctttgctgtttgtttgccttgtttttttgttggttttacttagttttgtttttggagctaacatccataacttttgctatgtatgatataatcccctgtatgaccctgggcaagtaacttaacccattcagggtccaggttcctcttatgggaaagggatgcttgataagacactgttcatggttccttgcagtttactattatgatagatattcgatgacctaaaaattaaaccagtttcctttttcaaatttaattttttcgggaggtggaggaagattttcattccttatggtttgagaaacatcgctttcatacatgtctagggtaaccaagttctctaaatgaatggcaatagtgatgtatttttcttaaatccttttctaaccagcattatgggtttgtgctgtaccggacaacacttcctcaagattgcagcaacccagcacctctctcttcacccctcaatggagtccacgatcgagcatatgttgctgtggatggggtaagaatcgtctctgaactgtgcgttttgtcccagtgagggtggggatgagcagcctgcacttgttaacacagcatttggggtctttgctcaccttttcagcctcaggctctacccatcatctttttttttttttttttttttttttttttttttttttttgagacagggttttgctctgttgcccagcctggagtgcagtggtgcaatcacagctcactgcagcctcaacctcccaggctcaagtgatcctgctacctcggcctcccaagtagctgagactacaggggtgcaccaccatgcctggctaatgttttgattttttttgtagagacagggtcccactatgttgcccaggctggtcttgaactccggagctcaagtgatcctcctgcctcaggctcccaaattgctgggattacaggcatgacccaccacggtgggctccacccctcttcttggtgacccttagctgtgcctcttgcttgctgtgaggcctcatgcatgtgccatttgctgaaatccaccctacccaccatcttaacccagagggctgtgcttgatgcgccaccctctcagaagccttcggggtctccccagccaaggccgcccttctgtgactgatgttgcctgtgctttctttgctccttaagggtggggtccatttccaattcaattttgtacctgccactgtacaaagtttgttgaacttcgtgcctttatcctacatgagaaattatattctgaaggactgctcgtgacaactattactgaaatgcacaaagaaccgtgtttcataacaaaagcagatgcatttcaggacttccagtcctctcaccgaaatggtcacaggaaggaacacaggaaaagattttcttcaccaagaaaatttgttcagaagattttaaaatatttcccattctcttgtaatcaacagctttcatttcagtgggagcagattactaagacattctgctctattgatggtgactgtttcttcgcttctaacttgggtgttgtcttagtgaattatgatcattgtaaggtcaatttttaaagtctaaccttttaaaaagttaggaatatgttgttgataaaatacctgttgtttttcctcattctgttgtatgattttcgtggttaatgcatcatgtcaagtattttgaggtgagaatactccacctaacttctctgattttatctcttttgtctgattttgtcttatctctccatgttgttcagaagcaattttttgtgagtgacttttgtgctgtcagaacacgaagcagctactctagtaagaatcctcccctggaattttccactaaaagtagttggcagtaaaacattccagggcaaaggaaaccagcttagaccgttccatgctctgagctgtgtctggcagttttcctgtttaggaagcagtgattgggggatctttccgacctggccggtaacttgggctaagatgctatcaaagcatttctttccaagtctggtgacacttcaaggcaagaaaatgagtgctaaattaactgagcatgctgcctctccttgctgaccttcttaccctcaattcaattgtcatttggtcttgaaccccacagatcccccagggagtccttgagcgaaacaatgtgatcactctgaacataacagggaaagctggagccactctggaccttctggtagagaacatgggacgtgtgaactatggtgcatatatcaacgattttaaggtaggacaaaccacactgtcaagactaaggtttaaggggtgacaacttagaagttgaagcccagtacagtggctcacacctgtaatctcagcactttgggaagccaaggcaggaggatcacttgaggccaggagttcaagaccagcctgggtaaaatagtgagacctctacaaagaattaaaaacttagccaggtgtggtgacatgcacctgtggtctcagctactcaggaggctgaggcaggagaattgcttgagtccagaagttggagattaaaatgacctatgatcatgccactgcactctagtctgggtgacaaagtgagaccttgtctcaaaaaaaagaagtagttgagctattttgaagagctgttttcctctgtaggtgatgagaaagttgagctttgcaaacagaacctttcccctgtgtttgagtttggtcatcctatagaaagaaacagaaggaggaagcccctccaccatgcttttcctctgctttaaaagaccaccaagctcactgaaggcactcctttgccagtaaagccagctgagcctctgttctgccctgttttatgggtttggatggttagcctgtggcaaactcttcacttgtaggaagcctcttcccttggggcactggctctcacctctgttgattactcctgtgtccagatgtgtagcccaaataagtttttctaacacatatttttagagcattattcagcaagcatttgttaagctcccactccgcgagatgccccaccaggtgctttggggaatgcaaaggtgtcaagagacaggcttctctcagggagctcaacctccgcgagaggagagaatgccttatcaagggaacaatggcaccacccaggctagggcaggacaggtgtctggggctatttcctgaccctcttgagatcaggcaattacatcttagggaacttagggaatagctgtgtgcaggccacctttgcctccagtataaatgtctctctcatagttcttgtgctcagggtggacttcatggcctcctgcctggctctcacaggccacattgacccatgggagtgactcgactctgttgtgtagtctctgggtctccagtacctgtcaaagagcctgacatacagccacctggttaatatttatcaaattattaaatgggcaatcgagacttggtatctgggattccactgggaatggggaagttccctacatacaagccagggaaggggaagttagctgagccttgacagcccagccctggcctgtgtggaacaaatagagcagcttctgaattcaggtctgaggtttgccatcgtcatcattaccttcctatcctcttaaggtatcacagtattctcatgtatgttatctcacttggccctcataacaggtgagtgactcgggtgtggtcctccctgtgatgatggctgaggtgctcaaggccaatatttgctcctggctgcatccgtcgtacctgctccatccgcagtgggatgactattcctttgtatcccacactcactcattccttctgtccccagattccatcttgagacaggatcttgctgtcacccagcctggagcgcagtggcacaatctcggcttactgcaacctctgtctcctgggctcaagcaatcctcccttctcagcctcccaagtagttgggactatacgtgcatgcccccacactaggccaatttctgtatgttttgtagagactggatccctttttgttttgagatggagtgtcgctctgacacccaggctggagtacagtggcgcgatctcagctcactgcaacctccacctgtcaggttcaagcgattctcatgcctcagcctcctgagtatctgggattacaggcacctgccaccacacccagctaacttttgtatttttagtaaagatggggtttcatcatgttggccaggttggtcttgaactcctaacctcaagtgatctgtctgccttggcctctcaaagtgctgggattacaggcatgagccactgcgcctggcccatctttcttggtgcccatctttctctattctagcagtggctctcagccaaactctgaaaatttgggaatttgggatcaatcactctagcaactcaatgccctttctgtagaagcagaaactctgggccttttatagagacatcatgacctgcaaaggagaaagctatagtttggggaatatatctcttcccaaggatttgtaattcaacctccagttagatctgtgttacttcgatgtacacatatttcgaggttcatttcctgttggtgttttgtatcccggtttgcttttcccatttccctggaatgcagagacatgtgaagcctttttccttccctccccagctcactgtgctctgtttctgctttgcagggtttggtttctaacctgactctcagttccaatatcctcacggactggacgatctttccactggacactgaggatgcagtgtgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaaggtacgtgtcttcatgggaagggtttgaattcaggcctaaacttttggttgttagtgtctgagaaagaatcacaaagagctgttagtgagatatcgtgtgatggttttgagtgtggcgtttcggacattcttcaggaggcggattgtggcagatcttcagggattcagtggccagctcggaggtgctgccatctgcccccttgtcattggcttcctgtagtgaatgacaccatcctgcctcctccaagaagaatcatgaccccttttgatgctgattataggggtgctttctctttatcttgaggacaatccagtcaagacaaagaggtggatccctctgggagagtctgtctggttttcatttatgccaagcccagtgctcccagaatatccccacctgcatccagccccacacccctggggcttctatcataagctgtctgcttctccactcttcctcatccattttcacttcccagtcactccgccttgtcgtttgaagacattggcatatcttccttcaccgccttctcctctccctcatgtcctgttttcatcctagatcaccttaccatcactcattcaacacacttctcattctgtggccactatgtgcccaaggtgtgtgccaggcactaaggatacaatcatgaataaaaccaaacatggtcctttccctcatggaactttcagtctagtgagggaggcagactcatattaaaaagtaaaaccatagctgtgatggatgctaagaagggctatggggttgataataattggtgcattttgccttgtcagggaggtcagggaagccttccctaagatagtgatgcttgtcagagatatgaaggatgagtaagaattagcatggcaagaagggaagaaagcatgttcctgggagaggtaacagcttgtgcaaaggccatggggttggaggggaaaatgtcaagtgtggaaagtaggtagagactagattgggacgggccttataggccacgttaaagttttgtctttgtgttgagagccattgaagcaggagagtgacatgataagactgtgatctgacaagctcctctgaccccattgtgcagaatggtttgggtaaggacacttatggattcgaggaaaccatctaggaggctggaccatagtctcattgagaaactgggatggtggtatctaagatggagatgacatcaactatttgagagatgttcaaagttggatcaataaattgtgacaatggattggacaggagggtttggggagagggatatgtctcggatgactcaggtctcaagcttgcagctgggcagaatggtaccatttgctgaaagaagcagcttcagaaggggacttaggcttagaaaggggggtcatgagtttgaatttagaccaattgtgtttgaaaagctgccttagtctatttgggctgctataacaaaataccataagctgggtggcttataaacaacaggcatttatttctcacagttctggaggctaggaagtcttcaatatcagggcaccagtagatttgctgtctggtgagagtctacttcatcatagacagcaccctctatgtccttacatggctgaaggggcaaaggagctctcttgggtctcttttatgaggacactaatttcattcatgagggctccaccttcatgacctaatcacctcccagagggggccccacctcctaacccatcacatgggggctagaattttaacagatgagttttgggtggacacaaacattcagaccatagcagaggccttggagaatggctgggaaagacagtattggaggagggttgttggatctataggctgggaattcagggcagggatctgggccaggaatgtatgtagaagatcattgttgtatagatgattgttgaaaacatgggctggatgaggtctctcaaggagagaggatgcagagggaagaaaagaggacgtaaggctgatgtttgagggacaaaaacatgatgaagactgaagaggagagaccaaacaagtaggaagaaaaccagcatttatgctgccaagaggacaaataagataaagacagaagcacttcggtggttttagaagcaaggaggcccttgggaatcagtaagccttgttccagtggagtgaagcatctcccagccagattgcattctatagagaagaccagggtaaggaatacgaacaggaatacttgaatataaacgttctttttgagaaatttaattctgaagaagaggagaaaattatgttaatagctggaggaggagaaggcaaaagatgtacatggtgtgtgtttaataaaatgcccttttatttatttatgtgttgcttgtttaaaatttattgaaatgtattttcattattctgtttgaaatattttcttttttttttttttttttgagatggactctgtcacctaggctggagtacagtggtgtgatctctgctcactgcaacctctgcctcccgggctcaagcaattctcctgcctcagcctccagagtagcggggactacaggcacacaccaccactcctggctaattttttttattatttttattttattttttattttttgttttttttttatttttattggagacggggtttcatcatgttggccaggctgatctcggactcctgacctcaaatgaagtctcgaaaagtgctaggatagacatctgaattcattccaacttatagttattatagttattataatactgctgtaaacacttgcatgtaagtttttatgtgaacttggcctcgaaaagtgctaggattacaagtgtgagccaccacagccatcctgttagaaatattttctactttcccatatgatttcttctttgaaccatagattattaaaaagtatgttttactgggtgtggtggctcatgcctgtaaatcccagcactttgggaggccgagacgggtggatcacctgaggccaggagttcaagaccagcctgggcaacatggcagaaccccatttctactaaaaatacaaaaattagccaggcgtggtggtgagtaactgtaatctcagctacttgggagactgaggtgggagaatctctcgaacctggaaggcagaggctgcagtgagccaagagcatgccactgcactccagcctgggtgacaaagcaagactgtgtctcaaaaacaaaacaaaaacaaacaaacaaaaaaagtatgctgtttaatttccacatattttgggtttgtaaaaatatcttgtaattattaatttgtaacttaattcctctataaaacttctaaaatttctctctagggagagaaatctccatgatcttgggttaggcaaagacttcttagatttgacacctaaggcattatccttaaagaacaaaaattgataaattggactttatcagaattaaaaatatttgttcttcaaaaagcattattaggaaaatgagaatccaagccacaaactgggagaaaaataattttcaaatcatatatctaacaaaggacttatatctagaatatgtaaagaattcttacaattcaataatagacaaacagcccagtcacaaaaggagcaaagaacttgaatagacattttaccaaagaaggcataagatggctaagtacatttgcatttgtataccttctttggtaaaatgtctattataaactaaaattagtggctgattaatgttcaacattattaatcatttgggaaatgcaagtcaaaaccaaaatgaaatactacttcacactcaccaagatggctaaatagtaagaaggacaataggcaatgttggaaaggacatgggggaaagggaatcttcccacattgctggtagaaagataagaaggtacatttgggagcatagtttggcaatttcttcaagggctaaacatagattaccatagaacccagcaattccgctcctaggtatatacacaagagaaaggaaaacatgttcacataaaaacttacatgcaagtgtttatagcagtattataataactgtaagttggaattaattcagatgtctatcacctgacaagtggagaaagcatgtatatccatacgattcctcaataaaaaggaatggagtactgataacatgccacaatccagatgaattggaaaaatattatgctaagtaaaagaagccaaaactaaaaggctatgtattgtatgactccatttatatgaaatgttcagaaaaggcaaatccatagagatagtagcttactggttgcctagggctgagggtgggaatggagcgtgactgttaagtgggcatggggtttctattggagctgatggatatgctctgaaactaacttgaatgatggctgcacagtcttcttaaatgtatttagacttgttttatggcccagcacaggcatatatcttgctgaacatacctttggaattttaggctttaatatcctctctctggctgcatgtttctatgcaccaaactctcatgcctaccaaccttgctcttaaatctttttttttatttttttgagacagtcttgctcttgtcacccaggctggagtgcaatggcacaatctcggctcactgcaacctccgcctcctgggttcaagtgatcctcctgtctcagcctctcgagtagctgggattacaggcaccccccaccacacttggctgatttttgtgtttttagtagagatggggtttcaccgtgttggccaggctggtcttgaactcctgacctcgtggtccacctgccttggcctcccgaagtgctgggattacaggcatgaaccactgcacccggccttaaatcttattaatgacctgaaacattccaccattaaggctgcagttcttcctctaccaagcctaggccttaccacaatcttttttatttatttatttatttatttatttatttattttttaagatggagtttcattcttgttgcccaggctggagtacagtggcacaatcttggctcactgcaacctccgcctcccaggttcaagcgattctcctgcctcagcctcccatgtagctgggattacaggcatgcaccaccacgcctggctaattttgtatttttagtagagacggggtttctccatgttggtcaggccagtctcaaactcccgacgtcaggtgatctgcctgcctcggcctcccagagtgctgggattacaggcgtgaaccactgcgcccggccaccacgatctttttttaagagtcatcagtccacctgcccccttgcccctttggccttctactctgcctccttcattcctcctccatgtagaatggatccactactggtgtctctgctggttcaccagtcactgagcacagctaagggacttctcagcgcattcatcgtggctaccatcccctcattgttgccagcctccagaagccctcagatttgcccagcagtccttggtctctctctgctcctttcccccactggccttttcaaccttcagcaccctccttaagccacctgactctccaccctctccactgaagacctcatcctccttgactgctatcaggtgtaactcctttgttccctcagcttcctgtcagacttatctctctgcctccaacctcatttcctgcccagtggtatctaggaggaagtctgaattctgaatctcctccccaccttcttccttcagggcaagatcctgttctcatatttcctctacctgcattttgtcagcctctccatctttctgccgagtcccatttttcagccaaaaagtggtaactaggagctctaggacctaaacacaaagaaagccctccctggatcttccccctttagctagcaagttcttgttccctcgatccctctttttctcccctcctaatgcagtagagaccaatggaaaagtgtgggatgtgttggaggtcagagggaggttcatcttggccaagtcttaaaggtgtcacacgcaagagttactgacccaggcgttctgctcaacgctttatagacactatctccgtagccatcaaaagaggcacctgtggtagatggatcattatctccagtttgcagatgagtagctggaggcttagatagctaagtaacttgtacgaggtacagaagtgctcagtggcacatctacctgagccccagccgtgtcttgaaggcccatgtgaaaaagcaggcagcattgagaaccggtgaggaactcatactcattatctaggctggggctctttacttatttggtcagtctgatgaatgctctgcatctccaggcttgaaagtacatctccacacagtatttgtgaatgtgtcaaagggttcagacccccaaaagcccatctaatccatatgtccactcaaacacttgtacacaactgttcattgcaccgttatccataattgccaaaaggtggaaacagcccaaatgtccatcagctgaggaatgaataaacgaaatgtagtacatccatacaatggaatatgattcagcaataaaaagaaatgaagtattgatacatgttacaacatggaagaattttgaaaacattaggctaatgaaagacgccagtcacaaaggactgtatgttgcatgattccatttacatgaaatgtccggaacaggcaaattcatatagacaggaagatctgtgattgcctagagcagggaaaagagagtgttggttggatgggaagagaatgttaaagggtacagggcttcttaacggagtgacgaaatgttctataattgactttggtaatggttgtgcagctctgtagtatactaaagactgctgaattgtatggtatatgaattctatgtcaataaagtgccacacacaaggcccatccaagaagtttgtggactttggactgaatgcgtgtgaaggtccaagggtacacacacatcctacctaacacagaaccaatgtggtttctgttttctggtgcacagtggtccctgctgctggggacagtcccaggccagctctggggcttctaaatgatcagccacctcagaacaggcagatcccactcccacactgagtgctaagctctgacatttgaaagaatgagcacgttagcacatggtttgaatgcagggagctggcagttgcggtgtggggttggacaaaatgatccctgaagccccagctgtttctaaggctgtgcactaacccccacatccttcatcaggagaggcccttgtcaaaggccctggcacaggactctatgctcttcctattcattttactgtaaagaaactaccttgatttagagagcaaagtcactgataagggcgattcataagattaaaaaatcacttttgtttacactggctttacttgagtcggatgtggctttctggttaatgccagatgtgaatgaatatcaactgggacttcagtagaaaggggtcaggcatgttctgctctgtccagcagacacagggcaatgctttgacctcactgagttcttatctgactggaaagtccattagataggaagcgttcttctccagtgctttccacaatatgtcctgtatgccagtggtccccaaccttgttggtatcagggactagtttcgtggaagacactgtttccatggactgtgtggtcaggggtgggggggtggaaatggttttgggatgaaactgttccacctcaaatcatcaggcattagttagattctcataaggagtgcacagcctatatccctcgcgtgcgcagttcacaatagggttcctgctcctatgagaatctgatgctgctgccgatctgacaggaggtggcgctcaggcagtaatgctcgctcacctctcactgtgcggcccggttcctaacaggccgcagaccagtctgtggcctggggtttggggacccctgctatatgccaaacctgaaatgtcatgttctgccactgcagcagtgcttgtgctatttatctctctttcagctgggtgtggataagtctcctgtcaatatcctatgcagccttcaacattttgtggtaggtttaggtgcatgacagagcatggtgtgagtgggatagtgtccatttttccttaaccaaaattatgctttgaagagtcaagaatcaaaatagaatactgatgaaaagtaattctgtattttaaagataaattgtcccaccttcaagatgtaaaataactatgaaataaaacaatgtatgataaacggttgaaagaaattccttcttttaactgtttgttgcatcttgcttttgaaatttcctggccgacgcgatggctcacacctgtaatcctagccctttgggagaccgaggtggtaggatcacttgagctcaggggtttgagaccagcctaggcaacttaataagacctcatctctacaaaaaaaatttttgaattagctgggcttggtggcatgcacctgtagtcccagctacttggtgggagatgggaggattgcttgagcccagcaaatcaaggctgcactgagacatgattatgccagaaaagagtatgtaaaacttttaaaaccttatcagtgttagtcacttggtctcaatccatttggagagacagaggtatagaaagagcccaagaggattataagagtctgtaagagatatgtaaaccatgcagttgggccttggagaggaagaaattataagtgcttaagattgctgggaaaggtctggtcttcctagtgggaaggatattttgtgcagagggattgatatttttcaagggaatagtatagtaagaaatatatttggtctttgtccctggttccagggccctaaaacccttggaattttctgagtggtaggagtgtcttttgttattcataactagcctctttcaatcccacctgggtttgtgctaatgaggcgacttaggatggagcccctagataaccataggatagttacaagggcatgatggcacctgcagtcccagctacttggtgagaggtggggggattgcttctcctgacttgcgtgcccaaacttctcctggttttcttccctctctttgctccttctcaggcttctctgtcagcttctatgttgcagtcctcaggacttggtcctgggctctcttcttacacttttggggattgtcctcacagatgtgctggacatgcttacatttccttttccagctcagctcttacaaggctctggagcccacctttgggggtctcataggcacctccagcctgataggtataaaacagaactctctccctgttacccctgaaagctactcttctgctggagaagtggtccagagagaaggaacagagctggacttgagtgtggcagtagggagggagggcggtccagcttcaggaaatagtaatagtaccagccacatctgagagcttaccatgtgctggctacagtactgagtgctcacaggtgtcttctcacccagctgttctcagcaatcctgagaaaggcacagacatggctgaggaagccccagtgggatttggtgattgatcagtgaaagtgggactgactaagtagtggatggctctactatttttaaattgagtttttaaacgtcactcactttcctgaaaagtagcatgcttaggcaccttctgaccatggagatgtgtatcagttagcttctgctgcataacgagccacccaaaacttagtggattaaaacgacaacagtttatttagttcacgattttgagtattggcagaccaagtagtggttttgctggtctcagctgggcatgaccacctgggtgttagccatctgtcagctgaggcaacagagaagatgagaccatctctctttcatcatccagcaagctagcctaggcttgttcacatgactagcagggttcacacgactgagcagggttcaaagaaagaatgcaaatgcgcaaggctccttaaggccaaagtcaggattcacatgtcacttcttccacgttgtttggccaaaatatgtcactagaccagccagatccaaggaatggagaaacatgttctacccctttttttttttgaaatggagtctcactctgttgcccaagctggagtgcagcgacacgatctcagctcattgcaacctccgcctcccaggttcaagcgattctcctgcctcagcctcctgagtagctgggattacaggtgcacaccaccatacctggctgatttttgtatttttagtagagatggggtttcaccatgtaggccaggctggtctggaactcctgacctcaggtgatccacccaccttggcctcccaaagtgctgggattacaggagtgagccaccatgcccagacagattctacttcttgatagagggacccactaataattggggccatctgttcaatatcccacaggtcttaacactattggaccctactttcatcctaaatttgatgtgcttgttaaacttcttttttgtctaatttgcagttatgcttacctcctacaagacctactatttccgtctaattcactgtttccagttgcacaagtcccgtgaactttgaaactagaccatcagactactctcaacaaatattatgttaatttagcaacaaaacttgttagaacttttgtaaatgggtaaataggctagaagtgaaagaaggtcttcttcaatttttaggttgtgaactttataacaaatatgacatgaggcagtagtttttgcttatcagttcctagcttggttccagatacgtgaggtggtttgacgactgttgttaggtaagctattgtattaaaaaggtctagctatggtggaactgttggaagttgagaaggaaaaagaatttttatttgggatttgatgagaagtgatttatcttttatgctgttattttatgcatttgatggcttcagttctatttggacctgtcccaaaatatagagaaaccataaagttatttaattttattactttaagactgaggaggaagcaaaaaagtgtgatttgcgtcagctgcagagccttttggggttctgaaggaaggggagaattaatcttctgtgtatttcattgagatctatttaacctcttatttctaagcaagccttgtaagaggcttttacctttttttcttttcaattctcctctttttcttctctttctcccaggtaagcatcacagtgattcatgagttcggtgtgtgagagcctttaaccttgggaactggacctttgtctttcccattttaagtcctgcaagtgtctaaatgttttctttcagagtgtgacaaaggcagcattcaccctgagcttattgttgcttttaaaggagctcccaaaaaattttggaaaattttaaactacaacttaaaacagtagtgagaccaggcacagaggctcacacctgtaatcccaacattttgggaggtgaaagcaggaggatcacttgaggccaggagtttgagacaagcctaggcaacatagtgagattctatgtctatttttaaaaatagtttttaagttagctggccatgatggctaacaacaacacgtgcatacctccccccgatagtttcacacctatagtcccagctcctcaagaggctgacacaggaggatcgcttaagcccaagaattcgaggctgcaatggactatgatagtgcagctgcagtctagtctgaatgacagcgtgagaccctgcctcataaggaaggaaggaaggatggaaggaaggaaggaagggagggagggagggagggagggagacttttgttttaaattccatttatccagatagtttaaaacagacagacaaacacatgtatctgtctgatcaacaaaaaagtaggtcaggcatttccaggaacctcacatttatgaaactattattattgccttagtgattacagcaaagggtggagagtctgccagggtcaagccgtggtcagagaaagtcactttgtcatggaactattttaactgagactgccttaggaagccccagaaaccactgcttggtccccatggggctgacttcattaagagtgtatctacttttagatcatattcagcaacacgtgcatacctccccaccaaaaataattgcaaaagcataactttttaagagaaataaaaatcaatgtatatattttttaaatagaatttttaaaggtaaattatattaaagtgtttttcattggttctaatcaaggagggaaggcaaatgtttttcttttagtgaacaatattctttaaaactcttaaactgggagcagaggaacgtgaagaattctttcagaagggcttcatgtcacctcttcaacgaatcttttcttggcagaattatcaacaagtagcagcagccatgagtgctactaagtgtatattgaatatcactctcctgcgtgcggagaatctcgcctcaaacaaaatggacaaagactttcccttcctagagcctgtgttatagctggaaatagctcataaactagtcatcaaacaaaagatatgaatttcaaatcatgataataactagaagaaaaagaaaaaatgaaaggatagtgagtgacttggaatggaaagcccagcattaaggaggagggtcgtggccctgcctgagtgatgagaaggcttcaggctgaggtgagtagtgtttgcacatggggacgagctgatgcccaagcaaaactaactgaaagtaattggggagctgtgtgtggtgatgcacatctgaagatccagcttctcgggaagctgaggcaggaggatcgcttgagggcaggagtttgaggctgtattgtgcctgtgaatagcaactggagtccaaccttggcaatgtagcaagatgtaagagtgagagagagagagagaagagagaagacaggaaggaggagaagagaagaaggagaaggagaagaggagaggagaagagaagagagaaaggaagaacaagaaggagaagaaagagaaggaaagaacaagaagtagtggagagtggagtgagcaagggggagtgcggcagacacaaggaggaaaggaggaaggtatgggctgtggaccacaggaaggaggtttgaaacaggaatgtgtgaaaagaatcctattttcactttggcagctatgcagagcctagattctagagttaataaagtcaagagactgtgaggaggctgcagcagtctaagacaacattgatttatgacttgctctggaagtcaggctgtgaggatagagagaaatggaagactgatggtctaataatgaagtcactaggatctcaccataccttagctctgtagtccagtgcagtagcttcttgtataatattgttgggttttttctgtttgttttgttgttgttttttttaactgagtcttgctctatcacccaggctggagtgcagtggtgcaatctcagctcactgcaacctccaccttccaggttcaagcgattcccctgcctcagcctcctgagtagctgggattacaggcacccaccaccatgcctggctaatttttgtatttttagtagagacagggtttcaccatattgaccaggctggtctcgaactcctgaccccaagtgatttgcccgccttggcttcccaaagtactgggattgcaggcatgagccaccacacctggccttgtataatattctttacaagaacgttcatttttaaccacatatggttaagtttaaattaattaaatgtgaaaattcaattcctccttcacacttttttaaaaaatagctactctttatagtatcactaaagttggacacatgcatatcccatgacccagcaattccattcctagcattcccctcctgtaagaaacatgtgcatggccaggcgaggtggctcatgcctgtaatcccagcactttttgggaggctgatgggggaggatcacttgagaccaggagtttgagaccagcctgggcaacatggcgaaacctcatctctaaaaaagtacaaaaattagccaggcatggtggggcatgcccgtagtcccagctatgtgggaggctaaggtgggaggttgacactacagtgagtcgtgatggtgccactgcattctagcctgggtgtctggagtgagatcttgcctcaaaaaggaaaaaagaaaaagaaaaaggccaggcatggtggctcacgcctgtaatcccaacactttgggaggccgaggtgggcggatctcttgaggccaggagttggagaccagcctgggcaacatggcaaaaccccatctctaccaaaaatacaaaaatgagctgggcatggtggtgcacgcctgtattcccagctactcagaaggcggaggaacaagaagctcttgaacttgggaggtggaggcggaggctgcagcgagccaggattgcaccactgcacgataacctccccagagcaatggctgctgcttctctccaccctcccaatctcaagcaagggcctcttctgaccaacgctaacccagaaccatccagggaaggggatccagggaaaacaattcccagcttacctaccaggtgcacagtccacccggcatgtgagggcccatctcttggatgcttatgaaatggaacttgaggtttgagaaaggaccaaacctccactttgttcacctgcgatttggtcaagagttggcttggcctgtgtcctgaccatagcatgaagcctgtgtggtgcgtgccattccttggctgctgctcgtaatgccctcccacttctctgtcttcccccttgaccgcaaaagtaaagtgctactgttctctaatactgcaaaaacaaggcaccggcagattttaagctgataaaaacctgctaaagctgtcattgtatataccttttaggatggaatgagataacatatcccagggtaaaaacaagagtgaaatagttctgagaactgtgaaactgtcgtcctctttctaaatgacttaatccaacagacaggtggtttttaatcacggacccccttcttttgtaggcattggaacaccaacatcttttcactttaatcatgtaaggagtgctaccgcttacaggccacacactgttccttcatcatcattgtccccaatgactggtatgaaaaattgagttgagacctgcccaaggtcagacagctagtaagtggcaggacacagatacgaactcaggtaggaaattcagaaggatctaaagtaaaggggacacttggaggctgaaaaatacccaaacgtaagaagactgaggagccctggggtgagcagcagagttgtgttgcagaacgtgatgaggattagggctcagcaggtgtcagccatggctgggcctcctccaggctgtctcctaggatatctgggccattgtaggtcacagtttctttcctgcctccctcccttcttccattcctctttcctcttccttctccctttatgttttcctttcttctcccagattttctctttcttttgcgtgtatgtgatctccccatcttcactttctttctttgtaatagaatggtccatctattcagccagctgttgatcctagcctttgagctttgagcaaatcttttttttttttttttgagacggagtcttgctctgtcactgcgcaaggctagagtgcagtggcgcaatctcagctcactgcaacctctgcctccctgggttcaagtgattctcttgcctcagcctcctgagtaactgggattacaggcatgtgccaccacacctggctaatttttgtatttttagtagagacggggtttcaccatgttggccaggctggtctcgaactcctgacctcaggtgatctgcctgccttggcctcccaaagttctgggattacaggcatgagccactgcactcagcccctttgagcaaattttagcacatacagagaggctgtgtagacagacctaaacatggtccctgttttttaggagtttatcctccactttcagttttgttatgggaagcagcttcccctactcacagaaattgtttatgcaacctatagcatcacctctgctcctgaaccaaacatggagtccacaccctaactctgagggtgcctgtaagagtccttagaacatagcagtaatatagacacccaactggataagcctcttcctctccctcaccccaaacccccctatccctcttgaggggttgttttggggaccactcctggtacctgtctgacctcaggatgcaggccctggagtcctctgttccctgtgttcaccaggtgtacagcagatagtgaggtcaagacctgcctctgggaaaggagaacaaagaaggaaaagatctatttaaggaagcagttcagcagttgtcttctgtgtacagaaaagtcagggagaggctggtctgtgggtacaggcagcacctgggaaccaggatgaaattcagaaatttccacactgttctctggtaccaacatctgtggccactgaagcccgtcagagggaccaaacctgtattttcctgaagcaggagtgggtctttggggcaagtttttgttgccccaaagaaggtggatgggggcatccaccttcttcccaccttggccagttatcccagcaagaagctaaaaccaaggctggcatgggcctggctgtcagcctcgcctttctgggggcatttctttcctccattgctgctggcctgccctacatcagggcccccaccttcctcagggctttcggtgcatctggggttgatggttctctgtctctctctctccagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaatgatgatgtcactgtttttaatgtgcaggtattgaattatatggtctgacttaaatcataactagacttgagtgggctgaataaaccacttcactaacttgaagttcaaaagg

SEQ ID NO: 35917 - DNA, 8531 bp, Homo sapiens
gcagaagcgttccgtgcgtgcaagtgctgcgaaccacgtgggtcccgggcgcgtttcgggtgctggcggctgcagccggagttcaaacctaagcagctggaagggtaagaggtgttcgggatcctgagaggaaaaagaaaggagtgtagtcgcgggagtgggttaggtgaggagttagtgaagagatgagttcagctctaagaggcggcgaggaggatcggatgggaggaggggcagggagcgcctgtggacaagtgcagaccggtcggcgcacgtcccacgccacgtggactcgcctttgtcggtggccgcctttctcgtcaggccgcgacgacagggctgtgccttatttgtgtctgtcgagagcagtgccgggcacggagttggcgctctgtaagtgcttgctgaataaatgacgggtgtgtgtgtcattcattcagcaagcactgagtgcttactgttgtgtcaccgggaccgatgtggagggacatttttagggtgtatttctggcgctttagtcctgttttctcctggacaatttatgcttgccccgcaccccatcgtgcgattctccgcagtctttgggctttgtctctctctctttttttttttttggaagttgcagaatggtgataaatgattttctttgctcctattgactgctaggccctgtggctaggtaccatagagtctctacacaggactaagtcagcctggtgtgcaggggaggcagacacacaaacagaaaattggactacagtgctaagatgctgtaagaagaggttaactaaaggacaggaagatggggccaagagatggtgctactgtctactttagggatcgtctttcaaggcgaggggcctcctatctcaagctgtgatacagggtaggtcatgagcgcagtcttctgtaaaatgagggatctggacggaatagttactctctaggcttcctttcagtatgatgtcccgtatcagatattcctaatgtctgtagttctcccacaccccaccgtttattggctagtcaaaatattctttgcattgtaaagtgtagcataacattacaagaatggattaatgggttgggaatgctgggttttggccttcattctggtgctgtggtcctgtttcctcatttgtaaaatgaagggggttgtaaagatatattctctaaaacccctaatgctatggctgtggcattaagtcaaactattatttcttactgctttgtaccggacatcactttcacattagtaaaacttttcatcagtgtagtttctcccaagcttgattattgagaaagatagtgccttgtttttaacatcctgtatcctagttccaccgcagtgtttggtacacagtagatgtttaaaagaagcttattaaatcaaatggtggccaggctcatggggctcacgcctttaatcccagcactttgggaggctgaggtgggcagattacttgaggtcaggagttggagaccagcctggccaacatggtgaaaccccatctctagtaaaaaaaaatacagaaattagctgggtgtggtggcacgcacctgtagtcccagctatttaggaggttgaggtaggagaattgcttgcctgggaagtggaggttgcagtgagccaaggtcgcaccactgcactccatcctgggcgaaagagcaagactccataccaaaaaaaaaaaaaaaaatcaaatggggctgggtgtggtggctcatggccataatcccagcactttggtaggctgaggtgggcagatcacttgaggacaagagttcgagaccagcgtgggcaacatagcgaaaccccatctctaaaaaaaccccacaaaaaccaaaacaaatgaaaataaaataaatcaaatgggatagaaattatagtccttgcttttggatcctttcccacattgacatattagttcatagatcaggggactggggaggaattgggtttttaccagagggagacctggagctgacctgacagatttaaaccagctttatgggataatccgcttgagacggatgacgctgtaggcaagtgattcactgctgtttcattcctctacctgcctatccccagaaccatggccaactgtgagcgtaccttcattgcgatcaaaccagatggggtccagcggggtcttgtgggagagattatcaagcgttttgagcagaaaggattccgccttgttggtctgaaattcatgcaagtaagtggacttcattgttcccattttgattccttcatagtataggagaacactgtgattaacctgtttctccccgtctttcttatttaaagttctccacggtagagtgaacacaagtgtcttgagacctggaaactcctcagtgccctagcgtttggctacatcttggaacaaaccaagttatttaggattttccaaaatagtctctgtaataggaggtgcattgctacgggaaaagcagtgcagagttccacatatgactgcatctctgtaatttctgactgagagctgagcatgtttgagttcttggtcttgagcttcctgagcagataattttagagagatttttttccccctttgagacaggttgttttttagcaagaaagtctttccatcatcaattactagacactaataaatgcttattgtttagcatatattaggtatcataggagctggtggaggaaaactatggttttggttttggggaggttcttcagaaacagcagagagcagatgtacctgcaagctacttacaaagcaatcttttgataaatgcaaaggattgattgaccaataacccttcttcaaacaaattctagagataatccaaattctcggctgggtgaggcatagtggctcatacctgtaatcccagcactttgggaagccaaggcaggctggtcacttgaggtcaggagttcaagaccagcctggccaacattgtgaaaccccgtctctactaaaaatacaaaaattagctgggcatcagggtgggtgcctgtaatcccagctattcggcaggctgagacataagaattgcttgaaccagccaggtgcggtggctcatacctgtaatcctagcattttgggaggctgaggcgggcggatcacctgaggtcaggagttcgagacagcctgaccaatatgatgaaaccccgtctctactaaaaatacaaaaattagccaggcgtggtggcatgcgcctgtaatcccagctactcgggaggctgagacaggagaatcgcttgaactggggaggtggaggttgcagtgaccgagatcgcatcattgcactccagcctgtgcaacaagagcaaaactccatctccaaaaaaaaaaaaaaaaaagaattgcttttgaacccaggaggcggaggtttcagtgagccgatattgcaccacactgcagcctgggcaacagagggagggagactctgtctcaaaaaaaaaaaaagaattccaattctcaaatcaaataggggatagtatgttttctaaaagggaatcaattttggacccttctagtgcattttaaaatttagtttgacttgcaatttacttcctatgtgatattttagaaaaactgctttagggctggcacagtgactcgcctgtcatcccagcactttgggaggctccgtctccaaaaaaaaagaaaaaaaagaaaagaaaaactgctttaatgtaaaagagggtagactgatgttcatgctgagaggagaatatggtgtccaaggtcaaggagctggcatctaatgaaggttttcttgctgtatcatcccatgacagaatggaatagcaagagagtgcaagagtgagagagagcaagagggggctgatgttgattttataacaaacccactcctgagataagacattaatctgttcatgagggtgaagccctcatgacctaaacacctcccattaggcctcacctcccaacattgttgcatcgaggattaaatttccaacatacgaactttgggggacacattcagatcacagcagaaggtaacatgagatggatgtgttgttgatcaggcatttaccatatgctgggcacatatgttttctgatttagtcttcatgccagccttgagaagtacttactcctgttctcgtggttgttagtgatgagcaacctaaggcttggagaggttcagtgatgtgcctgatagcatacagtgatgccactggaattttaacttgagtctctctgacccctgagtgcagatactttctcctttacattgaatttcctattaaggatatatgggtttggtgaagaatggacggaaggatagctgccatgactctaaaggggcatttaaatctggtgtggaggcaggaagcaagggagaacttgaggttcccaacccccaagcccttaaaaaaagcccgtgatctgttttgcagactaaagataatcagttagggcctggcgtggtggctcacacctgtaatcccagcattttgggaggtcaaggtgggtggatcatctgaggtcaggagatggagaccagcctggccaacgtggtgaaaccccgtctctactaaaaatacaaaatttagctgggtgtgatggcgcatgcctgtagtcccagctaccagggaggctgaggcgagaggatggcttgaactcgggaggtggaggttgcagtgagcggagatcgagccactgcactccagcctgggtaacagagcaagaccctgtctcaaaaaaagataattagccgggtgtagtggtgcacacctgtagtcctagctactgagaatctgaggcaagaggattgcttgagcctgggagtttgaggccgcagtgagctatgatcatgccattgcactccagcctgggtgacagaaagaccctgtctcaaaacaaacaacaaaaccaacaaaaagataattggaaccaattaatagaattaaaaaagtattctgataagggaaggtcacctcagggtctgttagacttccacaacaaaagtcttccatttggataggaaaggacagggcgagggttggatccctaccacggagtgattatatggccatgtaattttactttggcaagtgatgataactggtggctgaatgatggggcttctgggcagccagtctccacatctgtgtgtgtctctgatgtgtgtgatatgcgtcatacagtgcagtaccacagagctggaaaaaccatgggaccctgttagattttaacaagcgtatatgcagtacaagagagaacacagccaaactgagttgaaactgctaagcagatggtttgttctctagctaacttgattcgttcccacatattagccttgcagtatgagaggttctaattcatttttcagcaaaattatttattactagatgtcatgcacttttgggtgatttgcagatacctttggtaatcacatggtcatcactgctgggcttttatcctctgaataaacgtgaagcatccctgggtaatggcctggtttagtttgctgctcattaaatgccaagacttgcttcctggtgtccttctaacattttatttggggtttgctctgggaatggaaatttattgtattgttgattttcctgtctaaaatgagatagttgagggccaggcatggtgggtcacgcctgtaagcccagcactttgggaggcggaggctggaggatcacttgagtccaggagtttgagaccagcctgggcaacatagtgagaccctatctctacaaataattttttaaaattagccaggtatggctgggcgcggtggcttacgcccgtagtcccggccctttgggaggccaaggcaggcagatcacctgcggtcacctgagaccagcctggccaacatggcgaaaccctgtttctactaaaaatacaaaaattggccaggcatgatggccgccacctgtaatcccagctacttgggaggctgaggcaggagaatcacttgaacccaggaggtggaggttgcagtaagtcaggatcacgccactgcactccagcctgggtgacagagggagactctgtctcaaaataaataaataaataaataaaattagccaagtctggtagtgtgtgtctacagtcctacctactcgggagtctgaggcaggaggatcacttgagcccaggagtttgatttttttttaaatgagatagctggatttaattttaatgttctgtggttttattatcagtcagtgccaatagggagacaactgatataaaattggagaagtacatttagtcctgtcactgctcccttccagtgtggagaatgaattgggttataacagaatcagtgagcccaaccgctcatgttttacatagcagggtggatgaggggaaattaaatggattatatgtccttagatggtttgggggttattctcattctctgtcctgttgaataggcttccgaagatcttctcaaggaacactacgttgacctgaaggaccgtccattctttgccggcctggtgaaatacatgcactcagggccggtagttgccatggtgagtgtgcctgtgtgggatactccaagtatgcattgcttgtcatctgtgctaggctctcttctagacactggggatacagccatgaatgagaccaaatagatacctgttttcatataccagctaatggttagtgataggcttcagaaatgaaatatgcccagaaatgaataggagtagcaaatgatcactttagattgggtgatcaaagaacgcaatttttaagctgtgatctgaatgacaagaagcagcgatctgaatgacaagaagcagccagccatgtacagaatcacagtgaaaaacatttccagccaagcaaacagcatgtgcaaaggtcccagggtgggaatgagcttggctttttgaagtacgggaggagagttgaaatgcccgaagcctgatgggtgggagggaagttgggaggtgaagagttcagaggcatgggcaggggccttctctcttaggggtgtgttgaccatatacttcctgagtgctgggaagctatgggacacttcacacttggcatttctttttttttttttttttgagacggagtcttgctctgttgcccaggctggagtgcagtggtgccatctcgtctcaccgcaagctccacctcccgggttcacgccattctcctgccttagcctcctgagtagctgggactacaggcgcccgccaccacgcccagctaatcttttcgtatttttagtagagacagggtttcaccatgttagccaggatggtctcgatctcctgacctcgtgatccactcccctcagcctcccaaagggctgggattacaggcgtgagccactgcgccctgcccacacttggcattttaaggaggctgctctggttgctgtatggagaatacattgtagaaaggcaagcatgagggcagggagatcaggatcctcagtgctggaataagtggatatactctataaacatttgttcagtgaatgaatataatcttaaggggcctttttatttttccttttttgaattaatagttgccagattttctgctgtgattggttttcttctttgaccatatcttcttctgtccttggaggtctgggaggggctgaatgtggtgaagacgggccgagtcatgctcggggagaccaaccctgcagactccaagcctgggaccatccgtggagacttctgcatacaagttggcaggtgagattttggtatttttcccccttttccaaaatctgatttagttgccacaaggatttgggtttccgaggctggaggtagacatgataccatatgcaggttgattttatcggagtttattgttttcctccctcttaagttggcgtttggctttggttgttaacatcacttagtcgtacctctgttacacgaagtgtagaacctggtacaacacactttgctggccagtctttcctgaaggctctcactgtttgcaccagcgtggccgggagggctggatgtggggagggcatttttcagccttaagtgaatggccattgtaggctttttcttttaacatggtctaatgtccatggagcttcagcttttatgctgctgtggctgtagatttctggcaatgggcgcattttaatccttctggtcttggtcatgtgactatctctttctccacccaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcataggattcattgagttggttacttcatattgttgcattgcttttttttccttct

SEQ ID NO: 35918 - DNA, 53550 bp, Homo sapiens
gtagctaaggcgatcagcgggacttcccactgagacgagcggatgtcatattgtatcagggcgaacctctgaggagcgctggctgcgcttaggcaacggtgcggcaggcgccggggttttctgaaacagaaacgtttaggggtggggaaacgtgttccgaggaactctcgttttgaagtgcgacatacacctgtcttgccctgttccaagatggtggcagagcttctctgagtctctcgcttcctccagtccgtcggagaagcgctctttgattggccagtggacagcgccgtggcatgacgcgctggggcgctggccaatcggttgagagctgagctggacttggcggtgggagccggagcctgcttgttgcagctgtgggtgaggacggctctagctaggtgagcggctccggccaggtgagcggggcgcataggtgacggagggccgagggcacgggtatgagtttctgccgggggcgaggtgagcggcttctgggaggaggccttttcttgacagtttagggtagcgggggaatggatgatccgggagtcccctgcggatgtcgtcccgcaccaggccgggaccgatttctggctccagtttccccagaattgcggagtgcgcacacctggaaggacccaagtcccgttttatagttgagaaactcaagactcagacaagtgaaacgacttttgcttcatgacagctggaactggaacccaggtccttggactcccttcaaggattaaacctcacttattcttacatacacatggtcactgtgtcctgagaagttacgagttggcgcgataagggtggttcagattttttggcatattctcctgttatctttccaggcctttcattcattcactaattcatactttcagttatttacctcttcagataccttccccgatactttggtaaaagctatggacccatctccctagaaaaacggcatattccctcatgcgcataacttcagatgattagtggaccttctatagtccccttggattatgtgtccactgctaagaatccagaccctagaagggtgagggaaacaggcagtaggaaaaggagggagcaggtcttaggctgtacatgcttggaaaccattagatggaggcagtagcttctttttttttttttttttttttgagatggagtctcgctctgtcgcccaggctggagtgcagtggcgtgatctcggctcactgcaaccaatgcctcccaaggtcaagcagtcctccctgccgcagcctcccgagtagctgggattacaggcacctgccaccacgcccagctaatttttgtatttttagtagagacggggttttgccatgttggccaggctggtcttgaattcctgacctcaggtcatccaccggcctcggtcgcccaaagtgctgggattacaggcgtgagccaccgcgcccggccgccagtgccttttaataaagaacgttttgagagagagacggttatttaatgaaatctgctgacatacttgctgagagttgtgatagaacttgctttcattccgactttagttatccctttgcttcccatgaagctccagagtgcttcctgtgcacacagtgcttcaggttcttgccgttgccagaaataaacagatttcttagagtttcagttggagcaaacattggaattcttgtgttctgggctttatgtagtagagtaattcatttgcttttctagccatgcaatattattgccttaatcaaaattatttacagtatggtacttcccaaaataacagacagttgttatccatattcaggaagtgggcgcgagaggccactttaatttgatagactctttaatttgcctttttactacttttcttgaggggcttgttcccttgaaccccaatagctgagttgtgtgttaccctagattttaggatatgaacaggatgtataaatactcaatgaagttgggatcatctgggtttgagagtttagcctgtaggacagttttactgaccacagtcttcattttttttttgaaacagagtctggctctgtcgcccaggctgtgcaatggcattgtctcgcctcactgcaatctctgcctcccgagttcagacgattctcctgcctcaacctcctgagtagctgggactatgggcacgtgccaccacacctggctaatttttgtatttttagtagagacggagtttcactgtgttggccaggctggtcttgaactcctgacctcgtgatccgcccatctcagcctcccaaagtgctgcgagtataggtgtgagccaccacacctggccttgaccacagcctgtcaaggcatgaacataagcaaccgtggtgaggaaagaggttctggtgagactcagcataatagtaattttggtaataccaagtagaaataatttagctcaaaactggttcccattatgaaccaaacttgaagatcagtatccagctcttttctccaaagttaacaaagtgcggaagggaatgagcacccccccgctactgaaaaaaaaatcacttggaatgtaaaatttaatagaggaagaaaggaaggagattagagaggaagatagttggatgccgaaacagggttcaagacttacccttgagcaaggggctgaaattggcttgactgataggacgtgtgatctgtgaggaggtttgaagtagtagtgtttaactacatgtagtttggagatgatcaggtgattgtaaacctcccactcctttgatttatttttaagtgcttgaaaggagaggtgagaaaggagcagtgatcaatgataactgtgcggttaactgacttttgggtatcagatggaaaagaaatactgtcattctacagcaacaggttcttcccaagtatttaagaaacactgtgttagttgggccgggtacagtgggtcacgcctgtaatcccagcactttggaaggccaaggcgggtggatcacctgaggtcaggagtttgagaccagcctggccaacatggtgaaaccctgcctctactaaaaatacaaaaaattagccgggcttggtggcacaggcttgtaatcccagctacttgggaggctgtggcaggagaatcgcttgaacccgggaggtggaggctgcagtgagctgagatgggaaaaaaagagaaacactgtgttacatgacccatcttctttttttgacatttagttcagaatttcacataccattaaggtaattaaagttttatcttcagttcccttttagactatggcgacatacctggagttcatccagcagaatgaagaacgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttggtatggattcttttgaaactggtaaaaatgataaatacaatatattatgaattttatgtgatgctcataaaagtcattaaatttgggcaggtcatcaaatttgtgataagtagtagatgatgagactcctaaacgattcttgtggtgagtagtaagtggtgaatatttgtagaaatctccctggcctgataattccagataaaattggaatcttacaggaatgaggtagaggtagagggagaggatttgtaattcactttttttttggctgataatcagtttgcttttggcttaactgtagactttattgattcctcttaaagtaatttcccagaagaattcgaaagcttagaccgtcttctcatgcttcccgggtacagtgatgctatatggcaaggagaagtagcaggcagaagaaattttaactgttaacaatttgttaagtgtaattttttttttttttgtgcctgagatagtgacctatttcttttaaatgtgggcattatttgaaatgatttttaaacaggtagagagtgtcataaaatttttatatgagggaacattttttacttcattctcattgcttttatttaatgtgcccatatgtgaatgcatagccactggttattaattttctaaatgtagaaaataagggaaaagtaactgaagcattatcttgaaccaatttgaggaagtgaaatgtgcttgcccaacttttcttaaaatgggctaagtcaggttaaaaatctagaagcattttcctgtgtgtgaaatatgcttttaatgttggaatttagtagtttcacatagccggacaataaagatgttagaaaaaaatcatgaagagtatgttaagataaaaggcaagagagaaataatgtataatttatataaatcatgacatttaaaaaattaggaaattggaaaagagaaaaagatttagtatttcttcactgtggctgtttgatggaaattgtggtgtacttagccagaattctaactgcggtgaacgttttgcatactcatacttatgcatacacatagaaacacttacttgtgtgatttactgaacttgaaatttacaaatgaacgctttctaccttaaaaataaaaattttattttaaaaataaaagtggtacctacttataatatttatctttctcacagtcaggttgattatcgagcaaaactttgggcctgtaatttctgttttcaaagaaatcaggtatgtgaattatttttaaaaaatgttatatgttttattttagttgtattatgaaaaaaattaagttaggttgaatttgtgtttacactggcagtgagcagtttctgctgaactcagggtgataacttttgttaagcacaatattgaatttgaacatttgtggtttattctgttgagtggttttcttgagtccttgtcatttgcttggggctggggagggggtgttcattgaattcccttttcttacacattttctgtaggcagtgaatctgtgacccaaagaaagcacctgtttttcatatttctcttgacttcagtatattctgattggatagtgtatattactgaattttcattttctgatctttctaacttttagagtccaggtatcagtgttgagcttcttttgatttaaaaattttaaaagtaccaaactagaaggagctcacaaatcacaagagagacttctctataaaagtaactgtgcggccaggcctagtggctcatgcctgtaatcccagcattttgggaggccgaggtgggtggatcatgaggtcaagaaatcgagaccattctggccaacatggtgaaaccccatctctactaaaaatacaaaaattaggccgggcgcggtgacttacgcctataatctcagcactttgggaggctgaggcgggcagatcatgaggtcaagagatcaagaccatcctggccaacatggtgaaatcccctctctactaaaaatacaaaaattagccaggagtggtggcagccacctgtagtcttagctactcaggaggctgaggcaggtgaatcgcttgaacccgggaggcggaggttgcagtgagccgagattgagccattgcactccagcctggcaacagagcaagactccgtctcaaaataaaataaaaaattagctggacatggtggtgcgcacttgtagtcccagctactcaggaggctgaagcaggagaatcgcttgaacccgggaggtggaggttgcagtgagctgagattgcgccactgcacttcagcctggcaacacagcaagagtgtcaaaaaaaaaaaaaaagtaactgtgcctgtagtggaaatgttctaaaagtggattgtggtaattattgcacaactgtacgttttctaaaaatcattgacttgtataattaaaatgagtgaattttatgttgcgtaaactatacctcaataaagttgttagaaaaaatttgtgtccagcatagtgtacactgttctaacagatcttaagctcttcacatgcattcgttcatatatttgatcataattacaattactcattctcagatacagcatataagtctagtgatgaagaggacagtgtacaattgatgactgaccataggttcggaaactataagcagatgtcatttaaaatatatcttcatgagagattcagaagtatatagaaatcttaaaagcatttctgctccctattacatttaggattaatgtctttgtttaatataatttattatagtaattctaaggcagggtagcatagtggctaaagagccagagatctgtagccagactgcctgggtttggctctcagatctaccacttatttcctgtgtaactttgggtaggtcacttaactgcctgtgcctcaacttccttgtctttaaaattaggatgatagtatagtatacctatagtcacttcatgagattattgtgagaattaaactgagttaatgagtataaaggacttagaacagtgcttgacacatggtaagtgccatataagtatttggtattattatgcttacctaagattgtcacctgccaatttataagtatgatctgcaagtctatgtgtcctaagtggaaataatcttttgtaaccttcctagctggacagtgtgggggttttctagctctaaatgaatgtagagctggaagacggagggatcagggtgatctccgtctcctttgctcccttctgtgcagctggctgactgcgtgggtgaacagggcctctccaggttgctgggaggtggctggtgtgtctgtagtcatagatcgagcttatccctgctgggagctgcagtcagtgggcagtcatggccaggatggggctagagtcttctgctggctctgactgagattcttgctggggctcgcaagctcagttgtacccttctctcccaaccagaggcccctaaagctgcctgtcagctcctcagcagcacttgcatttggtcactctgaggtcactggcctggagtgatcatctgctcactttggggagatgcacctcaacttgtatttttaatgtaaagctaaagactatttggattataagccaacccacaagctgtgaatttaaaacatttgcagagagttttaaaaacaaaagaaaatgcctgtggcattatgttgactggaaaaaacaagttccacattgtatatatgggatgttctcaactgtgcttaagtctggaaggaaatctgccaggaggttgacagtagctgcttctaggtgataggattttggggggcttttcctcctttgtttgcttctattttcctggacttgccaatttttctacattccgtatgtattactttattgataatagccaaaataataaacctaaataaagtctttggctttatttagactattaactattgatgagataggtgaaatctcagcctttaatttgcagggcaaaacttaagaaatggttttcatttgtgtgtttttggctaggcatggtggcttatgcctgtaatcccagcactttgggagactgaggggagaaaatcacttgaaaccaggagttcaagaccagcctgggcaacataaagtgtgcttttaaacatttagaagttacaatagcttaaaactgctctaaaaaatattttttaagaggacagaaatgatataaatataaggcagggttagaagttttaaatgctgatttttatgttttttaacgtgtcctgtattttgtgctttcagaataaatacatggtcattaccattttttttcttcttttttgagacagagtcttgctctgtttcccaggctggagtgcagtggcgcaatcatggctcactgcagccttaacctcctgggttcaagtgatcctcccacctcagccttctgagtagctgggactacaggtgtgagccaccacgcccaactaatgtttttacttcttgtatacagacagggtctcacagtgttgcccaagctagtctggagctcctgagctcaagtgttcctctcgtcttggcatcattatcatttttacacatggaaaataaaaagtgtaatatagttatgccaaccctaataaaactgtttccttcttttcagtttcctccagcttatggaggcatatctgaggtgaatcaacctgccgaattgatgccccagttttctacaattgagtacgtgatacaggtaatttctttgttgtgcatttaatgagcaatgttaaatactgaatttctcttgaaatcctttgtcttccatgtctcttacctgggcaggggacttaaagctgtgagggcagcaggatcctaacctttaggtttgatgtgtgtgcatctactggcattgttttcaagtcctgacattatagaaggctactaaaaaggtagaactgattaaattccaaacctgttctctgtagccttcttcatctcagttgatggtactccatcatctagttgtttagcttcagaaccttagacttatccttgacctctctctttcatgttccatatctaattcactggaaaatcccattggctctatatttgaaatttatccagaatccacccacttccccctccctactaccagctgccctgggccagccactccttcttacttgaatcttctaattgttctccctgatgttaccattgcctatttatacattattcttcacccagcagccacagtaattctttttttttttttttttacaaattgtatttattcatttattcagtgaggaaagtttgttttgctttcaaatattggcctttgtgaataatgcttcaatgaatatagctgttcaaataactgtttacccatatgttggaggtttgcatttctgctacattgtgttttattggaaaacttgtctgtctttatgccagaactaaactgtttttattactgtagctttgtaatgtgctttgaaattagaaaaggtgacattgtttcttttttttaaacatttttgggctcttttttttttctttttctttttttttttttcttctgagatggagtcttgctctgttgcccaggctggagtgcagtggcacgatctcggctcactgcaagctctgcctctcgggttcacgccattctcctacctcagcctcccgagtagctgggattacaggcgcctgccaccacgcccggctaatttttttaatatttttagtagagacggggtttcaccatgttagccaggatggtctcgttctcctgaccttgtgatccacccacctcggcttccgaaagtgctgggattacaggcgtgagccaccgcacccggccacatttttaggctctttattgtcctttgagattccgtataatttgttggttactttttctatttctaaaaaaaaaaaattgttaattgaaaagggattgcattgaatctgtagttcactaggcagcatgaacatcttcacaatattaagtcttacaacccttgaacatgagcatgctcaaaagtgagtttaatttccatatatatgttgatatttttgctttcttctgttattgatttctagttttattccatttttatcggaaataattatctcatgtgtccgtgtgaagagaccaccaaacaggctttgtgtgagcaacaaggctcttgatttcacctgggtgcaggcaggctgagtccgaaaaaggagtcagcaaagggtggtggattatcattagttcttataggttttgggataggcagtggagttacgagcaatgttttgtgggcaggaggtggatctcacaaagtacgttctcaagggtggggagaattacaaagacccttcttaagggtgggggagattacaaagtacattgatcagttagggtggggcagaaacaaatcacaggtggaatgtcatcagttaaggctattttcacttcttttgtgaattttcagttgcttcaggccatctggatgtatacgtgcaggtcataggggatatgatggcttggcttgggttcagaggcctgacattcctgtgttgttatattaataagaaaagcaaaacaaaatagtgaagtgttggagcagtgaaaaaattttgggggtgatatggagagattaatgggcgatgtttctcaggactgcttctagcgggattaggggcagcgtgggaacctacagtgggagagattcaactgaagaaagattttggcgtaaggggtgatgttgtggggttgttagaaggagcatttgtcgtatagaattattggtgatggcctggatgtggttttctatgaattgagaaactaaatgaaagacacaaggtccaaataagagaaggagaaaaacaggtattagaggactaagaattgggaggacccaggacatccaattagagagtgtccaagggagttcagtgtaattacttgtttggttggtgagtttttgggctctattcttgacagagtcctttttgttaagttggaggctgagcttggtgaggtgtgtttttaaaagaccattagtttgtcctaccgttcctgaagattgaggatggtaaggggtatgaagttttcactgaataccaagagcctgaaaaactgtttgggtgatttgactaataaaggctggtccgttatcggactgtatagaggtgggaaggccaaaccaaggaattatgtctgacaaaagggaaaaaatgactgcagtggccttctcagaccctgtgggaaaggcctctacccatccagtgaaagtgtctacctagaccaagaggtattttagtttcctgactcagggcatgtgagtaaagtcaatttgccagtcccgagcaggggcaaatccctgagcttgatgtgtaaggaagggagggggcctcaacaatccctgaggagtagtagaatagcagatggaacactgagaagtgatttccttgaggatagatttccacgatggaaaggaaatgagaggttttaagaggcaggctaatggcttgtaacctacatggaagagattatgaaatgacaacagaatagaatgggcctgtgaggctggaaggaggtttttttttttttttttttttttgtctaagaaccatctgccttgagtggagagggattgataggtggaaacttcagtgggagagtaaacaggagtgaccaatgagaaggagaaaaactggccatgagggacagaagttggaatgctagctgcttctttagctaccttatcagcagaagcgttgccctgggtgatgggatctgatgccttttggtggcccttgcagtgtatgactcctgcttcctttggaagtaaagcagcctttagaagagtttttattaaagagacattaatgatggaggacccttgtgtagtgattttctgcctatataacagcatggtggtgcaggatatggaaggcatatttagagtcagtataattattgacacgtaattcctttgcaagagtgagggctcaagttaaggcaatgagttcagcttgctgagaggtagtggagccgggcagagtggtagcctcaatgatagatgtggaagatactatggcatagcctgcctttgctggtgtgtggcgattaggcctggtggaactgccatcaataaaccaggtgtgatcagggtgaggaataggaaagaaggaaatatgaggaaatggagtgaatgtcaggtggatcagagagatacagtcatgtgggtcaggtgtggtatcaggaataatgtgggaggccggattgaagtgcgggccaggaacaatggtaactgtgggagactcaacaaagagtgagtacagctgaaggagccggggagcagaaagtatatgtgtcaggtgtgaggaagaaaatagattttcaaagttatgagaactgtagagagtgagttgagcatagtttgtgattttgagggtctctaaaagtattagggcggcagcagctgccgcacggagacatgatggccagcctaaaacagtaaggtcaagttgtttggacaaaaaggctacagtgcgcggtcccgttccttgtgtaagaattccgactgtacagctctgcacttaggctgtgtgtaatgaaaagggttgggatgagttagggagactagtgtgggggcagtctctaaagctgacttcaaggaacggaaagaggagtggggaaaggatttaggatctgtggggtcagctaggtttgcttttgtgaattaatataatggtttagtcaggatggtaaaactaggtatccaaaggcagaagtacctaaccatgcctaggaaggaaaggagttgttgttttgtagaagagattggggtttgggagattagtcagacatggtcagcagggagagcacgggtgttttcatgaagaattatgccgagataggtaatagatgaggaagaaatttgagcttgactgaagtaatgggggctgtccgcgaagccttgcggcagtagagcccaggtaatttgctgagcctgatgggtgtcagggtcagtccaagtgaaagcaaagagaggctgggatgaagggtgcaaaggaatagtaaagaaagcatgtttgagatccagaacagaataatgagttgtggagggaggtattgaggataggagagtatatgggtttggcaccaaggggtggataggcaaaacaatttggttgataaggcacagatcctgaactaacctataaggcttgtccagtttttggacaagtaaaatgggattgtaaggagagtttataggctttaaaaggccatgctataacaagcgagtgataacaggctttaatccatttaaagcatgccgtgggatgggatattggcattgagcggggtaagagtgattaggttttaatgggatagtaatgggcgtgtgatcggttgccagagagagtggaggtatcccatacttgtgggttaaggttggggggtacaagaggaggatgcgaaggaggctttgaactggggaaaagagcgggagtgaggtgtggctgtagcctgggaatagtcagggaagcagataatttagttaaaatgtctcgacctaataagggagccgggcaggtgaggataactaaaaaggagtgcattaaagaatgttgtccaagttggcaccagagttggggagttttaagaggtttagcagcctggccgtcaatacccacaacggttatggaggcaagggaaacaggcccttgaaaagaaggtaatgtggagtgggtagcctctgtactgattaagaaggcgacggacttactctccactgtaagagttacccaaagctcggcgtccgtgatggtctaggtggcttctgaggcgatcaggcagcgtccgtcttcagccactaagctgagaagatctgggaaggagtcagagagccttgggccagagttccaggggctctgggagtggctgcttggtgagttgaacagtccgattttcagtggggtcccgcacagatgggacacggcttaggaagaatcccgggctgcgggcattccttggtccagtggccagatttccggcacttgaagcaagctcctgcgggaggaggttctggaggaacccctggcagctgcggtttaggcgtttggagttcttgtgtgctggagatgtggctggggtttgtctcacagtggaggcaatgaattgcaactcagaaatacattgttacttggctgcctctactctattattgtacaccttgaaggcgaggttaattaagtcctgttgtggggtttaagggctggaatctaatttttggagctttttctaatgtcaggagtggattgggtaataaaatgcatattgagaataagacggccttcctctgggggccttcctctggggtctaggacagtaaagcgtctaagggtttttgccaaacgggccattaactgggctgggtttttatatctgatgaaaaagagcctaaatgctaactgatttgggagaggtcagataaagaaaaaaggagcattaaacttgactatgcctttagctccagccacctctttaagaggaaattgttgggcaagtggggagggctagtcgtggaacgaaatggtaagccaggccgggtgtgaggaggggaggtgatagaaagattatagggtgggggagcagaggctgagaaagaattgggacctagcttggcctggtgaggagcaacctggggagaaggggagaggtcagatgagtccgtagaaaaggattaaaaggacttaagagcttggggtggagactgaaggaacagacaggagagaaagaagaaagatttgggacgagtcgcattgggagcagagactagggagggaccaatgtgtaaaagaatgcctggacgtcaggcacctcagaccatttgcccattttacgacaaggattatttagatcttgtaggatggagaaatcaaaagtgccgttttctggccatttagaatcattgtcgagtttgtactggggccaagtggtgtggcagaagaaaataagacacttagattttaggtcagatgagagttgaagaggttttaagttcttgagaacacaggctaagggagaagaagggaatggagggcggaagtttgcacatagtgaaggaggtaagtttaaagagaagggtagagacacggagtagggggtggggagcagccatgggctgcaatgtgggtgagcagccaaagcaggagtccctacaattgacttgtcaccaagggaatgtgggtgaatgaccaaggcaggcatccctgcagagatcagacgccaatggaatgtgggtgaataatcaggcaggcgtccccacaatgattaaacaccaagggaaggctgtcttcctgagtccgtgaccggcgcgttttgggtccacggataaaaggtgtctcctttgtctctactagagaggaaaaagaactggaattggaaggacagggagattgaagggtagcaagagaggctggagaagagagtgaaaagaccacttacccgatttgaaattggtgaaatattccctgggctagttggtccgaggacctgaggtcgtaggcggatctcttcacggggtgagggtgaggacaggggactggtctcttgaaggagtccctctgacccgggtcttcggcaccaaatatctcacgtgtccgtgtgaagaaaccaccaaacaggctttgtgtgagcaacaagctgttattttacctgggtgcaggcgggctgagtccaaaaaaggaggcagcccagagtaattctttaaaaacaaatcggccgggcgtggtggctcacacacgtaatcccagcactttgaggggctgaggcggggggatcacaaagtcaggagatcgaaaccatcctggctaacacagtgaaaccccttttctactaaaaatacaaaaaaaatttaaaaattagccgggcgtggtggtgggcacctatagtcccagctacttgggaggctgaggcaggagaatagcgtgaacccaggaggtggaacttgcagtgagccgagatcgcgccactgcactccagcctgggtgacagagcgagactccgtctcaaaaaaaaaagaaaaaaaaatcatgttacttctctgttcagaaaaccccactggagaaagtggctttcttttacccagggtaaaagacagttttcaaagccccacgtgttaccactccaaccccagtatctgctagtgtcctcgttcagcccagtgggcctctttgactctcctcaaatgtgctaacactcctgcttgaggacctctgctgtagcttttccctgaggctggagctctcccctgtatctgtggtgctccttccctctcttccctcaggctttgctcaaacattactttctttttctttctctttctttgtttctttcctttcttttttttttttttttctttttttagacagagccttgctctgtcacccaggctggagtgcaatggcacgatctcagctcactgcaacctctgcctcctgggttcaagcaattctcctgcctcagcctcccaagtagctgggattacaggtgaaccccactacgcctggctaatttttgtatttttagtacagatagggtttcaccatgttggccagggtggtcttgaactcctgacctcgtgatccacctgtcttggcctctcaaagtgttgggattcaggcatgagccactgtgcccggccctctttttcttttttttttttttaagatggggtcttgctctcttgtccaggctggtatgtagtggtacaaccatagcttactgcagcctcaaattcctgggcttaagggatcctcctgcctccgcctcctgagtagctgggaccttaggcatatgccatcatccccaactaatttttaaatttttatatttttttttgttagagacggggtctcgccatgttggcagcctggtcttgaactcctgtgcttaagcaatcctcccatcttagcctcccaaagtgctgggattacaggcatgaacccggctcatatgctactttctaaatgaggctgccctgatttctctgtttaacagttgactctgccctctgcctctcctcctggtgtttgcagtcccccttaacctctccattccagaaagtttgctccttgaggcaggtagaagtctttgttttttctgttcactgtgtgtcccaggacctgaaacaatgtctagcatgtaggaagtattaaaaaatgttggcaaagttgttggatacaaatagtttttatctttagtttgatttaataaaatctaagtcatttaataagttagagctttgtatagatgtccttatctcctaaaactaaatatagatgaagacttacaattttcatacctaatttgccttaaaaagtgctggttaagtctatttgtatattgatcattatgctgtttttctttgcccaaagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggtttgtaccttacttgtacaggagcagaaacaaggacttttttttaaaagagactggggtctctttaaaagagcctgtagcccaggctggagttcagtggtgtgatcattgctcaatggctcaagccattggcccacctcagcctcatgagtaggtgggactagaggcacatgccaccacacccagctgaggacatttcttaaaaattagtcattcacttttagtgtcattggaaatgaatctttttggcttttttttttttaaggatatgttgggcctgaccaagccagccatgcccatgcagcaagcacgacctgcacaaccacaggagcacccttttgcttcaagcaggtgagagcccaacatggagtgttacacgtattgtgatggacatgcagatgatccatgggagtaagggaagaaaaatattagaatttgtattttcttattattagagaaaaagataaatgattaagcctaatcaatattcagtgttttgtcaaaaaggtttggagaccactgtgctcaattgctgtttttagacattccacatctgatgtcctttttgatgcttaagtaaaactggaaaaactgaaaagacttctttcatgtgtcctcaaacatacttatgaccgggtattcacttgactcagcccattgagtgcctagactgagctaacaagctcgataaaatgcattgcccgacatgctgaagacaacctcttactttcaaggcttaagagaagcacagattagaatgatgaggaatgatgaagattgtccacataaatggacctcacatagactgaactcatgttaggcatgtccttaggatttttttgctgtctaaaaattaattaaactgaattgctccttttccagacaatttttttttccgtgcaacataagtaaattgctaagtactgggctttatattcctcaataaaactgctttaaattgttttgtgttagtagagagatagctttgaagaaaaaaattaccagtcagttactactctgaataattatcttgaagagcagtaattatgtggcacctagtgttgaagaccagagtactttattcaatctgggttgatgtgtctgttaaaatcttgcagatttctgcagcctgttcacaagattgatatgaacctcactgatcttcttggggagctacagagggacccatggccagtaactcaggggaagagacctttgcgatccactggtgtggctttgtccattgctgttggcttgctggaggtaatttaaaatttaccaggacctctcaaatcatacaaatgtgctctcagaaaatatatttgttggctttgtttgaaaatcacttgtgatctaagtcaaccgtctgtgttaatgtatcagaaagcatttgaggcatcattatcattcacgttgagggagcccctcaacattttgaaaatgccaaaagttttcattgaaaaactaagaattagagcaatagggagcactcaaacagcgaattaataaaactgtgcaaacccataaggttggaagaagacaagtgctgcttttctgcattatcatctgtattattctgcattatcaccactttttaggacagctggagagaatgcatctttggagtatttctattgggaaactgaaaccatactaaaaggtgaggctgtatacttctaacatgctgccattcgctattttagggcacttttccaaacacaggagccaggatcatgctgtttactggaggtccccctacccaagggcctggcatggtggttggagatgaattaaagattcctattcgttcttggcatgatattgagaaagataatgcacgattcatgaaaaaggcaaccaaggtaggtgctcttgggtatgggctgtaattctgaaagcccattgtcaggtttgggctgctctggagtgacagctactttgccaaggtcatgtgtcatggtcagcaagacgctgtttcagagacagttttccaatcttagctgctgttaaattattgctcctactttcagaccttaattagagtgggtggccttaaaactactcaaagggttttgagaatgaaaactatatttttattttattcagatatttttgaaaatgatttccaggccagtcccggtggctcacggctgtaatcccagcgctttgggaggccgaggctggcagatcacttcaggtcaggagttcaagaccagcctagccaacgtggtgaaaccatatctctactaaaaatacaaaatttaagccaggagtggtgactcacgcctgtagtcccagcactttgggatgccaaggtgggcggatcacttgaggtcaggagttcgagacgagtcttgccaacatggcgaaacgcctgtctgtactaaaaatacaaaaattagctgggcatggtggcatgtgcctgtaatttcagctactcgggaggctgaggcacgagaatccgttgaacctgggaggcagaggttgcagtgagctgagatcgtgccactgcactccagcctgggtgacggagtgagactgtctcaaaaagtaaataaaaataaaaatacaaaaatttgctggggatggtggcgcacgcttttaatcccagctacttgggaggctgaggcaggatgatcacttgaacccgggaggtggagatcgcaccactgcactctagcctgggcaacagagagagactctgtcacaaaaagagaaaagaaaatgatttacatgtttttatatttgattacctccttcggtaattcaggcataccttgggaataatgtcactgtttcctaaagatagctttcctctcttcacagcactatgagatgcttgctaatcgaacagctgcaaatggtcactgcattgatatttatgcttgtgcccttgatcaaactggacttttggagatgaagtgttgtgcaaatcttactgggtatgttgacagtgaaaacctgggcagagtgacagtgttattttaaggaaagagaaattagtgatggagccataggaatgggcaaggccaactcagagaagctttcaggtagctctgggctatggtttcagtgactggggagggcctgtgggctccttggagagggaagtagtgattagtaggagggctcaagagttcactacaaataagtcgtttcagagtaacttatttcttccttagagttgttaacacttttacagagaccaggccaagaaagcaagcagcatggactatctggccttcatcagggcacttccttttgagaattggggaaaacagggtctgaatgctgaaacaactaggataaacctggctaagtggccatactttgtgactaactccaagtgcactcagcctagaggttgtactgactcaaagcctgagtcagtattgtattcacaggccagagtgtggagcagtggttctcaacatgtggtggtgtccagatttgcagccttaggggctcctgggaactgattggaattgtatatttctaggccttacccagacctcctgaatcggaaaccccgggaatgcagctctctaggagattctagggcacatgaaagtgtaggaaccactgatgagcactggtctgcagctgcctacgtattgttatcaccaggggaactttaaaagctacactttctttaggtcttgtcctcagagattctaatttaattagcatgaggtgcagcctgggcatcagcattttaaaagtttctcccgtgattctaacatagagccgagtttgagaaccatgcagcatcttgagcctcactctagacctgaatcagaacctgcatttgaacaatatcccaggtgatttgcatgcacagaagtttgagaagcatcatagagctgtggaatgggcctgagagtctgcatttctaacaaccccacaggtgatgctgctggtccccagtgagtaaaaggaataaaaggtagaaccagaatcagttggagttgtcctagagagcagcagatgagttaggtgatagaattagggtcccaaatgatactgatgtagctatctcagtaatccacatttaatagtatgaattcctaccacggccttccaggagttctgactcggaatgtccatagaaaagctttagtgtatttgtgaacatcccttagattgtatgctagtttgtgtgaattttttctgtgaagagttaccatctgttgcacacatgtgttagtatagctcaaggtgagccaacagtgtgggatgacttccagcaaaggcaaggtgattccaggctgtgctataggagaagattatcttcagggaagaccatattcttggtttctttggtgctagtcacaccttatccaaatacattgttttctgttctgaacattgcaatttcaaggggcaataggagatgaattggagatgtttgaagaagagcagtggtggagagtcctggaaactgtcatgtgaggaatgattgaagtagctggaaaagattaagctgaagacacatgggggtgtgagaactgtattcagcagttgagggacttccctgtgaaggaatctgatttgttctgtatgtgaccaaagagtggaactagaaccaaaccagtgggtggaagctgctggcaaatgaaatttcactcaatatcaagaagggcctttcttaacagagctgttcaaacacagaatggacagcttggggaggaagctcccaatgctggaggagttcaagcctagtctggatgtaacttggcaggtattttgcagagggtttggttgagtgttagtattagagttgtgtgaatgtcacagaaaacccacaataagtttatttctctggcggtaggcagtccggggctggtatgttgctttcgtcatcattacgggctgaggctcctactaagctgctctaccaccattcatatgccatctgtggctcaagacagttgctggagctctagccatttacagcagcaggaaggaggaaaggtcagagaaggattgctcttcctggaggaacacactccacatataaaggacacagcaatagtcagaacgcacatgccaacagaggcacatggccataggcaaggcaggctggaaaatgtcattgttccaggaaactaaggaagaggtagatatttggtgccaaagagctgacagacggttcaggcactctgagatggccggaccagatgatctttcttgtgttcttcaagattctgagatcttgttttatgaatgacgtttggaggcataacttgcgtcaagctgtgcttttctgtccaaatgcatgaaatgctgacattttgcacaatgttttcctctaacttcagtaagggattaatattaatactcatgagttggaaaacataattcttgtaaagtcaagaattcagtattttgaggcagtaaattaacctgaaaaggatttcccacaggcctgggtattttcccataccaaagaactgtgagaggaattagagctgttcttaaggcttctgtttaatgctttagaagtagtttctttgccaagtatgaatttaacatgctgtttttatttttttaatttattttattatttatttacttatttattaattttttttttgtttgagaaacagtcttgctctgtcgcccaggctggagtgcagtggtccgatcttggttcgctgcaacctctgcctcctgggttcaagtgattctcctgcctcagcctcctgagtagctgggattgtggctactaatctttgtgtttttagcagagatggggtttcacgatgttggctaggctggtcttgaactcctgaccgcaagtgatccgccctccttggcctcccaaagtgctgggattacaggcgtgagccactgtgcctggcctgtttttttatatttaaattaatcagtggctcttttggggacctggtttctttttttctttaaattatttttgtaaatactgagggagcatctgaatggctttcaatcttcctaatattcacttgatttttttcttcttacctagaggctacatggtaatgggagattctttcaacacttctctcttcaagcagacattccaaagaatctttactaaagattttaatggagatttccgaatggcatttggtgctactttggacgtaaaggtacggtaaacttttttttttttttatgtggactcactgtactgcccaggctggtctcaaactcctggtctcaggcaattttcccgcctcagcgtcctaaagtgctgggattatgaggcatgagccactgtacctggccatacttttaaaacttcaatgaaattatagtgttcttactttttcaatcaatatccagacttctggcaacctccacctgctggacatgggcatgtaaaagccaattaaaaggatctcaaccaaatggctattaaaagcatgttattcactttatccctttgcttcttgaggatgacctatatatttatttatgttctaagtaacaagctgcctggttcaccctcaggctctgctccaccctgcttcaaggcagtaggagatagaagaggaagtagggtgggtgttatgagcagcactgtggcctgaggacaggggcagccacacggtggtctgcatccacccagccatcagcatggctcactgcattgcacagagacgtggttatgtttaatgtcttcctgaagaatagccaaagtactctaaaatagcactgggccaggcatggtggctcatgcttgtaatcccagcactttggcaggccgaggtgggcggatcacctgaggttgggagttcgagaccagcctgaccaacagggagaaaccccatctctcctaaaaatacaaaactagccgggcgtggtggcacatgcctgtagccccagctacttgggaggctgaggcaggagaatggcttgtacgtaggaggcggaggttgcggtgagccaaaatcctgccattgcactccagctgtggcaacgagtgaaactgtctcaaaaaaaaaaaaaaaaaaagacagcattttgagattttttttttcccatgtagggactcatggccctgatacagctgattctaagtcattgagaaagcattaaaagagggtgttaggccaggcacggtggctcatgtctgtaatcccagcactttgggaggccaaggtggggtgattgcatgagctttggaattacagaccagcctgggcaacatagcaagaccctgtgtctacaaatgatttaaaaaaaaaaaaattaacctcgtgtggtggtgcacacctgtggttccagctactcaggaggctgaggcgggaaaatcacatgtgcccaggagtttgaggctgcagtgagctatgatcatgccactgcactcagcctgggcaacagagttgccagttggcggggcaggtcaggggccgtcattagaagatacgattggaattattacttggagaattagagataattattaaatcatctaggttagactttaaaccataatcttaaatgcttgagggttttcttttaaagatggacttttgaaatgaattcacattttaaaaatctaagtatgttggccttgtcgttatattggagttcatgaattaagtatttttaaagcaacacaaaacagtatgttctctgattaggtatatgcaaataattatggatatacatgaatgtgaatatattcatacaagggattggaaaagaatgtagtattgttagaattgttatctacatgtacagtaatttccaagtttaaaaagtaagttgtgagagttgaaaatgctcatgtttcaagtgtttctaagggtggattttattaaagttctaatcacagtggctgaggaaaagtttgtaggactaagcagttatgatccctgtggagttttctcttggcagaatagtagtgttatattttccctctaagctttcattgtggccatgatgacagcagggtggattgaagtgatctttaactttacactgtcacatatttgttatagacctctcgggaactgaagattgcaggagccattggtccatgcgtatctctgaatgtgaaaggaccgtgtgtgtcagaaaatgtaaggaaaacaactccatcaccctcacctcctgccccggatttaacccgtcagaagtgtcagagcatgatgatctcacatgtgtcacctgttggatgtgtctgcagtgacaggagaagggctaaccctcactgatgactatactcggagaggtggtgttattccatctgttcatccaaagggttagagagaaggaaactgaggcccagaaaggttcagtatcttgctcagggtcagaactgacatgaaggagttagagcccaggtgcccctgactccaccacccatggtcgttgtgccaaagccacggcatgctgttcagcacaaggcaaacattcagcacagtccttccagagtaagcctattgctcattgcccttagaggtgatacgtttgtctcactcagctaataacaagccttttacaacagagaccaccatgagttggtgtggaagtgggtgacactgctgtgtgtgcagacatctgttttctctagtaatagtttttgagaacaatttagttatcatttgagatgagcggctttgcttattgtccacttcctctgattatactttacttgctaggaggcaaaccattcggtttggcaaggcctctctaaggtggtcctgggctggggttacacagtcatgttcttccctcattgtcaccatcaatgggagggtagaccatagagccagatgtggatccaaggtgcaggtttacaccccgcacctggcccgagcaaaggacttatttgctctgtgattcagtatccttatctggcaaatggggataataacagtgcccactctacagcattgttaggaggtttaaatgagttggttcaggtgaagcagttagtgcctggcacactggaagtgtgggtcttctttcatgttgtcagcaacaaacgttcttgggtgaccacataaattaaacttttgttgagcttggcagaggcaaggtgatttgagagcacattcctgtagccttctgagtgaggcagattgctgccctaaagcccatctgatgagtcattcattacccccagagtactaaggggcttgtacccctatttcctggcaaggctttggaaggctgccttgttataaaatatttttcatggacttaaaatctgcctgctgaaggcttcttgaagtagtttaagaaggtatttttatgaattagtacaaactaattaatatttctagtagaattcagccatgaaagttttgtttggggaatgaggatgcaaagaataggaaaatacaattttcagacatactgagtgatgaatttctatacctaccatttagtcattgattgttaacattttgccataattgctctgttgtcttgtttgccacatttgctttatctgattttcatttatttgccacatttgatttatcaactttttttttgccgacctttgaaaataatttgcagatatcatgacagtccttaagcacgtcagtatgcatcttctaaaaataacgatgttctcctaccacgatgtcattatcaaacttaagaaaataataatttcctaatatctagttcatatttttttcctaatttccccccaaatgccctttgtagctgtttttaccccaactggcattgcatttgatattacagcctttgtaaagtgagagtctgggttaaaggtgtgtttacattcaggcaaagcctttttgccaagcattgttcctgggcagtgtgtactttatgcttgtgtcacatccagaggcactatgtctgctgtcccgtgttacatgtgctgagttagatcgcttggtgatggtggtaactgccccactgcctttctactgtaagggaacacttccccctttgccattagcaggcaatcttttgaatgagagtgtgtagcacaatatgaaactcttgtttgccaacagcctaatggtttttagcatccattgatcttcatgcaaatcagtttatttctttggggattataaaatggtcatttcctaattgtctttatcgtttctccaataaaggcatctaaagagcaaatgtttaagtaaggaatttgtgtatcagtgagaaaatgatattttggagctctagaggagccgtcctgggtctggtgcttagaatggggttagcaaggcaagaaggggaggcatgaatgctcctttgacttctttgcctttttcctgagcacagctcttcaccttccagcagataataaacacctgcttcctttagaaaaggccactacaaggaaggtgaacccccgtgaatccatctatcttattatctagcttagggagtactgacagaacagagtgcaccctctccgctctccaccttagagctgctgtgtgatttcaccttaagggtctttcttaagagtctgacttgattgattctttgtggatttcagcgttatataccatgtagagacaccccctgacacacccacccccccccacacacacgtagtatatgtgtaaacccggaacgatgggtcacacctgtaatcccaacactttgggaggctgaggcgggaggattgcttgaacccaggaggtcgaggctgcagtgagctgtgattgtgtcacggcactccagcctgggcaacagagtgagagaccatctcaaaataaataaacataaataatatatatgtatagtatatatgatgtaataaaaattggtcagaatgttaatataaaaagcttaattttaaagtgtaaatgtaaatgttaagccttcatctgttctcttttcaggagaaggttttatttcaacttaaatgttctcctaaaagaagatactctaagtagcctgccctactcagtcagtacttttcattagcaattaaccacagggatggttttctggttttgtttttcaaattcctcttcccacccccaggagcttggtgttggtggcacgagtcagtggaaaatctgtggcctagatcctacatctacacttggcatctattttgaagttgtcaatcaggtgagttggatttcttcacatgtcttcatgtcttagtgtcctgttttgtgatttatctcaaaccagtggtctctggttactttcttcacaaaccaatattccttgggtattgtattaggcctgatgatagtctggcatgaccttttcttatttattccttcaagggtttagtcggagtcaggcaacaaattacttttgtccttttattgttgaactgataaggtcattagaagtgtaatagattttaccagtcatcataatgttggtgaattttttagtgcatcggttctttccctaatattttattatgaaaaattccaaacatacagaaaaattgaaagaattgtacggtgaacacgtactacctaggtgaacccatcaacttgattctgtaattaacattttactctactggcataccttggaaatactgtgggttcagttccagactaccacaataaagtgaatattgcaataaagcaagtcacatgaatattttggtttcctattgcatataaaagttatgtttgcactatagtatgttaagtgttaaatagcattatgtctttgaaaacattgttcattcttggattaaaaaaatactttacagttgacccttgagtagtgttggggtgctgacactgcatagttaaaaatccacatataacggccgggtgctgtggctcacgcctgtaatcccagcactttgggaggccgaggcgggcggatcatgaggtcaggagatcgagaccatcctggctaatatggtgaaaccctgtctctactaaaaatacaaaaatttagccaggtgtgttggtgggtgcctgtagtcccagctacttgggaggctgaggcaggagaatggcgtgaacccaggaggcagagcttgcagtgagccaagatcgtgccactgcactccagcctgggcaacagagcgagactccatctcaaaaaaaaaaaaaaatccacatataactttaactcccccaaaacttaactactagtagtccactgttgactgggaacctgaccgataacagttgattaacacatattttgtaagtaatatatattatgtcctgtattcttacaataaagtaagctagagaaaagagaatgttattaagaaaatcataagggaaggaaagtgtatttactatttgttaagtggaaatgaacatcacaaagtcttcatactctcatcttcatgttcagtaggctgaggaggaggaggaagaggagggtttggtcttgcagtcttgggtggcagaggcagaagaaaatccacatataagtggacctgtacagttcaaacctgtgttactcatcattaaaaagtcaggaaacaacaggtgctggagaggatgtggagaaataggaacacttttacactgttggtggactgtaaactagttcaatccttgtggaagtcagtgtggcgattcctcagggatctagaactagaaataccatttgacccagccatcccattactgggtatatacccaaaggactataaatcatgctgctataaagacacatgcacacgtatgtttattgtggctctattcacaatagtaaagacttggaaccaacccaaatgtccaacaatgatagactggattaagaaaatgtggcacatatacaccatggaatactatgcagccataaaaaacgatgagttcatgtcctttgtagggacatggatgaaattggaaatcatcattctcagtaaactatcgcaaggacaaaaaaacaccgcatgttctcactcataggtgggaattggacattgagaacacatggacacaggaaggggaacatcacactctggggactgttgtggggtgggggaaggggggaggaataacattaggagatataactaatgctaaatgatgagttaatgggtacagcacaccagcatggcacatgtatacatatgtaactaacctgcacattgtgcacatgtaccctaaaacttaaagtataataataataaaaaataaataaataaataaaaaaacctgtgttgctcaagggtcaactatattgctcaaaaatgttaatgctcatctgatcctttagtgagtcatactcttttgctggtggaaggtcttacattgatgttgttggctgctgactgatcaggttagtagttgctgaaggctgagtggctgtggcagtttcttctctttttgttttttttttaattaagacaaagtcttgttctatcacccaggcacgatctatcacccaggcacggtcttggctcactgcaacctccacctcacaggttcaagccattctcccaccccagcctcccgagtagctaggcttacaggtgccagccaccatgtctggctagtttttgtatttttagcagagacaaggttttgccacaatggccaggctggtcttgaactgacctcaagtgatctgcctgcctcagctcccaaagtgttggaattacaggtgtgagctaccacgccccacctgggaatttcttttttttttttttttttgagacggggtctcgctctgtaccccaggctggagtgcagtggcatgatcttggctcactgcaagcttcgcctcctgggttcacgccattctcctgcctcagcctcccgagtagctgggactacaggcacccgccaccacgcccagctaattttttttttgtatttttagtagagacggggtttcaccctgttagccaggatggtctcgatctcctgacctcgtgatccgcacgtctctgccttccaaagtgctgggattacaggcgtgagccaccatgcctggccggaatttcttgaaataaggcaacaatgaaatttgctgcatcagtcgactcttccttccaggaaagatttctctgtagcatgcagtgttgtttgatagctttttacccacagtagaacttctttaaaaaatggaatcaattctcttaaactttgctgctgctttatcaactaagtttatgtaatattgtaaatcttgtcatttcaacagtgtcacagcatctgcatgaggagtagattccatctcaacaaatgactttctttgcttatgcataagaagcaactccatatccattaaagttttatcatgaaattgtagcaattcagtcccatcttcaggatccgcttcttcatctttttaattaaaaaaaataggccgggtgtgatggctcccgcctgtaatcccagcattttgggagattgaggcaggtggatcacgaggtcaggagttcgagaccagcctgaacaacatggtgaaaccccgtctctactaaaaatacaaaaaaaaaaaaaattagccacgcatcgtggtgcacacctataatcccagctactcaggaggctgaggcaggagaattgcttaaaccaagtgatggaggttgcagtgagccgagattgcgccactgcactccagcctgggagacagagcaagactccgtctaaaaaaaaaaaaaggccgggtgcggtggctcacgcctgtaatcccagcactttgggaggccagggcaggtggatcacgaggtcaagagattgagaccatcctggctaacatggtgaaaccccatctctactaaaaatacaaaaaacaaaattagctgggtgtggtggcgggtgcctatagtcccagctacttgggagactgaggcaggagaatggcatgaacccaggaggcggaggttgcagtgagccaagattgcgccactgcactccagcctgggcgacagagcaagactccgtctcaaaaaaaaaaaaaaaaaaagagatggggtctctctttgttgcccagactggtctcaaactcctgggcttaagccaccttggcctcccaaagtgctgggattacaggcgtgagccaccacacccagccaggatccactttttttttttttttttgagatggagtcttgctctgttgctcaggctggagtgcagtggcaccatctcagctcactgcaacctctgcctcccggggtcaagcaattctgctgcctcagcctcccgagtagctgggattacaggtgtctgccaccacacccacctaatttttgtatttttagtagagacggggtttcaccgtgttgtcctggctggtcttgaactcccgacctcaggtgatccgcctgccttggcctccaaagtgctgggattacaggcgtaagccactatgcccagctgaggatccacttctaattctagttatcttgctccttccaccacatcttcagtgacttcctccactgaagtctcaaacccctcaaaattataagaactggagtaaacttccaaactcctgtgaaagttgatattttgacctcttcccatgaatgatgagtgtttcaatgacatgtagaatggtgaatccttttcagaagattcttcattttctttgcccagatccatcccaggaatcactaggtatggcagttatagtcttatgaaatgtgtttcttaaatttaagacttgaaagtcaaaatttctccttgattcatgggatgcagaacggatgttgtgttagcaggcatgaaaacgtttatctcctttatatctccgtcagagctcttgagtgaccaggtgcattgtcagtgagcagtaatattttgaaaggagtcttttttttcctgagcagcaggtctcaacagtgggctttaaatatttagtaattgctgtacacagatgtgctgtcatccaggctttgttgttccttttgtagagcacaggaagcgtagattgagcacaattcttaagagtcctaggatacttggaatggtaaatgagcattggcttcaacttaaagtcaccagatgcccaggtatggtggctcacacctgtaatcccagcactttgggaggccaaggtgggtggattgcttgatctcaggagctcaagaccagcctgggcaatgctgtgaggcctcatctctaccaaaaatacagaaattagccagatgtggtggtgtacgcctgtagtcccaactacctgggaagctgaggtgggagaatctcttgagcctgggaagccgaggttgcagtgagctgagatcatgccattccactccagcctgggtgacagagcaagaacctgtcttagaaaaaccaaatagagtcaccagctgcattagatcctaacaagagagtcaacctgccctttgaagctttaaagccaggcattgacttctctctagctatgagaatcctagatagcatcttcttccaactacactgaaaatctgtggtttagtgtagccaccaccttcatcagtgatcttagctaatctgaataacttgcagcagtttctacatcagcacatgctgcttcaccttgtgccattatgttatggagatggcttctttccctaaacctcaggaaccaacctctgccagcttccagctttctcctgcagcttccttacctctctccaccttcataaattgaagagagttgggaccttgctctggattaggccctggcttaagggaatgttgtatctggtttgattttctattcagactactaaaacattctccacatcagcaataaggctgtttcactttcttatcattcacgtgttcacttttaatttccttcaagaactttttctttgcattcacagcttggcagttttggggcaaaaggcctagctttcagctatcttggctttcaacataccttccctactaagattaatgagttttagcttttgatttaaaatgagagatgtgtgactcttcctttcacttgaacacttagagggcattgtagggttattaactggcctcatttcaatattgttgtatctcaggaaataggggaggcccaaggaggaggagagagatgagggaaaggtcagtcagtggagcaacagaatatacacaacatttatcagttaagtttgccatcttatatcagtgcagtttgtagcaccccaaaacaattaaaatggtaacatcaaagatcactgatcacagatcaccatagcagatatataataataatgaaaaagttggaaatattgtgagaattactgaactgtgacacagagacatgaagtgagcacatgatgttagaaaacttgcgccaatagtcttgcttgatgtacgattgccacaaatcttcaatttgttaaaaaatctgcaaataaatgaggcatgtctgtgtttgtttaatgattaacaatccgtcacaaactggataattcatcagcaataactcatccagtttgtgattcatcaatccatcttcgttttgctgcatttcaaaacaagcctcagtcatccatgtatttcatgcctaaacacttcagtaggtgtatcattaacttaagttcagtattgaacgtagttcttcaacttttttggagataaggttatatgcagtgaaatgtgcaaatcctaagtgtgcccttcaaaatgtgtcaagaaccttcctgtcattgctgtgtcagtcattttagaagagtacagtgggctctgtgaccgtgtttgagttgcgcctataacagacaaggttatggcctctcatcctacagcacaacaccccgatcccccaaggaggcagaggagccatccagtttgtcacgcattatcagcactccagcacccagagacgcatccgcgtgaccaccatcgcccgaaagtaagcagccccagtttcctttctgttgaggaactgactgacatttttcccttgaagagatactttaacatttgttagtttgtctttttgattccattgaatggttctcaccagacctcattagcttatttgatcagaggaggaggcatttttggctaacccagttgggcctatgaacacttgcctagaggaatcatctttctgtaggaaatatagttcattaaaagtattaattattattattatcatctggagacagtctcgctctgttgcccaagctggagtacagtggcacaatcacagctcaccacagcctcaacctcccatgctcaagtgatcctcccacttcagcctcccaggtagctgggaccacaggcacctgccaccaaaactagctaatctttttacttttatgcagagagatggtgatctcacattgttgcccaggctggtcttgaacttctaggctcaagcagtcctgccaccttgccctcccaaagtgttgggatttcaggaatgagccactgcacctagcctgtgtttctttttctgaatggatgtctggctttctgatctctcctaaacataagcatggcactaactctggaattgtcagttgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactggtaaattggggacagtggcattaggttcagtcttggtttctgctttactttcgagaagaaaattgtcacttaattattattatatagtgaatcagcaagaatttatcagttgcctaccttatgctgcacgctggacattctgttaaagacgtgttaaatgtgcattttcccctcagagatttacattatagttgggaagaaacaacacgcatggagcatttggagagtgatacaaatctgtgtgggttgagttgacttagatgagtcattttgtgaatgctctggtcttgtatttttcttctaaatctggaaagtggttttggaaatagggatccagcctggtaagtttagggagatgccttttatcagtctggatttaatgagatgagagaagtcacactgtaatttaaatggggaaagtcttttataaagaatacaacaagagagtagaacagtgagggactggctagaaggaagtatagagaagtgggcagccactacttgtggggctgagatagagcaccaaaggaagtgcccttctccccagggctgatccagacctagttgggagggcatggccatggcttggtgagtcttttgcagagaagttaccgtggtgctgtgccaggggaacttactagaaattcactttctagaatttgaagaaaatccaccctccagggtgccagggaaagctgtgtataggaaaatgtctcactggagacatgcagggatgctgcttagctgctggctgccatgttctccaggagctcagcactggggagccacggtgcagcaggacctggcacccgggaagctgctgaatgagcactcgggcgcccaaagctgacgctcacctccagcactctctactgacaacgcttgatatcgtgccagctggcaaaggagaggtagtgaaagggcccatgtccatttcacagcaggcaaagggggtgagtttggagccagcacaaggcaataaatcaataattggcacatgataatcttaccttcctggagagtcacagcatgtgtttgtgatcaaagccaccatggaaaggcccagtagggaaacctgtttcattttgttcagccctctatttgcccttgccatctcatggaaccatttttcaggaagtgtcaacatttcaaacataatttgaaaattgcttctttaggatttcagagggaggatagataagcagagggcccaggtggctaacaaagacttcctgtggaaatgagccttgagtcaggtttttattacagaattaattggagaagggaaggcaaggcttgctgagtggagggctagcaggaatgagcctgcaggagctagctgggtcttttagcttatgctgaggactttggagaaaccagtgtcacaggaggctaggttgtgcagtggggaacagagtcagggaaggtacaccttgattggggagctccttaactttagggagcaagggagacgtggctgtgattgttaagcgggggtttgatgtcagcatgatgcttgtgtttacatttaatatcaccatgtgaggcacattgcagagagaaaaggctattgttgtgaatggaggatttttcaggctcaatggcactgagaccagcatagtggcaggagagatggaggaagcagaaggtttgaaatcaggatgtaaactgaaagaattgataaaacttgatgaaatgattctgtgtaaagtcaaaaaccaaaaagtcagcactgaatgacatttcacacatgggtaactgcatgagtggtgttgaggtagaagatgggaaaggagagcaactttagggtgggagaaagttttttctctttttttaatgtaatagtttatttttgataatttttgataattgaatgtgaacttgcaaaagtgtgtctcacgaaaactcccatatttgggtggatgtcctgactggggctcaggctataggtcagcactggacactggagggtggatttggatgacacccatctggctctagtgttcatttgtacccaaagcagtgaggatgggaggagggggccaagaactaacccccaaggagtccacagttagggggaggaggaagacaaaaccattgaagaaggcagaaaagggttggttggagagattatgagaaataggaaagtgatgtattagcagctgaaggagaaagtttcgagacatttgggcagtcacctggctcatgctgctaggaagttcaagaagacgagaactgcggaaggacaccagattttgtgggaagaaagtaattgttagaaatggggtttctttaaatgatgaacagtccaattctttagtgaccagaaatgtgtgagcagaaataaaggcgggaagagaaaacattgtggttcagaagtctgccattgggagaaataaatttgagttttagtgtgagagaacatcaaagcgtaactataattgttagttttcatggtgttagagggttttcatatggaacaggtgcctggaagagctcacctagcttctctggttagggcagtcctcaggccagcattgcctgagagctgattagagatgcagaatcttcagctcctccctagagtctgcattttaacaagatcccctggtcatttgcctgctcactgatgcttgagaagtgctagtctaggacttatagtaagtggcagagttcagactggatgtagcttagtccaggaatatttccaggtaatgctaacttagatttttctctctctttttgtgtgtgtttgtttgttttttggtattttctttccatagtgtcaaaagtttggacagtataacaaagaagaccccacttcttttaggttatcagattccttttctctatatcctcaggtaagtaatgtatgtttctaaaataactacagagcaataaattttgatagaaattaactttattcttagggtaaagtgaagactttttaatgtgttgagactcagtctgtaggtgacagagattgttcaacccaagtcgaatatgtgtctaggcaagacagcaccctacgccctacagaagatagagatgacatgcagaggggagaaaactcatgcatacattttcatgaacaggcaaaataggatcattgatataaggccgtaaaaaatatctctcatgtgtagaagttctggggaaacagctacctcagcaacaaaccaagaaaatgagcacacatggagatgaagataacaaaacaaaaccacagttagtacaacaaatatttaataatatgtctgtggttattatgtgcatcataaccaggagtgagcaataagcagctcctgaaagtaactgcactctgcatgaaccaagcctttggaagccattggacaagagagaggagcaggagaagtagatgaatttccgtctccattgtaacttaggaaatagagcacaattcatgggtgtctataaggattacaggagctgaggccaactgagtattaaatatttagcacaatgccagtaacctgttcagcactaaatgtgacctagctccatagcaggtgcctgggactctgaggtgtccatgtgccagaggttaaagctgtgtggtgttgtgagaagagccctggaccggccagagtcaggttgaggttccagtgctggctccgcaggggctgaccttagaggaggttccaaagccccgtagagtttggtttcccacctctagcagtggggagttggtctggtgaagtggtttgcagttttttttttttttttttttttttttaaagccatggaatcctttctttgagaggagctgcccttaaaagccagcacataaagcagacagagttggtgcttctctggttgtgcctgtgtaccacccccacactgggtcccaccagagccctcatccctgggcccctgaggacttgatgaagactctaagagcacagcttgaaaaccagatgaaatgctttctcagattccttctgtcaaggcattctaggaaagaggccaacagcccagtctctagagccaggcggccaggtgtagagtccagctgtgacactcagtagtggggtgaccttggacaagttgctcgcccctctgtgcctcagtttcctcacctgtaaactagggatggtaagagaacttacctcatgggcttattggaaggattaaatagttcttgtcaagtgctttgtgacttgcatgtaggatgtattagatgtcagccttgattattatttaggaacctatgattgaatatttggagtctcaggaagctttacacttcacaaggcagctcattttcgtgttctggcaactctttaatgtgagctgaaagtctgcccccaccccttcttctcatcctcgagggcgagaacctatggttgcagtgtcatcccttgtccctttctcccctgcaccaacacttcaccatcccagcttgtgtcctgagctgtcatctgctgttcctgtgcctggaatccccttccccctggccctgtggcctcctcagccacgtctctcagggtgcactgtcagtccccggagctctaggaagtctcctcctggccctccacccccactccccactgctatcctgtactctggctcataactcgtagcccgagtgtgcctttctcactgggcctgacttctgagagcagatattctgtctccactgcctggcacagtgactctggaaataaacatttctttggctttcctcttaactgtggaagctttgacatacccagaggcccttttcttaaaaaaattttgtatttttttaaaaatttttaatttttaatttttttgagacggagttttgctcttgttgcccaggctggagtgcaatggcctgatctcagctcaccgcaacctccccctactgggttcaagtgattttcctgcctcagcctcctgagtagctgggattacaggcgcccaccaccacacccgggtaattttggatttttagtagagacggggtttctccatgttggtcaggctggtcttgaactcccgacctcaggtgatccgcccgcctcggcctcccaaagtgctgggattacaggcgtgagccaccacgcctggccaaaggccctttaaaaaaaaaaattaatttttaatgtggtaaaacacacataacaaaatttaccatcttaaccatttttaagcataccgttgagtagtgttacgtgtattcccattattgagcaactgatgtctagaatttttcactttgcagagctgaaactctgtgctcattaagcaacaactctcagttttcctctttccctagcccctggtgcccccttatgctttctgttctgtgaaaccagagagcccttttctgggttctcctatttcagagccctgaggtagatctactctgtgggtgtctaagaaggttacaattatatgcatttctctttccgttctttgtgaatgcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagaggtgaggctctacccaaatgctttcctgaggattggaatcacctaacatatattcttttttaagcaaatttacttagcagaactgtaaaaaagaagtaaaatttggagtttttatagtaatttaacattatttctattaaaaaatacctttaggaaaatgtcaaaggacatataaagctattatttgtgaaaggcaggaataaatgtaaaaaactctaggaaataacttggatgctttctttttccttgtgcttgtatacttacatccaacaattccatgtcttgtatctgaaggaaagactcctagatacagagtagactttgtgccaaaaaaaaaaatagtaaaggaactactataatagaggatcaaataacaatccgaatgtttaatataggaaaataaataagtaacctgagaaatgcagttgaccctcagtattcatggaagattggttccaggacctccctcagataccagaattcttagatactcaagttactaatataaaattacataatatttgcatgtaaccttggcacatcctcctatatactttaaatcatctctagattagttataatacctaatataatgtaagtaccatgtaaataattgtcatactgtatggtttagggaataatgacaagaaaacaagtctgtacatgtacagtacagatgcatatttttttcaaatattttcagtccaagattggttgaatttatagatgtggaacccaccgatacggagggccaacagtattcacaaaaagtatgtaacataataaaatagataagtccttatgtaaaaatgttacatgaaaaaaagtcaaaatagaaacgtttctaaatattccctgcaaaaataaagaactatatggaaaaaaacaaaatatcaatatttgttgtacttgggtacacatttaaaaattttctttatcgagtaccacttacttttattattgaaataattactaaaatagcagggggatcacatgacatcaggagtttgagaccagcctggccaatgtggcgaaaccccatctctactaaacatacaaaaattagcttggaatggcgccaataatcccagctacttgggaggctgaggctggagaatcacttgaaccccggaggcggaggctgcagtgagttgagatcgcgccactgcattccagcctgggcaacagagcaagactccctctcaaaaaataaaaataaaaaagaaataattacatatataaaaattatatgtgtatatgtaaatataataaattatatatgtatatataagaactatgtatataaatatatatgtatatgattatatatgtatatataaatataaattatatacttatataatataaaatattacttacaaataaataataaacgtatttttttttgagatggggtgtctgtcacccaggttggagtacagttgtgcgatcttggctcactgcaacctccgccttccaggttcaggtgatcctcccacttcagcctcctgaatagctgggaccacaggcacgtgccactacagcccggctaattttttgtgtttttggtagagatggggttttgccatgttgcccaggctggctttgaactcctgggttcaagtgatctgcctgccttggcctcccaaagttctaggtttacaggcatgagccactacgcccagccataatttatattttgtagtaaactttaaaaacttgtattaaatgctgcttttcatataggtatccgtattctgtctcatctacagagaatgtctgtagagattgctaaaatacatacaaaactgagaatattcagaattatttttcgttccaagatcaaaagatatcattaagcctggacaacatagtgtgagaccctgtctttacaaaaaataaaaaattagttgggcgtggtggcatgcacctgtagcctcagctactcaggaggctgaggtgggagggtcacttgagcccaggaggtcgaagctgcagtgagccagggtcacatcactttactccaggctgggtaacagagcaacaccctgactcttaaaaaaaaaaaaggtatcattaatctccgttctcaattgatgaggaattatttggagcctatttttcctacaaagttgagaatgagtcagaagcagaaagtggaagtatgtcaggaagaaaaggggtgacttactgtgctgggcaccatttgtaaatagcctttgctgtggataccaggcatgggatcagggtcgggtggaagtggttgctgtgtggggagcagggaagaccaatgccatctttctctctctttttcttcagccagtactcttggatagcagcagcattctagctgacagaattttgctgatggatactttctttcaaattgtcatttatcttggtgaggtaagatgatattattaattaattaatttctttttgtttttaaattggagaaaaggcatacacatttaatgtgcacacaaggagaattattgtccttaactatggtttttgttttcttctcttatttattaagttaggtttttaatgacatttgtaaccacagtttgggcttagaaagcaccatggcttttattctagtaaatccctggagtatttgtatatttattaattttaatcatatttgctgttaagtatgggccaggtgcagtggcttatacctgtaatcccagcactttgggatgctgaggtgggcagatcacctgaggtcaggagttcaaaaccagcctgaccaacatggcaaaaccccatctctactaaaaatacaaaagttagccaggcgtggtggcacacacctgtagtcccatctacttgggaggctgagatgggagaatcacttaaacccgggaggttgaggttgtagtgagctgagatcacaccactgcattccagcctggtcaacagagtgaaactccatctcaaaaaataaataataataataataatatatgctgtaaaaaaatctcaggtggttattttaaatcactgtaaattattaccttcgaagttaggcaaaactagttttttctcctcagtaaatattttatacatactgctgttctttcagagttatatacatactgctgttctttcagagttagtgtttagagctaaggttgtactttgatgaaataacatggcccagggaactttacgctgtgtctgtggatccctaggatggctgtggatagctttcagtccatttctttctcagtggggttcatgccctgagaaagggaatggctcctctgaattatttgcatctttatggcaaaaaatcctttaatgaagatgatggtgatatttatattcagtgatgctttttcttctattgtatgatctctaccttcttaaattggttattgatttggtttcctaatggccaaccattagaaatgatttctgatgtcgtgaaaagatataaattgtgtttcaggattccttcagtaacttaggaagtgttagttttctaatactcctaagtattttataactttaaacttttttcagcatgttaacacccagtctgctagccacttgcacgcaagtgctaggctgtcagtaatagtcctagactgagagccggatgaccagctgctcttcccactggaacctttggtatcagtacagttggccctctgtatccacgggttccacctctgcagattcaatcaactgcaggttaaaaataattttgaaataataataaaaaataatacaaataaaatatacagcacaggccgggtgtggtagttcatgcctgtaatcccagcacgttgggaggccgaggtgggcggatcatctgaggtcaggagttcaagaccagtctggccaacatagcgaaaccctgtctctactaaaaatacaaaaattagctgggcatggtggcagacacctgtaatcccagctgctcgggaggctgaggcaggagaatcgcttgaactcaggaagtggaggtttcagtgagctaagatcgagccagtgcactccagcctggacgacagagtgagactctgtctcaaaaaacaaaaccaaaaaaacagcacaagaacgatttatatagtttctacattgtattagatattataagtaatctaaagatgatttaaagtgtatgggaagatgtacatcggttatatgaaatactatgccattttgtatgagggacttgagtatctatggaatttggtattgggaggagtggtcttggaaccaatctcacagataccgagggccgactgtactaaggatgaagctttctttgccttaagctcatctccttatcgacatttcttttgcaacccctgatcctgttcattcacttgtttattgagcaccttcttgtgcaagtgaggggttctaaggataaagacagtgacattgctctcaccttcccaaagtcctgagcgtgctgaacgcgagtgttcttatgaacttctggaccctggtgagctcgtgggcatttcccataggccaacagtcaatcacagcatttagacctggaaaacggtaactgctactttgagaaggagtgagcaggctacagaaggaggcatctgatgagaatcctctgcctggagccatattaatggctctgttaagacacattgcacacttgctgtagcctctttctccatttttcctctccattgtcttcttgttctcctaaataacatgcgaaagcacttcactttatttataaaggtatatgaatcagttaatgaatgtttcttgatttcctgtgtatacaagatattttctagaccagttgtggatgagtataaaagaaggaagggtgataaaatgtgtagcgtagtcagggagacagatcgtctgctttccacagtttagcatatggcttctcctcactgcctcatcaacactcatactttgattcttacagcttttgtctcctttgccaagggtaccccaattcagggcccagggggagcaggggatgggggtgagacaattgcacgcaagtctgtatgactactgctcaccagaggagtgtaatatgtgtgccgttaggaaaggagatgggggagtggagtctgtgtgggcagccaacaaatccctttccttaccagatgtgcggagatgagaggctagactgagtgataacagtggaagtggaaaaggagggagtccaccgctccttgggatgagtaatccatgggctttgttaactagttgatatagaagagaggaggcatgagtgacgcctgacattcctgggggaatgcgcaggcgggggcattttcctcctgcttctcctcctgccggtagctctgctttgctctccctctgaagcttgtcatttttgatattagacttcttcactagaaacaagctctgggtggcgatggtagaatgtcagtgtcagtgaaggctgttattacagtttccacaatagttttggttggtttgtttctgtgtagaccatagcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagtcaggtgagtgagctgagttctaactccagtggtttgttcgttttatgatagattgttattgctatacatctaaacaggatggttaatattttatgtgatgacataaattgacacacaggtaatcttccaaatatgacttctttttaaatgagtggtcaggccaagcgcggtggctcacacctgtaatcccagcactttgggaggccgaggcgggcggatcatgaggtcaggagatcgagaccatcctggctaacatggtgaaaccccgtctctactaaaaatacaaaaaattagctgggcgtggtggcgggcacctgtagtcccagctattcgggaggctgaggcagaagaatggcgtgaacccgggaggcagagcttgcagtgagctgagatcgtgccactgcactccagctggggctacagagtgagactccgtctcaaaaaaaaaaaaaaaatgagtggtcaaaatgtgcttatgtaaagggattgccaagataaaatacatattttatgttttaggatccttaaatggagagccagtgggcttaagctaaagaaatagattactgtgcagtaaaacaattctaattagattactgtgcagtaaaacaattctaatttaaccaaacaaatgttgtaaaaacttatcttttttctgttacattaatattaatgtcactttttaatctttaaatctttttgttgttgttgttgttaaaggctcgattccttttgtccaaagtgaacccatctcagacacacaataacctgtatgcttggggacaggtaagaaatcttcaggtatttggggaggatgctaagctagtttttttttaaacttgttttaaaattctacaaattggatctcttttggcctggagacagaataactgcgtaagttgggtattttgctggggagtggcggggagggaaacaagttgaataacattactgggccggaggttgagggggctccctgggtgtgtccccttccacaatatacagcagaacataccaggttcaggccaggggacagagcactgtactgtggcctccatggtggtgtcctccgtcacacagcctcatggcccctagtcctctccccaccaagaatacagggcaacttgtcaccatcggttttgccgcctcctcactttccagcctaattccttcccttttcttcccccaaccccgcctgattactactttatctaactgctcccagcatttatgtctctctcagatgagtctttcctttcattctgttttcttaaaacatttttaaattaaatttttttgagatattgtaaatttacatatagttgtaagaaataatacagagagatcacctgtatcttttacccattttcccttagtgttaacatcttgcaaaaactataatacagtatcacaaccgggatattgagatttttaaggtcaagatgtgcagcatttccatcaccacacttatgcactttatttctattattgttacattgtaatatataatgaaataattgtacaactcaccataatgtagaatcagtgggagccctgagcttgttttcctgcaactagatggtcccagctgggggtgacgggagacggtgacagatcatcaggcattagattctcatgaggagcatgcaacctagatccctcacatgcgttgttcacaatagggtttgcactcctattagaatctaatactgctactgatctgatgggaggtggagctcaggtggtaatgcacgtgatgggggagcagctgtaaatacaaatgaagcttcacttacttacctgccactcacctggtgtgtggcctggttcctaacaggccaaggactggtactatccgtggcctgcagttggggacccctgatttaaagtgtatgggagggtatgcataggttatatgcaaatgctacaccattttgtattagggacttgagcatttgtggatttggggatccacaggaggtcctaaaaccattcccccacagatactgagggatgactgtatatagaaatacaattgactttggtatgtttatcttgtattctgtgaccttcctgagtcgcttactactcttaggagtttttttgtaaacttctcagaaatttctacttagacaatcatgtcatctgcaagccggggacagttttatttcttccttttcaatctgaataacttttactttattttctcaaagaatcagctcttcatttcattgactttattatctttttattttcaatttcattgattgctgctctagtcattgttatttcctctctcctgtttgcagtaggtttttaaaaactcttggctgggtgcggtggctcacgcctgtaatcccagcactttgggaggccaaggtaggcagaacacgaggtcaggagttcgagaccagcctagccaacacggtgaaacccccgtctctaccaaaaatacaaaaattagctggtgtggtggcatgcgcctgtagtcccagctacttgggtggctgaggcaggagaattgcctgaacccaggaggcggaggttgcagtaagctgagatcacgccactgcactccagcctgggcaacagagcaagacgctatcttgaaaaacaaaaagaagtgaatttattatagacagcttatagttgggtcatggtttttaatgcactctgctgagctctcttacttggtatatttagaccatttatatataatgtaattaatgatatgttagggcttaagtgtgccattttattttttgttttctgcttttcttttttcatcttacgtacttttttcctgccttcccatgagttatttgaacatgttttaggattcccttctgacttgtttgtaatgtttttgagtgtatctccttatttagctttttaagtggttgctcctaagtgccctaggtttttttattttaattgagatgaggtcttgctatgttgcctaggctggtcctaaactcctgaggtcaagcgatcctcccacctcagcctcccaaagtgctgggattataggcatgagccaccacacctggccaggccctaggtattacatcatatatgcataacttatcacagtctactggtgttcaagcgaagtctagagaccttacctcccttttcaacactttactctcctccatcggtaatataattatgttaaatatttcctctgcatacatttagtatcacatcagacagtgttataatttttgtttcaagcatcaaacataattgataagtcttaaaagaaaaacctattatatttctctacatggttgcttttattgttttctttctttttagagatcttttagccattctttttttcttttttcttttcttttttttttttttttgtttttttgagatggagttttgcacttgttgcccaggctggagtgcaatggtgtgatctcagctcaccgcaacctccgcctccaggttcaagcaattctcctgcctcagcctcccgagtagctgggattacaggcatgcaccaccacgcctgactaattttgtatttttagtagagacagggtttctccatgttggtcaggctggtctcgaactcctgacctcaggtgatccgcccgcctcagcctctgaaagtgctgggattacaggcatgagccaccgcgcctggcctacttttaaccattcttttagcataggtcttctggtgatagatttttagttttcttttatttgagaatgtcttgacgtccctttcatttctgaagaatattttctctgcatataggattctgactaacagcccttttctttaagcagttgaaaaatattgtgctgcttcctctggcctttatggtttcttatgaaaagttcactgtcagtctcattgttttcccctgtagagaaggtgtcattttcctctggctgcttccagtagtctttttctgttgttagttttcagggtggatgggcaggggcagagaagaaagtgtaattatgacatgtcttggcatggatttctgtgggtttatcctgttttgatttactcagctttttgcttctgtaggtttctatctcttgccaaataggaaagttttcagtccttatttctttgaatgccttttcacctgctctcttttctttctttcttgacatccagtgacatgaatgttagatcttttgcagtaccccaggtactacatttccatgtattttctttcttttgttcatttgggtaacttctattgttttgtcttccaatgtattgattcttttttctgttctctttctgcattgaacctatgcactgcgctttttgtttgtcactgtatttttcagttacaaaatttccttttggttctccgtgacttccacttctttcctgggaccttgttgtttctttgctgaggcttcctattttttcatttgtttcaagtgtgtttgtaattgctcatgaagcatttttatcatggctgttttaaaatctttgtcaggtgattctaacattgttgtcaacttagtgttaacacctgtcacttgtcttttttaattcaggtggaggtcttggtaatcactttgtgtaagtgatttttttattgaaacttggacacttgagtgtttgtatgagaccctggatcttatttaaacctgctacttttcgctgattttttcttacactactctgacagggaaggtggttggtggggggggtgtcgggggcactggtgggctccattactgccaggtggagaagtccaggttttccactggcctctgttgacacctcggggtgtctagtgatttcttgttactgcttagtgggaatgagagttccagctcccccatagcctccagtgagaccgctgtggagatggccttgttacacttgggtgatggtgaaagtcctgaccctcctccaggcctctgaggccaccccagtaggcaggcggagggacatatattttgccaggttgcggtggaagtccaggctccccaaatggcctctactgacaccacaggggtaggaaaatttttttacttggccattggggatgaacttcctggttccatacttagccttctctggcaccatcttggtgggagtattagggtgccttgttactgccttgtgagggtagaaattgtagctgcccacccagcctttgctggttcaggtgggtcagggccacagtttttcctctcatttttgcccggagtacagtggttattatctaagattgttctgtcttgctaggctgctttagtcctttggctagagaaagtgggtgttttttgttgttttgttttgtttgagtctgtgctcaatgacaatttgccagcttcctcagctccaaattcagagtatatgaggcataagaaagcccaaggaactcactgctgtgcatccttgggtcccaaggtctttagtttttctgtcttctctccacctttaaaagtcttcttatgtttggtttacataagatgcccgaagttttcagttgtacttagtgggaggaatagagaaaagtatatattctattccttcctcgaaatcctctgaaaacattttgatcatgcttacacttttctaattataacagtatggtttcattttagaaaatttgaatatgttttaaaaaataagaaaatttaaattacctagaatcattatttaaagagttaactatttccagcttttttctacgtaaagtgtattattgtgtgtgtgtgtatatatatatatatttttaatttctttacaaaattggaatcttactacaaattgaggtttctattcaatttttcccataacattaataaaattataagctttttctgatatttgaaatatccatctgttcagtggagataccagttcactcgtttgtgggtacaccattatccagcttctgtggtaagcagagcacttaagaggaaaggcaggcatatgggcctccgtgagctcacagtggtggggagctagaccctgggtacttcatcaggactatggagaagagggtaaagtaaaacgcctgatgctcaaaactagcaggcggtggtggcctgatctcggcataccaggaaaggattttgtgaggaaattgtgctttagtcaaaagaagttgttcgtgaggcagaggatggggtgatgggagtactcgtagcagaggggacaacacctgtgaatgttctgagggaaggtgcttgacagctcatgaattctaatcagcttctaagatatctgccaactaatctttatcattacatttcaggaaactggagcacccatcctaactgatgatgttagcctgcaggtgttcatggaccatttgaagaagctggctgtctccagtgcctgttaagctgaggatacaaccaggaaatgcaacggtgtcagattgtgttcaaaatgtctagaaaggcttgataacattcctgttacttttctagcagattttaacaaataatcaaggacattttatatgtaactctttagattataatttatttgtattcctgtctttgtcctttttcttgcactataaaattataaggtcataaatgttttggtacttgtagatgtttatgtgctttttgtatcctaacttttagaatctaaataaaatcagaggtaatgtattttggcagcttgtttaggtgagaatcttaatgatcataaaggaaataaatctagatgcagaaagtactggctaaaatattgctaatacaaatgtgatttcctg

SEQ ID NO: 35919 - DNA, 53550 bp, Homo sapiens; identical to SEQ ID NO: 35918

SEQ ID NO: 35920 - DNA, 9383 bp, Homo sapiens
cgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcggtgggtggcggcgggctgccggggggcgggaggcgcgcgggctcctggcgccgacgcctgacgccccccgccccgcagccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctgtgagcgcgggactccgggcaccccacggctgggaggccggcgggccccacggggctcccccacccgggcctcaaccttcctttccttccttggcgtcccagggcaccctcccgccccgcttccgtccccaggcaccactgccccgaggcccagcagcatccctgcacccgccgaggccgaggcctggagcccccggaagttgccatcctcagcctccaccttcctctccccaggtaagagggcccggttgttaggctcggtggacccaaagaagagcccaccttgaccacggccacggctgtagaccctgctgctggtctctgcctgcctctcactggtgtctttatgaagcttttccaggctcccagacccattcagggcctgagctcggcctggtcccaagccctgcttccctgtggcctccaccgccatctccagccccttcttctaccaaggtaggtgtcccctgccccccagggaagattcgagacaaggaggaaggaattcagcctttgatgtagcgcagagccccagtcagccaagctgggtcagctgggaggcagctgtggtggggagagcctggagccttgggcagaagggaagagacagggaccccacctgatccaggctctcttcccacagccaggcccagagagctcagtgtccctcctgcagggagcccgcccctttccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggaggtgagtgtcgcaccctggcagggaccctggaaggccatcagataaccctcaccacttctccagcctttccccctcgcttccccacacaactccttcagccctcattctggcgtagggtccctggccccttggtggttctgggcctcgggtaggtggcactggtggcccgaaggccttcgcttcgagagcctcacgctgcccgtcttccctgccccttcccccaccgcaccctgggggctgcagaacgctgacctggagtggactgcagtgaagcagagcttcctgaccgaggtggagcagctgtccaggtgaggccagagggggagccacaccaggtcccgtggggcttcagaccgcacaccacaggacctggctcccttgggcacctgaggcctggcaggcccgggcgagctgaggccccagccagggctgcccacccagtctggcctgatggaaagtgctcccctttttcaaacaggtttcgtcacccaaacattgtggactttgctggctactgtgctcagaacggcttctactgcctggtgtacggcttcctgcccaacggctccctggaggaccgtctccactgccaggtaggctcacctggcccggcacgcttcccaggacccaaagcactcctgacacctggctggagccgggcgcggggcctagggctttcagcctgtgtgagtgggtcctgccagcaggccaggcctgcacttccagctccccagcagcacccggctcaggatttggcccacggtggggtcaatttttttttttttttttttttttttttttttgaggtggagtcttgctctgtcatccaggctggagtgcagtggtgtgatctcagctcaccacaacctccacctcccgggttcaggcgatcctcctgccgcagcctcccgagtagctgggactacaggcatgcaccaccacacctgcctaatttttgtatttttagtagagatgaggttttgccacattggccaggctagtctcgaactcctgaccccaggtggtctgcgcgcctcagcctcccaaagtgctgggattacaggcgtgagccaccacgcctggcccgacccaatgttttctatagagctctttcccaggcctctcccctttgcaagcagcgtagctggagggtctcatcagcaagccccggaggcgagggggtctggggctaccagctggaccacctacagctgagggagggcccccttgcctcctcctgcatgctgcgtttggggagagcgggaagaatgccttcaaggacttcccgaccaccagggacaaagggatgagccctgggagccgaagcccagcagattctattgaacgtgtccccagccattgcttaagaagtgcaggtcacggagactttgctcctcgttttccagaagggggaaactgaggcctagagagtgaagtggctgttccaggctgcacggtgacaggtagaaggatggttgggatcaaggaacggccatccagcaacctcccctgtccccctttgccaccccagacccaggcctgcccacctctctcctggcctcagcgactggacatccttctgggtacagcccgggcaattcagtttctacatcaggacagccccagcctcatccatggagacatcaagaggtgaggaggggcccttgagaactgccggggcagggcctgcagcaaggggggccccgcgtcctatcaatgtggggatcaggcatggcctgggacctcaacaccccggcatcgcacaggtgtgggaacgggccaaggatgggccctactgatgagcagaggcccccaggcagctggagcgctcagggcagtgccagcgctttctgtgggcaaggcaccgggctggcagcctcgagtccagccttatctaagccgggcaggtgtaggagctaggaccgggctgacgccactgtcttctctccccaagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtgagccactgacccctctgctggctcagaggaggagaagccacaggcaggcagaggtgggggctgcagagtgcactgcgggccaggggccatctgccaagaccccaggaggctgcagctccagggtccccctccctccgaggccctcctcctcaccctgcacctaactgtgtgtttgtaatttgtcttcaagtgggctctccgagttgcccgagcttcagtcccataacatctggctctgcctttgtccacacccttgtcaggcccaatccatgtccacaccagaggcctcttccctgccaaggccactgccatgctctccctcttccctctctccaggtagtgctagagaccttggctggtcagagggctgtgaagacgcacggtgccaggaccaagtatctggtgagccccttgaggcagggccaggagggacacacagctgctggcagccagcaggcacagccccagtggcggggataactggggcgcagtgcccatggatgcctctgctgccacagtggcctcatttttgaaagtaggcagggctccaaacaacttcgtttaccttgccgaggacaaacctgtctgtcctgcagacactatgggccttgtacagaccccacctgggctgggggcagggggaagggcggtcccagggcactgagacccaagctgcagtggaactcagaggactctggccggagaaaggcggtggtagagaagaagcaggccccgaggaacctcctgggccccagcaggctgcagctgagctctccgcaccgtgcagggcagcctgagctgcctcacggtcttactccactcagtctgcctcaccgtggactgtggtggggccaggagactagagacctgggttttagccccagcctgacagtggccttccagcaaattcctgctcccctgtgggcctgttttcccatatgcaaaacagacttcacagaatgtgctcagccagtaattgcttcactgcttctcctcttgtttggggcggttcctgtgtgctgtggggtctccgtcaggattcagccccgctgagaacccaggagccgggcttgagccctccttcctttcccttccccgtccgtccatccatgcatcctgctgaagaagcgcaccaggctccttgggggtccttggacttccccacttgctccccaccctgcagccaaagtgctcttttcaaaggcccctttgccttttctctgctcttggggtgaaggcccagtcccttatgtggttgaccccccaacgccccaggtccctgggactcggggcgctccctgctgcctgcttcacagccttagtatgtgccgttcgctctgcgagaaaagccaccgcccacccaggtggttcctcctggtctgtctgatttcagaactggagatggcctccggtcctgtttccaccctgggggcgcctctctgcggggcgcctctctctctggggtacctctttgtctgtggggcacctctctgtggggcgctttccttctcggctctgccctctcaggctacttcctgccttcagaccccagctccatggggctctcccccaccaggaagtcagctctgtcaaaccgggtcccagggttctgtttgttcctgtatccctagggcccagagcaccactggcccacagtaggtgtttaataaatctctagaagctactcgggaatctgaggcaggaggatcgcttgagcctgggagttggagaccagcctgggcaacatagcaagataggcatggtggtacacacctgtaatcccagctgctcgggaggccgaggtgggaggatcacgagcctgggaggttgaggctgcactgagccatgattgcaccactgcactccagcctgggtgacagaatgagtccctgtctcagaaaaaaagtaagttgtagaaagaccaagagctgtggcacagtgtctcacacctgtaacaccagcactttgggaggctgaggcgggaggatcacttgagcctacttggagaccagccaggccaacaaagcgagaccccatctcttttttttttttttttttttttatcaaaacccatacgattgagtgacaaggacctgaggactgcagctgcaggtgtggccacctggtagccatactgacagtatttatcccacagaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtagccagctgcgcactgggacggggtggccagatagaaagcccgcattccaggccttgctctgtagtgaccccatctcagcacctgctaggtctctctggagtctccacacatttcttgcttgccctttggttctgtttggggcagcgcccctctgaactgaggggccccgggcagtcctgctttgcggagcccagctccgacccccttcacatagagagaaggaaagagctgctgccgcgccccctgctgggcgcactgcactactgcatctgcctttttctgtcccctccctagtaccccacctcttctcctctggtgacagttgaaaatggagaggccccgtttgagggcagcggggcagtgagattcattttgtagaaaagaacgaggccattctcagtccttgcttttggcagccgcgcttctcagcactccctgtgatgggaacagaggggcgaggggcagagcgttcccagctgcagggtatgtcattttagagccctggggcaggtcacggacggcctggagcagccctgtggtttgcccacggggtgaccggccagggctgccatctcaccctgagagtccctcttttccacttgcaggtgtacgagaggctagagaagctgcaggcagtggtggcgggggtgcccgggcattcggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggtagctggggagacgggttcccaggagagggaccaaggcctctttgggccaaagcccctgtaagtccccaccccagccttctagaagagaaccagggccaaatgttcagctcactgtgaccttagcaaccctggtttcccctccccaggccacatccttcccaggtggagcttgctctccagccctccccccaccccattcctgaaggctgggaacaaggagggctctgtctggtagcctgagagctgggccctgcccttggacttctctgaggaattcaggcctgaggccagggaggcagggtgctaggctgcgggctggggagccacagcatgaggctaagggagtgccatctccaccccaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggtgctgccgcccaggctggcctctggggtgctcaggcgcatccgtgtcagccccaaagagcagagtgtctgtcccgactgcgctgagggcgtggggcagccgggcaggccactggctctggcgacctctagaagcccagccggccccacatgcctcccttagcaagaccctggcccactccttccctcgcctcctgacagtagcacctcctttagcccgagggtgcctgccccactctgtgctttcaggaaataggaagccccagcaggaattttccatcccaggtactatttgaagaaccactgcttaggaaccctcagctgggcgaggtggctcatgcctataataccagcacttttggaggccaagatgggaggatcacttgagcccaggaggtggaggctacagtgagctgtgatcaagccactgcactccagcctgggagacagttagaccctgtctcaaaaacaaatgaacaaacaaacaaaaaccctcaattcccacgaacgccccaggagataagggagcatggcccaggccttgagccagggcttctggcagtaggggagcctcccccatttgctaagcggactttcctcttccttctgtaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgc

SEQ ID NO: 35921 - DNA, 48453 bp, Homo sapiens
aaggcctaagccggcgccgagagagccagccgcgttacgatggagaccgaaagtggagaaaaggccagctgtgggcaaggagtgcacggccgccatcttggttgtgggaagtctcgtctaggctgtcctctctccagttgggaggaccaagatggagcgaaggatgaagtagcaagtgcacgtctttcttgggagcaggatgttgcgcaagtttacacttctgaccccatcacactgcttcccactgagatgcaagaggtagggaattccctaaacactggaaagtatgttggatgctggaaagctaaaaagaatgacaaatgtcccccaagatagataagctatagtatagtgcaggatgagaaatgccaaataaggagcaaggaagaaaagagatgaattatttctaggttggggtaaggaaggataatcacattaggtcatatggaagtctagaaaaattggtcagatttggaataataattgggaaaggaaaacaactttgtcaccagcattgaaatgtaaaacatgaatatatgcaataaatagaaagttaaatttggaagaaatacaagggacgtgaagtaggtgaagtgggaaaatgtggtatcagggcttagctgtttctgctccgtgagcggctcctttaacaggcagtctatgccctggagctctcttgtgggttgatagagacttcatcacattcggcctagaccaggtaataaaaaagtaacatggaaaaatagaataatgtagataacaagaggcttttagtggccatataagctttttggtctttattccaaagacaatgaaaagtaattgaagacttttgactaataaatagtgtagcacttttcctaaccacatggtattcaggtttttaaaattgctttacaacaaattatcacagtcttagtgtcttagtggcttaaagcaacacatatgtattgcctcacattccatgggcaaggaggtcaggaacaggttagctgagtcctgtgctcatgctctcacaaggctacaagtggatgtcagccaaactgcaattctcatctggaggctcaactagggaagaatctgattccaaactcctgtcagctcattcagttccttgtggctgtctgactaggggccctggcttcttactggctctgaactggaagtggccatcaggtcctagcagccacccacagttccttaccacatgggccttactaaaggctctctcgcaacatggcagcatactccttcaaagctagcaaggagaatctctctactgagcacaagaaaggagtcacacagatatagatacagccatggatatggacatggacatagatatggaaatggatgtagatgataacctaaattagggagtgacagccatcacctttgccatatattattggttaaagtaagtcacgggttttatctgtactcaaggagaaaggattatacaagagtgtgacttatcggggtcacttaagatgggccagccacaaatattaatttggcagcaatgtgccatgtaaatcaggtgggaaatacagggaagcaaggagacaagtgagatgtcgtcattgttgttgtaaccaaaaatgtatggttatcactgcaaaagaatcataaatgagacccacaggataaaatcgggaatttcaccattttagaggcatatatatatatattttttgagatggagtcttgccctgtcacccaggctggagtacaatggcaccatctcagctcactgcaacatccacctcctgggttcacgcaatcctccttcctcggcctcccgagtagctgggattgcaggtgcacaccatcacacctggctaattttttttatttttagtagagatggggtttcactctattggccagactggtcccgaactcctggcctcaagattggcctgtctcggcctcccaaagtgttgggattacaggcgtgagccaccacacccagctttagtggcatttttaaaacttaagtactactctgtccttaaaatttagtagcaggctgggcacagtggctcacgcctgtaatcccagcactttaggaggccgaggcaggcagatcgcaaggttgggggtttgagaatttagtagcaaattaccctacagcacaccagtaccttctggacttcttaagctccaggttagctctgcaaaaggcaaggaggcttgttcttccattttacaaatttcaaaagagggagatagcccagtggcctaacagtgactttattgctactgttattttcggatcacttcatgcatgctgttatttttttctcatcgaggttttcagtcgtagtttggtattccccatggtgcctagtactcagctaatactcccctttccttcctggaccctctcccagaaaagtcctatcatggtcgatggctttattttaataccaaatggcaaagaggcttaataagggttttttgcatgatttttgtgtaattaaaactgttttgtgcaattaagagattccttttgcactttctcacatgacataaaagtcaagtgttgatacttctctttttttcctgtctcatgacttccatgattcaaaccatttctttccaagtaacaaaatgtctttttctagaaacatctctagttactccatactcaggccttttaggaaggagtgaaggtgataaggtttagggtgttaagcctcctcacaaatgagggtttcacagcccccctcaccaaaccagcaagactagcaagggaaaattagaatagataatgaaggaggagctgataagtcctagtggtagccctggtcaccaactgcagcaacagggctgtagatcgtctactaacctccctcttctaggtttcccataaggaagagagggtgaccagaaacctggaggagttgctccccaaacctgtgtagagaagggaactcatttttgtgtaaatagtggactatgggagacacatgaagcaccacccagattccccttcaagaaagaaccacttcctagctgcaaggagagtggtttgctcacactcttgctgttagcttcttcagggtcacctgggctttccagctgagatcacactaatcttgaggcagcctctgatgaatgactgagcagggtgaggaaagtccagggcacattcttcttggggaggcccctgttctagggggtggtatcaaggcataggaatttctgctcccatgggggactcctttaacaggcaatctttgtactagagcttcctcttgggttagtagagactttgtcagatctgctttttcccttcctcggcccaatcctgcttcctcccttttcctctcacagatgtgagagaaataaaccttttggactcctcactccatctcagcatcagcttcccagagaacccagcctgcaccatgacaccatttttaacaattgacaatcaggagctgtcattgtacttttgcaacttttccctcagttttttttttttccgtataaaaagttggaaaaaaagaaacaaagattaaactgatttttactgatttttaataaaagagagacatcagacttatcaacccatgcaatgcatgtgtcttattttgatattgattcaagtaagctataaaataaattaggagaaaaatgggaaattttaaccgagtggatatttaatgatattaaagaagccttgttaacatattagaatgtaataatgatatttcggttatgtctttagaggattcctcatcttccagatgtgcaggctgaaatatttatggatgaaattgtcagatgcctagcatttgctccatgataatctgaggtaaggaagacagtggcaatagctaccttaactttacttccatcttcatgaaatagtacattcttttacttctaattctaattcatcaaggtgaaaaacatcacttattcaccatccagtggttttaggcactatgctgagctacacatacagaaaatgcagagacttggttcttgtggtcaagttactcagtctggcagggaggcagggagacaggcagacccactactgtgaggagtgatgtacctggtgctttccaccagttgccatggggctgatcctcctactgaccttgtaatactaatgttctgaattttgatgggaaatattgtttttaacattgtgtgaaaagccacttccttattgtacagaaaccactaacatacatttgacttttattggatttcttcagtatctggccctcagatgtactcagatattcagatatctgctacttaagaatggactgaatgatgagcgtgtgtatgtgttacgtgtgtgtttgctcaagggcatgcctgagagagggctttgaataaagtgaagcttctgttaagagttttatcagctggacatagtggctcatctctgtaatcccagcatttttggaggccgaggtgggtggatcacttgaggtcaggagtttgagaccagcctgaccaatatggtgaaaccccattcctactaaaaatgcaaaaattagccaggtgtggtgacatgcacctataatcccaagtacttgagaagctgaggtaggattgtcgcttgaacccaggagccagtggttgtagtgagtcaagatcacgccgctgcactccagcctgaacaacagcatgagcctgtctcagaaaaaaaaaaaaaaaaaaaaaaaagaattttatcatttccttccttgtttgtctttcctagctagacaatatctacaataccacaagcaaaaagagctcttttatagctagtgattaaatgaaaacacagattgtaagttttgtgtagtttctcagttccaaagagttaactctaataatgctagagactaaatgttcatttccccaatattcatatattgaaaccccagtgtgatggatttggagatggggacctttgggaggtaactaggtcatgagagtagagcccttatgaaagaagagacaagacagaatacttgttctcctgcctgcccttttcctctcctctctttctctctctcacccacttcttccccactgtatgaggatacatcaaaaagacagcccttttaaactggcaagagaaccctcattagacactggatttgggccagcaccttgatcttggatttctcagcccccagaactgtgagaaataaatgtttgtttaagccaccaactccatggtactctgttagagtagcctgaaccaagacaaaacccttaacatactcctttaaaaaattaaaataaaatttaaaatgcagtttttattacagaggctgaggtgttagaaatatttttctaaatatctgggcttcttaatagaaactctaagcagtttaatgacatcagatataaatttaagaataaaaaactattttacatatttggcaaacacccgaactgactctgagaattgccagtgagtttctttagtatgctgcaggagattgcagcatgtatgtgacagtgtggaacactctacagcttccaaggaaaccctctcctccaaggcatagcctagtgtccaaaactaaagaatataatattagcgcgataaatggtacatctggagacttgatggcatctaaagagacacttgctatcaaaggggaaatgagatccttttgactaaaaatatattgcgccacctagggacacctgggaaaataatgtattcaattttcaaattcaaagcatacaactagaaagtgtttggaaattatgaagcaggatttcctttttatttaatatttatattacataaatatcgcacaaattacaccaggctggagtgcagtggctcagtcctagctcactgcagccttaaactcctgggctcaagtgatcctcccactttagccaccccaagtatctggaactacaggtgtataacatcatgcctagcttgaattcttagatatgacagcaaaagcacagataacaaaaggaaaaaataggtaaattgaatttcattgaaatttaaaacacttgtgcatcaaatgacaccataaagaaagtgaaaagacaacccgtagaatagaatatctgaaagtaatttactctataagggattgatacccagaatatataaagaactcctacaacccaacagcaaaaacaaacaacctgattcaaaaatgggcaaaagacttcaacagacacttctccaaagaaaataaagaaataagcattatgcacatgaaaagatgtttaacatcttaagtcattagggaaatgtgagatatcacctcacccacaaagatgactattattaaaaaaattaaaattagcaattgttgctaggacgtggagaaactggaaccctcatacattcctagtaagaatgcagaatggtgcaggcactgtggaagacagtttggccgtttctcaaatggttaaacagaatcaccatatgatccagcaattccactcctaggtatataccaaaaagaactgaaaagcagggacttgaagagatccttgtacaccaatgttcacagcagcattgttaacaacagctaaaaggtggcaacagtctcagtgtccatcaacaaatgaataagtaaataaaatgtgatatgcccatataatggaatattattgagccttaaaaaggaatgaaataaattttgatatatgctataatacagaagaaatttgaaaacatagcgctaagttaaataagccaggccagatgcggtggcccacacctgtaatcccagcactttgggagtctgaggcaggcagatcacttgaggtcaggagtttgagaccagcctggtcaacatggtgaaactctgcctctactaaaaatacaaaaattagccgggcatggtggcgcatgcctgtaatcccttcatgagaaggttctggaaatggatagcagtgagtgcacttaatgctactgacttgtgcactttaaaactggttaaaatgggccaggtgtggtgactcacatctgtaatcccagcactttgcagggctgaggcaggagaattatttgagctcgaggagctcaagaccagcaacaaagtgagatctcgtctccacaaaaaaataaaaaatttgctcagcatggtgggatgcaactgtcagcccaactacatgagaggctgaggcaagtggaccagttgagctcaggaggtcgaagctgcagtgagccatgatcatgccactgcactccagcctgggtgataaagtgaagccctgtctcaaaaaacaaaaagttaaaatgctaaattttatgtaagtatatttactcaatatatatgtatatacatatatatgaggaaatcctgcttcataatttccaaactctgtctagttgtatgctttgaatttgaaaattgaacacatcattcaatcatatatacacatagtgagtatatatacacacatatatatacacacatacatacatatatacacacatatatacatatatacatacacatatatacatatatatatacacacacacatatatatatatatatgaaacaactatgggttgatcacatgtctgtgccttccattttagcccgtacccctggacatggagctatcacaaaagtgtgtactccaaaggacaggaacatgtaataatcatgtttaacttctgaggctatggcacagtgcctgccatacgggaggtcctgaagaatttgttgtggttgtcagtgagctgattccaatcttaattcactgaactgtgcgggttgttcagataaaaaccaatgactcccttgctacattcaaaggcatttcacatcttttggtctttgacatccttcatccttttggtctttgacactttacttttgtgatagtcctcctgattctctgcttctcttaacttttctcattttactccctatttgtatttgtctttaaatttctgttgtaactctttgcttttctgtatacttccttatgatctactttagtggtatcatctatgaccgctatgctgcaaactctcatatatttatctctagcctgtatgttaatcctctaacctccaatttccctggtgttaaacaattcttaaatttttatatcaggcagagtcacaaaaggaaaaagcacattcaaaatgggtaatcgaggataatttggtaaggagggtattaacaaacgtgtagatagagtttaggaaaatcaaaaaagcaatggtgggccgggcatagtggctcacgcctgtaatcccagcattttgggaagccacggcgggctgatcatttgaggtcaggagttggagaccagcctggccaacatggtaaaaccccgtctctactaaaaatacaaaaattagcccggtgtggtggcagtcgcctgtaatcccagctagtcaagaggctgaggcaggagaactgcttgatcccaggaggcagaggttgcagtaggccaagatcgcaccactgcactccagcctgggtgacagaaggagagaggtctgtccccacccacccaaaaaaaagcaatggtgttgctaaagagaaaataaagacaatgacagcaaggattgagcagtgagtagaaaagtttaactgtaaagtaggggactagattcatcacacaactatgctctgggtgggaagggtggttctttttaaaccaaaggatccttattggtattaggagagtgaagtttctggatgttgcccattagctggtggtatctgggcttaccagttaggctagtgctaggtggctggagatagttcatgctataagcctgggaagtccatttaggaattatggcttccaggtacctctgtttcctatgggtgcctgccttgggattacagtggcaagtgtttctgctctttatgtgaactatccaattcagtactgtcttgtctagtcaggtctaggtagcatcaacaggctgtcatgcccagtgtctggttccagcccatgctgaggtctgaagggagtaggttgatgggtggcaggtagctgaaagaacacttgggaggccataggccggtgaaagatggttttactcagcagctctcttacactgtgtgtctttgtctcggctgcctgctccggctctgccactcccacgcctgcagctgcattccctggtctgcaaggccagctctcccttacagggtcagcagcttaattctctctgggcatgagtcgagccatgccgtgctgtatgtacagtgtcagcagggcagttataccttttacaaacaatagtgcctccaaaccaggcgatgagccttcccatgttatagctacatagctgtgattatataacaagtggagttatgtgtctgtgctccaaactcaatgagtcacacaggatgtttaccttggcctattcttgaccaaatcacatccattttccttacactaggtgactgacccggagtttctctgttggtatcctggtgctgccaacacccaggagtgatttctacttctatgtctaaagagacaatagaagacagtgtttgcaggaactcaaagaggataatggtatgacaagagctgtggcctttggtggagacacagacaacctgtggcaacacagcaggaagggagctaagggaattactaactggatctcattttcttctaccctccaatctcttcaagaagctcgaacagaggatcctattgatgcagtccatgtaggcaggttcctagggctgagagcagagggaagaaaggtagagagtagatctggagggacacatagtgtctctatcagagctaacttttacaatgcctcttttcatcttgcttctcaagaatctataatctatcttgctttcataagccctgttcctcccttcatatctactatagctgctgtagtggagaccacttctacttgcttcttaggcaaaactggaaggacagttgagaataataataatccatctgttctggataaattgtgctccctcaccccacccaaattcataggttgaagccccaacccccaatatgacgctaagtggagataggacctttaaggaggtaattaaagttaagtgacgtcatcagagtggatccttaatctaataggactggtgtccttgtaaggaagagaaacagactagtactgtatgtgcatgtgtgtgtgtgtgcacagagaaaaggccatgtgaagacacagtgagaaggccgccatttaaaagtgaagaagagaggccttaggagaaaccaataccagcagcacttggatcctggactccaagtctccagaactgtgagaaatacatttcttctgtttaagtcactcagtctttggtattgttatagccaaagactgagttgttatagcaaccctagctgactagctgaatagacaccactgtttataaacatttttatcaagtatcttatgatttggttctttataaacatcatccaatataaccttttaccatcacaatcctagaaggcaggtgttattaatccaaggctcacagacaaggaagctgaggttctgagaggttagtagtttgtgcatggccataaaatttaagtagcaaggccggtcatggtggctcatgcctgtaatccaagcactttgggaggtcgaggcgggcgggtcaccttaggtcaggagtttgagaccagcctggctaacatggtgaaaccccgtctctactaaaaatacaaaaaagtagccaggcgtgctggtgtgtgcctgtattctcagctacccagggcgggctgagacaggagaatcgcttgaacccaggaggcggaggttgtggtgggctgagattgtgccactgcactccagcctgaacgacagagtgagactccgtctcaaaaaaaaaaaaagcaaatatttattatggggacttctgtctattaaaaccattacaatgtgctgataccacatgaaaaaggaatgtaattactgtgcctctggtgtggctgggttcagttaagaattaattattttaatatgtttctgcaacacctttagctttctcttttcacatgtcctgggcttcaactatcacccaatctgatgactctcaaatctgtaacgtcgtcctagtcctttttctttagttccaggctcatccctctcacgatctactatatctctcacttggatgtcctacaggcattttaactcatttttaaaaagctacacgattgaaatgttttgagttattttaaattcctctgtcatctcactaaattggaccaataattgtttctcaaacatgttctttcctcttcatttccactgcagatgctttcctaatttagttcctggatcaccacagtatcctcctaaatggatctcactgccttccatcctccttgatgctacctgagggcttttctgaagacactttttctttttccttttttttttttttttgagacagggtctggctctgttgcccaggctggagtgcagtggcgcaatcatggctccctgcagccttgacctccccagctcaaggaatcctcccacctcggcctcccgagtagctgggaccacatgtgcgcgccatgacgcccggctacttttttgtatttttggtagagacgggagtttcaccacacttgtaattgcaaaattgccctgaaatgatttttccattctcttcccgacaaaatccaaattccttagctagtcattatctgaccttggccttccctccaatttcatctccccagctaaatccaaagacagataatttgccacctagcctaatatttaaaagagtacactggcgttagcctgccttgacttgaaatcacagaacctacttcacagggattaaatgaactagtacacatataaagaacttatgtcttgcctggtacatcatgtggtaaatattagctattcttcttatccaccctctcaactcatgcatttgcacctggtggtccccttgcctggaatattacctctcaccatccatctaacccctgcttctctttaaagattcaatccaggagtcagattcctagcaagtttaccctgccccacccttccatctcgttagtctccaccgcttcctattcaaattattgtttgcgtcggtcactagaccgtgaacttcctaaaggagggatagtgtcttcatctttttggtcaaaacctaaagacaggtgcacgatactttctgaatgactgcacagaaagcgccccatatgtaattaagtctgttaataaatattcctaaacgttattttgtcttgtatgtagacctgccccgaatacagtacaggagcatcttcaaagtacttccagtgggtgccctggacagcagctaagaaccccggggtaaaacgagtttcctctctactgttacaaatcagaaacctcctccgtaaaagcctcagatctgggaaacgcggatgcatatgccaacttttgagtctcagtctgcgcctgcgcacgtgacctctacacgtctcctctgcgcctgcgccgctcaagttagcgcgaggctactcagtcgagggtgggactacgcttcgcgttttgggattgggcgctgaaggccaaaccggacgacgcggaaatgacgtcacgccgggggccctgccgcgcggtggctgctgggtgccgcacgccttcccatcctcctcctctcccctcccccatccctccccgccccctcggccgctccgctccctggcgtgactcggcactgagagtcccgggagaagactcggcggtcgccacctcttctgtccaggcctcggccttcctgagcatctctccttcctctcccagatcgtcttctccttcagtttcaaagccagtggcgtcgcggccaccctgccgggctctctgtgaggatggtgggggtgaagcccgtcgggagcgacccggatttccagccagagctgagcggcgcgggctccagactcgccgtggtcaagttcaccatgagagggtgaggccaggctcgagctctgtgggtccccgtctgtccttccttgctttcctttcactctttgttggccctggtttcctagccgtctgctgccccggagtgtccggcagtcgccgcagccccaggagctgccggaattaggcctcgtttctcgggtgtgaacccccatttatgcacaggggttcctagacgggctcgggggcctggctggccggcttctccagctcaggagatttctcacctgctccttttcaattctttgacaaactggttttgggggtggcccgcccctattccttccagcctgtgggagtctccgcagccacccttgcctgagcctgaccccttctttctgcagagccagctgtcatttgcatctccagagctccaaaagcttaatttaccgaacactttgtttctcttcaccacctacatctctctaaagcctttgaagattcagatggggcgatctaactaatatgcgtagctctgagtcctgaatttctgctaatgcatttcgaactaagttaacgttgggttagggtgctttttaaattatttgaacttttttcttcctcgttcggccactaacttgtagcttaggctcccctatgtatgcgattgcaactggtcacacacgacagtacatatataatatatttcaggtggacagttggccggatgtcttagtttgacccggctctgttttttcacttaagaggacagggatcttgaaaaatgttaactgtctttggtaaatatcaacaaaattataggtcgtagaaaaggtggaccttttatagtggatgtgtagtaaagttcctttgtaagaatgacatgttggaactcggcgttgagaaccaagatttcagcgtgtgtgtgtgtttcacagatctctccttgtgtatgtcgatagtatttagttagaagtatgagaggtttccgctttattttccttgaccccttggcgttatttatacatctaacttggagcagtctactgctggtatcactgtttatgtaacacactttcttgtccaaataactgtataaacacaaaattccattttgaatttcagagcaaaaaacaaagtttctactagatggttcactaaatgttgagtatataaatggtggcattaggattatatcgttttagggaatggatgcagatagatatgaaaacaagttaagacttatttttggaccagtctctcttacactgaattgaaaaaggatagtaccttgcatttcatatggtgggctagagtacccatatgatatacggaattttgcatttactaaatttaaaaggataagtgatgtcatatatataaaacacctaaaaggaatgttagaattctataaatgtgtcttctcatttttagcaattttgtgatgtctgtattcttaataataggggaatacctgtagtacattaagtatctaggccacagtagaaaagggaagataggatttcaataaggaacctcacctcacttttagttcacttattctaattctggcccgtcgaagcttttatatttttgtccctcaatgatatattgtttttctcccttaccatagcagtgggagagataataaaataataaataaatattgattgaagtgagaaaactggggaaacattgctgcgaaggaaggttttttctatcagtgtggtgtcacttaagcataagcataactgcagacattgattggtaaggaactgttacatttaaaaaggtattttagtggaattaaaattttttttctttgtaaaaaccgagggaaaattaatgtttggatttagagtaagttcaaaagcatatttatattacgtttacaaatctggtaagattattgtatttacctttaatattcctcgaacttattggccattaatacatcctgtctaaactcattgtcaatagaaccccagaattatgtatatgacgggtcagtattagactcagaaacaactgtattcagtaaaatcttgtaagaatcctcttagatcaaagttaatgctgtcccagtttagactgagggcatagtttctccagcacctatttcatttcctttccaaccctattttaaaccttttttctttttttttaacctctatgctttatgcactctcagtctaaattttactaaaatgatacatagattgttctcctgtgtaagaatctttagtggcttatgataaaatatatataacataaaattgaccatttagccatttgtaagagtataattcattggcattaaggacagtcagccctctgtatccatggattgaaccaaatgtggatagaaaatatttggagaaaaaaaattgcatttgtgctgatcatgtacacacttttttcttgtcattattttctaaacaatacagtataacaactatttacatagcatttaccttaggcattataagtaatctagagatgatttaaagtatatgggagaatggtcgtaggttatgtgcagataccatgtcattttctattaggcccttgagcatctgtgatttagtgtcttgctggaggtcctgaaactaatcccccagatacccagacatgactatacagtcacaatgttgtgccaccatcaccactgtttcctataactttagacagaaattctatatccattaaaggataactccccatccttacttctccaaagggacaaaactgtacccattaagcagtaatttgcccctccccatctacctccttggtaacttctattctgctttctgtctctatgaatttgtcaatttgtggcacctaatataagtgaaatcgtaacaatatttgtccttttgtttttgacttcacttagcatagtattttcaaggttcatccatgtcttagtatgtctcagaatttcattcttctttataactgcataacataatccatttatttatatggcaaattttgtatacctgttcattttttgatggacattccagttgtgtcttcctttggctgttgtggataatgctgctaggggacattgctatgcggggatccctgcttacttgcttgcttttcttttttcttatttgttagagacagggtcttgctctgttgcccaggctggagtgcagttttgagacgatggctcactgcagcattgaattcctggcctcaagcaatcctcccacatcagcctctcaagtaaatgggactacagacacataccaccatgcccgctaatttattttttgttttagagactaagtctcactttgttgcccaggctggtctaaatcctggcttcaagcgaccctcccacgtcagcatcccaaattgctggggttacaggtgtgagtcactgcgctgggccttctgtgcccatttttgaattgagtggtttgtttttgggttgagttgcaggagttctttatatatgccggatgttaatatttaatttgcaaatactttgtcccattctttgggttgtctttttcttgatggtgtcctttgatgcatgagttttaaattttgatgaagtccaatttatctatacttttgttgcctgtgcttttggtgtcatattcaagaaatcattgcaagattcaatgtcatgaagatttctccctatgttttcatctaagagttttatagttttagctcttaagtttaggtccttgatccattttgagttaattttggtatatgtcataaagttagggtccagttcattttttggcatgtggatatccaatttttccaacaccgtttatcgaaaacactgtcttttcctcattgaatgatcagcacccttttcccagagtattttttaaggattaaaatagtcaacgcttacatattccttagtctgtgtaaggaacttgtttaagctcttatattgactcaattcattcctcagaataaccctaacagctatccttgttttacagttgaggacattgagtcacagagaggttaaataatttgtttaaggtcccgttaataaatgcatcgtttgaattataaagtgctgttcttgatctttccagcctaaggagaaaagaaatgcacgttcatctctgtgtatctgcacagagcctgacaattttcaatatgcctttccttaaataatttacacctctgcctgcaattcatttcactctctgatattctttttggtaatatttttaaacagtgtctccaaattgttacttatgcccagatacattttagtggttatgagtagtaccagttttgttgttactaaagagttaaaagaatatacattgtgtcgttcgttgtccctggtctcccccctccccaccattaaacagtgtgaatgattttttttttttttttttttttttttgagatggagtcttgctctgtcatccaggctggagtgcagtggcatgatctcagctcactgcaacctctgcctcccaggttcaagcaattctcctgcctcagcctcctgaggagctgggattacaggtatgcgccaccacacatggctaatttttgtatttttagtagagacggggtttcaccatgttggtcaggctggtctcgaactcctgacctcgtgatctgcccgcctcggcctctcaaagtgctgggattacaggtgtgagccaccacacccagccaatggtttttatcttgaattgatgaatgtatcacttttgtagataatgtttaccatgcactgatttttttttttttttttttttgagacagggtctcgctctgttgctcaggctgcagtacagtgatgtgatcatggctcaattgcagcctcgacctcctgggctcaagcaatcctcccaactcagccccagcagtaatcggaactacaggcacgcaccactatgcctggctaatttttttttttttttttttttttgagacagagtctcgctctctagcctaggctggagtgcagtggcacaatctcagctcactgcaagctccacctcccgagttcacgccattctcctgcctcagcctcccgagtagctgggactacaggtgcccgccaccacgcccggctaattttttgtatttttagtagagacggggtttcaccgtgttagccaggatggtctcaatctcctgacctcgtgatccgtccgcctcggcctcccaaagtgctgggattacaggcgtgagccaccgtgccctgcctaagttttaaaatttttgtagaggtggggttttgtcgtgttgcttaggctggagatacattgaattttcttaaagcagatctgcctttgtagtttgttagggtttgttacaatctaagaaggatgtcagtgtatattaggatgttgagttctaatagttacaatagcttgtccaaataattgtatattaaacatatgttaattacataccgcaaaattactgataactgaaggaagtttattgaagtacagagtaagcaggcccagtagtccataggaaccaggcagaaaacgttagcaagtagctgtaagactagggcatattgaagccctggagaacagagttgctttatttgttaactttttattgaagtgcaaatatacaaaaatgtgcaagaaatagatcattaactccggactcctcgcactgtcccaagcttcttcccactactcttgaattctaacactatagatcagttttgcccgtatttgaactttatagaaacagaatcatacagttatgtagtttgtctggctacctttcaagagtgttaacacagtttaatcttggcaattgatttggaaataacaatgaaaggcactgtgtaggacattgttttggactttttagcatagctgttaagagttgggttctgggatctaatttaaacttactaatttgttgttttttagagtcataaagcttaaatgaggtgacatgagtttgtgaatgcgtaacatacagtaagtgcccaatgaatgctagctgttttatgtaattaataataccaattgtgattaagcctgccgattagtaaacatagcacatgtataaattgcttaaagttttaccctgcaggaaaaaagaaaaaaaaattctttaactgtggctttagaaagcatattatccacttaccagttgtgtatattgacacaagttgttgctcaagataagacacttatcttgaagggaaggacagttagctagttcatgaaatggaatttgttttatattatgactgtagtaaaaagtgtattaaaaagaagctaatgctctttcaaagaaagctgatcttggattatatttatgaattgcctgttctagtggtggccctgccgccaactaggatgtttggtgttgggcaggtcatcttatgatcttcacttcttacttactggttaattatattaggttatgtctgttttaaagttttagttttgtgggttcctttttttttttttttttgagacagagtttcgctgtttttgcctaggctagagttcaatggcgcaatctcgtctcactgtgacctctgcctcccaggttcaaacgattctcctgcctcagcctcccaagtagctgagattacaggcatgcgttactaggcccagctaattttgtatttttagtagagacgggggtttcaccatgttggttaggctggtctcgaactcctgacctcaggtgatccaccagccttggcctccccacagtgctgggattacaggcgtgagccactgcgcccggctgggtttatttctttatacattgtagaaagctagcggtttactgtattctttttctcaaacagcataactcaaaatccttctaacatacacattttatatattggactaagcagataagttttcagtcagaaggtttagagtagaaaagtaactttttttttttcttcattttaaatgtctggactaggtgatctcttgaaccttttgcagtgaaataagaaatcgtagattgtgcaaagggcagctaatcaaggtgtgtgcaagagaaaaaggtgtaattctgaaattcaagcatactgggtgcataatattgtagagctgggaaaagtccttggagagtccttttattttatacagagaaatcaggtgacttgttcatgatctcagctaatggaaatttgtttactctcaactgctcctgttaaggagacagacatcttatgtaaaatgatcaattggctgggcacagtggctcacacttgtaatcccagtactttgggaggctgaggtgggagaatcacttgagtctaggagtttgagaccagcctgggcaacataggcagacctcgtgtcttcaaaacatcaaaaattggcagggtatggtggcacgtgcctgtagtctcagctgcttgggaggctgaggtggaaggatcacttgagcctgagggaatgaggctgcagtgagccatgattatgccactgcactcaacctgggtgacagagtgaaaccctaaaaaaaaaaagaaaaaagaaaatgatcgatttatttgaatgattgttttgtgaaagtgtgctgctgtatatatttgtgagtttgtatatatttatgcttctctgctgatgcattttgatttttgaccaaagttccaacctctgatggctaactgaaattaaagaatctagataaagttaaatcttgaaacagttttttgcacagtaaccataattttaatagtctgttcagctgcaagatgtgtgtctgtaacaccagttagctcgtaaataattgatgaatagagagatgtcaatgtgatatggaagttgtattggttcatgtgtgattattcctaggtagtgaaaaatagaaataaaaccttcatctggaagcagaaagctctcagccacacaggcaaattccctctcttgtttattttaagaaagttaatgaagttaaataagagtgcctacacctagcgtttgttccccagaagggtttattttcagtgttgcattttctcctgtcccttccttaatggcagccccactggctcagagctccacttcagtctgctttgtcacaacacctgtaagcatcatttccagttgattttgttcttttcaaatattccccaaggtcgcttccagctctgagccacatgctgggatgtccatctttttcctgaatcctagttactgtctttttttttttttttcttttccaagttggagtcttgctctgttgcccaggctggagtgcacgatcttggtgaccttggcttaactacaaccttccgggttcaagtgattctccttcctcagcctcccgaatagctgggactataggcatccgctatcacgcctggctaatttttgtacttttagtcgagatggggtttcaccttgttggccaggctggtcttgaactcccaccctaaagtgatccacctgccttggcctcccaaagtgctgagattacaggcatgagccatcatcgggcccagtctggttactatctttcttactgatcttgttacaaaattgcatgggtttcaagtagtttgccaacaaacttatttttcccataaattctctctttttggtgtgtgtttttgcaggagggtggttttcatgaatggatatattgtactatagaatggatacctctgtaatttgtgacacctgtgtaaatgcagttaacactaaattcttctcaactcatttaatattttaaaatgaaaatacctattcatcacaaaaaagcaaaggatgcagaattatggatactaactgttcattgtgcctgtctctgtctttttaccccctatgcatttatatatatacataggtttgaaatgtgatcctagagaacattttataatgagactttcttcccccctaaacactgcaaagtatcaggctggggtgcagtggtgtgatcttggctcaccgcaacctccgcttcccgggtgcaagtgattctcctgcttcagccttctgagtagctgggattacaggcatgcgccaccatgcctggctaatttttgtatttttagtagagatggggtttcaccatgttggcctggctgatctagaactcctggactcaagtgatccgcccatcttggcctcccaaagtgctgggattataggcgtgagccagcgtgcctggcccctgtcataactttttaaactagttttccattaattgccatttaagttgttttctaactttactattacaaacatgttacattgaacttccttatactacatgttattgtgaaatagagtaagtgttgttaaaatggaatagactttcaaaagggtaattattgggtcttggcttgtgttcatctaaaatgaatagatatgacccaatcagtggcctttgaaaaacagtgtagtgatatatattcccatttataaagtttaagactaattttagttgactgtaaatattattttcttagatttttggtgtatggctttcaggataacacaaggtgaaatgctgattgaaatgttaagaatgtggagttgatcacaacttgagttttaacatttgtttttattttgtgcattagatttgctttttcttgcatttcttatttctgcaaacttttattgagacatacatggcacacaattagaaatgtatagttcaattaattttcacaaactgaacacacctatttaatcagcttccagacaaacaaaacattgctagcctccagaagtcttattctatcagtaactcactaaggtaaccattgtcttgatttctgataccattgattggttttgtctgtatttgaactgtatgtagtcatatagtatatgctagtagttgctttctttcctcaatgttatttgtgaggttcatccatgtttttgcaagaggttttataccagttattttcattattgtgtagtatttcattgtataactataattagcttacccattcttttgttgataagaatttaattgtttctgatttttgactcttagaactattactaataatactttttcaaatgttctaaggtgaacatgtgtcttagatgtattccccaggaattttgatgggttggtgtattttagcagtttggtttttttccctccaaaatggttaataccagcttgcactctcacagtatataaaagtttagttgctctgcattcttgacaatacttaattcttcttgtagctatttttgctgagttggttttaatctgcatttcccgggtatccctgatgactaatgaagtagaacatctttcctgctttatagaaagtttttgactttatttattgactgtttggataatctcatttgtcaagtacctattcaagggttcattctttttcttttgggtttcagtcttctccttgttttgtaggagttctttacgtattagaagtataagtcctttgtttgatatgttttgcaaatactttttcctagtctcttaaagacattttttgatgaataaaaggttttaatcttccagtttatcaaatatagtccagtctgtcaaacctttttttttttttagtacttcttgtgttttgtataagaaatcattgcttagtttgaggttttgaaagtgtcttcctgtattttttcctaaaaccctccttgtttcaccttttacatttagatctacaacccatctggaattggtttttgtgtatggtgtgttgagattcatttcttttcctgtatgagtatatagttgatctagcagtatttattgaaaagaccatccttttcccactgcaatgctacatcaagtttttcagacatcagagtactgtatgtgagatgggtctgtttctagactcttctttcaaaggaaaactgatttgatcattttgcttattcttgtacaagtactatattctcttaataaaggtttatgatagttcttaagatctgataatataattttttcagattagaacctcaaaacgacttgggctgtccttggcatttctctataatttttagaatggaaatttgttaatttctacaagaaaacctgctgagatcttacatcagttgtaaagatcaaattgagtaaaattggtatcttggcaatattgagtttcaaattcataagcagagtaaattcctccatttatttaggttttctttaatttctctcagtgagaacaaagctagaagacttaacactattagttatgaagactaaatgtaacatctgggctcattaagacagtatagtattgatacaagtatatgtaaataacttactcaaatagaccagagaatcaggcctagggttatggttcatgcctgtaatgtctgcactttgggaggcccaaggcaggaggatcacttgaacccaggagtttgagaccagcctgggcaatatagtgagaccctgcttctcaaaaaaaaaaaaaatgtagcttggtagctgggtgtggtggcatgcacctgtagttgcagctacttggaaggctgaggtgggaggattgcttgagcctggaagattgggactgcagtgagccatgatcatgccactgtactctggcctgggttatagaatgagaccttgtctccaaaaaaaaaaaaaaaaaaaaaaaagaccggcttggtggctcacgcctgtaatcccagcactttgggaggggccaaggcaggtggatcacctaaggtcaggagttcgagaccagcctggccaacccagtgaaaccatgtctctactaaaaatacaaaaattagctgggcgtggtggtgggcgcctggagtaccactctggccgacagagtgagactctgtctaaagcaaaaaacaaaacaaaacaaaaaaaacagagagtcaaaagccagcagtatcagtgtttgttctattttatgtttaattgacgagtgctttagaattacaatctttagtgttattttacttaattttccttttctaacaggtgtgggccatgtttgaggattgccccagcattcagttctatgagtaataaatatccacaggctgttttcttggaagtcgatgtacatcagtgtcaggtaagggaaaggaatcttttttctttttaatttacttttgaataaatttgaaatccaacattaatattcttcatttatctcttgatgcacatagtacttattcctttgaagataggaagatgttatgttgatgtcattattacagatgtcattatggctgcattagttaagaagagtagcacattattaattgcttcaggtttgtattaatcaccttctgatataaaattaatacgatgttgttaataggtcacctagcagttctgtgtattacatttccttatgttttgcaaacctagaattatatcttctacccccgaggtattggcattatatagcagtggcaaggagttcttggttgtagtttgaattgatcagtttgttatcttatctccaaatggacacactgagcagaaactttaaaatggtgattattgttgattgagccacagtgttgtaggtgaattgccctgattatttagttggaatggtatgtggcagttctgtatttgtatatgcagaaatgtggggaattgttaagggaaaaaaaaattggaaagctccttccaatactaaaaagtagagtctttagttctaactaaggaacaactctatagctctgcagctttatctttgttaaatttctgagtgtggaaaaaattttagaatattatgtagtgtgtagttactttgggggtttgttgaaaaccctacattacacacatttatgtttcagcacttagttgcatgttattgcactatatcattggcccctgatttaatcactatttctagaatgaaaatgcttttctcctggagctgttctgtcaggtattgtaaccactggctatgtgtggttactgagcactttaactgtgacaaattcatattgatatgtacggaaagtataaaatacagatcagattttaaagacagtataaaaaatgtaaaatattgcattatctttttatgttgattagattgaaaatggatatattagatttcctgtaatattaaacttgattttacttattttgcttttttaatatagataatagaaaatttacaattgcatgtgtagctcacatgtgctacatatccattgttttgggcagcactttcctgaaaggtcatagttttttcacctagaggctttgagaagacattcctgtgttatctttatgttctttttctttaaaaagtatagtagtgactttcataatatttgaatatataaggtgccatatttgctttactgtttcctttatacttgtcatgaaaagcttaaactaggatactcggtggttattaggtaatttccattcagtagttagtcttatacaattgtggagctaggacagaatttataaagatagctgttagaatgtgttttgatgggtgaccaaaagtcatttctgtaagaataaaaattgggtgacggttgcagtgcaaaatacattacatgctctttttaacaggcagattggctaccggttttcagacctgcacttttttctagtagcagtggtttgtgttgactttatcaatacccttcttggttattctttttgagaaatacctgtaattatgaaagatctgtctggcattaagcacagtttctgcattggaagctaatttttctactggatgatgtatttaccagtaaaaatgataaaaacatggggaatgttctttattgtgtgtgtgatggtaatgtagctatgcccaaaggggaactctcttaggaataggtctattttttccttaaataacaaaaatgcagtattttacatgtttttagttcatgcttatggtatttaacttccataaaggtgtagaatgaatattcaaagtggtttaagatttaattcataacactgtccaacttgccaattctagggaacagctgccaccaacaatatatcagcaacacctacatttttgttttttcgaaacaaagtgagaattgatcaatatcaaggagcagatgctgtgggattagaagaaaaaatcaagcagcacttagaaaatgaccctggaagcaatgaggacacagatattccaaaaggctatgtatgtagactgaaaagtgaaatcataatgtataatatcttgtacatgtcattattgggctaaaatgaaatataactatgtttccatcttctatctcttactggtttagaatacttttaaataagagctttcaaatttattagctgactattgagttttgtctgtatgtgtacgtttgtgtgtgtgttaagcctctatcataaatcatttttcctaaatttctcctaattttctttgccactttttaaaaatctgctttctgaactattttaatagccatttaaaaatacttgctttatacttttttttccagaaaatgtagaaatgtgcattagaaatttttttttcactttttgacagttatgtaaaatgacttacaggttttagttatggccattaactccttttactgtcactcacttcctatagttttatctttttaaatgtatgccctcttttctggcactgtatttaaaaaaaaaaaaaagtctaattactgattttgttttagaatcaaatttgactttgttatcacatgtattctaggttttaagagtaagttatttcaaataacaacataaagacttaagaatctaaaggatagtgtgtggaaactgcagagtataaatagttagaatgcagcatttttaatttgagagctattcaagaaggaagcaaaatttggaagtagcacttcatggtattagatttgcttatacaaataggtaaatcttgtatactaagagatatatatagtttttaatttctctggttacaaagttactgcactggcagatcaaagaatgaattttaaaaaaagttacctcaagttaaagttaatatcttttttttttttttttttgaggcggagtccctctgtcacccaggctggagtgcagtggcacgatctcagctcactgcaacctccacctccagggttcaagctattctcctgcctcagcctccccagtagctgggattacaggcacctgccaccatgcccagctaatttttgtatttttcgtagagacgaggtttcaccatgttggccaggctggtctcgaactcctgacctcaggtgatccacctgccttggcctcccccaaagtgttgggattacaggcgtgagccactgcacctagccaaagctaatatcttaaacaatgtataacaggcatattaaagcagatctgtgtcatggagctacaagtcctccctgtaagtctaaattcatgccgaatgaagagatgctatagtccaaaaaaaaaaatgagagattctttctatatgggtgtgtagtaggagattgtaagggtgtcagaaagcatcagtaatgtgataccagcattaatttaaggaagtacaattactatttatttaaaatagacctgtaatttgaaattgtaatgtccaattaggaagtatcaacatatcgtttatgtcagggttgttacatcttttggacagttttggaaatcatttaacttgtaaaccattgtgtttatatctttgtatttttttccctttattactaagggtgtttgcattaaaaagtcttaggaacacagcagtcttgttgcctagctacaggcatacttctttacacatccgctgtggtatgagtgttttggcctcagataggaaataggaaaaaatgaagttttaagaaataaaaatttagtttttgtgcaaatgttatggataaaatatgaaaagctgttatttttaaatgtccctttttttctgtcaggtgtcaatcaagacattaaagttttgaactatttaggtctcacagggttattcagtatttaaatttggtaatcttatataacgatgataccattataactcccaagaaatttaatattgatacaatatttctaattatcctacagttaaattttcttaattatccccaaaatattctttatggctgtttcccaccatttaggatcaaatcaaggatcatgcattgcatttaagttgtcctaattaatgttctttagtctagaaacttttctctgccttttttttctgtcatggttttccattttgaaagtctaaaccagcactggtctagtaatatggtagccactaggcacacttgtctattgaacattttgttatatgactagtgcaactgaggaacttaatatttaattttatctaattttaattaatttaattttaaattgccacatgtggctaatgagtatcatattgaatagcatgggtctaggctgttttatttaattaattttttttttttttttttttgagatggagtttcacacttttgtctaggctggcgtgaagtggcatgatctgcaacctccaccgtccccctggcccctgcccctgccgctcgtttgaagcagttctgcctcgggctcccaagtagctgggattataggtgcccaccaccacacccagctactttttgtatttttagtagagagggggtttcaccatgttggccaggctggtctcaaactcctgacctcaggtgatccacctgtctcagcctcccaaagtgctaggattacacgtgtgagccactgcacctagctaggatatctgttttatagactgttgcgtattctggattaacctgattattttcccatgattggcatgttgattataaaggtagcaacatttatttctcattgcaggttttcagaatatgtcagtttccagttatgtcaactatgcaatgtaataatgccagtttgtcccagacagtttttataacaaaatactttaatgcacccctttaaatatgttttgtgggctgggcgtgtggtggctcacgcctgtaatcccagcactttgggaggctgaggcgggtggatcacctgaggtcaggagttcaagaccagcctggccaacatcagaaaccccatctctaccaaaaatacaaaaattagccaggtgcagtggcacactgctgtagtcccagcaactcgggaggctgaagcagaattgcaggaggcggaggttgcattgagccaagattgcgccactgcaactccagcctgggcaacagagggagactttgtttcaaaaaaaaaaaaaaaaaatacatatatatgttttgtgtgccccacaataaataaaaacaaaaactatttagaagaatttacccacttagtttatttttatcatttaggtattgcaagtctgactgtaatgttgtcttaatcctagataccatattgaagtgacatatagataggatggaagacaaaaacattttaaagattttgtcaaaactgcccttttaaggcaaatgttcataatgctccgaataattctgctatagtaaaactttgctctgtagcccttttttcttccctccccatcttttaaattggctatacgttaccctgagtaatacatttactataacatttcagctttgaaagcatttaggctgttttatctgtaactagaggtctatactaatgattattaccattttcatatttacttgacatacaaagttttcttcagtctttgagaattatgtatgtatgtatttgtatctttaaaaaacataatgaaaaccctttgagatagagaggtgaacatgtgactcatctataatacttggtagacttgaaaagtaatccttgtttaggagataaaatggatacttttctagaaaaatacacttttaccaaaatcaactctactagaagcagaacacctaaatagaccagcaccatagagaaatagaagaaatagtagtaaagatttcttccctaaaggcttctatgactttacaggtaaatgttgccaaatccgtataaagatcaggtaatctactgttactgtaactacttaagatcttaagtaaaaagaaaacttttaaatttatttttgaactgtgacattgatctgataatttgacaaagtatgcaccaaaaaagaaagctgcagaccagtttcaattatgaatattgatgtaaaatttttaaataaagtgttagtaaacaaaattcaataatatcatcatgggctgggtgtggtggctcatgcctgtaatcccagcactttgggaggctgaggtgggtagatcacttgaggccaggagttggagaccagcctggccattgtgaaagcccatctctactaaaaatacaaaaagtagccagacatggtggcacacgcctgtaatcccagctactcaggagactgaagcaggagaatcacttgaacccgggaggtggaggtttcagtgagccaagataacaccactgtactccagcctgggcgacagagtgagaatgtctcaaaaaaataataataataataataacaaaattgagtttttttaaagcatgtaagagttgtttatgttaggaaatttacttaatctgtcacattaatagacctaaggagaaaaatcatgatctccaaatatgcagaaaaggcatttgacaaaatttaaatacccctttattcctaaagcattcagtaaaatcttaataagggaacattggaagcattcctactaaagtcagaaataagacaagcatgaccaaccgctgttaacacaactctgatgtgtgggaggtatggaagtgttagaataaagtatacagagatgggcatgtgctgacaccacagggaagtaaacggtaaaatccaaagtattgagaaatctataagctaaatgactagattaaaagagatttcagagacatattaaccaaatacaatttttttttttttttttttttttggagacagagtcttgctctgtccccaggctggagtgcagtggtgtgatctcggctcactgcaacctccgcctcccaggttcaagaagttctcctgcctcagcttcccgagtagctgggattataggtgcccgccaccatgcctggctaatttttgtatttttagtagagacagagtttcaccatgttggacaagctggtctcaaactcctgacctcaggcgattcacccgcctcggcctcctaaaatgctgggattgcaggggtgagccaccccgacccggcctccaaatataatgtttatactttttttttttttttttttttgagacagggtcttgctctgctgcctgggctggagtacaatggcgcaatttcagcttactgcagccttgatttcctgagctcaagccatcctcccagctcagcctcccaattagctgggactaaaggcacatgccactgcacccagctaatttttttttttaagttttttagagacaaagtctcactatgttgcccaggctgctcttgaactcctaagctcaagctgtccacccaccttggcctcccaaagtgctgggattagaagcatgagccatcgtaccaggcctttttctttttatctctattattggtgtatacttttttggatctttattctgcgtgtaacaattcaagtgtgaaatatttatgagacagtggaggaaatttgaccactgatttgatggtgttaaggaattattgattgtgataatgatattgagaatgtttttttttaagttcttattgcttagaaattcatactgaaatgttcatgaatgaaatgaaaagatgcttttttttttttcaaactaatcaggaggagagttaggatgtagttgggggttaaagatgaggcaagagtggccttcagttgatgattattgtagctggaggtggtggatacatgggatttactatattattatatttttgtctgtttgaaatttttcatgataaaaactttaagtccttatttgctactcatcttaaattggacatcttcatagatataaagagtccttgaccactagaagagggaaataggctttctttggatcttacggatattttaatttgcatattttcttctgtaaaacacttattttttaaagtataagtcaacattttataatcttaaagacatcatttctgataccttatcaagtaggctaagcctagacttggctttaataattgatggtagatctcagtcagaaatgcaaatgaaaggactactgtaaaagttttatgaactgttttaaaagtgttttctttaaaattgcctaaagagaatcagagatttaaattttttaaacatttttatacctaatccaaatatgttgcctaaaatcttgcaattttttttcagatggatttaatgccttttattaacaaagctggttgtgaatgtcttaatgaaagtgatgagcatggatttgacaactgtttacgaaaagacacaaccttcttggaatctgactgtgatgaacaggtaattgagggctgaagataagcttgtggagattatcactatttatgcctgctcttgtttcttgttcccattttgtggcttacgtctctccttcccagatgatcacttcttcctttcatttctatagcttttagtttctttgacttttgttttttgaccatacatacccaccttctttgttcttgtatgtgggctgccaggtgcactaagaaaaattgctgaactcttgggtgggacccactgcagaattgagctcttaccactgtttggtctttttgttcatccttaacctgacttccataccttcttcccactcagatgaatttgtatatgagaaatagagactaatgaaatgagcactccctgtgtggctaattcctttctcctagatagaaacctgtattatattccctatgcttccctgccttgcccttatcacaaagtaagttgggtgttaccaccttgatcaagctttttaaatcttcattttggctgttacttttctcagtttactttctcttccattgtcactgatttgtcccattccagttcatcttctatacggtaacagaagttatttttctaaaatataaagttgcatgtttccattccttagaagagtaaaatgactcttcactggctttaggaggaggctgacttgatctgtttttaactttctcatctcttctgctcttcacctacagttcagttccctaataatgtcatgcttattattttttgatacactattatgggtcaagtataaaaagtattggtgtaactaaaggaaatagcctagttattttcttaggcagataaaccacaacatgattctgaaatcataaatccaaaccccatctttccatgctgtaaccccagagccaccatgtttttcagctttgagagtatcattcacattgtgtttcttgtaaatggtgccctaaaaataatgtaataatgctaatcagcaggactggttcaggcttcatgaaattttcctgctcaggaaatcttcccagggtagatgcataggtacgtacatcaaacacacttttggctggaaagaagattgagcaaatgatccagaagagtttcggagagagaaacattctgacagtgtttcatattcctcttcccttatgtggccttccagattcagtcagtcaagtaaatgtagaatggaagtttggaggttacttcagagctataagaaccctattctcttgagtttgggattagagtccatttcagggctagtctctgcataacctgtgtattgcctctaaatcgtcaagtgatgtggatagatacttgacaaataaaccatcgtagagctatgtgctaaaatgttagtttaaattttattttgagaattttgtttgatttgttagaaagcaggttgcttgccagtttatagctcataagaccttacattcctatgcatagttttagtatttacttgattaattttttcttgtattcccttatatacataactaatagtagtagttctcagatgttatctaatcaagtgactctccacttgctgatttttcatattacgttggttttgttcgatgaattaggttggttttttttttcttgcctgttattttcattctgcttcagtagtttatgtactcaaggtgtgtacaagagccctttaaaatgaaactcttatcttcacagctgcttattactgtggcattcaatcaacctgttaagctttattccatgaaatttcaagggccagataatggtgagtaaaggatagcttttctttaaactaacttctgctttgtagaactgttagcataaaattaaaactttttattaaatagaggtacttgttttttctttttttttttttttgagacagagtcttgtgctattgcccaggctggagtgcggtggtgcaatcttagctcactgtaatctctgcctcctgggttcaagtgattctcccacctctgcctcccaggtagctgggactgggactacaggcaggcgccaccacgcctggctgatttttgtgtttagtacaggatttcaccatctgttggccaggctgttcttgaactcctgaccccaagtgatccacccaccttggcctcccagactgctaagattataggcatgagcaccgcacctggcttgttttggaacgaagcaagatgtaaatgaatgagtaaataatgtgagattattaggtactgaaagtatgaaagaaagagaacttagttatttttatactttttcattttaaaatttgtttccttttaatctgagaagtgctgaatccttttttccaactgttctaaaactgtagcttttgagcagccgtattttagaatcaaaactgaaagatttatttcaaattccttttattttgaggaaactgaggctccagatattcctgtttgtgccctattaatagtatcatttttttatatcgatacatgtaaatatgattgtgcagacttaggatttctcttcttgtaaaataaagaattttccttttttgcccccccccattttttctttttctgttaagctttttctgagggggaataggggaatggagactagggttctgattttttttttttttttcgattgattggaagaaataaccaaggccttatttagaagatagcattttcttatttgttctgctaaattttcatgttaataatttttattaataaaattgtacttttactctgaaattacaaagtatttgtataagcaaatgctgtagaaatgagtcttacttttccttcttcagccacaaaatatgggtcttaaatcgtgccttgaagttaaagggattaaggcattctatacatgggactttaccacttatcacatcctaatctaatccctaaaatgaaatttggcaatttttattaattttcttttggctaaatgttgtcactgataatgctctcctcctaaataactgaatgtaccaactattggcaactataagatctagctcaaatgctatttcttttatgaaactttttgttaacctgcatatattgtcagaatctattgtcaccttccttgtacctcctctcctgtggtattttgtttatcgtagcatgtcttttgtagttggggggcagggactccctctgtgtgtgtgtgtctgtttaaatcttatattcctaatatttaccacagtgttagctcggccaagaaggaaccagtaaatgtgttttggaaaataaaggattggctacctgaatactcagacttttgtacaagttctaataatggagttatttgaagtatatgtgtattgatttgtgtgtgtctgtgtatagtgtgagtgtagtggtaaagggagtatagtatatttgaggtttttaaacattttattttattctaccattgtataggtcagggccctaaatatgtaaaaatttttatcaacctaccccgatctatggattttgaagaggcagaaagaagtgaaccaactcaagctctggaactgacagaggatgatattaaagaagatggcattgttccacttcgttatgttaagtttcagaatgttaacagtgtaactgtaagtagtatttcgttcatatgtatttaataggtttgtgagtaacaatactattttcagtatcctaggtaagtctaagtgattctttaaagtggtatttattcactcagtttgaaatgagtaaaatgtttaatgggataaattttcttctttttaatttatgtaccctaaagaggaaggacagattgatttttgaatatttgtggggttttgtcagttattttatatgtatatggtaagttttgctggaagtttattctacaactttatactaaaactgaagatatttgtgctttattctttatacctggtatagtagtgatgtgtttgtaaaatcttatttacttttcttgaatatggagtttttaagtgtggtggtcatgatcttagtaaaaatgactttttatttatttatttttttttgagatggagtctcgctgtgttgcccgggctgacttgaactcttgggctcaaataatcttcccgcctcagcctcctgagaagctgggattacaggcatgcaccactgcacctggcttaaaaatgacttttaaaaagataatactacattttataagatgacctaaggtatatctgaattttttcttcctttgaggcaggttcttgctttgttgtccaggctggagtacagtggcacgaccttggttcagtatagccctgatctactgggctcaggtgattctccctcagcctccagagcagttgcaaccgcaggcacgtgccacctcacccagctaattttttatttttgtagaggtgaagtctctccctgtgtggcccaggctggtctcaaactcctgggctcaagcagtcctcccacctcagcctcccaaagtgctgggtttataggcttcagccactacacccagcctttctgaagattgactagtgcttgaggtgattttaagtgatgtattttagatgtcattattaaagtgccactctcaagaatcagctaatttttagcagttattaattgcttttaaaaaatttagcattgaaacccagctcacacttctcacctacagtcatttagaggaatgggtaggacagttagaaaagaatagcagaatacttagaaaaagaaagtaggaaccagcacagagccactgagaatgtcatgccaaactggtacagcttgtttgttgtgatggaataattctatttttgtaaattagaagaatgctaaagtatgtgttcatttaagaatgtttttgagagtttcacagaatatacatagtagtagtatgaagaattataattggctgggtgttgtggctcactcctgtaatcccagcattttgggaggccaagatgggcagattgctcgagcccatgattttgagaccagcctgggcaacatggtgaaaccccatctctacaaaaaaatacaagaactagctgggcatggtgatgcgcctgtagtcccagctactctggagggaccacttgagcctgggagattgaggcttcagtgagctgcagttgtgtcattacactccagtctgggtgacaaaaaaaaaaaaattataatcaagttgagttttaagtattagaaatatcctacccaaatgaaatcaaagaaaattgttatattaaacttagtatactcattatcaaatattttcttgaaataacatatggctgcctatgaaaacaataaaaactgacgaatgagtggcatctcagaatgaaagaagtatgttgtttaaatcacgagaggcagtttttaactggtcatgggagtacgctggtagtcccagctacttgggaggcttaggcaggggcatcacttgcactaaagagttcaggaccagcctaggtaacataatgagaccttgtctcaaaaaagagataggtgcaatattttaaagtagacagcacctagaatattgtgtttttagaaatggagcaaatttcaaaaatccaatgtatgacaaaggatcaatgagtaaaacttttagtttttatcgtgctgaggggagttattaaatatagagtcaagcttaaaaaaaaaatgaggcacatagtattgttttaggagctgattcccaatactattttttcttttaatattctaggaaatagaatggatacaggaatatcagaaagaatatcactttagagattttcctcagtgaaaaactatgattttaataaaatttccaatgatagtctgtcccattgtaattgtaactcttaataccctttcaacattctctataaagaatttaattgctgggcgcggtggctcacacctgtaatcccagcactttgggaggctgaggcaggaggattgcctgagctcagaagttcgagaccaccctgggcaacacagtgaaaccctgtctctactaaatttaaaaaaaaaaaaaaaaaaaaaaagattagccgggcgtggcagcatgtgcctgtagtcccccctcctcaggaggctgaggcaggagacttgcttgaacctgagaggtggaggttgcagtgagctgagatggcaccactgcaccccagcctgggcaacagagcaagactccatctcttaaaaaaaaaaaaaaaaaaattagccgggtgtgctggtgggctactcaggaggctgaggctggagaatcgtttgaacctgggaggcggaggttgcagtgagtcgagatcgtgccattgcactccagcctgggcaacagagtgagactccatgtcaaaaaatacatatagagagagaatttaattgtgactctgccatactatcacaccaagttaccatgaacttatatatatgggtctcttgccatgacatctctggagaaagtgagaatagcagggcaaacagccctataattagtagtcctatcctataggagtactagtcttaatgttatataattttgattaattttttttttttttttgagccagagttttgctcttgttgcccgggctggagtgcagtggcacgatctcagctcactgcaacctccacctcctggattcaagcgattctcctgccccagcctcccgagtagctaggattacaggtgccagtcaccacacctggttaatttttttgtgtttttagtagagatggggttttgccacggtggccaggctggtctcgaactcctgacctcaggtgatctgcccacctcagcctcccaaagtgctgggattacagacgtgagccactgcacccagcctagattaatttttacaaagaatggagaatatttatgttattaatttaaggaaattgattaaacttaaagcatgtttgtgaagaaggattgtaattataaatgcaaacttttttttggtagatatttgttcagtcgaatcaaggtgaagaggaaacaacaagaatttcatattttacttttattggtactccagtccaggcaacaaatatgaatgacttcaaacgagtaagtttgcttaaatgatacttcgggatagtaaaaatataattttaatggaataatttcatgtatctcaactgtcacactttcttttaacaaaataattcaaaattatatcatgtcatgaaattttacaaggctaaactaggatagaaagttcccctaactatatttttagatatccaacaaagtaatctttaataaaaaatgatgtcttaactgataaaagagtcttttaatgaatgacatcaacataagggtaaaaataatggcttggttatagaaagtggttagtaataatggaaaaatgaaagtaaaatcatttgaaagcagttgtgagaattaaataacttagttgatagtaagattctggtgattatttctgatgaaattttaaattacttgaataattttatttaaaaaaaatggactgagttttaatatactgacatgttaactttccaaaccatgtttgtatgctgaaatagcacatttcatcaaataatgatgaacaggcaagttttctgaagtatttttgtatatctttatgtgtgtgcatataattttcttttgaaaagacacaattataaggttagtaaagaattaatagggtacatgggacctttgttaatccagattaattccttctgtacattactggaacgacttctaatgggcaacagttccctagcgtcactcttaaatatacagccagagattatcaaagtgctactgagagctttatcagtacagagcgttagttgctatatactcagtttaaatgtggcagcacagaatacataggtatcccactgtctctaatgattgcatctggcaggcagtctagaacttgaggaagagtttccttaggcctggcaattcctagatgaagaggctcccaagagacccttgttgtggaattgaagatggagaacatcttgagcactctcattctttttggtgcatctacagatcttactttaattcaattatagaaaaatgtattagattgcataacagaggatgatcttacaaaattgtatgctgtttttaccaaattgcaaacctggacaataggtattttaactggttgttttccaattactattttcctgtctcatagcgtgattaccttttggggactgcaggaataattatgcactttagagctgttatgtctagatgtttcacatatgtattatgacaggtcagaagaagcagagattaagcatctacatttttacgatatgaaatatgttttattgggaaaatgtgtgagcaacaaagacgtcttggctgcctgctttacctttttgaattagatgccattggacttggctttaagtgtgccttgtgtggtttattcttaacttagttttttataagatctattactattatcttattattttctcatatcattcattaatttggctctagtttcctgtttcttacctcagtttatgctatttgattttcatttttttctgtaaccaccattctatcttgtttaccttcttaccagctagccattcagttaaagtttctctaatttgcatgaataattatccatctaactatctgcctccacctcgtgtttaacatccccctcacatcccttctagcctagtattttctcttttctgactgtcaaactacgtttttgggggctgtctttaggatagcaaaggtgtaagaccttttttgtttgagagtatttgtgcttgttttataacagccatttattcatttgattttttttaactttaaattaccatatgatagcagttctcaagctttttgatctcaggacctctttatattattaaatactattgaaggccaaaaagaacttttgtttatgtgggctatatttatctgatatttgccatttataagttaaaagtgggaaatataaaaaatatttgtaaataatgaacacatgttaatgaatatttttaaattagaaataagcatattttctaaaagaaaaaccaatttggtaagaagagcattgattcagaattttatgatttttttttttttttttttgagacagggttttgttctgtcacccatgctgcagtgcagaggcacagttatggcttactgcaacctcaaactcctgggctcaagtgatcctccagcctcagcctcacgagtagctgagactacaggcgtgtgccaccacactcggctaatgttttatttttgtgtggggacagggtcttactatgttgcccaggcttctctgtttacgagccttatagtgtcctttccttctcatatctgcttctgcattcagtcagctttcctgtcacacatcatatagcccctggaaaactcccctggatacttgtgaagagaataagagtctaaaaggcaaaaaacgatttagcattatgaaaatagtgttgacctcccagactccttgagagggtcttggagaccacactttgagaactgctacaagaataatttgaataccataatctactcccttgttggtgttctgggcttcttagccccttgcttttaatgtttaataaattttagttgattaagtgattttcttaggtatattaatattgcattttcttgtaatatttctgaatgacatttgtactgtagttattctttgtcttttagggttattctttaaaagtaagctagtatttcattgtttttatattgtacaaagtaacaacttcaatgtagttaaaaaaagaaaaagagggtttacatgtaactgaaattggccagcttagtccttgtacagatagatttgcttattaaaaattataattgagtttggttttcattgaaggaaataatatgtggtatggtatcttttgtccctgtagtacgatgctagtacaatagtctctccttatctgtcggggcggggggatacattcttagacccccggtggatgcctggaaccacagacactaacaaaccctgtacatactgtgtattttcctatacagatggttcccaacttatgatggttcaagtttacaatagtgcaaaattgataatgcactcagtagaaaccattctcttaagtgtggggcagttaagcatttttgacttacaatattttcaccttacaatgggtttacttatttttatttttttgagatggagtttcactcttgtcacccaggctgtagtgcaatggtgcgatctcagctcactgcaacctctgcctcccgggttcaagtgattctcctgcctcagccttccaagtagctaggattacaggcgcctgccaccatacccggctaatttttgtatttttagtagagatggggtttcaccatgttggccaggctggtctcaaactcctgacctcactgccttccttggtcttccaaagtactgggattagaggcatgagccaccgtgcctggtctttacaatgggtttaatcgggatatattaccccatcggaagtcgaggagcatctgtacatatatacataccgctgataatgtttaatgtataaattaggcacagtaagagatttaacaacaaagccagagcatggtggctcatgcctataatcccatcacttccggaggccaaggctagaagatcacttaaacccaggagttcaggaccagctggcaaacatagtaagactccatctctatttaaaaaaaaaaaaaaattacccatgcaagacggtgggtgcacctgtagtcccagctacttgggaggctgaggtgggaagatcacttgagcccaggagttcaagaccagcctgataaacatagtaagattccatctctataagaatacacacacacacacacacacacacacacacaaaattacccaggcaaggtggtgggcacacctgtagttctagctacctgggaggctgaggtgggaagatcgcttgaaccctggagttcaaggctgcagcgagctaggatcacgccactacactccagcctgggtgacagagcaagaccccatatcaaaaagaaagaaaaataaaaaagattaacaccaactaataataaaatagagcaattacaacaatatactgtggttaaaagttgacatggatatggtctctcccatgcttgctctttctctcactgtctcaaaatatcttattgtactgcaccataggcagttgaaactgcagaaagtgaaagcatggataaggagggactactcttcagtcatgatctctgtctacagcagtttatattcttgtagataacatagggacaaacatagggaaagttaatcaaaattaatcaaagcttagttcaagggtttctttgtccacagagtattctcagacgttaccagctaggtgacttttccttttcccccaacgactgggaaagtctgagaatactttgtgaagaaagagggccttgaactaagttttgagagtagaatttggacagttcaacaggcagctatgggcacccttgatagaatggaaaagtagggacctggacatgaacttaggaaggtggaggattcaatcgttcaaggacaagtcacatgtggcatgtcttttcttttacttgtttgctcagtctgaattagtatatacatagtaattagaattgaaatttttttctttttttttgagacggagtcttgctctgttgtccaggctggagtgcagtggtgtgatctcggctcactgcaagctctgcctcccgagtttaccacattctcctgcctcagcctctgtagcagctgggactacaggtgcccgccgctacgcctggctaatttttttgtatatttagtagagacggggtttcaccgtgttagccaggatggtctcgatctcctgacctcgttgatccgcccgcctgggcctcccaaagtgctgggattacaggcgtgagccaccatgcctggcctagaattgaaaattttgaaatagatttggcatatattttataggcacagggaggaaaattttgatgacctctgtgtagtgaagggcgctatataaaatggcttaatgaataataaagtagatcaaatgtttagcattttcagtttatatttttatcttgtgtgagctgtttctggataatttccgtttttagtatgtcactgacttcttatgtcactaagatatctgacagaagctaaggtaatgctgttgaatctccaatgtggacagaaatcttagacaacctttcatgctattacaactttgaaggttagacttttaaggtttgacagactagaataccccttccacttgtctggttttggctcttataggcatcacgcacagattataatctatactttggctgtttgttgttgtcaatggattttttgtgttgcagcatgaaaagcttgccattgccatcttaattggaagtagatgtttttgctaaaatatgctctttatatggattgctttattttaatacagaatttttaattacaattttataaaaatacaaaaatgagaaaattataggggcttctgcttcttaggaaatgaggtgcatgtgaaaagatttttatcactataataaaaatagacttttctaaactggccattcaccgtatcagctatttttgtaacatttctgtctgtttatttttcagcttttttaatccaactcaaatgaactaaaaacagaagatattttaaaatgaagtaatataaagattgaccttgtctcactctactcccctccttgcttctctgctcatctagcacctgtctgctctcacccttcccatgttctcgccattgttggtgcaagatttctacagcttctatcatctggatcagccttgttacctaggtttcctcaatcatctctttcttcagatctcatcctagttgtgtttcttaattggccttttattttgttttggcttttgttttgggcttgcaactaggtgctttaattttttaccataccgtgttgctcactagcctttttttttttttactttctactgtttcatatttaattttgtattacattttgaggcataacatcacaataaaattaaattgttataaaatgttttagatttaactagttgaatagttttaatccattctaaactttaaattttatttcctaggaactatagaattcttttggaaaacaaatatagcagttgcatcaagttcttttatgtttgtgctagtttaatatattgattacatttcagttgaggggtgttggttttcttttcctcgttggaatgttagccccaaagtccttttgatgattgattggggcatgtcctctgcttttgcccaagtgagctcaaaaccagttgaaggacttatggactgaatattaggttgggttaacatattaatatagaagatcaatggactctttactgaataaatattttttacacctaatttttatgtacctaaattttggtttgtctgaggtgtaatataaagacttaagaatgaataaaagagctttacgtttgggatgacaatccatgttggaatgttgaatttcttcttttttacagaaaatacacattggcaagttgagagttatcaacctgtgaaacagtatgcagatttgtgtcttctgtatcacatctgctagaagtttaatttttaatatttgtttttgttttcttttgcttaatctaatagctttgtgttttgtgtttcccaagtaatacaatgatcaataatgctctcagtgtttatcagcacaaaatttacttgtgatagagataatgccagttccccttctagtggctcttaaaacctgaatttcttactcttatccacattcttttatatgaaactgcctttttatcatcttgctaccttgtgagctttctaacatggtgtctttggaccaaaggggagttcttttaaggtactagaagtgagttttcttagggtgggaaaaacatttctaggattgtgtgattgggatttcagtggaaagctttcaggtctctcatgaatgatgttgacccagctatgttatattttagaccagacatgtactgatgacctttatgagttttgctggtatagatactgccatttagaatagaatcaatgtaaaatacgaaaattaaatatataaatgtacacagaaatctttctacacaaacatacattcagtattttgcaagtaggtttctttcaaggcatttttgccctaagaatacattatctaatgataaactgtaagttgtcagtacatttctcaattagaacatagttttcaaactctcctgcagagaatttgttttctagatttgttggtagagaacaaatttttattcttcacatttttatgctgccacatatatagcaaccagaatgttttttataatcctccagtagaggatttttctaatcattgacagaaacaaggtttattcatttcatttttaatagtactcttaaagtaaccaggatctttttcttaaaccagaaaaaattagtcacttttaatctgttttcattgcatgtcagtgtattgagggggaaagtctggaaatttgctatattgggcatgaaggacatgagtttaacatacgcttctaattccagattcttttgtgatcgacatttgatttctaactatctaaaaatagtatgtcaaatatgttttactcatatagcatcattttttaaattaacttctctaaactttcaaccttgtttttaaaaattgctatttaaaaaaaaaaaaaaaactgtgtgaaaccaaaaatagcctgcatgtgttttatttttaattccttgtggctgggattggaggggaggtcacagtttgcttcaacagtgaaaatacattgcatgccagaaaagatccaaggataaaaattaataccaaggttttaaactgattattagtatttttaataactcatatttaaaatcaataggatgtacatataaacttatttttgtttttctaggtagttggcaaaaaaggagaaagccactaaggtacaaaagacactggacaaccatattgcaatcagatctacagctcctggataattgcttgattctcgccagagactgtcaatgtttcattcattgccattaccaataaatcattgcttttgttcagatggtatcactagtgtttccattgtaatcttgacacatgcaattgtaaataaaagtcaccacttttgccaagcttaa

SEQ ID NO: 35922 - DNA, 4030 bp, Homo sapiens
gcagcctcgagggccaacaacacctgctgtccgtgtccatgcccggttggccaccccgtttctggggggtgagcggggcttggcagggctgcgcggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcaggtaaggggtaggagggacctcaactcccagccttgtctgaccctccaattatacactcctttgcctctttccgtcattccataaccacccaacccctactccaccgggagggggttgggcatacctggatttccatccgcgcacctagccacagggtccctaagagcagcagctaggcatgggagggctctttcccaggagagagggggaaggggacagggttgagagctttacagaggaagtggacagcatggagggaggtaaggaaaggcctgtaaagaggaggagacactggctctggcggaatggggactattggagggttaagcggatgtggctaaggctgagtcatctaggagtaaacaagaggccttcctttgggaggagccaatccagggtgtagggggcccagagtgaccaggtgcactagggaaaaaatgccaggagagggccaggaagaggacttgttagtagcgactcacttctgggcaggcaggccagccagctagccagcctgctgaggcttcccaagaggggcagagtgctgggatctgggaatccaggaaaggagggaatggggtggggctagatgaaaagggataggtgtccagggagagcctctggctattcctgggaccaggaagttttcactaggatacataacactttttacacactcaccccacccatccctggctttctattcatggaacaacctctctctacaatccctccagatcttcgcaaatactgtggacaatgcccgcatcgttctgcagattgacaatgcccgtcttgctgctgatgactttagagtcaagtaagtttgggggctagagagctgggggtccaggggtggagctaagaaggatctgctccccaggctgggtcagttaggggctcacagtgggatcctgttaggtgtgggtggatgagagtcagggtccatcagtgtattcatttaactgttcatttgtataaccccgtttaagaatactgtcctccaagtgccaagaatggtgctcaggggattaccacctaattgctgactcaagttgctggtttgcaatgggcacagaacttctcttagtaggtggcatgagttgagaaggttctggatcagagataggggcccctctgatcacctccactcctataggtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggcaagcaggggccactggccaggccagggattgaggggccaagagaagtctgggtcggagaatagacaagacaaaccaactgcaagtagccttgctaagacgtttagaaatagcagcctgggctcttcttaaataagaccgttctgatgaagagcattctcagggggtcgagtacaccctggctcacctgaattacaggtcaaaatgatatgggttagaaaatgagatgagaacagaagtagaagcagctaacactaggagctgggggtgataaaggaatgacagcagatggagttggcagcgcttcctaaaagatggtagaaggagcaggtttgtgaaggggagggtggataaaggaacagggtgaagttacagagaaaccatcagtgagtgggtggcatttctacccactggagtagaaaggccagaactggcattgccctgagtgcaagccaaggggttcctcctgtctcttctccaactgtaggcctcctagaagaggcaatcacagaagaaaggccttgttggagctctgaccctgaaccctcctcacttttgcccctgtcacctttaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcaggtgcgtgaggggaggggatggctgccaaggtgtgggagggaggcagacggaatgaggggcctgatggactgtccccatcctgcagattgaggagagcaccacagtggtcaccacacagtctgctgaggttggagctgctgagacgacgctcacagagctgagacgtacagtccagtccttggagatcgacctggactccatgagaaatctggtgagtgccttcacatcacctgcccagctcctccttcacttggcctcagacccaaccctgtctcaacccaaatcctatccctcatatcatgagttcctttagctcagaaagagtcagtttcctctttgcatttccctccactcctatcccttatcccagtacttggcacatagcaggtgcccaaaaaagtttccaaaagtgaagggatgagcagtcctgggactctgggctcaccctgcccctcctctctgtgcccctgcagaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaagtgagtggggctctcctacccacacgtgctgggatcaggagatcacttctccccaaagtctgagcttttggaagcaccccatgtgtctgttcactggtatccactgagcactgggccgttgctccgtgggtgctcctgtgtcttcaagggagtaacagttacagaggtctcccccttgaagaaagcaaactaagtattgtccctagctgtacttagtatgcaaatgaagtttggccttgagtttcccttttctggaggaagaggctgagggtgatttggagataaaggtagaggtcaggaggctttttccctctacctttcttgtctcccttctactccacggggctgtttataacttgggcttggtcttctgttacagtcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttc

SEQ ID NO: 35923 - DNA, 5375 bp, Homo sapiens
aagttcgggtccgtagtgggctaagggggagggtttcaaagggagcgcacttccgctgccctttctttcgccagccttacgggcccgaaccctcgtgtgaagggtgcagtacctaagccggagcggggtagaggcgggccggcacccccttctgacctccagtgccgccggcctcaagatcagacatggcccagaacttgaaggacttggcgggacggctgcccgccgggccccggggcatgggcacggccctgaagctgttgctgggggccggcgccgtggcctacggtgtgcgcgaatctgtgttcaccggtgagcaacctccgcctgctcgccggacgcttccagtccctcccccaaaccccttgccctgtccccgcgcccctccacgggcctagcatttcctctgagcagcggcctggcctgatcaccacccatctccccacagtggaaggcgggcacagagccatcttcttcaatcggatcggtggagtgcagcaggacactatcctggccgagggccttcacttcaggtaatggcgggcagagcctgctgaccctgacctttcacccttgacgccgacccagcagtggctatagtcggacgtgcaacaggattcaacgctgctcttttcccaccctcctcatccctgcccctaggatagtgggtgctgcgagaacctccagcagcatacaaactgttgttttccagagggacaagagaatctctccttgtctgtggtcgtggagaggagcaggccaaaaaacgcgtggtgaggggaaaccgggcaaggctagtgaaactgcggccttttctttttttttttttggagagggagtcttgctctgtcgcccaggctggagtgcagtggcgcgatctcggctcactgcaacctccgcctcctgatttcaagcgattctcctgcctcagcctcacgagtagctgggattacaggcgcccgccaccacgcccggctaatttttgtattttagtagagacggggtttcactatgtagatcaagctggtctcgaactcctgacctcaaatgatccgcccgcctcggcctcccaaagtgctgggattacaggcgtgagccaccgcgcccggccgaaactgtggcctcttaatacctatccctgtcctctccaggatcccttggttccagtaccccattatctatgacattcgggccagacctcgaaaaatctcctcccctacaggctccaaaggtaggtctgagcacttggtaatcacatggcaggtgggatgatcaaggtagctggcaagaaaccccaggggaatatggtagtgtcaggcctttaggcctctttccacatctgcaagagctgtaacaaaaatacctgcctcctggggtcaaagcagcaaattctgaacacactgtgtttgcgtgctttttactgtctcctccctgacgtgtattcaataagagtattgtttgtccctcgtcttgttcactgcctagatcaaagctttgttttaaagccttttttttctaactgcttgacttactatatctacagttacatccactagtacactctgttctggagaagtttgtccctaagcttgactagttcacctgttctctccttctagaccatacataaaagccgtgcctttgagttccccagacctcttcctcctccccacccacgcacacatatacaccctgggtcaggtagctcacctgtaacctgtaatgtacttctttgtgctatacctagtgcaggtcgcttattcatttactagactgggccctgggaataaaagattcattaaacacaattcttgtcccccaagtccttacaggagacatgattacggtacagcacgaaagcgcccacgttagaggttgcacagagtacagagggggaaagagtagtcagctctgctggtgacggggtttgcagttcaaggcttcacagtgggtgagggtgcatttcagctgtgctgcgtcttgtcttccttgtcagcctgattaactctcctccccccagggtagtgccaggctgtacaccattgcacagggcatacagggaggaacatgaaggagaaaatgcttgggaaagggtgtttggccttgaccagccactgctgacctcaatctcagacctacagatggtgaatatctccctgcgagtgttgtctcgacccaatgctcaggagcttcctagcatgtaccagcgcctagggctggactacgaggaacgagtgttgccgtccattgtcaacgaggtgctcaagagtgtggtggccaagttcaatgcctcacagctgatcacccagcgggcccaggtctgactcccaccaccatctgcgtggtgtcagcctttccttcctaggcccagagtattgggaattaggaaaggcagcttattagaaaagcattgtcaccctagtgccatttccacctaaaagctgtgctaattgccactgtgaaataaggagagccagcattagaactcgatagcactcggtgttaggaagcacagaggaaaatggccaagtcttggcttttcctgcacctcttcgagcagagaggcttatgttacaggtttgcctgacaggaagctaaggcagtgcatgttgtattgagagtgaagggttaggggtcgcaaccttcctttcagctccccagtcccctcaaaccacccctcccttcccctcttcacccctgccctcaggtatccctgttgatccgccgggagctgacagagagggccaaggacttcagcctcatcctggatgatgtggccatcacagagctgagctttagccgagagtacacagctgctgtagaagccaaacaagtgggtgagtcgcaagagccgtggggtgagggcttctgagatgcaggaggaggaaagactccatgggtggggctcctgacccaggacagggtctccctgactctctcccaccacagcccagcaggaggcccagcgggcccaattcttggtagaaaaagcaaagcaggaacagcggcagaaaattgtgcaggccgagggtgaggccgaggctgccaagatgatatccttctgctggagagatctcagcccagcccctagggcacctgagttccccattctccttcatgggcaggctgatgagactaaggcgaatgcgactccgtgctctctggcccttggctccttgttgggggtggggactacagatgagatctgaaatcttagtggtagtacctgagccatgactccccactgtaaggccagatcaatagcattggtggccttgccttcatttctggtgctgcccctagttcctggcagcagcctgcagggaggcccacaggtggggtccacggtagggctgggcacaagccacctgagcgcaaccttggatctgacagcccagaggaggactggagcaagggagtgtggtaaggacagggccagggattgagacctgcccttgcgtgtaccttaaccctcctcaccttggagaagcactgagcaagaaccctggctacatcaaacttcgcaagattcgagcagcccagaatatctccaagacggtgagtgtgtcagcccagcgtctctgatggggctgccttgagaaagtgctttcagttaaggcacattgaggtgagggaattcgaaccttgcttgttccggtttctactcagattggcttctctggccggcgcggtggctcacgcatgtaatccccgcactttgggaggccaaggtgggtggatcacctgaggtcaggagttcgagaccagcctggccaacatggtgaaaccccatctctactaaaaatacaaaagataatgagcccgctgtggtggcgtttagctatattcccagctacgcaggaggctgaggcaggagaatcacttgaacccaggaggcggaagttgcagtgagctgagatcatgccactgcactccagcctgagcaacagagcaagactccgtctcaaaaataaataaataaaaaattggcttctccgatactcctcctgtcaagaatgattcctctgggttccctgaccttttgttctaatcatagctgctgctcagcgctctggatccctaagtgcgagcagaaaccatgtgttactcattgctgcacccctgccctaatctgcatgtgttccatgttaagtagctgctgaattgcaggggtcggaattgaggtctttgcttaatgcaagcatctgtcttatttcctgccctgtagatcgccacatcacagaatcgtatctatctcacagctgacaaccttgtgctgaacctacaggatgaaagtttcaccaggtgagagatgtggccacactgtggggtatcaccaagaacgtgggacctgagtctggttgtttgggctctggagcctgctacagctattcatatggctcagagacattgaaccaaaattagaaaagggggtggttgacagtttctatcttgcatctcataggattgattttatgagatcaaataggattattcacataaaaagcactttaattataaagttttcatctaaccaaaaagtgatgaaagatgatactcagttttcttactcaagagccctcaaactcctctggtgaatggagggatgttaggaaaggagatgagaaatagcagtggccatgagaacatgcctcctcctttcatgagcctgagattcctggctgtcaaccctgtttatcttttctcttgggagcaaaggagggttcaaagctgagtggggcctgaagctgtcaattaacatgtgcatttctcttctctgtttcttgttcatctggcgatctggcaccacaggggaaggtaagctgttgttgcttctgtggggtcctgcaggccaccttctccagtacccgcctcctaccctaccccctttcccacctccccgaagacaaaccctcaatcagggtaggagggtcgtagagggaatggcctagagtgtcctgcctctcacatttatgtcccctaataatgtcattatctatcttttttttcctacagtgacagcctcatcaagggtaagaaatgagcctagtcaccaagaactccacccccagaggaagtggatctgcttctccagtttttgaggagccagccaggggtccagcacagccctaccccgccccagtatcatgcgatggtcccccacaccggttccctgaacccctcttggattaaggaagactgaagactagccccttttctggggaattactttcctcctccctgtgttaactggggctgttggggacagtgcgtgatttctcagtgatttcctacagtgttgttccctccctcaaggctgggaggagataaacaccaacccaggaattctcaataaatttttattacttaacctg

SEQ ID NO: 35924 - DNA, 161050 bp, Homo sapiens
agatctgccctgtagagccttgcggttccactgctggcctccggattcccgggagcccccagcccgacaggacaaccttccttccccgcttcctcctttccaggtctgtcccagcccccgctgcctgggccacacccgcttccctctggtggcccagccaccaccgccgcagttcgcgggagcgctcttcctggggcgggcacaggcccagggcgcatgcgcactggtcgaagggcgcctcccagtccggatctcgcgaagttacgttagattggccgccggtgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggtctgtgcgccccgccgccggctctcctgaccgtgagggttctcgtcggcctcctgctcgggcctgccctcagttctccacctcttgaggctgggggcggcgggagactccctgctgcggggtgagggggcggtttccccagagggcgggagggagagctggtggaagggagggcgctgggcttgaggccccccttcagaacagttgctggtggagttgggaaccgggtgatttccggggcataggggaaaaggaactgtggtcgtttggggccccagggccattcgtggataagtctgggatttggggtcgagacaaggaggggtgtagtggggttgtgcctgggccccggtgtcagtggtatattcggaggggtggatgctgaaggaagaaaactaacaaggggcattacggacggttaggcagatgaacatctttgacttgtaggtgggcattggatttgttgcactttttaggacttgattacaaatgatgataataatagtaatctagagccctaagccgagtgccctgaacgaacgatttcctgttttctcatttattactcttggtcactggggaggggaaaacagggtgtaattagctgatctgcaccggctgaaaggaaggggatggaagtgggtagagtaaggaagccctctaaagggcttgcccacctccggaccggaacgtgttgagtctgatactcgaagtttgccgcagtgtcagagatccttgagccccaggtcctcgggtgtgcactggtgttagaaagagaagaataaataggggacactcttttcaaagccggttaccaagctctggtttttcttttggggttgggaaaaaagaaagctggtcacaaacttttctcaaaatggatgctttgtgcatattaaagttttatagtagtctgattgggatctctcaatgttagccaaataaggagaaactattggcaatccagagataatgttgccttgcctttaacaggccaaaagcaacacaaccacgtagagttatgcataaaaagcaatttttaagtgacggtaataggtgacaaaacataggctttttctattttcttagcgggcaacttggaataactgtaatagaaaatgactttgcagcgatagcttccccttaacaatgaaaagacttgtaagctatctcaaagttgccttggttgtgtgtggaagatgcatagccttattttgaataatgttgtagtaaaaacttgtttgggaggttgaaactcaaggctttatatttcatgaatattaacttgatgccttttaaaaaaaaggtgtgtagtgacatttttccttgtcctgcttactgtttaagggagtgatgaccattttaaattttgtgtaatggaattctcttatcagacttggagtatagcctttgtttacaaagttgactggatatattgaaatgattgacacattgcaggacaaatatggaattaaaaatgtggcacccagtaaaaatatagcagggtgtctagcgctttctcaatttcattaatttagattctctaatgcatagcaaactttttatttgggtgaagtttatttaaggcatatcataactcgtaaaattttaaaaccatggtgttgagaatgaaggaaacttttggcattaaaaatgataatgtaattatataagatgaatcttcaaatttctttcaagtgtactttacacgttttagtgtgaaacagattttgaaagacgattattactgtaggaggtcaggataattggataatggttcgcatcaatatgttttattcaaattgtcaaatagaaatttaaagttactattgttgtggaggaacccagttgtattggcttagaggaagacgaaaagttttgatatttacattattgtgatactggtttagggaggaagagaaaatacatttaactgccttcttaagatctttttttctcctctcaatattcacacgttacaagaattgtcagacttaccaatgtcttcctgattaactgaattcagtggtcagtttggtgttgtgtagatatatctttattgggtattttgttttagttgacaaacagaagtttctaaatttactccatttgcgtaatatctttctgtcactttttgtcactgtgagtgtgggtttgacccgataatctccaaccgcctccccttttccataacatttttccatatctgcaaatgccttaaatcggtgaagccaaagtctttaaaatatcaagcattaaaaatttgtgttatgttttcttcactctcatttcttatttatcaactcttgtacttttttcccattgttactatgaaaacagggagttcactttgggcaaatttaggacaacagttagtgaaagacaataaataaaattaaaaaccacacacacacaagaaaattttaagcctttaagaaatctcttgaacttagcttgttttccatacttaattgtaaaaactaaaatcactgatttaatagtccttgaatagttctttaaaactttaacctctcaaaagatcgtagaatacctaaaatgtataacggggttaattgttgattgttttttgaatattcatttactttctggttttgatcaagtgttctaaatttcattgtcaagagaaaagttttaggaacatcacaacccacaaatatgcttttgaaaatcgaatattttgcttttactttaaagagcttatatttaaaggtttattaatttgttgaatgtgctacctcattagaagttataaaagatatccagtcttcagctgttctttttgtatagaaatgtgtcctctgtatagaagaaaaagcagcgtttcttgtcaaatttcctatcttagtctccagagtagcctttctcccccacccactctacccaggacctgacccccaaagctacaaaacagcacaaagttaaccatagatacaaatttctggtttttctagaaccgaggtctagagtagaatttcattattaccaatggggcaataatcagcttctgattttatagctacctggtagagttttacagtatgtgattatatctctattttagcatattttgtaaagatttaaggagattaataaagttatatatagaatgccttattgctgattcttactgatactggtgtgcataaaatacagggctgagatttttctccagcagttttgagtttagcctgttgattttagccttaaaatcttttctttttcctctgtgccagtgacttccaagtcagtttacagttccctcatttctgcaaagctccaagcctcatttccattttttggggttatgtattgatttgaaatgaaatattaaatgtattgtaattttatatttaataatgtcttttaagtagtaatatagtaaatacaagttcaccccctttgccatagaatggcaactactgtattcacgttaacctttgtgatttcttcaaaggatttcttattgttcaaatatagattttcatagttgcaattcagtattataattttacgtttatccgttaacattagagatacttatctttagactttaccagcatcctttttaactaattattttaaaagtattattaatttggtggtaagacaattttacatcgtcaggaatttctttaaattcaacctaaaacaggtctatctttcttcatcaagtctactcttctcattgatgttcctgtttctgttaatgatgtattaatctttagaatcaagttaaacattttagttattgtttactcattccccttgtctatgcataatccagtctgtcttctagctcagtcttttctttacaattaccttggcatcagttcttttctttgccactttttactggcaacctagttcatacctttattattttattttattttatttttttgagatggagttttgctcttgttgcccaggctggagtgcaatggcgctatcttggctcactgaaacctccacctcccggattcgagcgattctcctggctcagcttcccaagtagctgggattacagacgtgtgccaccatgcccagctaattttgtatttttagtagagatgcggtttctctatgttgatcagactggtctcgaactcctgacctcaggtgatccacctgcctcggcctcccaaagtgctgggattacaggcgtgagccaccgcacctagccttatttttatccctagagtatagtaatagcttaattgtttttcctgcctctattctctcccttatttaatctagcatgcatattgctgtcatattaatctttgaacagtatcattttgatggtgttattcctctctctaaatttggatatagtacattttatcatttagcttatggttgatacatctccattgtgttgtatcctttatagaaattggttaacttgcttacgtttcaactagatctttacattttttatttccatgcctttagccatgccttttatcctctctccctcgtttgccaattaaaattctagtcattgttcaagattcacattctcttttctggggtgttcactgtaccttatattctgcctctcctgcaataaaaacactttttactgaatagtgtttgtgtttgtcttcccttgtagcctctgaggacctaatcttccacaatttttgtatttccagagcctagcacatagtagatgctcactaaaggtttattgaatttttatctttttacctcatcaataggaagttttagagttatttttatgttgtgagatatatttttgaaaccttcgcatcagatacttagcgtattgttcttgcacataatggaatttgtgtgattatgaaacaaattaaaaactttgttgtagatttcaatatattttaatatcttgagattttaaaaaaatctttttttttttttgagatggagtctcattctgtcacccaggctggagtgcagtggtgtaatcttggcttactgcaaactccgccgcccaggttcaagtgattctcctgccacagcctcccaagtagctgggattacgggtgcgtggcaccatgcctggctaattttttttgtatttttggtagagatggggtttcaccatgttggccaggctcatttcgaactcctgacctcaagtgatccgcccgtcttggcctcccaaagtgctaggattacaggtgtgagccactgtggccggcctaaaaaattcttaatatcgacctcctttctattaaattttaaagcagtctagatattggttaagtggtagaaaaatattatatccagttgagtcactaattaattactcactttgtaagagtctgagctagatcctctagagcgggggttcacaaacgctgggccgtggacaggtcgatccacgacctgtgaggaacaaggccacacagcaggaggtgagcgacacactggcaagctagcattactgcctgaaatccacctcttgtcagatcagcagcggcattagattcccataggagtgcggaccctattgtgaactgcgcttctgaggtatctaggttgtgtgctctttatgagcatctaattcctgatgatgatgtgaggtagaacagtttcatccggccccactccccaacccacatctgtggaaaaattgtcattcacaaaactagttcctgatgccaaggttgggtaccacttctagaggaatacaaagtagaattagttccatgttctatgctattagaattttaaaatagtttttcttttactttccaaaacagacagacttacagataggtttaatatgaaatccttttgcttttaaaatacaaatttgatctacttctaagggagccattttaagcatctttgtaaaatatgtgatcctctcgtcagtaaagggaatacttttgtgtagtcttcttaagatgtgaagtgtaaaagagactggaagcaattaattttgagttgcttgttagcaaatagtttgattactatgtaaaatctgaattaagagtttatagtttgtaactgtttaccctttttttgatggagaatgttaagatcttggaagaacctactggataacttttaaagagcattaaaatttgtgtctaaaagaatgtgcagtgtaaaatatttctctgcatagttttctttttagaaaagctgtaacactttatgctcatgcctttcaaaagtttttattgaaatcatcctaaatccatttttaaaaacctacctaaacaaacaaataaaaccctcccaaccccaaactggcccctcacttcctacaaataagtgggcaaccctagccatatatggggtgtgctggtagggcaccagtgcccacactgctgctgttctaatgctttttctgtagttgctgcctctgtgcttcctggcaacacttttgtggtctgactttgaggtgtcataaccaagaccatctttcatgtgcctcagctacagtatgattgcaagctgtgactgagcattttctatagccaggtagaaacactggatggaatagaggaagtgtttttcatcatccatttgttattaccacatttaaaaattacagttcacataagaaaagtgttttaaaaatcttattagatgatttttaaaagaaaactatttaaaaaccttttaatagggggaggcataaaacgttgttttgttactaccataacatgttacttcttgacactatatgaagttgctattttcattgcctctgcctgcaaaaaattgccatcttttactccacccttcttttgaaagtttgtggggctccacaataaggttgagaagatgatgaggtattggcattttggtatacctctttgaaaggttgaagaactccaacaattataagtttattctcagttggagtcagatatgtagtagccatgacttaatcagtgttttattgaggagcagtgcttttccaaacaatagtttaattttcacaacatgctttttcacttgctcaaagttaacaagaaaataaatggcagagctggaattcttatgcaggtctgtttgatgccgaaactcaaactttaccctatgccaggtatcttctttgaagtctgaagaagaaaatattcttaaatcttttcatcattatggtggtgtttagtaattggaggtttctctgtaaattagctgaaaatcaagtgaaacacacatataatttttttcttcatccacatttgttttagctagcccatacttttaagacctttctatggtaattgaagtgcagtagtactgtatctaaattaatctcagaattcgaaattgtcctaaattttaggaagtgccaagattatttttgacttaccattatgtgcagaatatatcagcagcaacaagaaacactccttttttcaggacatagaatttaatttttaactacctttatttttctttaccctaatagcaatttatatcgtttcagttgttgggtgtgtgtgtgggtgtggtgtgtgtatgtgtgttttgagacagggtgacagactctgtcaccatggctggagtgcagtggcatgaacatagttcactgtagccttcctgggctcaagtgatcctcccacctcagcctcccgatcagctgggaatacaggcatgtgccaccacttccagctaatttttttttttctttgacagagtctccccgtgttgcccaagctagtctcaaacttctgggcccaagtgatcctcccacctcagcctcccaaagtgctgggattacaggcgtgagccactgcacttagcctgttttagttttttttaatcatttacagtaaattttttatacatacgtacatgtacatatttgattctttttagagacaaattgtaggaaacttcataccatggatactgggggtgggggggaagaagtcccttatatacccttaaggtagggactttgattctttttttctttaaatctccttttgtatcggcattttgttttagtaggtacacaataaatatttaatgattaaaaaaaattggacacaatgtaaactaatattttgaagagcagaattcatagaatattaaataattgggtaagtgtaacacactgacaaacttttaaaatgtcctaataaaaaagcttatatcaaccacttacttttataatacttacaatgtaaaggtagccattattacaatcaaaacatttattaggtggctgggtatggtggctcacgcctgtagtcctagcactttgggaggcctaggcaggcggatcacctgagctcaggaatttgagatcaacctggccaacatggcaaaaccccatctctactaaaaatacaaaataaaaattagccaggcatggtggcgcatgcctgtaatcccagctactcaggaggctgaggcacgagaatcgcctgaacccaagaggcagaggttggagtgaactgagatcatgcctcttcactccagcctgggcgacagagcgagattctgtcttaaagaaaaaaattattgggatgttagatttatttttgaaatgagatctattactgattatcaatagacgcttcagtttatgtaacttagtttaaaaattctttaaacaaatccttgagtgttcatttagaaaagtaatctctaggctggatgcagtggctcacacctgtaatcccagcactttgagaagccaaggcaagagacttgatcccagaagttcaagaccagcctgggcaatatagggagacggtgtctctaccaataaagagaaaagaaaagaaagaaaaagaaaagaaatctctagcatggtaatattagaaataatgcatattttctgttattttactgatactttttttttccaaataacatttttactatggctccctctatgtcagtattttctgaccttattagtgttttggttgtttatctttgcattgttatgctggctaaccataaaaagacacgcttgagttctgtgttactgccctaagtgtgcttgctgctcaactcaaatgctctttcatgggaggagacattccacattgtcatgtgttgtataggcatttctgaaatgacattcagtagaaaccatggaaagaagtgaaagcattcctcagctgtcacttttttagtagtctatttaaatgttatgtatattaagtgagatattctgcagagagagcttcacttaataaaaagctttactttaacttgatgatttaactcacatttgagctgaaattactattttcttagtttaacatgacctctaacaataaaatcataagattgtacaaagctcatgtcattttcttgaatactgcatagtgcagaggagaatacattttgtgagatgtcacttggcaccctcttaaagattaataaccatgtgggaaagtatattttcatggactgttacacacacacacacacacacgtacacgtatgcactcaacctttacttgtaataaacatcccaaattatatatattttattagccttcaaaattgttttagatggttataaacttatttgaatatttatattcttgcatggaacacttctagagcttttctgttggagtttcagctccagaacatttttttaaaatatcctcagtgttgagagtttttttttctttcaggagagtttttaaattttgaaaatgatatcattcgaagatgcatctggtgaataaaggtggatcatgtagtcatcatggttaataaatatccgtgattacatgatattttctaaaaagcttattcttaactggaatatgatcataaatgtcaccttggatttaagttaactctttacgttgtgtggatttgagtatgcttcagaatttgtaaacctaaagtactgttcatttgtgttctagattttgatgaaacaagtcaatgttatagtttgtgaacatagtcttttttgtatatgtttgtgttttctgcaaaagatttcggtgctgcctggcacagtagctcatgcctgtaatcccagcactttgggaggccgaggtgggaggattgcttgagcccaggagttcaaaactggcttgggcaacaaagtgagaccttgtctctacaaaaaatttaaaaattagctgagcatggcgacacgcatctgtggtcccagctactcaggaggctgaggcaggaggattgcttgagcccaggaggttggggttgcagtgagctgtgatcacgccactgcattctagcctgaacgacagagtgagaccaggtctcacattttaaaaaaaggttgtgatgctgctggctctagatcatgacactatgtcattaagaactattgtttttctcaaagatattttaatttctacagtttttcttaaaaggtttggacagatgacatattcagcaatttctgtattccttccaagtacatggaatctacttaagaactctgtagcatattcaagattttttcttttaaaatgcctattgctgtttaactctttgaaccatcattttttacagttaaaatgcctttatattgttgatcttctcagtgttttccattattttttgatatacatgaaaatttaataagtaattattaagtcttcagtgtcttgcttttatatgggtcatccccatctccttttttttaaattttattttattttttgagacggagtcttgctctgtctcccaggctagagtgcaatggcacaatctcggctcactgcaaacgccgcctcccaggttcaagtgattctcctgcctcagcctcccgagtagctgggattacaggcgtccaccaccacgcccggctaatttttcttatttttagtagagactgggtttcaccatgttggccagaccggtctcaaactcctgacctcaggtgatccactcgcctcagcctcccaaagtgctgcgattacaggcgtgagccaccgtgcctggcctctcctttttatttttaaacatggcttacttttgtatgtttaatgttgtatgtgaattttatcccaaataaaaatagttgtaaaagtttaagaataattatttaattaaaacactaaagacaaatgtaaaaaataaaatgttatccaaaatttcgggactggactttgctccatttaaaagtttaacatccttttaaatatctctgtacaagtatgtaattttctataaatggggtcatacctaattttctggtttataaccagttttgaaacattatgtattttaagaaacatttctgtgttaaagaatattcatatacattttcccttttaatgagtgtatcgtattccattgtgtgtgcatgtgcatatacatcttggaatttattttcctagtcctttcctgatgaacatttagtatattttccactttttatcatatggtgaatattatgtacatcttatttatttatttatttatttttttgagacgaagtctccctcagcagctcaggctggagtgcaggggcgtgatctcggctgactgcaactaccgtctcctgggttcaagcgattgtcccatctcagcctcccgagtagctgggattacaggcacccgccatcatgcccggctaatttttgtattttagtaaagatggggtttcaccatgttggccaggctggtcttgaactcctgacctcaggtgatctacccacctcgggctcccaaagtgctaggattacaggtgtgagccatcgcacctggcctataccatgtacatttttactcgctcatcacattgtattccttaggattgttccttagaaatcttatctgcaatcttatgttttgctcaaaataacatgccatttaaatgattgtttatacaaaatactttttaaaaaattttttacttttaagttctggtatacatgtgcagaacgtgcaggtgtgttacatgggtatacttatgctatggtagtttgctgcacttaccgactcatatctaggttttaagccctgcatgcattaggtatttgtcctaatgctctccctacccttgcccctgagcccccgacaggccccagtgtgtgatggtcctccctgtgtccatgtgttctcattgttcaacttccacttatgagtgagaacctgaggtgtttggttttctgttcctgtattagtttgctgagaatgatggcttccagcttcatccatgtccctgcaaaggacatgaactcattcttttttatgactgtattccatggtgtgtatgtgctacattttctttatccagttcatcattgatggggatttgggttagttctaagtctgcaaaaggcatttttaataaagtttctagtatattgaaaatggaaaactaaccgtgaaagtactcatgttgacacatctgttaaattgatgcgataatgttatcccctatatgtcacccacaggcagatttttgttttatttattgttttttttgttttgttttgagatggggtcttgctctgttacccaggctgggagtgcagtggtgtgaacacagctcactgcagcttcgactgcctggccttagtgattctcccacctcagccttttgagtagctgagactacaggcgtgtgcccaccacaactggctgacttttaaaatcattattattagtagtagagacaaggttttgctgtgttgcccaggctggtttcaaactcctgggctcaagcaatcctcctgccttggcatcccaaagtgcttggattacagccatgcactaccatgcctggctgaggaaaattgttttattgctttattactctgtgtgtgtgtgtttgtgagaataaaattagttgtatttcactcagagaagcaattggggaagacaaggtaaaaagtgttcttccttttttctttatgtaaggtttagttctaatgtttgaaaattttgaagttattaaaatattaaacaatatctgtattcatttatatgatgctgttattcatttaaattagtgaataactcattcatgcaagaaacatagagagatcaccatttatcatatgtccagcacagtactaatctctaaaaacagtggtccctggctacatgtagtatacaatctagttgaggtggcagcatgagccgatgattacaatgtaaataagtggtagagtagagatacaaggtgaaattaaaggctttattaggcgggcttaacccagagtatcaatggaagacatccctgagaaagctctgtaagttataggtaacttatcagcagatgttttgagccttttatgaccctattcactactggtttgtcttctgaatgtacctgtttagtgtacctttttgtcagtttctttcttgaagatgaatgttgccaaggttctcatatgtctattattcttttttgtgttatttatgtagtttcaactttctttttatatgatctgtcctccttcttacatgatccatatcttattttttatatcagtcttccatttactaagctagaatctcagggtctttttctgttttctcctcacttgcatacagtacatctcctctaccatgcacacacctaaaaaaaaatcatcttttgtatattcatttaacatatattaaaggtctcttctgtgccagacactactaagtgctgagaagacacatttttgagcaaaaatataccaacagtaccctcatagagtcgacagtaaaatgaaattagccatttgggaaatgcaaatcaaacccacaatgagatactagttcacacctactaggatggctttaataaaaaagagaacaagtaatgactaggatgttgtattagtcctgttttcttttgcttataacggaataccagaaactggattatttaaaaagatttacttattacagctatggcggctaagaagtccaaggttgtagggtcaactctggtgagagccttcttgcctgttggggactctgtagagtcctgaggcagcacagggtatcacatggtgagggggccgagtgtgataacgtgctcaaggtctttcttcctcttcttagaaagccacaagttccactcccatgataacccattaattcattaaccctttaatccatgagtggattaatccatttatgagagaagagccctcctgatgcagtcacctcccaaagtccccagctatcaacagtgccacattagggatcaggtttcagcatgagttttgggagggatatttaaatcacagcagatatggagaaattggaaccctcatgcactgctggtggtaatagtaagatggtatagccactttcaaaacagtctggcattttctcaaaaggttaaacagagttaccgtatgacccagcagttctactcttaggtgtatactcaagagaattgaacatgtgtccacacagaaatgtgtatagtaatgttcatggcagcattattgatgatagccaaagatgaaaacacaaatgtcttatcagctgatgaataaagtgatatgttttgtccctggaatcagcggaatattattcagtagcaaaaaggggatgctgataattgctacaaagatgaatcttaaacatgctaagtgaaagaagccagtcacaaaagaccacatggtgtatgattccatttatatgaaatgtccagaataggcaaatctgtgtatgaagcaagaaggcagataaatggttgccagaaactagaggtgttgaggggagttggtgaataactgctaatgggtacaactttttagggtgacaaaaatgtaaaattgtgctgacagttgcacaactctgtgaatctgtttatttgtacactttaaatgggttattttatggtatgtgaatggtatctcaaacatttaaaaaagtgaacgtatatatttatcagtgtttactactaaaaattgaggcactgacagagccagagtaattatcttctatcagtcccccagcctcagcctaggcttggtattagtcactataattatgatggtgaacagaacagccagacattgcccctgccctaacacagcttgtagtctactggagtgtatagataatacacagacaattataaatttacatcagttatgtgtaatgatatgtaatggtaatacagtatggaagcttatgaaggcatatttcacctagattgggggaggggagaagactttttttttttttttgagatggagtctcactctgttgcccaggctgcagtgcagtggcgtgatttcagctcactgcaacttccacctcccaggttcaagcaattctcttgcctcagcctcctgagtagctgagattacaggcatgcaccaccatgcctggctaatttttgtatttttagtagagatggggtttcaccatgttggtcaggctggtcttgaactcctgacctcgtgatccgcccgcctcagcttcccaaagtgctgggattacaggtgtgagccaccgcgcccggctgagaagactttctggataaagttgatgtttgagctgctcagcgatgagtaaatgttagccaaggttgttagggagggaagattatgggaaactatttcagagagagggaaaatagcatgtgtaaagatctggaagtgcacagaagtgctgaaggatttttttttttaagacaagagtcttgctctgtctggagtacagtggcgtgatctcagctcactgccacctctgcctccccggttcaagtgattctcccacctcagcctcctgagtagctgggattacaggcgcatgccaccacgcctagctaatttttgtatttttagtagagacggggtttcgccgtgttggccaggctggtctcaaactcctgacctcaagtaatctgcccgccttggcctcccaaagtgctgggattacaggcgtgagccactgcacctggccagttgaaggattttaatcaggttaaatggacaaccaatttttcttttttaagaaaaatcacttttggctgcagtgtggacaaggcactgaaaagagaggacaaagctgaaggtagagagacatttgaggaagttgggtagtctgagagagatgactatgagatgaactagcttagcggcaggagggttggaaaatagtagatggacttaaaatatatttatgaaatagaattggtaggaattggaggtggattggcttgagggattatttaaagatgtgcatgcacctgttttctggcttggacaactagatgatgaaggtgcttttcacagcatgcagtaaatattgtgtgcttactgtataggtcagcagcagagtattgatattgcagaatgatactggaggagacagtcaagtaaacaagaaatgaaaatcaagtgtaaaatgtacactataggctatctgtacaggatgttgtgcacacatggaggaggggtggcctaactataactaatacatggagatcatgcttggagtgtggttttttccttggatttagtctgttctcttacttgcctctgattccctggaaatgtgaaaaccaagtagaaaacaatttatgaacatacagaaaaaacgcaggatacagattcgtgattatgtttttttttttttaaggtttcagtgaactgcctaaaaatatatgcaaaattttgtttttctgtacttttcagttcagaagaattagtaaagaatttctaagtaaagccaaatttacttttatgatattatgtatgtggcagaggtgtatggggaggagtggatcacagaactgttggagaggaataaaggagtggtagtagtaacgatctacaagtcttttattgactgaaatagtatgctatgaaaataaagtcacaggttaagataggtgagagtacattttctcagagcatgttggatttttctaattgtatagtgaaagaattttaacaatctctaacttctctcagtttctaaatttactaaatggtatttttcagggaaaataaaggtaaaatattagttacaactaagaaacctaacacctttatacactttttatgtctaatagatttaatgttttttcttttttgctcaaaatattacaggacttgctttgagtatttgattgagggttttttgcatgttttaatatttttaaaagttgcagttaatgaggaaagtagtagtgtacagaaaggttgggttattttgactttgagtaagcatcagcagatttgtttcagcttaaatgaaataggacataattgttatatattaaactcttttttttttttttttttttttgagacagagtctcgctccgtcaccaggctggagtgcagtggcacgatctcggctcactgcaacctccgcttcccaggttcaagcaattctcctgcctcagcctcccgagtagctgggattataggcacgtgccaccacgcccagctattttttctatttttagtagagatggggtttcaccatgttggtcaggctggtctcgatctcgtgacctcgtgatccacccgcctcggcctcccaaagtgctgggattacaggcatgagccactgtgcccggcctaaactcttaactctgtataacatggcatctttttcccttttcaacccatccttgacatttagagccagtctttatatgtgggaatactatataagtttttctcgctttaaaaacactcaaatgtaaaaaatgttaattgcaggacagtatgtatggtatgagccctttggggggttatttacatagggaaaaaatctggtaaagtacctcaactgttaacagtggttgtctctgggagggaaatacagattttgaattatgttacttttggatcttttacaacaagcagaaaaaaaaaaagaaaaatctcaattggagaaaaatgcctaaatggctattcccagtaatattttatggattaaatatagaaacattgatataactaatgaattttagtttgctagtgtttggccactcaaagaagctggtgttgatggttcagtatttatttctgtattatacttgccttttctctgaaccttttatttcatgaggaatgactgcttgacgatgtgatgaacaccttgggagagtattctaagcaaataatggaattctggatatggttagatgtattttgtagctttttgcaagtggactacagaaagttcagagaaaagctaagtataattaccaaaaaggcaagtcatttttgaaggacaaaggggttttaaaggataaaatttgggttttagaattttaaacaatccaataggagataatgtgaagaaagaattagaaaagcagttttatacagtatgctcttttgccccattctttatgaatgtataaagcatttgtcgatgaatatctgtcttaagaatgaattgaaaaaacagccccaagtctcttagaattaggaatgttgaagcccatagttacgtgaattttgtgaaaatatttttgaaggcagtgaaaagaggacttttaaaatttataaaccagaacaagaataggaagatggaaggcaactgatggaatggcttttaatttacatacacatttgttgtttataggtacatttgttgtttataggtacatttgttgtttataggtacatttgtttaaaatggtcttctactctacactggcaaaattctaatatccactattaaacagatagttctggaagagactgtgttgaacactagatgtcaatttgagttttctgaaaacaagttatgttgacctatctttacttcctttttggtcaaggtttagaaacataactgggggaaatgttgcaaacagtatagcttgattttttttgtaaagcacatggaaaggctcttgttatgtctttacggttaacatgacaaaaatttggcgtgaatattatcaggattaggctcactaatagctgggtgaactactgtatacatgtcagcctgctgattgatcactcagtgtcaacccaaagggaagactaacatagtggtccttgtgttcttaatcttgaccctatcctgtgtaacgtttaagcagataaagttgtaggagctgagagagaacttcaaaaagcataaaatagtgggttttaaataataagatgaaaagataatgggtattaatttaaaattccacattaaaaatggatgagtgtaggttggtagagatcatttttgacagacatatgagaagtaagtcattggaagtttaacagcaagcctggtgtctgacaacagtataataatttttaaatataccaatttaatgtaaagcaaaaatagtgttaagcctagatttaaaaaaaaaatctattctgcattgtaagatcacatctgtagaatgtgtctaggtttttagatttgtttgctgttcagcagatcttagcaatgacctgccaagggaatggcttcatataacaaagttagttctacagagaaaaacaaacctgtgttccaatttctttttctagaattgttaacaaatttatacataaacatgcatacattctcacacataagcaagcacacgtacttcacagtatagtaattggagtcttaaaatgccctaagattcccagaactccatcaactcaattattttcttatgagccccttgaaaaacaaaaaggaatcaattttcaaagccgcatacttacctacagtgttagaccaacctctagtaggaaaatggtagaaggattttgtgcatatattagttaggagtcttggttgtaagtaagaaaagcccattggaaccggcctaaataatttataagattatagtatctcatagaactggggcttctggaatgaattagaatcaggtactatatgcaactcaagaagttctctaagtttctcattattgtttctaacaaatccagatttttttttttaatagaaaaccagattttttgttttcccagtttaaaaaggcagaaaataaggtcacttccagagtttacattctggtctagttatctagagagatttatctcctcctgagttctaattccagatttccaggaaagggaccaaatgatccatctcaggttattcatgtatcatacaaggtcatcaatggtggctgatggggctgaacccctctgaaaaaacatgcctactctaactgtaatcatgtattttgaggagatgatggggacataaagctggaaataataagcgagttcagaaagatgccaatattgattgtataaatgtacagtctgtacaaataaaaaagtacaaacaaatgttaaagaaattttaaatcagcagttatcagactttttggttttaggaccccctttataatattaaaaatcaaggacacactagccaaataaataaaactgggtaaatatgaatatcagtatattatatcaatgttaatattctgattatattatattatagttttgcaaagttttaccattagaaactagacaaagggatatcttggtattacttcttacaacttcatgtgaatgcacatgactgcaataaaataccattttgaattttttgtctgttattattttaatgctaaaaaaaaattgaggaacccaaagaggtttttgtttatgttggctgtctgtatttaccaaattagaaaataaagttgaaaaaacttttaaatatttattttaaaataataacccattacattccaacataaatattatgcttatgaaaaatagatgtattttacgaaacaaaaagagtggcatcgttttacatttttggaaatttttttaaatgtcttaattaagacagctgaattctcatatccacttctgcatctagcctattgtgatgtcacatacaagctcctggaaaactccatcatatgcttgtaagagaatgagagtattaaccttgtagacttctgtaaggggctaagagaaacactgagctaaataattgaggggatatactatgttcatggcttgaaagactgtaagtattgtaaagatgttcttccgaaaccaatcacagatttaatacaagtccaaacaaaatcccagatatgtgtgcattgtctgtttgtgtatgcatgtgtgaaaaatggtaaattgatataaagatgaaaaagaccaggcacagccaagtcaatctttaggaacaagaaagtgagaggactgaccgactctgatggacattaagacttataaagccacaataattaagacaatgtggtgttagtgcaaaattagacaacaaactaatgaatcagaatagagtgtggaaaaagatccagacagatatggacacttgatttatgataaaggtggcatttcagaaaagtggggaaaagagagtcttgtcaacctgtctatatggggaaaaagttcatcttcatctcccccgtaccttataccatacacaaaaataaattccagttggattgtagatctaaatgtgaaatacaaaagtaatagatactctggaaggtaactatgagaatatcttcataaccttcgggtagggaaaagatttttaaacaggacacaaaaagattattacccataaaggaaaagattgtgtgtgcatatgcgtgtgcacatgtgtgttttaaacaacaaaatacacagatgcatcacaaaagaaaatattctattggtaataaacatacaaaaagttattcaatctcattcaccagagaaatgcaaattaagagcacaatagatatcagcacataccactggaatggctaaaattacaaaagactgatgatatcaaatgctgagaagggatgtggagaaacgagaattctcatacactgctagtgtaagaagtatgtgagatttctaatgtattcaaatatatttaaaatttgtttatctcttgcttggttgtacttatgcagtagcaatggaaacgtactctatggattaacatacattttaaagctaaaattccacaggagattgttgaaggtttttgttaaagtgattggttataaaaatgtttatagttgatagggattctcttattatgattaggtgataattatattatcagagattcattaattttatttcttcttttttttttttttttaaatcaggctttcctctgtcacccaggctagagtgcaatggcacaatcacggctcactgcagccttgacctcctgagctcaagcaatcctcccacctcagccacctgagtagttgggactgcaggtgcatgctatcatgcccagctaactgttttttatttttttgtagttgggggtctcgctatgttgcccaggctgttcttgaactcctgggctcaagcgatcctcccgccttggccttccaaagtgtggggattaccagtgtgagtcaccatgcctggcagtgtttcattaatttaaaaaatgtttgcctgccttgtgtgtgccggtcataatactgggagctaaggaatacagagattagcaaaacaagaccctcttctcattaaatgtatcaatgcaagttgtattaagtattttgaaggaaaaatataaagtgttatacaagaacagaaggttttgagagtttggatggagtctgtgaaagtcatgattgaagtgagaactgaaagaccagtagttgtaacttggtaaagagttgatggtcgagggtggagagatagattcttggtgaaaggtggagaaataggttctggtcagagcaaagccctttggagaaagcatgctcagcagaggaactagaaggccagtgtgactggagcacagggggtgagaagaatggtatagcaaacagtatagagataggttgaggtcagatctaggaggatccaggagaccttgataagctcattttcacactagaaccctagaaatgcattaaagtgttttaattgctttagtgctaatcagatttgcatttttaagagacggctgctggctgtagaacagattgggtggggggaatcggaggtggagaggagagttgtgcctggaggccagttccagaggctgatacgggagtagaggcaagagctctttctcagatggcttttcagtcgaaagctggtgctttacaagatgttaaaaggcatgctaagtaaaaaaaaaaaattatgatatgtttgggagatgctccattaaacaaggtaaaacagatattttgctagaatttttaagtcttaaaaaaaaaccttttatttcaggtttcagggtacatgagcaggtttgttatatagttaaactgcgtgtcatgggggtttggtgtacagattattttgtcacccaggtaataagctagtactcaatggtattttttctgatcttctcccttctcccaccctccaccctcaggtaggccccagtgtctgttgttgccctatttgtatccatgtgtttttgttgtttagcttccacttatgagaacatgcagtatttggtttgctgttcctgtgttagttcgcttaggataaaatgcactgaagaggagagaggctgaggaaggagctgaagccgagtgatagaaatggaatctcagggtgttgcgcctggagggttgttggttttaggaaatggagaaaaggtgtctgaaaaaagagtgggaggatggattgtagcaagcctgaaagtgtaaacttaattcataaattgtgaatttctaacagtagattaaatgaactaagggctactgcagaaagattaatttggtagtaggggtaaataggttaggacatggctgctagcaacctatttcagtagttcaccgtagagataaaaatatcccttccattctctctgattttgtttgatgctgtaagtgttctatttactgaagaagttatgggggttttttggtcagtgatttatattgatcttcagaattctgtgcttaagtttcaagtgatttgtgttagaaattaagaagttagggctttttactttccactttcccttttcaaatcagtaatactaacttttttagccactagctatattctgtattttaatagctacatatacttaacactaaactagtaaattactaaatgatttgaactgttagtattcatctttgtgttatgactagcctttgaaattagatgtgtttatgtgtgtttgtttacatatatacatgcatgttcgaataatgcattaactttaaggagtgaaatcatagtagaataaactagatttaaaacattttaattttacatagctcttataagattggaaaagtttttttttttaagaataaagtcatggggattatactttgaagtatactttttaaggttctatttatttatttatttatttatttatttgacggagtcgtgctctgttgcccaggcagtggcgccgtctcggctcactgcaacctcccacctcccaggttcaagcaattcttgtgcctcagcctcccgagtagctgggattacaagcgcctagcaccaagccccgctaatttttgtatttttagtggagacaaggtttctccatgttggccaggctggtttcgaagtcctgacctcaggtgatcctcccacctcatcctcctaaagtgctgggattacaggcatgagccactgtgcctggttttaaggttcattttaattagatattgtagttatcccatcccattatgtttgaattaggtcttttagactaattcagattggctcttttctcatccagtaaactgctttcttctttatccgcatccaaatgataaatgttatttgttgtcagtttacaaaatgattcctccccttttttattataaaaataatatgacaggctgggcggggtggctcaggcctgtaatcccagcactttgggaggctaaggcgggcggatcaccggaggtcaggagttaaaacagcctggccaagatggtgaaactctctctctacaaaaatacaaaaattagccggatatgatgcctgggcgacagagtgagactgtgtctcaaaacatcgtcaacaacaacaacaacaacaacaacaaagcaatatgacattaagcagaggctgtagttgggatgcataatttttttttttttttttttaagacggagttctgtcaccaggctggagtacagtagcgtgatctcggctcagtgcagcctccacctcccgggttcaacgattctcctgcctcagcctcctgagtagctgggactacaggcacccaccaccacacccagctaatttttgtatttttagtagagacggggtttcactgtgttggtgaggatggtctccatctcttgacctcgagatctgctcaccttggcctcccaaagtgctgggattacagacgtgagccaccatgcccagccggggtgcagaacttttaagttcatactgtaacagattctagtaacagttgtgggaattaatatctgagtcttcagaaggatctatttgggaattaacatctttgagacttcagagggaactatttggttggaatagtaaatagtaaacacttatataatagtatttaaggatataacagacatgccttaggcggttacattatcacattaatcatatgaggtattattcattttattattccattagacctgtgaagaaaatgaggtacagatgtgactgtagggtcacaacaaagcttataaattacagggctgggagttgaacctgagaagtttgactgaacagtgttctcacaaacgctatgccatagtgcctctggactacttgaatcaccaggttccatcctcatggtatccttaagaatacctgggtcttaattataggacaattgataggccacaacaaatctggtaggtcagttatctcctaaagctaccccaatggggtgttccagaaacttcctggatgcatccagggtacaccaaggtcttactcttgccagctaatgtgttctgttgctccagggctcactgttgataatcatgggtggtatataacaagaaattgagaatcctgtaggcatatggttatttaatcagcctttgattttaaataactttatctgaacactgttaacatataatgactaaaatctaacaccaaactagctggtcacaggtcttctgttagtattttatatttccattaacttctttaaaatgttcctatatcagaagacattgtgtaaaagccttattaaatgcttctgtttcattttcaatttaactatattagattatatacctgcttttctcctagcttctgctttcatattaagtcatttcttccattactgaaatcttgtttgtttttattggataatctgattccaagtttagaacttctatgttttaaaggactgtggatgacagggagataaaaaatgaaaagactacaagaaaagcagttcctagtttcagcaaaaaattcaaaggcatttgggtcttctattattaactgctcttttcctattttggaataaaattaaagctagagtctagtttaggtatggtagttatcatagatgcttccactactacaaacagtgtgttctttgaagatctgaaataattaaatacagtgctttggatcctcgccctgttttaaatagaaatgaattttcagaaaggattctactctttaattactgtggaagacactgtaagagttaacattgtttaaagaaagccttatatgggaaagatcaattgttagttagtatcctaactaaacgttttcaaccccagatacccattcttatgaagaaatctgttcttcagaaatttagtgtatgtagcaagccgtctgatttttccttaggctaataatggaggtcactccattaaaagtactgtgaaccactattatataccacagaatacagtatagcagtcttccaatttttaaagaaacatagatacatagattaatatatagaggctaggtcttgctttgtctcccaacctggagtacagcagcaggatcataattcaatataatcttgaactccttggctcaagcaacactcctgcctcagcctcccgagtagctgggactactggcacacactaccaccccggctaatttttacattttttgtagaggtggagtcttgctgtgttgctcaggcaggtcttgaactgctggcctcaagtgatcctcctgccttggcctcccaaagcactgggattacaggcgtgagccaccatgcctgaacagatttatttttataaacagtaataaagttaggttaagcccagatagtgaaagtaggcaattgtagagtgaactttcatctttgtaggcacttgctctgtttatcaagttcttaattttcattccctcccaagaaaatatcccacttgatctttaatttttattttgtttaacttttatattttttaaccttgatgatattttagtataggctaaatctcttaggacactcagaagtttttcccccccaatttttaaagaagttccagagttccattttatctttctagttgtcttttaaagctaaaatatgtttattgtaaattgaaatcatgagcagatgagttttagtagagctaaaagaaggacagagtctgcctgttcttaataatcttagggtgattggaaaatatatcaaaagacattttaattttcttataatctttttcacagggtctttcttgtagatgacagctgtacctttcccacctgcctctttctcttactaatatacctaagagaccttttgagtgaggggagatagagttattataatctgtatttatatattaatgaagtacattaaaaaatttatgcatggatgtaaagagatttactgagataatttatgtagaatcagtacaataggcaatttgtaggccggatgcggtggctcacacctgtaatcctagcactgtaatttgcctgcctcgggaggccgaggcgggcaaatcacttgaggtcaggagttcgagaccagccgggtcaacatggcgaaatcctttctctactaaaaatacaaaaaagttagctgggcgtggtggtgggcgcctgtagtcccagctacttgggaagctgtagcaggagaattgcctgaacctgggaggcggaagttgcagtgagccaagatcgtgccactgcactccagcctgtccagcctggacaacagagtgggactctgtcttaaaaataaataaatttataaataaataaatacatacatacatacatacataaatgaataaataaaccagcactttgtgtacaataagcaatttaaagcaagctgctttttttcctgatattggctaaatatggataatattgatgtgttttagctttttaaaaaatattaatggtaatatatctgccgtatagaacatttagaaaataagaaataagagaaaaaattactgtcagccctttactctatgttaatatattggtatactccttttgcctaatttttatgtgtttgtgtgtatttttatatactttgtgtgtattctaaatgtattttgtatatttgtgggttaaaaacattcttgtgattgtactatacagtttttttaatcccacttatcatatagctgattttttaagtttttatcattaatattaatttggatgtttgtaattttattaaccattccaattctgtttctaggtttttattatttgcagttcactcattcattcatttgcttattcattcaaatagtaaatatttattgtatgcttgctttggtgctaatattttgatgaatattttgatgcataagatttttttcatttaaagtaggatgatttccttagctgagcatctccacactgactcttctgggtgaaaatgaaggaatgtattaaaccactcattataaacattaccaaattgttttcaaagtttcgcaccagtttgaccactaagaatgtgagtctgttttactctgtcctcacctgcactgtacacaataatttacttctttcagtttattacagctatggacagttttccacatttaatgtattacaggtggattatataaattttaaaaatgcatgttagtttgttccacaattcaatgatttcttctacaggagatgcttgattcaaaatcataattaaaaatacatacatgggttaagagtgaagcaaagactatcaaatgtacaaataaaaatatgcgtaattggaaagatagttatgataccaaataaatgactcaaatttaaggctatatatataagtagccttaaatcagaaagtatctgcagcatcctgccttcagcaggaaggcaactgaaaagaacactggttctgtgtcttaggtttaaatccttctgtgccacttactagttccctgtttttattaacccctttgagtttgtttactcttttgtgaaatgtgaatggcataagaatgtaaaatgattgccagaaatgacagggaaacagatttggatgcctctccttcaaaaaaaaaggggtgggggggggcggcaaaacaaaacattctagaataggatatttgaacaacttttctttatgtggttcacgctctaaattaatttgttgttaagctctagtagtgctgtttttaggtttaatgggcttttcaattttattttgttagaatgtttactcagaattttgcagaatagactttacaaagttgtttgaaggctgttaggtatactaagcaggaaagtaatagctatagtaaaacatgaatagaattagtgaagaaaggtattttaataacatagcagctggaagaaagattaaccaagccatgcatgaattgattacaatataaagtgttaaaatagattttcagacacgaatttcactattttaggttttagaaatgtttttgtatttatatttgaatttacctttgtgtggttttggtattcttttccgagtgaacatgcttcagtgtgttttgaataattgaacaacagttcttttcccctcttggtctccactttacttctacaccacacacaccttcactgagaatagatcaccttttggcctttgtaagcaccagtcacctagtgctgttgcctttcagagttgaatatggagcaagtgaaatctgcagatgctttcacgtatattaagcagccaattgcttaataaaacattatattgtagggtgttataggttcaaagaaatagagagcaagtgaaaaatgtagagggaagaacttgtaccactggaatgagctactttatgctgtttatataagagtcttttcctcttcagagcttgttaaatgataataatattctgcagcaaggttttcgtcataaggatgaaatgagagggatatgtgaaagtacctagcacagcctttcccattatagggaaaagggaggtaatatttgagtaaccactccattcaaaatgttttgttaggtagtggggcacatacagaaagtgtctgcctttgagtttccagtctgttcggggatacagaatgaatggatctgaaatgactttagtcatttagaacatttttttctgtttaattaagcaccacatataagtgccatcattttattccggtcaagcagaattgggagaaaaaagggatacactcctttttttttttggagacagagtcttactctgtcacccaggctggagtgcagtggtatgatctcagctcaccacaacctccacctcccgggttcaagcgattctcctgcttcagcctcccgagtagctgggattacaggtgcccatcaccatgcctggctaatttttatatttttagtagaaacgagatttcaccatgttggccttgctggtctcgaactcctgacctcaagtgaaaaagggatacacttttacataaaagtaaactttcttgattgtagatgatgtcaacaggcagattttcaaggaagatatctaatgtgttgggagggagaggtagagttactgagtagggggaaaaatgggtcagctagacagtaatagttgtataatgtggttttacatttatttatttttttgaagagctgtgagttcatgattgtatttatatttacctttattttctcaaataattaattgtaataagcaaaatagataaaagatagcatttatgcgtgaaactagaaagcgagacatggacacagtatcaagatccagattgtgctatatagaatacagattgagtgtccctcatccaagatacttgggaccagaagagtttcagatttcaccttttttctaattttggaatatttgcatgtatttaatgaggtatcttggggatgggtcccaggtctaaataagaaattaatttacgcttcatgtgtacctcatacacatagcctgaaggtaattttatatgattttttttttttttgagatggagtcctgctctgttgcccaggctggagtgcagtgctgtgatctcagctcactgcaacatctacttcccgggttcaagcaattctcctgcctcagcctcccgagtagctgggattacaggcacatgccaccacacctggctaatttttgtatttttagtagagatggggtttcacaatgttggccaggctggtcttgaactcttgactttgtgatccacccgcctcggcctcccaaaatgttgggatttacagacatgagccaccacgcccggcctatatgatgtttttaataattttgtgcatgaaacaaagtttgtgtaccttgaaccatcagaaagcaaaggtgtcgctatttcagtcactcgtggacagtgtgtagttgtttggcatcaccattactcttgactgaatttatatgctactgataagcagtcattttcttacacgtacacgtgtgaattttttttttttaaccttttgtgggtatgcctgcatgggggaattggggcatgcacgggaatgataattgcatctaaagagaggaggatcctgtataaattatatgttgtgtacctacattttaactttgatctgtcacataaggtcaggtgtggaattttccacttgtggcatcatgttggtgctcaaaaatttttggatttgggagtatttttggggattcagattagtgatgctcaacctgtaatataaaaatgtaggtttctccttgattgttatttttggtagaattagttaaaaatgactttctgaggtaaacagcatggaaacaggaaattgtttttaaaaaggagtgagtttaatatatacacctatgtacctgtaaaaattgaaattaaaaaaatttttttttgaagtttgaaaggccaatatccatttaaaaaatctctttgaaaactggtaacttgtctatgaggtaaatgtttgttgaactgaatctcatttaattttaaaataaaaatatcactttttttcaatttgaggtgtcaaagatttcaagactctagcataaaattgctagaaaaattggaccaatttattgtggggattagatgaaatactgtatgtataaaataatatataaaacgcagtactaatgaaagggcttaagaagaaatgtcatattttcaggttaagcatcggtactgatattattagtaacacttgaggcttagaggaaatggtgttgtttgttagaaacacttactatagatttgatactgaaatctgctttggaattctacatctctcttaaaataattggagatatatgaagtagttgacactctttaagttgaaccaagctgttagggaataagatctcaaatctttaacaagacttatctggatctgctgacttttgtagtctcttctcttgttaatctgtattctagctacacttcccttcagacccttaaatatcctgagcccattcatatctccagctcttatattttccctttgcatagaacagtctttccatcccttatcctcaccttctcttaactcctattcgttctttaagttttgtaaaagggaaacagggaaagttttccctgactctgtgtcttattctccagaaacctgtcttttcctattagcgccctgttctttcatgcctcttctcctagggtgtaattacgtatttatttgtttgtttatttgtctagcagtgaacccaagcattatcctagtgcctggcacatagtgagttctcagtaaataattgttgagcaattaagttaaaatattgagtaacttctctttggatcttaatctaatttttgctttgcttttgcttgcttcttcatctttttggggtgcatattcagttaatagctgttatgattattgtgtggtaatatttacctttaaggaagctgtgcacttttcacatactttttttttttgtaatgacaccattcacaaacaaggaccaagttaagttgcagtaagcttacttttttacctccagagaaatgaaaacatgttcacacaaaaagttgtatgtacatttttatagtggctttatttataataaccaagaactgaaaacaactcagatgcccttcaggtgtcatgtcaacaacccaaatgtccttcagctgcccttcagtaatcaaaggagccctactgaaagggatcacctggtctggagaaagctggtgtttgagtgtgattactactaaaattttcctttggaattgatccttactttgctggctcatgtaatcaggcatctcaaacagttacttctgccaaaaagcttatcctaattggttcccgatctagagccctctattgtgtgttcttacattctttcatatttctgtaacggttctgtaattgtttatttacttaactgttccttccacccaaaatagaagtttcttgattttgtctttatagccttctcacctaacatagtacctgggacattgattgctagatattcaggaaatgtttaatggtatgaaggattctcttcacagtaacctgtttcaaggacttcatcttcgggccttgaagagaatggacacttggaaattctcctcctgatttatttggtgcatggatacccagatgaatagttaaactgagatttttaatagatggacaatccttctatactatggtttatgacatgtcattgattgctgcattgattttggtacatctggggtgactatttaggagccttctcctcttaaaattcgttgtgtatacaccccaaagtcatgtaattacgttacagagaattaccattctgatggtgtgaagatacaccttgggaaatactttaaaatcctggacagaaactgaaatatatatctgaaagatatgttcatgggtattaggtttaaggatgttaaagctatagccttgaaaagctttgttcatgatttaagttccctgccatttgtttcaaaggcacatttacggaaatgtgtattttgtgtgtatttattcagcaaatatttgtgtgcctattacgtggtggaccctagaatccatcaatgaattcacaaagcagacaaaaatccctgcactggtggagtttacatggagcttatttgctgcctctgtatgtttctatatgcatgtgtgtagatatgacatcattataggacaggcagcataataaattgttataaggatgttttgtattttagtagaggactgataaaattggagggccattgctaactcttcattatctgttaccttatttcacagatctgcattttgaatttttttgccctggcttatccaaacaggaaaggcaaagaagttttattaaacaattgaatgaaagttgtatttattgttctagcaggtgcaaagcattctgctgtaaatattgcagggtggaaaggatggctaacacacagttcataacttcaggaagcatatagtttaatagagacaagacaaatatatgaataatatgcaaaataacatgaatggtacaaccaatgcctattgtattcaaaaaaggggagatgttacactaatcagaaaggccaaaatgaaaaaacctttgatatgagcatcatgaaatgcctgcgatgatgtggcacaattggaactctcattgttggtgatgtaaattggtacaattgctttgtaaagatgtttggtattttcttataaaagtcagtgtatacctgctgagaaattccactccttatgtttagccaagagaaaaagaaaacatacgttctaagaagacttattcatagcaacttcattcttagtagtcaaaaactagaaatagcccaggtgtttatcagtggtggagtggatgatctatggtatagatatataagggaatatttatgcagcaataaaagggaatgaactacttgataaccacaacaacatgaatgaatctcataaacattttgctaaaagaagcctttcacaaaataaagatacgttctaagattccatttacatgaagttttagaatggccactcatttattgtggtggaaaaaaaaacccagaacagtagttgactctgaatgggagagacagaccagaaagggacatgggaaaattttctgtagtaatggtatgttctgaatcttgatacaggttaggttgtgtgcactggtttatgcattgataagacagtgaatatatatatatatatatatatatatatatatatatatatatatatatatttttaagatctctgcatttcattgtatctaaattttgcatcaaaagaaaatgaaatatattgaactctaattaatgacaaacatgctgagttatttagggagacatgtactctacagttttacttttttggtactttcaaagtagctgtattaatgtgtaaataaatgactgtggatagataagtgtgctgagcaagtagtagcatattaatagtagaatctagatggtgattatataggtgttcactgtaaaattctttcaactttgctatatgtttgcacattttcatacaataaaatgcgaaggaaaagaggaatagtatatatggaaggtagcataaggaaattttaaaaatgtttttatttaagtagatcttaggatgtagaaggatggaaaagatttgttttggttgagggagggtgtgagttggtatagaggcagagatgtcggaaaggcattataggaggagggagtagtaataggagaaacagcaggttaagaattggactagtgattggttttgtttggctaaagtacagggcaaaatattgcaacatgaagatggaaaagtagaaggcatttgtgtaagaaatcattagaagttcagtttgtgagtggtagactatttcttcgtttgcagcaaaggggaaggaagatgaggagtgtgaaactgtaaaaacttatgtggaaagaatgaaatctttagataatagccgttgaccatttccattttcttcatagtgtaagggtatagctattggatatttatttgttttttgagacagagtctcactctgtcatcaggctggagtgccgtggcaccatctcggctcactgcaacctccacgtcccgggttcaagcagttcttctgcctcagcctcccaagtagctgggactacaggtgcacaccgccacacctggctaattttttctttttgtattttagtagagacagggtttcaccatgttgcccaggctggtcttgaactcctgagctcaggcagtccgcccacctcggcctcccaaagtgccaggattacaggcgtgagccaccgcgcccggccagctattggatatttattataagtgggattgtggatcagtgggatttggtactgatgagatcttaaggcaaatgtcagagatttgaggtgataaatagaatgtgttaggaattctggcagtagacatttaaaaaatatctgctggtagagtattacactgagtttagtgtgaagtcattgaggaccaaatccacatagtttctaaattctcctagcattgtttgacagcatctgtgtgggagaacagagcaaattaatggtattactcagtcctagagattggcaagggttaccaagaatcctgaggtgcagtgaatgtgtagttgaagtaaagaggaggcaagtaaagcctgtgaatggtggtagactggaagagttggaatgagtcaagggtcaggaattcacaatgaggacaaaagaagattcagtttaaaaagggtggaggagatgcaggatgtggtaccacgttcttctctgctgaatttcagagttctaaggtcttcacagtgaaacatttggaagtaactggcatcatcctccacttgatcacataaacctagaacttaggaggcttgttgttttttttcttttgttttgttttgctttttggtaacctgattttcttttttctctttttcaacttttattttagatttagagggtacatgtgcaggtttgttacctgggtatattatgtgatgtatctattacccaggtactgagcaaagtacccaacagtttttcaactcttcccactctcccttgttccctccccgactccccactgttgttgccatctttatgtccatgaatacagtacccaatatttagctcacacttataagttagaacatatggtatttggttttctgttcctgcattaattcaattaggataatggccttcacctgcaccttgcatccatgttactgcagaagacatgatttcgttatttttttatggctctctagaattccatggtgtgtatgtttaataccacgttttctttatccagtccatcattaatgggcacctaggttgattccatgtttttgctgttgtgcatggcgcagcaatggacatgcaagtacatatgtctttttggtagaacaatttgttttctttggggtatagacccagcaatggggttgctggatcgttcttgggaagtctttaggaagccttcttgaaacttattctcttaatctccacctcaacgaggttgttttaatttttgaatttttgctgtgaggataatctaaactatatgagaatggataactagatagatgaacaagatgaattactattttagaactgatacactccttcttgatttcagttgcatacaattgcatttatgctgtgagttggtgccaaatagaataggtttattgtcatacacaaatgaggaaagatcaagatggatttaaatcatctttgcaataagtgggggccaattcacagtgagatggcatcactcacccctttacgaactaaagagaaaatggcaagaaaatgtataaatatattttgcactggcctcagtggcttacgccttaatctcagcactttgggaggctgagatgggagcatcacttaagcccaggagtttgagaccagcctgggcaatgtggcgaacacctgtctctacaaaaaaatacaaaaatcagctgggaaaggtggcacgtctgtggtcgcagctgcttgggaggctgaggtggaagaatcacctgagcctgggaagttgaggctacagtgagctatgttcgagccactgcactccagcctgggtgacgaaagtgagaccgtgtctcaaacaaataaataaataaaatttattttggtttagatatgcactgaaacatatataaaggcctaggtttatgttattagctatttaaataactttgtaacaaaaataattctagtcaatattagggatgttttagaaaggtcttatgttactcatatttgaaaaattctgttgtaccagaataaatttaggtcctcctagcatggtttataaggccagtcacaaccccttcttcttatctctccttaattctctctaatcacctacttttgtttcttgtactttatgacccttcagcaatattaaatgttctctatttgatatactactcctcttttaaaaaaaaaaattgttttaaccttcaccatttctttatccttaatgacatagatcaggtttctcctagaagccttgctcttacttaggctactccctaatctctgagctcctacaaaatacagcatttgctgtattattttgttttcacattgagtctgttaaaatcatatatttaataaggctcggtattagtcatgattcatttttttgtattcccagcatatagtaccttacagatgatagtaattgttgacaaaatctgaacagagtagcagtgctggtgaagggcattgatgtcaaactgtggttttctgaaagctattctctggaagaggaagtttattactataataaaatagaggcttggggtatacctttatgtcttatgtatacagtctgttctcttaagatgaaatagctgtatcagaaaatagtgttccatttggatcagacataactattccattgagctttatacattgctgttttgtaagctgagctgcttctatttccctccccttttttggttctatagtacttaaaaattacatcatacagtgatttactagtatattttaattttgaagtcatgagtaggcagaattgtaaataaaatgtaaataatacaaagataaagtattagcatataatctttctacattttcttagagtttctcctgtttttttttccaggaaccctgaaattatctgcaggagttgcttcatgtgattgctctttttaattatctccatgtgaagaaaacattgccaataatgttagcttgctttttctcagcagtagtcagttttgacattacttgcctatgggctagccctctacattttacagggcataatttcttaataaacttttccccccatattggaaactttatgacttaaaaatatctgggaaataatcattactcatagaactgacacagaagttgtagaatccacacacgtaagcataaagacttttattttactagggagaagtcctcacgtgatttttttgtactcttattttaggctctttaaaaaaaattttggcaaattaagagttgcagattagtatggaagataaaaagttgtcagatagttttaagaggagacagctgaaagcaagacgaaaggcggacaacctgctaaaagcaaacataattcccaaaaagcgtgttaggtgttttagctgcgtaagctattggttataaggacattgttgtgtaacagcagagtgtaataactgatgcaataatgagttaatagaaaaaagttaaattacatttttgtatttgtttaaaatgacaaaggagtgcgtgatagattttaggaagatttccaataaaagacttttttttaaggcaatatcaacgatttatatatatactcctttttgtgaatttgatcataatattttataggaacatttttgggatctatgacagtatgtttaagtgaaactagaatttaaaaatatgaatcctcggatgatagcttagtacctgtgtgtgtgtattttaagattattagatgtgactttttccttgatctttctatccatgggaatcccaaagccttatatggtcaagacttagcttttagatttctagtgaaatgcaaggcaccactccaaaaaagaaagaaaagaaaaaaaccaactagctgtcttttactctgtcttcagttctgtctttttgcctgactttattaccacagtagttaaattactaagaaccttctgtgcgttggtagtctgtcttagtagagggaggaattccttttgtggcagtagttttatgctacagtgctgttattttaacagaacattatatgctattggttatgtaattttttaaaggaaacttaaaagcagtctcattatgttatgtcactataaaggtagagaggggttagatcttcatgtggtgtaactaggaagtgtaggtttcattgatggtaaatactagggaaggtgaaagcaaaattattacttccttggaatctttctgccatggaactcctgctacctgaatagagggcacaggtgataatgaggtgaacattcaggagcagcagtgataagtgacaaagggatgctaggataacttacttgtactctggtatgttcttatttagctctaagtacagttatctttttgccttgaaggatatgatttttctgagtggtcatgagtatcacttatttatacatttaactccaagatggtttaatagtctgtagaaaatttttagtatcaattacacatttttcatgtaggaaaaaggaaagtgttatttgcctgtttaacaaaagaaaattggaaaaggtttttacaatgtatccattctcctgtagtaagtcagctatgatacagaaaaatttctctgatcacagtgatttacaggtgacaaagtattggcaaactatttcctagtcctactaatgaagctaaatcatacttgtagacaaggtttctttccttcagcatttgattactgtctaatgtgttctagatactgtacatatagtaacaactaagatgggttcttgcttttgagagcctgtttgagagcccgtagtgtagtggaggcagaagggggagaaaagggatgaatgtaaagatagtacatacgagtagataattatacaatttttaaagtatgttaggacaggtatgttataatatcaccgaaaatagtgggaggcagttattcaaccttagctacattaacataggctggagaagacattggaaataaaggcttaaggtgtaaaagactaaattgaggagaaatctgtagggtctaacagtgtgtcatccattactcagggcaccctttatcttcctccagagaagttaaaagtcctaaattactgtagttaattacttttttttttttttttgagacacagtcttgcttttgtcgcccaggctgggagtacagtggcgcaatcttggctcacggcaactccacctcccaggttcaagcagttctcctgcctcagcctcctgaatagctgggattacaggcactcgccaccactcccagctaatttttgtatttttagtagagacggggtttcaccatgttggccaggctggtctcgaactcttaacctcaagtgatccgcccaccttggccttccaaagtactgggattatagggatgagccaccacgcctgacctcaaagagcatttattaacatttgccattcagtagtttcatggaaacagtttggaaatactatgataattttttttttaagtaactttactctcagaagggctccatactgacagttgtttcaggaggcagattaaaaattcaggtgttcttatttctgccctattacttccccttttgacaggatagtgatatgctttgaagaggtgttaaaactttaaatataaaagtactagcatcgaagaaaatgattgaatgaatgaattatgcagcagaaaatttatatttccctcaatgcaaatgtataaaagttgacatttcttttttaaaaaaattattgccatttgccctgtctcctcaaaagtaaatattaaacgaataataatttttattatttattagaataactctggttagactgttgttttgtatagtttttacttgttaatcatgagtactgccacattatcagacaattattattttttggttctcaagttataatttcggattgggcatgtttaagaaatggagggtggtctagtgttattagagctttgaatttgtgcaagtggagagagaggactaagtttaggtaactcttacttgatgacatttaagaagggtgaaaatacaggagaaaagacagatattataagttgcggaagggaacataatgtttggatacacataagcttaagcagtgaagactggtatgaatactttatacattcatcaaaatccaacagtatggccattagttatcactgcatagtagattacccccaaacttaaaataccaaacattagctcacactttctgtgggtcaggaatggatatgacttagctgggtgcttctgactaaaggtttctcatgatattttcctcgagctattggctgggactgccatctcatctgaaggcttgggtagggtagggtggggatctgcttccaagttcacttatgttattggcaggccttgcttccttgccacatgtgtctctcaacatggctgccttccagcatgacatttggcttatcccaggttgtgagtgatccaggagagagcaagagaggagggtgcatgccaagatggaagccatagtctttttataacctaatctcagaagtgacatcttattacttctgtctcattaagtttgtaagaaacaagtcacccagtctaggggaggcagttacacaagtgtgtgactaccatgaggtagtgatcattgccaccttagaggctacctactataagcaaactaatataatatttgtggtattttacattcttcaatttacattgccatgtacttagcagttggttcctatttattatgccttaagagctgcttgttatctccctttctcactattcaacaagatacttgaatcaattttatctttgcttctttcccctctgcccccatctaaatgttcagtgcccctcttattttgtgactttgaagtattaactcctgtttcctcaactccccttatcagtggtcccagaaatgcagagtaacttggttgtctaaaatggaaaatattatttagttaagataaccatataagattttttcaatccttcatcatccccaggatccagaattatatattcttaacttcattttttatttttttaaaaacatatctgaatatagctgaataattactaggttctcagtctctcttatacatatctttgctctttctttctgaaaaggattcaggaatgtagttcccccctgccttccaactttttttttctttccatgtcatgacatgacaaaaaaaatttcccttctcttccaaaacctttcccctttttctcaattggagagagagagaaagagagagagagagtgagtgaatgtgtgtgtgtgtgtgtgtgtgtgtgtgtgtgtgtgtgggtgggtgtgggtgggtggtgtgtgtgtattcttgaggtttctgaagttacctatgtatactggagtaaggagaatttgagattagagagttaatattagaaatttatctatgtgtatgcttatgtctgatggcctatgagtttattgcaggcaaggtttggctctcttttaaaacggttttgagctaggcctccatgctttatgttaaaaagtaagttgttcaattaatgttgattgtccgtaactaaccattgtttaattagaaagcatcttttcagaatctctttatacaaatcctttgatatacttttgttaaaaaggatgcatattacatatgcttattttaattaaaaaatgttagaagactgaagtaacggttcaaatttgggtaaattttcctttacaactagagagagtattttcttaaggatttctttaagatttagaagataggcctgaaaacatttcagtggatatttttgtgtaggataatttttaactacatttcaattttggacttactcaattagttgcttactggggaagatgaggaagtcagcactcatccattttaatcttcatctcattttgttagccatgttactatttctaccttattagagtgtatgatatttaaatcctttctaatttactttgtatgagtttttcaaccgtgcttattttgttgttaaataagatttatcatccacctttgatctcttattttattcaatgttattaagtagcctcaaaatgtagggcattttctttggtttttcaagttatgtcctcttccacactgctgtctctatctgaagttttacatgcttatatactgctatggtctgaatatttctgtcatgcctaaaaattcatatcttggattccttaccccaaggtgtgatggtattagaagatgggacctttgggagatggttaggtcatgagggcagaacccttttaaattgaaattagtgctcttataaaagaggcccaagggagctgcttgcccttccaccatatgaggatacgtatatgagtcaggacgcagaccttcactggacatggaatctgccagtgccttgatcttggacttctgactccaaaattatgaaataaatgtttgctgcttataagtcccccagtttatgatattttaaaaatgacagcagctcaaacaaaccaagacacattaaccccaaccccaccatttctttttaattttttcttcctgtagtatgtgttgttcatagttgctgaattaggttagactacagagggctgatttgtattcaaggattggcaagaaaagtttagaaccagtgcagaattgtatcaaaatagcaagtgaacagtacaaatgttgtaaaccagataaagatacagggatatgggagatattatttcccagtcagtgtctccctacctcatgtgttggtggtcattgtggctcacttggcatgaggaacccagtggggagcagctcagagcctggattttgttgtcttttctatcactaggctggtggagaaagaagcaaagtgagagcccatcagctttctcttctgcatgttactatgtaggccattccttgctgtgacattcatttactagggctctatttcctactcccttatagggccttcagttgaactggacatgttctgtcacaattgccatagtgtttattctgtatctttttagagataatccatatgtgaacaaatacacacacacaaaatatatcacattggtcagagactactcgtgttttacatttgttcttttcactttgcaaaatatccaggaatttgtttcatattagtccataaattagttctttattgatggacatttaaattgtttccagttttacacttaccagaacttagcaaataattctgtacatgtcattttgcacatgtgattgtatctgcagaataaattcctagaatgaaattgcactgtcaagggatatgtgcctttgaattttgatagatagaaccaaattgttttggggtgttattttaccttttgctgctgctgtttagttgtgtagcctattggttaggggtacagatgctgaagccagactgctgggttaaaatcctgaattttgccagttatcatctgttaaatggtagtaatagttctcacttactgggttgttgtgaagattaaatgaattagtatatgtaaactacctggaacagttccatggcacgtataaaagtgctatgtaagtaagggttagtgtttatttaggacatggattctgtaaaatgtggcttcactctgccatttttactaggaagaacttcttataattctattttccattttccccttgcttctatgtaactgcattttatttctttccctcctgcctcttcaagctactgcttctcaaccctctgttgtttcccctttcttaaatactcatgccctctgggttctgatgtagctttctctgatcactttttacacatgctgcttgtgccttgttatttattcctctagctttggttactgtgggtatcagtggttcacaatctaatgtattttacaagttagatgggcaacttctttaaagaggaaatttctgggcaccaccttcagagattttgatttctcctctcccccaaatattggttaagtactttagttaaatccatagcatttatcatagctctttttgttgttgtgtgtttagttacgtgtcttgtgctggactctaagctgtgtgaattcaggtatctggtctgtatacttcaccattgtattcctaccagccagcatagtgtctggctgtagcagacactcagtaaataattgttgaattattaatctgttctctttatggcccacttgttttgctgaacactgtttcatcaagaaacaattagttaacaactatgtgtattaactatgttaatgttttgttttggaagactgtaacaattttatgtccttactgtagagatgtttttgggaaataactcagtgactttaagaggttaatgacttaaagtgttaattaacgctttggtgtgtagtcttccaggcttttcattagacattgcaacagcaagaattgtgtcatattatgagtattcttttgtaacttgttttttaagtaaatagtaagtagaagcttttgtttccctgaaactaaaattttcgcattagtatatttattgagtgtatttattgattaaacccctctagctgagtttgtgaaccacatctgataaacgatagaattcagcaaggaaacctttctctgtatctgccttccaccctgtctccagagtgcagacagtaatgagacctgcataacatttattttctccaaaaagttttcttataacttatttccattcacatattgagttttcctttatttcgctatatcgctgttaaatttcatagcatttttctacttacttgcttatctttttttcttaattgggcatcctgtggacaagattgtttattttagttcatcaacaaaaatttattgaaatagcactgtcaggaattatggaatgtgtaaggcagtttctattcttaaggaactataatctagccaggagaagagtggaaatacataaaatactaataaagtcagcatgtcttacacagtacttaatacagttttatgtatacatacacacagtaggtcataaatgcctacttatttaagaaattagtattttggttcactacatatgtattatgtatttgctgtatgctaggcattgtgcacaaaggaaacaggaaaatatgccctctagtgttggtctttgtatctaccaaaatgaatgacttactgcattacgttatatgtggtaggcagtcagtaaaaattattcatgaaagaatgaccctgaagttcaatttattttgtatccctaatgactaaactccagaagaaattctgtgcccttactaagtccccaaataaaagtgttggcttctaaaaatctaggttcaatgtactactttatagatttttatcagtaaaggaaataacagagctatgtaacaagaatagataaagagcatattttaatctttggatatttgtggtttctagtttttggcattctcattcaaatatatagtatttgttgaatgaatatttatacagtaattaaattactttttctttagaaacttttgtgggttttttgtcttgaattgttttcgtcagatttttttatatcctgtatttgctatgtctagttcattcagtcaacaaatatatattgtgatctctctttgtcagacactgttcttctataattactcttagatactatatataagcctcaacttttgtttgtccaaatgaagagttccctatggtctagccattgtgtatgttttggatttcttgttctagtcatcttgtcatttgaatctcatttgaatatttaattattgtgtggatagatttctgtttttacatctagattttcacacctgaggtagtagaaaggtgagaaaaggtcaatttaaatgcaatgctggactctttgttttcataactaaatatagacggcctcctaaaattgtacttgcttttcatttgccagtattctaatgcaagagctaggtttttcttttttattatttagtataggagtactgcttggagtttttctttgtctttcttgtgtaaaccacacccataattcctcctttgaaatgtcccacttcagttttctttaaaatagaacaaaaacattgcttggacagtatccaattcagttcctctttaaacatactgacatttatgtcgccctgaatgcttggggcatgaaatattttctagtatatacacacaatttctgcttgtaccagttgagcttgtcgtaagagtcataaagaattgtttctgtttggctgaatgtggtggctcacacctgtaatgccagcactttgggaggccaaagcaagaggattgcttgaggccaggagttctagaccagcctgggcaacatagtgagacactatctctaacaaaaaacaaacaaaaaaggaattgtttctgtgaagaggaaattgactaagagaacttctgtattcaaagtaattcaaactaatttgcctattacctatcaataattagctgttcctaatgattaggcacaaattgcaagcatttcgggtaatggactataatttcattttcacctaaattgttataattacatttatacaactcttttcttttgctttgctcttctgaatcatatataaacttatgaatgagtttgcagaaaagtttgtttgaaggatgtttgtaatccctaagattttcttagggcatcttttaaaacttaaccatcctcttagaaacttttggcaggtgggactcttacctgccacctgccaccaaaagtggcactaaaaggaatatttgacaattctttgccatttaactgtttcataatttatagtgggataaaaatgcattctagaataataatataaaaaggagaaaataatttaaatggggaagaattagcatggactatataaacaatagtgtttaactttttgacaggtactactttatgcgctgtatatattcatatatttctcatagtaaacttttgaggtagtgggttctattattatcctcattttcaggaggagactgtggcacacaagatgggagtttacccaagaacacccaaccagtaaatggcagaactggattaattccagacagtctggctctagagtttgtacttttaacaaaaataatttcaagaaaaggaatataacaatgttagaatttatttcaaatgctacttgttttgtgatggcaagtttactcaatttaattatgtttgtttaaacatacttgttctattttaggaatgaaatttaatgttttttcaagctacacatctcaagatctgtctttaagtcatggactctgtctgctttgagcattgtataaacaccttgttaactctttgttagcaggcttctcaattttttccttatgaacatgtgtggaacaataaaaactaaagttttatgtacttgaatcagtttacaactcaagttgacaaagctgcctgtacgtggaattaaatgacaaaactgtcttcacacagccatttattattggtaattgttctgcatttacattcaagaaaaacttgaaggtaaaccatgtcagataagattttgaaagtgtatttgagccgttctgcttctttccttatatggttcagtaaactgaccaaatttagtcagaaatttaagtcagcaagtcttgtttttcttaatgtgctacatgtgttagcttttgattctcctagcaacaatatttttatgggcatgctttgccagtttcttgtatgtactttataaatgttgaggacaacagtttgaacaatttacaccactaatttgagattgatatatgatatatattttgcggcaatgcttttagcatttaatttatattaaaatatttcaaaaacatttataaacaaaagaacaagcagatttaacattaattgcttttggtattggtattttgttggtgtttcttatgtcgacttaaaagtatatacatttaaaatcaaaattagcagtgtttcatttattggagaatagctatttctgtgtgttaatgtctttcaaagagccagtgtaatcaccttcttcaaatggagaaactttaaaaattaccaatttgtcatgaaagtcttttatcttaagtgtcaaaggattactcaaaagatggcagataagaccctattctggatcttgcttacctcaccgtatttggctttgcgtctttatataccagacctgtttttcacttgttcttatgttaaactcaaatatatgaatcacctccaggaaatattccctgacgaccaccattccttcttagttctccttttctcagctctcataaaaaccagtggacgtgtctgaaattgtcttaccatattccttttgatataatcatctatttttgtatttgtcttctgtactagatggtgtcttgaactttctatttctagctgtttactgactaaggtatcacaaatgtctgttttccaagcacaatatcctgatcataatttaatcttacccctttccttactgttttcaaaatcacttctctacactctttccctgaatgatttcaagtcccattgttttattacctcaatgcagataattcccaaattgacattttcttcccacatttattttcacagctccagatctatatggttagataggtgtacagacacctataaattcagcatatccaaaacaaataaaattgtcatctttcttttcccagtctgctgcttgaatctgtggtgtttatcttcatgaatgtcttcttcctgcatcttaactcttcatatctttcattaaaccttgaacatttcctcctaagcttccttaatacagtttcatgagtacaggcataccttagagatactgtgggtttggttccagactaccacaaaaaagtgagtcacacaattttttttggtttctcagtgcatataaaagttgtgtttatgctataccgtagtctattaaatgtaatgtagcattatatctttaaaaaatcataatgctgtagtacataccttaatttaaaaatgctttattgctaaaaacaaatgctagtgattatatgagccttcagccagtcatagtctttttgctggtggagggttttttttgttttgttttgtttgtttttgttttgacggagtcttgctctgtcgccgaggctggagtgcagtggcacaatcttggctcactgtaaactccacctcccagattcaagcaattctcctgcctccacctcccgagtagctgggattataggtgcgtgccaccacacccaactcatttttgtatttttagtagagatggggtttcaccatgttggtcaggctggtcccatactcctgacctcatgatcctcccgcctcggcctcccaaagtgctaggattacaggcatgagccaccgcgcctggcctagtggagggtcttgacttgatgttggctgctgattaatcagggcagtggttgctgaaggttggagtgactgtgacagtttcataaaataagacaagtttccctcatcaactgactcttcctctcatgaaagatttctctgtagtatatgatgctgtttgatagcattttacccccagtagaacttctttcagaattggagtcgatcctctcagaccctgccactgtatcaaccaagtttatgtcattttctaaaccttttattgctatttcaacaatgttcacagcatcttcaccaggagtagattccctctcaagaaaccacttgctttgcttgtccatgagaaataactcctcatctattcaagttttaatcatgagattgcagcaattcagtcacatcctcaggctccacttctaattcttgttctcttgccgtttataccacatctgcagttacttccttcactgaagtcttgaatccctcaaagtccatgagggttggaatcaactttcaaactcccattaatgttgatattttgacctccttccatgaatcaccaatgttcttaatagcatgtagaatagtgaattctttccaaaaggttttcaatttactttgcccagatccatcagaggaatcactatctgtggcaactaactatagcattacaaaatgtattttttaaatacgaagacatgaaagtggagattactccttgagctgcagaatggatgttttgttagcaggcatgaaaacaacattaatcctgtacatctcccatcagaccccttgggtgaccaggttcattgttgttagcagcaatattttgaaaggaatctttttttctgagcaataggtctcaatagtgggcttaaaatacttagtaaaccatgctgtaaacagatgtgctgccatccaggctttgttgttccatttatagagcactggcagagtagatttagtgtaattcataagggacctaggatttttggaatgggtaatgagcactggcttcaaacttaaggtcaccagctgcattagcccctgaaaagagattcaaactgtccgtggaaactttgaagccaggcattgatttctcctctcaagctataaaagtgctacatgtcatcttcttccagtagaaggttgccgtgtctacagtgaaacgctattgtttagttgtagccaccttcatcagtgattttagctgcatctggaagatgcagcttctccatcagcacttgctgcttcaccttgcacttgtatgatatggagattgcttcttaccttaaacctcatgaatcaacttcctgttagcttcagacttttcttctccagcttcctcacctctcttgggcttcatagaattgaagagagctggggccttactctctattaggctttggcttaagggaatgttgcagctagtttgacctgtccaggtcactaacactttctccatgtctgcagtaaggctgctttgctttcttaccatttgtgtgttcactggagtagcacttttaatttccttcaagaacttttcctttgcattaacaacttggctgtttggcacaagaggcctagcttttggcctacctcagcatacctttctcaccaagcttaatcatttctagcttttaatttaaaatgagagacacatgactcttcctttcacttgagtacttagaggtgattgtagggttattcattggtctaattttaatattgttatttctaagggaatagggaggcctcaggaaagggagagagatggggaactgccggtttgtggagtggtcagagcatatatataacatttatcaattaagttcaccatcttctatgaatatggttcatggcgccccaaaacaattgaaatagtaacatcacagatcactgatcacaaatcaccataacagatctagtaataatgaaaaaatttaaaatattgtgcaaattaccaaaatgtgacacagacatgaggtaagcacatgtttagaaaagtggcaccaatacacttgcctgacacggggttgccacaaaccttcaaattttaaacaaacaaacaaaaaaatgcagtatccatgaggcacagtaaaactaggtatgccgatatcggtggttgtttagctcaggccctttcctcttcttattgcttctgtgacctttctgaaatactgatctgatcacgtcacccttcttcctaaaaactctaaataagctttttcaagcatcatcttgaaattctaaagtgtttttttctactttctcctactacttacttgagccaccgttactgatgggaacatagcagattctgttcgtctgttgaggtaaaaagaggttgaaaatcatctgtagtacaactacagtctttgcattatattcagatcttttaccacttagccttatcctgttttataacttacagatactgtctaccactggttgactgactgtttgtttattccatgaacttttaaaatcagcagtgtctgtgctcagtgaggttcttgccagttgatttggtacttgaactcttatataatcttcaaaattatgctcaaatatgtagggacccgtatggaccctcttagtcacaaaaagatctctttatgtcctccgtgatattttagtactttctacccactgctattatggcccttatgtgatcattgttatttatggactatccaactatattttaatgtgatctttttcatacgatcttggcatatatactttttagtatatataatatgaaaaatagctaaaggaattagtgatatttagccgtaaacagagaatatgctagaattcttggggaaaaaaatgttttcagagtatttagaggttatcagttaaaagaaggattgcatttggtatgtggagcttgaggaggcaaggcatggaagttaaaggaatacatattttaagtgatacatagtagtctcaaatggtagcctgcttttttttttttaactttttaacttgaggtataatttacattggtaaagtatacaactcttaagtatacaattcagtgaaatttcacatatgtatatctctatgtaaaaatcaccccgacaaagatagggacatttccaactgtccggaaagcccccttgtgtccctcctgtcattctcccacagatttaaccctggttctgagtcttatcaccagatcttattttatctggagacctgcagtatgtatccttttgtacctgccttctttactcatttatgtatttcattcatgttgttgaagatagcagtattttgttctttttgttcaatgttcttttcttttttaatcagtttataggattctgttatgtgaataggatctccctttctacacctcaccccaccctgtgtatttatgcattccacataactttagtagatgctattagatagttttctgaagtggttgtgtgaatttcatactttcaccagcaatttggttgttttcttttttttttgagacagtcttgctctgttgctcaggcttggagctcagtagcgtgatcttggctcactgcaacctccgcctcccaggttcaagcgattctcatgcttcagcctctcaagtagcatgtgccaccgtgcctggctaatttttgtatttttagtagagacggggttttgccgtgttggccaggctggtcttgaactcctgacctcaagtgatctgcctacctcagcctcccaaggtgttgggattataggcatgagctgccacacccagccttggttgtttttccacattaccgtttaatgctttttatgtaagaaagaacttcttgaattttttacttgaaacactattcattgtagacattttgaaaataaaggaaaaattaaggaagaaaataaaagtgggtctcacaaccattatttttaaccttcaggatgcattcttttagtcttgtgtgaatttttttagtaaagttgatgttttggctgtgttcccacccaactctcatcttgaattgtagttcccataatccccatgtgttgtgggagggacccagtgggaggtaattgaatgaatcatgggggcagttacccccatgctgctgttctcatgatagtgagtgagttctcacaagatctgatggttttataagggacttttcctgttttgctcggcgcttctccttgccaccgccatgtgaaggaggaggtgtttgcttctccttccaccatgatggtaagtttcctgaggccaccccagctgtgtggaactgtgagtcaaacctctttcctttataaattactcagtctctggtatgtctttattagcagcataagaacggactaatataaaactttaaatcatattaggcattaaaaaatacattgtgtgttttctcctatattcttttatccttttccatttccatatttgcatcctttttaaaaaaaacttgctataccaccttgaaaacacctgatctcatctaatctaggaagctaagcagggttggatctggttagtacttgaatgggagactactaggaataccagttgcatttggtatgtggaacttcaggaggcaagacatagaagttaaaggaataggtattttaagtgatacatagtagtctcaaatggtagcctgttttttttttttaactttttaacttgaggtataatttacattggtaaagtatacaactcttaagtatacaattaagtgaaatttcacttatgtatatccctatctaaaaatcaccccagcaaagatttgtagttttgtagtgttgtaggcttaaaaaacaaaacaaacaaaaaaaaaaccttcttaatatattgtgggcatttccccatattcttttataaagaatcatttcttatttgcttgttgatatttttcggtttaaaagaataatcatatttgtattacatataattatcaagtagggttttatattcttatactgaggataaaattcaggatacagttttggagcctatgggatttaaaagaggttgagaaaaaaaggtgaacagaatttaatgagtatcagccgggtgtggtggctcacacctgtgatcccagcactttgagaagccaaggtgagtggatcacttgaggtcaggagtttgagaccagccgggccagcatgttgaaaccccatttctactaaaaatacaagaattagccaggcatggtggcacacacctgtagttccagctacctaggaggctgatgcaagaggatcggttgaacccgggaggcggaggttgcattgagccgagattgtgctgctgcactccagtgtgggcgacagagcaagactctgtctgaaaagagaaagaatttaatcagtatgatttctcaaggaaagtgaatgattatgcaagtcacagtaagtcactctcttatctcagcattctataaactactttctaatacaatacactttttatgtttcttcgtcattaaatagctgtgattctcaaacctctttcttttaaccactgccctgtgaaaaatagttttcttgagcaatatctgtatcaacgttgcctatgtattcttttatcatctgttatatgtaagatatgttctaggcactttggaaaactgccgtcagcttgcttataacttgttctagagggaagatacataataattttaaatatggtagggaatttttatgataaataccccctcacacttcttccctccacttgaaatataaagacaccaacgtccaaaaagattaaattacttgttcacagccacaaaatttgtggcagagccagaactagaacctaaaaccaaaagctgtgattccctctcaatgcttttaccctttttttttctgagatggagtcttgctctgttgcccaggctggagtgcagtggcatgatctcggctcattgcaacctctgcctcccggggtcaagcggttctcctgtctcagtctcccgagtagctgggactacaggtgtgtgccaccatgcgtggctagttttttgtatttttagtagagacagggtttcaccatgtttcccaggatggtcttgatctgctgatctcatgatccacctgcctcagcctcccgctttaaaactttttgggtacactgtatagtgcttttcttgatagaaactttgtcattttcttccttagggaaatgctgctaaaagcatttcttttgtttctatggtagttaaggaaaatttatttcatgtatacaagtaatacttagcccctagaatgcgtgatatcctgttgcaggtgagaaatgtgttgataaactaggaacatctgtggaaagcagtgtgttaagtgtagaaaaagcttagtttctggaacctgagcatctctgtgagattcccagccctatcatttcctgtctgtgtgacttattcaagctacttaatctctttgaatcttagcttcctcctacattcattaattcatttattgagcccaagaactcaaggtattgtggaagcagccgaattctgcatgtcaagaactgtgcatggtattgaggatgcagcagaattcctgctctcagtaaacgctcattctgggagtgggtaaacagatggtaaataagtaagcaaagtatatatagtatgttgtaataaacggtatggagaaaaataaagtagatactcaggatataaaatggtagggagggggttgtaattttagtatgctgtccaagaaaggcaataccaaaaaggtgagagttgagcaaagacttcatttatgaaatgtggatacagtcatatcttatttatgcattgcttgtgtataatgctgatccattatctctcatcagccagccccaaactgctctttcttaggttgaagtggcatttaagaagctcttttgttttctccaagagttacagtctgacattaatatccttttttgttgttgttgatgtgttttcagtcctagaaaatagttttttttcccaaatatgaacaaacaggaacttcctttggtggttaagtactgtcttggtgtttaagcctcttttaaggggatgggtagataaaggtaatggtctatgtgtagcaaaatgtattagaaccactttttaaatggcacatcaatttttattactttcaacagctacttcaaatatccttccggattcttaataaacttgggctttttatacatttaaatgggtagcacatgaattttccaacaaagatcttttggcaataaaccaaagatgacagtgtgtaaattaatatgtctactgatcagtttattagaaacacttttagagtacagagataatagtcatcagcccacatactcctagttgtgtattagttgtttatcatagataggaaataggagctaattagttcatttactgggttttacccacattagaaaaaaagaggccacttgccctctgggcaaatagtggctttgtgtgaattaggacggaaaaaacctttcaccaagttaaaggctccttgagtggatttcatcccaccttcccaatcccccaagtcaaatacatggcacagactttacattcttgggcaggggtcctggtaatacatggggattgcatctcaggagggacaatatgatgatgattatgaatagtgccaattccagaaagcctccccagggtaaatggagtgtgtttatgaatacaacctatctcataggacaggtataaagtacttatattcacatacagatatatccctaatctgaaaattatggagtttacaatctagtagaggtagaacataggtataaataagaaaattgtggctattgatattattgataatgtgatagagtactaggaattacttgaaaaggatgactaggagggccttcctgaagaagaaacatctgcattgagatttgtttaatgagaaggaatcagcatgcttagatctgggggcagagcattcctgacagtgagaactgcaagaacaaaggctctgaggtatctggtcaaggaatagtaaggtccctattgtggctggaacagagtgattttaggaacaattgtggggaacaatgagtaccttggagtgggtttttgtgagaataatgtatgtaaatcatagataaagcacctttcatactacctggcacaaagcaagcatttgataaaagttcccttcttatttactttagggctgtagttctcaaattttttttttattttaggacttctttatattcttaagaattactgaagattccaatgagcttttgtttctgcaggttatatgtattaatatttatagtcttagagtttaaaaccagggatttaaaatacaattaattcatttaaaaataacaatgatttacccctgttaccaaatgacattttttaattaaaataactaattcattttttcttggttgtatgtattaatatttacagtcttagagtttaaaactgaggatttaaaacactatttaaaaataatagcgatttacccatgttaccaaataacattttttaattaaaataactaattcattttttcttgaaagtttatcattggcaacaaatatactgttaattgcttttcttttttttttttttggagacggagtcttgctctgttgcccatgctggagggcaatggtgcaatcttggctcactgcaacgtctgcctcctgggttcaggcaattctcctgcctcagcctcccgagtagctgggactaggcgtgctccaccatgcctggctaatttttgtacttttaatagagaaggggtttcaccatgttggccaggatggtctcgaactcctgacctcaggtgatctgcccgcctcggcctcccaaagtgctgggattacaggcgtgagccaccgcgcctggcgttaattgcttttcttgaagtgacagactcattttgttcatttgcaagaaaagatctcccaaaaatcaaagttagactaactgtagtttgtcatttaagtagacataatgttgcatggaaaagtggctaagtcagcttgcatctcaatgtcacaagtgcttttcatcaagacaaccatcatacttggaagaggtgctttaacatacacttcccatcttgttccagagaatataaaaaagacctgtatacaagggccaagatttaatatgtaccgctttgtcaaagacatatatgagtgaaaattgctgccccctaaccaccactttttttggagacagggtctcactctgttgcccaggttggagtgcagtggtgtgatcatagttcattgcagccttgaactcaaactcaagcgatcctcctgcctcagcctctcaagtagatgggattacaagcatgagccactgtgcttagcaatgtttttttttttttttttttaaattatgagtacaaagtggttgaaacagtgactgttaatagaggtggggtttttttggccactgccattatttgtgctaaaacacatgcagttttacagctggtacttttataccatcacgtgtacatgtcaacaaagtaaaaaagggaaatgacatcttagttttttcttgaaaacagttttgccctaatcaactccctaaaggaatctactcccccttcccccagcagacaacatttttgggaaccactgctatagagactattgttagtacttaattataatgtcttcattttaataggtacttgttatccagattgggttgccataaagagtctaggcacatacactactgttgtatgtgtacctaagcaaggacccttaacaatttagtgtcattagcatgtttgatggagtatagtcaagatagcagcagatttatttacagagaatatttatattataaaagctacaaagtaggaattttattctattgatgtattatttggagtgttaattcgtattttttccaatcttgctttctgttttgtttttaggcttgcattgatgacaatgttgatatggtgaagtttctggtagaaaatggagcaaatattaatcaacctgataatgaaggctggataccactacatgcagcagcttcctgtggatatcttgatattgcagagtaagccagttctgtgttttcattttattctaatactgtttgacagacctgaatgtttattgaagtgataaagataaatgagtgaactcttatattactttaattcatgaaaattattctttccaagaaagaaaataagtggttattgggaatccatatattctcagaatcagatcttctttttgtctccccaccctctttggcctttggtacttcgtattaacattagtaattgtacacattctctgtctccatcttttttcttttgagtacagctagagcattttcaaatgattgagggttaatacttagcagtctaactcattcctttataatcataaatttggcaactgggttacattgctatagggagaatatgatacatagttctccagtgagcctgtttacttagtttttctgaagattgtcttttttaaaaaatacattttttagaaaattcaatgagaaatagtcattgtattctctactacctttaatgtgtgggtacacactaagaacatctgattttttaaagcatttaacagtggaagtatagatatcttgaaaaataattttttcattaaattatttttcttattactatctatccacacagtaaacagttttgttgtctctctgctcatatatgaaagcttatcaatgaataaatattgaatatgggaattctactctgtaaatatcttagtaagccttcatagttttttgtctacattttgctttttttccccatttgtgctggagatacaatatctcaatttcaaggcagaaactgtatggtgaaatgaaaagtgctccggcctgggaacgataaggtctgaattacccgaattttattactgactctgccactaactatacgacatctttccataatttgtttcctctttctgagccatgatttctttgtatataaactgaggaagtctttttcccgttgcaaaacagcagtggttgttcaaacctaacaattgtgattctcaagttctttacttcctttttgtacttttcccgctcaatctcgagttctttacttcctttttggacttttcctgctcaacagaagacttagatctcttcatagaaaaaaaaacccagataattgtgcatttatctttaactacacttaatgattaggctctggagttaattgatatggaatatgaatgcctcctcagtcactatcaaggagtataaccttggcaagttgtttaacttttctaggctttggttttctcttctataaagtagtatttcctaggtttgttgtgatgattaactgcagtaattcatcaaacgtaggacctggctcataggaaatagtacatattaacttttgaccattaccttttgtatctacactgggaaaattaaaactcaacctctttcttcagatgtttaattcttatgtttcctttttgtattcatgtttctgagtttgaaaagacaatattaattgtcttgaataatttctttgcatagacttgattgggtcacagacctattgtgtcagttggaatgcttttagctgcaagtgatagaatacccaatttaaaatgacctaaagaataatggtacttgttatacaggataaaatatcatttagaggaaggacatttaggcttattaagccactcagtgatgtcagcaaggacctggaatctttcagttttttcttctgaatttcccaaaaatggactttattcttagccttctcccctcttggttacaagatgattgccacaactctagaattgtgttttacatatccacatccaaaagcaaataaaaaaaaaatggattgcaagtagaaaatatcctccctgtattctgtgtacatcaaagaggaaaacctttcccagagagccctccagttgctgaagacatcccataatgggacttcttttggcctggtcttggtcatttgtccatgttgtagctaggaaaagtaaatatcttggcatattcagcttttacatgctagtatataagaagtatgaggaagggtaagcagtttgttgcagttgctaatgttatcagtagggtgactattttcagtttttggagggtgggatatggaatatatgctttacaggacttgtgcaaacaaaagtgaccttttttggccaaggttgactatagttgctaatctaattagtttgaatttatgactgtgctataaactatggagtttccttgaaccagattaaaattagaagaataagttttcctttttattctttctgccacaagattcttttttaaaataatgactgtttttataaaaggcagtttaactctagcatatactggatgatttgttaaggtgatgatagcccaaaatccttccgaatgctcatttttatcagcataatctcttttagcaggttgggcatggtggctcatgcctgtaatcccagcagtttgggaggccttgcttgagctcaggagttcgagaccagcctgggcaacatgacaaaaccccatgtctgcaaaacatacaaaaaaattagccagttacaatgatgtgtcccagctactctggaggctaaggcaggagaatttctggaggctaaggcaggagaattgcttgagcctgggaggcagaggttgcagtgagctgagatagcaccattgcacttaagcctaggtgacaagagtgaaaccttgtttcaaaaaaagaaaaaaatacattaaaaacacctctttcagcagttaatttcactaatgattaagtgaaattaatgaaaccctagttttcttgggtatagaaaaataatagtctggtggcctaattgatagggtgaagatagtccacagatcagtgttttataggcatgaaagaaagcacttataataataataataataataataataataatagagacaatagttataacccagggggtaagaaactggggcatatggtcactgtggtaactgaagtattttggagttaaatttgttgcaaatcctagttctgccattcactagctttgtgtgcttgaccaatctacttagtctcagtaatttaagattatttataaaattggaaagatctagtttcttcctaagtcttttttctcatattgcattccacttcacatttttcactctgtcaatactggactacttttagttccccaacattccctactggtttacatcagtgtgcctttcttcgtaatagtttatttgcctgctgttgcattacttgagcagcttctaccagactctcaagatgcagtttgtataagggtcatttcttccaggaagagtttctgatgttcttggcaaattcatcatcatctctaacacatcagttgtttgtgtatatgcttctttactaactgcatttatgcactgaatagtagtaattcatccctattgatatgtgcagttaagcctagattagtttactctgaggatttgaggatgattaggatacattgagttctaaatttttaacctctgttggaaatagtagaacaaagaatgtcagattacagtatcatttctaggcatttaacaattttacatttggtctgtagcgtaatagaagccaagtgaataggtagatgaatgatggctcttcatacactggctcaattatctcaccttttcaccaaaataattaccctcaacttttgcttattcttaacaaggtagaagtcctagggtaaactaaaaatagaggttgtttagtaatgtcctttctccagaatggaatggaggacaaataaatgaagtgagtttgtggagcctgattttatgctcagcatatgcattgttttaataaatactcactgccttgactttttcattcttaagaatgttactactttgattaacatgttttaaaaattatgcagtcaataaatatgtaagcacttactatatatatcaggtcaggtactaaaatgtatgcattaacatcattcttttcctttggggtgctgaatcagtattatgggcagaatagtgtcacccaaaattcttacttgaaaccctaaccttcagtacttcagaatgtgactctatttggagaagcggcctctaaagggatgattaagttaaaatgaggctgatggagttgtttctcatccagtctggctggttttcttataagaggaagacattgggacaaaaaagagacaccagggcccctctcatagacaggaaagaaaccatgtgaagaaacaagaaggcagccatctaccaaccaaggagagaggcctatgaagaaaccaaagctgctaacacattgatcttggacttctaggcaccagaactgtgagaaaataatatttctattgtttaagccacccagtgtgtggcattttattatggtagtcctagcaaactaatataagcagtataaactttccactatcacatcaaggcatactcttccttaaaaattacagtgttaatgtcattggctatggatcaaaaatgaaatggaacagtatgactttggacatactagaaaaggcaaatgattttagagcccaagaacccatgtatgcaatttattgttccaatcttgaattatcaattcattatacatctgtggcataaattataattgaattactgtgtgcaaagcattgaaaaccaagttctctgactgaagaaataattagatgaaaacataggaactatacaatggtaacattttaattgtcattcttttttatttattagttggaatatttttgtaaaagaaactttctcatctctactatttggttaccctttgtattagtccattctcacgctgttgtaaaaaactgctcaagactgggtaatttataaaggaacaagatttaattgactcacagttccacagggctggggaggcctcaggaaacttacaatcatggtggaaggggaagcaaacacattcttcttcacatggcggcaggaagaagtgccaagcaaaggggggaaagccctttataaaatcatcagatctcatgagaactcactcactgtcacaagaacagaagcataggggtaaccacccccaggattcaattacctccctctgggttcctcctacaacacgtggcgattatggaaactacaattcaagatgagatttgggtaaggacacagccaaaccatattacctcagtacaatttttataggggagacagaatatattctttattatttctccttatgtactggctttttaaataatgaatttccttgctatctaccttcagtagggactaatttttttttttctagtttaagtaatattaggagctcatgcatttgaacatattttctattttattttatttgtattatacttttaagttctgggttacatgtgcagaacgtacagttttgttacataggaatacagatgccatgatggtgtgccacacccatcaacccatcacctacattgggtatttctcctaatgttatccttcccctgaccccccaccccccacagaccctggtgtgtgatgttcccatccctgtgtccatgtgttcttattgttcaattcccacttatgagtgagaacatgcggtgtttggttttctgatcttgtgatagtttgctgagaatggtagtttccagcttcatccatgtccctgaaaggacatgaactcatccttttttatggctgcacaatattccatggtgtatatgtgccacgtttgcttaacccagtctgtcattgatgggcattttggttggttgcaagtgtttttctattgtgaatagtgctgcaataaacatatgtgtacctgtgtctttattgcaggatgatttataatcctttgggtatctacccagtaatgagattgctgggttaaatgatatttctggttctagatccttgcggaatcgccacactgtcttccataatggttgaactaatttacactcccaccaacagtgtaaaagcattcctgtttttccacaacctctccagcatctgttgtttcctaactttttaatgatcgccattctaactggcgtgagatggtatctcattgtggttttgatttgcatttctctaatgaccagtgatgatgagcattttttcatatgtctgttggctgcataaatgtcttcttttgagaagtggctgttcatatcctttgcccattttttgatggggttgtttgcttttttcttgtaaatttaagttctttgtagattctgggtattagccctttgtcagatggatagattgcaaaaattttctccgattctgtaggttgtctgtttactctgatgatagtttcttttgctgtgcagaatatctttagttgaattagatcccatttgtcaattttggcttttgttgccattgcttttggtgttttagtcatgaagtctttgcccatgcctatgtcctgaatggtattgcccaggttttcttctagaattttaatggtttttaggtcttacgtttaagtctttgatccatcttgagttgatttttgtataagttgtaaagaagtggtctagtttcagttttctgcatatggctagccagttttcccaacaccatttattaaatagggaatctttttccccattgcttgtgtgtgtcaggtttgtcaaagatcagatgttgatagatgtgtggtgttatttctgaggcctctgttctgttccattggtctgtatatctgttttggtaccagtaccatgctgttttggttactgtagccttctagtaaagtttggaagtcaggtagtgtgatgcttccagctttgttcttcttgcccaggattgtcttggctatgccggctcttttttggttccatatgaagtttaaagtagttttttccaattctgtgaagaaactcagtggtagcttgatgggggtagcattgaatctataagttactttgggtagtaaggccattttcacgatattgattctttctgtccatgagcatggaatgtttttccatttgtttgtgtcctctcttatttccttgagcagtggtttgtagttctccttgaagaggtccttcacatcgcttataagttgtattcctaggtgttttattctcttagtagcaattgtgaatgggagttcactcatgatctggctctctgtttgtctgttttggtgtatagggatgcttgtgatttttgtacattgattttgtatcctgagaatttgctgaagttgcttatcagtttaaggagatttggggctgagacgatggggttttgtaaatatacaatcttatcatctgtaaacagagacaatttgacttcctctcttcctatttgaatacgttttattgctttctcttgcctgattgccctggccagaacttccaatactatgttgaaaaggagtgacgagagaggggatccttgtcttgtggcggttttcaaatggaatgcttccagtttttgcccattcaatacgatattggctgtgggtttgtcataaatagcttttattattttgagatacgttccatcgatacctagtttattgagagtttttagcatgaaaggctgttgaattttatcgaaggccttttctgcatctgttgagataatcatgtggtttttgttgttggttctgtttatgtgatggattacgtttattaatttgcgtatgttgaaccagccttgcatcccagggctgaagccgacttgatcgtggtggataagctttttgacgtgctgctgaattcggtttgccaggattttattgaggattttcacatcgatgttcatcaggaatattggcctaaaattctctttttttgttgtgtctctgccaggctttggtatcaagatgattctggcctcataaaatgagttagggaggattgcctctttttctgttgatcagaatagtttcagaaggaatggtaccagctcttctttgtacctctggtagaattcggctgtgaatccatctggtcctggactttttttggttggtaggctattattgcctcaatttcagaacctgttattgtcctgttcagagatttaacttcttcctagtttaatcttggaagggtgtatgtgtcgaggaatttatccatttcttctagattttctagtttatttgcatagaagtgtttatagtattctctgatggtagtttgtatttctatgggattggtggtgatgaccacttcatcattttttattgtgtctattggattcttctctctttattagtcttgctagctgtctatctattttgttgatcttttcaaaaagccattgatttttttgaagggttttttttctgtctctgtcttcttcagttctgctctgatcttagttattgcttgtcttctgctagcttttgaatttgtttgctcttgtttctctagttcttttaattgtgatattagggtgtcagttttagatcactcctgctttctcttgtgggcatttagtgctataaatttccctgtatacactgctttaaatgtgtcctagagattctggtacgttgtgtctttgttttcattggtttcaaagaacatctttatctctgccttcatttcgttatttacccagtagttactcaggagcaggttgttcagtttccatgtagttgtgtggttttgagtgagtttcttaatcctgagttctaatttgattgcactgtggtctgagagacagtttgttgtgatttctgttcttttacatttgctgagaagtgttttacttccaattatgtggtcagttttagaataagggccatgtggtgctgagaagaatgtatattctgatgatttggggtggagagttctgtagatgtctattcggtcttcttggtccagagctgagttcaagtcctggatatccttgttaattttctgtctcgttgatccatttaatattgacagtggggtattaaagtctcccactattattgtgtggaagtctaagtctcttcgtaggtctctaagaacttgctttatgtatctgggtgctcctgtattgggtgcatacatatttaagatagttagctcttcttgttgaattgatccctttaccattatgtaatggccttctttgtctcttttgatctttgttggtttaaagtctgttttatcagagaccaggattgcaacccctgctctttttttttttttttttttttttttttgctttcaatttgcttggtagatcttcctccatccctctattttgagcctatatgtgtctttgcacatgagatgggtctcctgaatacagcacactgattggtcttgagtctttatccaatttgccagtctgtgtcctttaagtggggcatttagcccatttacatttaaggttaatattgttaggtgtgaattcgatcctgtcattatgatgccagctggttattttgcccattaattgatgcagtttcttcatagtgtcgatggtatttacaatttggcatgtttttgcagtggctggtaccagttgtacctttccatgtttagtgcttccttcaggagctcttgtaaggcagacatggtggtgacaaaatctctcagcatttgcttgtctgtaaaggattttatttctccttcacttatgaagcttagtttggctggatatgaaattctgggttgaaaattcttttctttaagaatgttgaatatcggcccccactctcttctggcttctagggtttctgccaagagatctgctgttagtctgatggttaccctttgtgggtaacccagcctttctctctggctgcccttaacattttttccttcatttcaactttggtgaacctgacaattgtgtgtcttggggttgctcttctcgaggagtatctttgtggtgttctctgtatttcctgaatttgaatgttggcctgccttgctaggttggggaagttctcctggataatatcctgcagagtgttttccaacttggttccattctccccgtcactttcaggtataccaatcaaacattgatttcgttttttcacatagtcccatatttcttggaggctttattcatttctttttactgttttttctctaaacttctctttttcctttatttcattaatttgatcttccatcactgatatcatttcttctgcctgatcgaattggctattgaagcttgtgtatgcttcatgaagttctcgtactgtggttttcagctccatcaggtcatttagctcttctctacactggttattctagctagtcatttgtctaaccttttttcaaggtttttagctttcttgctatgggttagaacatgctcttttagctcggagaagtttgttattaccgaccttctgaagctgacttctgtcactttgtcgaactcattctctgcccagttttgttcccttgctggtgaggagttgtgttcctttggaggagtagaggtgctctggtttttagaattttcagcctttctgctctggtttttccccatctttgtggttttatctacctttggtctttaacgttggtgacctacagatggggttttggtgtggatgtcctttttgttgatattgatactattcctttttgtttgttagttttccttctaacaggcccctcagatgcaggtctgttggagtttgctggaggtccactccagaccctgtttgcctgggcatcaccaatggaggctgcagaacagcaaatattgctgcctgatccttcctctagaagctttgtcctagaagggcacccccctgtatgaggtgtctgttttcttctgctgggaggtgtctcccagccaggctgcacaggggtcggggaccctgttgagtaggcagtctgtccgtttacagagattgaatgctgtgctgggagagccactgctctcttcagagctgttaggcacagacgtttaagtctggagaagctgtctgctgtcttttgttccaatatgccctgcccccagagtggattcaagagagtcagtaggccttgctgagctctgcccagttctagcttccctgccactttgtttacactgtgagcctagaaccacctactcaagcccagcaatggcagatgccctttccccccgccaagctcccacattgcaggttgatctcagactgctgtgctagcagtgagcaagggcgtgagacccgccgagccaagcacgggaggggatcttttggtctgctggttgcaaagaccatgggagaagtgcagtatttgggcaggagtatactgctcctccaggtacggtcactcacggcttcccttggctaggaaagggaaatcccatgaccccttgcgcttcccaggtgaggcaacaccccgccctgcttcagctcgccctctgcgggctgcacccactgtccaaccagtcccaatgagatgaagcaggtacctcagttggaaatgcagaaatcacccgtcttctgcatcgatcttgctgggagctgcagaccagaactgttcctatttggacatcttggaagtaactcccgtttgaacatattgatgtgtttcagtccactgcagctattatccttatcagttggcaaattgaaccatctttggtcattgagaggctcttgaagttggcttcctaagaccttgggacatgaccaaataaagtagtctttaaaagtttccttactctttggtattgcaagattttccagactaatcttttatattcctgcccaaggcctggagtcctcatttctccaagaaaccctgttccttaggatggctactgagagtgctcattactattgggttggtcattgtttccaggtcgaaatcagcaccaaagtgtttttttctttaacttcttctaacctgtgtcactgtctttcctctcatacattgctgggaagcacaggattaaagtaacacgtaattactaatttgcttcatcatgtattacacatacgttacactgagtataataatgccgccaccaccaccaccaccagtatgattactgaaatcattcaaagttttgtttttgagggttttgttttgttggcatttctttttgtccttagtatattcaacttggaatataccatcaggttactatgtgttgaattcacttgagtttactttttaaaattttaattttgttttataatttacgtaaaatactagttccagtggcaatacctcctctaccaccatatttcatcccataccctataaaaaaagtttaaaaaactatcttctagtttgctaataaaagtattatttttattgaagtattaatccccccatcttttgtaataaatgatagaatatcacacacgtatttctccactttgcttttttcacttaacagtctattctggagatcactatctagtggagtgtagagatactcgtcattgttcttttcagttgtagtactccactgtgtagtattcattatagtttatcatttattcagtgtgtccctcttaattgaccaatgaatgttggttaattgaatgactataattttagtcttagagttgtcccttatttttgtattattgcaagttataggaatttttatgtttataaaatattttgtatatgaataagaaaatggaatgattaacattttggtttctggtgtaattatttggatataatcttttctgttatttaattttgccaccacatttgttttttaggcttccactacaaatacttaaggcatgcttttatcttgaatagctttagtgttcagttttccaatctaagagggaaattagccctgtattagcctagcattatatggcttcacagttcatggagtagactattaattggtgcacttaacgcatttttcttcttgtttagagtgattttatagacattgctgttggagatttcatatcctattataaaatgctcatagaattttgttggtttgtttgagacagcgtcttgctctgtcgcccaggctggagtgcagtgggatgatcataacacaccgcagcctggacttcctgggcttaagcaatcctcctgcctcagcagcggtagctaggactgtagacttgcaccactgcttctagctaatttttttatttttattttttatttttgtagagacagagtctcgctgtgttttccggggtggtctcaaactcctgacctcaagtgattcttctgcttcggcctccttaagtgttgggattataggaatcaaccatgaggcctggcccagtgacattttcagcatagaaaaaaattcattagctttgtcacttgatcattaaagaattagctatttaaggatataactttgaaatatgtgtggcgacttacttatggcttggcttttcttctgcattatagcctttattttataaacatccaacagaatcctaagatttctgttggctcagctttaaaatatatccagtatctatttctcattacctttttccatctctctttgatcctgagcactgttgtttttttttttttttctttcttttttttttttaaagacagagtctcaccctgttgcccaggctggagtgcagtggcacgatctcggctcactgcaggctccacctgccaggttcatgccattctcctgcttctgcctcccgagtagctgggactacaggcacgtgccaccatgcccagctgattttttttgtatttttagtagaggtgggatttcaccatgttagccaggatggtctcaatctcctgaccttgtgatctgcccgccttggcctcccactgttgtttttcactggaattattgcagttgcctccttgtaggcataactgtcatctttcccacacctattttttttcacagtagccgcagtgatcgttttaaattattttgcgttgtagccataatgatcattttaaattattttgtgttgggtaacatgacagttttattgaaagcctatcagtggatttatgctgcattcagggtagaagccagagttctggtggcctacagaggtatgctttggtgccttgtcacctctctgactccatcctccactcttttctaggctttgtgctaaacctacactggtcccttggttgagcctttgaacagactaggcatcttgcctcatggcctttccatctatttgctggttcttctgtctggaattcaataatgctgttatttttggtgctttgaaaacagaaatttcaggaatttcagaaattcttgaacctcacctccccccagcaagaaatattatagtataggagttaagagctcaggctcaggagttaggcaactctgtttaaatcttaattctgttaagtaattctcgtcaactttgaatgaattaccagcttccctaagcctccatttctttatccataaaatggaaatattaatacttgtacctaatttataagattgtgaagattaaatgagatcatgtgtataagacacttggcacaatatgtggcaagtatttctattcagtaaatattaactgaattagttgttattgtttataatataatttttggttaccacttttcagtgaaaaataggtaagctcttgggtttcccagattatttaacaaaggaaactatcattttgtctcttggttttagggcaaacttatctagaagagaggagcagaggagaatgaagtagtaatttgtcatattttcattcatatgttgttatgtgggccataggaaagttggcagatccatgaatttcaattttattatatatttcttgtcaagaatactttattagtacaaagcatatcatgtattttgattagaagtcttagagaaattaagatcttaggaaaatattaaaattttatttggggtatttatatccttgtatactaataatgagatacatttgctgaaagctgtagacgttcccatatacattcttacttggtttttcatggaaatttatgggaatgttcactgttattcctatttcacaatcagaactgaactctcattcttgagacgtaaattctgatgatttttttccattatatcataactgatagtagcattgggcactatgagatttgaaaatgactgcaacatagattctcatcttcaggcttatagatagatacatgtgaagtcaattaactctaatacttggtagactaaatggaccagtatataaggaactctgaggaagaagtgcttaattctgtctaggccaattaaagaaagattctggaggaggtaacattcgtttattttattttattatttttttattattattttttattattattatactttaagttctagggtacatgtgcacaatgtgcaggttagttacatatgtatacatgcattaactcttcattaacttgtcatttagcattaggtatatctcctaatgctatccctcccccttccccccaccccacaacagtccccagagtgtgatgttccccttcctgtgtccatatgttctcattgttcaattcccatctatgagtgagaacatgtggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagcctttgctattgtgaataatgccgcaataaacatacgtgtgcatgtgtctttatagcagcatgatttatagtcctttgggtatatacccagtaatgggatggctggaaaaggatgagcataatttttgcctctgcgagttgggagctgcctgaggaaagtcatgtcattcacaaatgagaaataatatatgataaagttcttttaactggctaccactgtatttatacttaccatttctttgttaaaacttattgactgatatccatatgcctaaacattgctgctaataggccacttctgctaagctcacggttctgtttccaacacttgaattgcagacctaccaaaagttatttgtatgtgttttctacctgttaatgcctgtcatatgcaaaaccagaatattgttgctaagataacaaagttgaatactttggaaagactcaatggcagtgccctaaaaggatggttgttttttaattagatgggggtgagacaactcaaagactgaaagaaaaaaagaactagaaggattgtgtactcaaattgctttgctgttgacttcaagtttttggttcactctaaagacagttcgaagtcttagataacacattacggatatcatttatgcaagaaagacagcatggatttatagtcatgaagacatcatccaaagaaatagactagtcttcactaaaggatggataaataaatatgcatttatgtcttgtatgattaaataaatgcattatttatgcatatgtgttatattttatgattacctatttcagtcagcctatttggttaaccaagcaaatactggttctgattgcattaaacagaagggccttattggagccataatttcttggagagaaggcattagtggaatatggagagggtagcagataagactgggcaagtcagctggggttacaacgtaaaggatttgtatgccaggctgagtttgtcctttgatggtgatgcagttttagggaagtgatgacctttcagactgtttttttggaagattcttgacaaattagagaggttgggcaagaaaactagggcagtggcagtgagattggaagtagagcagatctgaaagaaatttggagaatagaattgataagtcttggtgtgatttactggatctaagtactaaggtaggaagaaaaatcaaaggtggtgctaatgatgataaatagctaacgtttaccaagtgcttactgtgtttttttttttactgttctaagtcctttagataacataatttcagtcatataaaaatgtactacttcccacaggtccttatgcataaacctccaaaactgcaaaaaatgaaaacataaattttaagtttgttgtaggcacatttggcaacagataatgacctgcactgatgggaggctatttgtagtctttatctcacttaactgtaaatgtgtggtttgttttttttttgcagaaataattttgtgtttggttatagagtgctatcccagacctggtgggagtgttacataatccataatattatctttctaaaatatgaaaaacttttacttttcttctgctggtggaaatgtaaattagatcagccattgtggaaagcaatttggtgatttctcaaaaccttaaaacagttaccatttgacccagcaatcccattattggttatatacccacaggaaaataaatttgtaccataaagatacatgcacatatatgttcatcgcagcactattcacagtaacaaagacatgaaattttctttgtttgtttttctcagacctcttagggtgaaaaaaatatgagcaattttgaaatttgggtgtaggcgagagataatagacctgtattaataattataatttgggggccaggcgcggtggctcacacatgtaatcccagcactttgggaggctgaggcgggcggatcacgaggtcaggagatcaaggccatcctggctaacacggtgaaaccccgtctttactaaaaatacaaaaaattagccgggcgtggtggcaggcgcctgtagtcccagctactcgggaggctgaagcaggagaatggcatgaacccgggaggcggagcttacagtgagcggagatagcgccattgcactccagcctgggcgacagagcaagggtccatctcaaaataataataataataataataattgttacttggttgggcacaatggccaacacctataatcccaacaccttgagaggcctaggtgggaggattgcttgaggccaagagttatagaccagcttcagcaacatagctaccccatctctaccaacaacaacaaaaaaatcagctgggcctggtggtgcatgccagtaggcctagttacttgggaggctgaggtgggaggatcgtttgagcccaggagtttgaggctgcagtaaactatgattgcacctgttcacttcagcctgagccacagaatgagactccatctctaaaatttaaaaaagtcaaaaaaaaataaaaattatagatgaagagactgagtcatagagagaaatcacacaaaatatgtgtcagagttagggtttgaacctacacagtcttaacttttcaaatgtgcattttagatactacactattctgcctctctttctagcctttgtcattgggaaaatgataccattaaacttattaagggatctaaagagcggaattaggggaagctgaagaagagggagacagtgtagtagaatattaatttagattggtctaatttgagctatcaatggaaaaagtacagtaggaagccagaaatattttggatatatttataatgcacatactggatttcatcagatctaaggtgccattgttgtaacatcataaataccgattttaaaaattaaataaaattatggtgcagtatttgtttttatcccataaatttcccctgcccccccgccacacacacacagtatcattctctgtgctgcttagagtatataacattgcttgcttgggattttcttctgcgtcactgataggcattctgcaagctttgattttggcactttcttgatcttaccataaaatatcaacataaagttttcagacaacatccagaagaaattttatgtaatagttaaggtcaacagatacgattccaacaacacacataactcaactgaagtgaaaacaatatgaatagctgtgactggtgtcacatgtggatgataatgacaacccagtcatgtctgccacctggccaacatcaattatacaaagtcattgattttaagattcattgattgtaaaagatttcaatgacattaaaatgtgtaggaaatgtgcatcttagaattgttaaacaataagtagtacttttgcctctgagaattggaagttgcagtaataaagtaagatgctaaggcatgtaaatgtttttaataaatacatggttttcaagagttaatacatgattgaagaggtttagaatcaattctctagggaaaaattgagagaaagattctgtcttgagcatttcctatgtttaagagttactttatgaagaaaatgtaaatacttcccctgattgtgaatttatcttttataaatgacaatctaggtgacccatttcacaaatagattaatttctctcataagtgttagcttggtctttgttactggtataattaattgtactatatgctgagtacaactaaaaactctgaatattatacgtaaaacacaagaagactctgaaaggtggagagaataaggcagaggagctagggatctcaggacccaaataatgacactgcagtagttccctgccttttcttttagcctcatatattccataattagagctaaagaagctgataacccagaagtgcaatggccacagacaaagaaagcgccagcaaaagcccagtcttttaaatactagtagagggacaccatagcaagacagaaaactttttgagaataaccattctacttcaaccaaacaccacagaaaaaaacattggtcacactcatagctgcaaaggccaagtagggatcctagatttccatcctcaccaagctgttatgaggcaccctaacacctcctccactggaattgtgtcagattaggccaggtacagagttgggactttaattcccatagaatggttaactagcctttccccaacttgtagtgttactggagaccatgtgggaagctaaaacttctacgtttatttgggagtaaagaggagcttctgtccttccctgctaagtggcatcagaggagtcctattggagaatgaatgctttcaccacttctaagcagtaaaaaagcctttctctacctatgcaccccaacccccagcacccaggggtattagtagaggctacatgggagcagtagcttctcagccagagacatgtcagtggaggtggagtggagagtcaggattcccacccagcccaggggaatcaagaagctgccccatctgtagtgtaaatggaggacaagtggggaacctgaacatctacccccaacttgccgaaatgaaatggcacctcactatcttcatctgctggagcaaaatcaaacaaagccaactaacacagaaaatttaagtaagatctagagtcttataatacccaaagtgtgcagattttaattaaaaattgtctggctgagtgtggtgactcaagactgtaatcctagcactttgggaagccaaggtgggtggatcacctgagtctaggagtttgagaccagcctgcgcaacatggcgaaacctcatctctaccaaaaaaagaaaaaaaaaattagccaggcgtgatggcacatgcctataatgccagctactcgggaggcttaggtgggaggatcacttgagctggggaggtcatggctgtagtgaactgtgatcatgccactgcactccaacctgggcaacagagtgagaccctgtctcaaaaaaaaaaaaaaagaaagaaaaagaaaaaattgtcatactaggaacctagaagatctcaaattgagtgaaaaaagacaattaatagagatgaacaccaggataacagatattaaaattatctgacaaagattataaagccagctatcttaaaatgcttcaacaagcaattatgaatgagcatgcctgaaacaaatgaaaaaatagaaagtcttagcaaagaaataaatagaagaaccaaatagaaattttagagctgaaaaatgcagtaactaaattaaaaacttcaatggatgataggctcagtagcagaatggaggaaatagaagaatgactcagtaaactgatagaacaatacaaattgccaaatctgaacagcagagagaaaataggctaaaaatgaacagagcctcagggactgtagcaaaagagcaaacatctatgccatcagatctctctgaagaagtggagaaagagggcatggctggaaaagtattaaaagaaatgatcactgaaaacttttcccaaatttggcaaaagacataaacctacagatttaagaaacctagcaaactcctaacagggtaaaccaaagcagtccacaccaagacatggcatatgcagacttttgaaaattgaagattaaaaaatcttgaaagaaattagaaactataccagaggggggataaatagtttgaatgacagcagatttctcatcagaaatcatggagactacatgtcacatttgttaagtactgatagaaaagaactgttatttttaagaaaactttcaaaggtctgaggtcagaacttttgtttggattcataatgttacacagtatctttcattgggatacagaactttcaaaagaaaatgggaaagtgcatttctactaatgagaaataatcataagattatttactattttgcattttgttgctcagagacttgctaatgaaaatagcatttatttctgaatagtgtaatgttctgcttaatctttgaatagttcagatagtttaattttcataatttctcctaggatggctttgagtaattttttcagattttcaagaagcatataactattacaatgctattttgctgactttctgatttttaaaactttgtatattggttaaaataactttttaatactactttttctacaataatgtattagtccaatcttgcactgctatgaagaactacctgagacagggtaatttatgaagaaaagaggtataattgactcacagttccataggctgtacaggaagcatggcaggggaagcctcaggaaacttagaattatggcagaaggcaaaggggaagtgtgcacatctttgtatggccagcaagaagagagaaagagagcaaagagggaggtgctccacactttcaaacagccatatctcgtgagaactctgtcagcactaagacagcactaagaggatggtgctaaaccattagaaaccaccctcatgatccagtcacctcccaccaggccccagctgcaacactaagaaatgcaattcagtatcagatttgggtggggacatagagccaaaccatatcaactgaataagaaaatatacattaaatttggacactaaatatatttagctcttgctgataattgctttctttgtctctcttcactaagttctcattagcttctggtttaaagacaaagtttttcttaaattttttcttaaaagatgaaaatttttaaatagctatttccttttcttaaatatttgcttctgtggtttggtttttgacaaaactcagaagatagtggagactatcaaaatttgtcttccaaagtcagttaacccagaatctcacctgtttatctaatataccatattcacattgcaaccaatagctttgttaactttataccttttgttagattttccagttagcacataaatagttttgtaaaaatccttttggatcatgtcttgatttggaagcttactcatttatctatctaaaattatcaaatcagagtttctagagtattataaatctcaattaaatctgtcagattaccatttttcatttctacaatttgttaagaatttaatggttgggcccggtggctcacacctgtaatcccaaggtgggaggattgcataatgccaggagtttgggaccagcctgggccacaaagggagaccccatccctaaatttttttttttttaaatttagctgggtgttgtagtatgttcttgtattcctagcaactagggaggccgaggcagttaggatggcttgagcctaagagttcaaggttacaatgaactatgattgcactgctgcattctagcctgggcaacagaatgagactgtctcttcaaaaataaagataaaaaagaatttcatcctgtactaggtggcatctcttatgttgactacctttgatttgcttaaggaaattactaagtattgttaagaaaatataggcctgattttctttaccctgaagcactcaatacggttgttcatttgaaaagtagcccagtcatctaactttcagtttggaacacctgtgtgaaaatctgtttttttgtttgtttgtttgtttgttttctttccaaggaatcttagaataactatggcatatttttcctaattaatagccacacaagtagcttctaataccccagcttttgttctgaaggaaatctagatgtctgttttcaatatctccagggtctttcaaagtgaaattttcatattccagatagcctgtagtttgtttaacattatcttaaacattgctttctttcttttttttttcccccctttgaaatggagtctagccctgtcacccagactggaatgcagtggcacaatctcggctcactacaacctctgccttctgggttcaagtgattctcctgtcttagcctccaagtagctgggattacaggtgtgcaccaccacacccagctaatttttttgtatttttttagtagagttggggttttgctatgttggccaggctggtctcgaacttctgacctcagatgatctgcccaccttggcctaccaaagtgaaacattgcttcctaaatgtgataattttgcatatgacaacagatagtactttaattttatttttaactcatttaaaccacattgcccagtaaagttattttataaattagattttagttaagttttatatatatataacttataactaaataatatataactacaatgtattatactcaactatatctttgaatgtcacacaggtgtcaacaggcagaggtgggaactgaacccgaagtctgcagagcataaaagtttctgcttttttcacccctccaacctttgaattgcttttggagactatttatggtagataagaattaatccaccataggattaatcagtccgtgagattttgtttattattatttattattattttttcaaatgtgcctttgtaacatttacatttgcaagtaatagttctagagtgcaggagaagtttgtgaattgtgtgtttgcatgcataagtacatacatacatatgtacatacacacgtacgtaatcttttggctcaaggattgctttgggcgctgcttcctgccagcagttttggtactttactctgttagtttctcttaacatccttcctgtttatataaattctgtattgtccgtatttggctttgacctggtatttccttgaaactctgctttctgtacttcaagctgcagctagtctgagatattccttttattctcaatctttgtatcctttgaatgatttgtgatacccaagcagaatagatgtatttttatgtaaatattcctaattgtttggaattttgcctaggagaataattacatattctctcagagcatagcacagcaagactccactatatcttacctttctgctttagactcatttatttatttgtagtatatgaggaaatattctttttagttttatatacattttcaaaactatgaaaacaggaaaaattacctcaagtctaacttctgtttgtagaatttccataaagatgataaaacttttacagcatatttttaaatttaaaacatgaaactacaaaatgatacagtagccatttttgtgatcagatacacatgtccagaacaaacttattacagaaaacttggttaacacacaaaacaaccaatacaaatctctcttcctctatctcttagaggtacccactgttagagggagggtgtgtgtgtgtgtaaaagatatagagattgatcagttatttcatttattctaaggaaaatgaactgggcctccatctggctgtatatacttcctatcacaggactttattttgttccttctcacctacagcacattgcccttctgttctcttttgttagcacctacataatcatcagagaatccttttctgacttcactaaatccatttttcctattaatcctagacactaccttattctgttacaggacctaccacagctttacatttatttgtgtatttaatctgactgtcttactagactataaactttttgaagggcaattctgtgtttctttttgtttacctttatattcctggtatgtaacatagtgccagatgcatactagacactccataaatattggttgaattaatgaatacgtttgaaataccagcaaggaatgtacataagcagttcataaaaggagaaatacaaatgccagtaaatatatctaaatattttcagtctcatgtgtaatcaggaaatacaaattaaagcaatgacaacatgttttatcttcatgatgttgggaaaattttttaaaaattgtgaatttcaactgtctatttaagtgcacatctattaagagaataatattaaatgaaggtatgaaccagacatactatggaatatttttcaggtgttagaagggaagagttacattatacttcatttagaataatctcattaatttgtgctttacaaaaagaaccccaaaagtgatggtgtatatatgtttacacacatataaatttatggcagaggtactggaaagatttttgccctactgttgatagtgtttatctctgggggagggaacataatagtaggagaggaataaaggagttcctttttccctctgtggacgtgtactttttttaaaaaactattttataattagaatatttttatatagtcgaagtatgaaggagctaaattggttaggaacataaaggaaaagacccattctttatatatggaaaaataaaaccagggatacccaaatcaaatggtttaatttagaactacaagtagttctatattgttggtgcctaaagtgtgatgccggaagaaggaggaggctgaaaaagaagacaaggccagatcagtgagggctgtacattatcttttctcctagcatggtagagccatcgaaaaattttttaagttagaaattgacttgggtaggccaggcgtggtggctcactcctgtaatcccagcactttgggaggccgaggcaggcggatcacgaggtcaggagattgagaccacggtgaaacctcgtctctactaagaatacaaaaaaaaaaaaaaaaaatgagccacgcgcagtggcgggtgcctgtagtcccagctactggggaggctgaggcaggagaatggcatgaacctgggaggtggagcttgcagtgagcagagattacgccgctgcactccagcctgggtgacaaagcgagactctgtctcaaaaaaaacagagagaaaaaagaaattgacttgggtaatagatggttagttacatcgttcagtagatgactctgggagatgtgctgttgacatgattaaatagataaataacctttttgtatctgaatacctttggcaggtttgatgaagcctatagatactttcttagaattgtgttttggatgcttaaaataaaatacagagtacacagaagccaattatattggaatgcacttatcaaaatatttaaaaaatatatttgtagtataattatctgtctgcttctttagtaaaatattaaaaagacctagtggtgggtttaatagctaattttaaaataatgataagcaataatttaatgtatctgtgttaattgaattttttatgaaccttctgaattttacccatgaaccccagcttaagaactcttgtttgcgggatgagattgggagcgcagagaccagtaaggaaaccagtccatatggagataatgagaagtctcagtggaggtggatcctatgagactttctaattattattaaaaattaacatttttgtattggtaaagcaacgtgtgtacattatagaaaaattaggaaatataaatttaaaaaagaaacatgctctagatggttttgttttttgtttttttggcttgatctcagctcactgcaagctccacctcccgggttcttgccattctcctgcctcagcctcctgagtagctgggactacaggcgcccaccaccacgcccggctaattttttgtatttttagtagagacagggtttcaccgtgttaggatggtcttgatctgacctcgtgatccgcctgccttggcctcccaaagtgctgggattacaggcgtgagccactgcgcctggcctgatagttttttaaaatttaaataatgtatatactgccctttattgctgctttatataggaactttcctcattggttatgcatttagttttatttcaatgataatatcttttgcttaactatttttcctttggttttacaggtttttgattggtcaaggagcacatgtaggggctgtcaacagtgaaggagatacacctttagatattgcggaggaggaggcaatggaagagctacttcaaaatgaagttaatcggcaaggtaaaataaaaagcaacctaaatggaaaaatgttttagaaagaatgtgatacttttccagcaaaaatatttgttgacattgaagggcaatcataatttcatgaaaaaaatgaattcagcttgcaaaacaatagtacagtatgtttctgttttctaaaatattctccactctatcttttaagtatttttaaagttaaaagaaatgttagaagcagcaggatcaggcataaaattatgtggaagtaaaagttttggagcaaaataaagtaggcaaaggggatagaaagtgcacagggtaagtggcacattgcaaagttaaatagtgtggtcaagaaggctcactgataaggggtcatttaagctgagatgtgaatacaatgagggaatgagtcatgatgatctggggaaagagcattccagacaaggggagcaatgaatacaagaatgggaggttgtcttgtatatgcagagaagcagctagaggcagagcagaggaagaggcaggaaggagatgaggtcacagaagtagcaggaggtcatatcaccttaaggccttgtgagccattgggaagactttggcttttaacctgagtgaaataggaagccaatggagggattgaggcagaggattgacatgatttgttatacttttagaaaggatctctctggctcttgtgttgaaaatagattgtaggaagacaaggacagaagtaggagaagggttaggaaataactgacataatccagacaaaataaagtgatttatttttgactggtagtagatgaagtgatgagaagagattggattatggatatattttgaaggtttggccaagaggattattgagtcattagctagaaggtgtgaaaaaaagaagattctaagatttttggtttgaacaaatggatggatgaagttcctatctgagatgtgaagattgtaagaagagtaggttttatagggaaatattagggcttcattttcaggcatgttaaatttgttttgcgtgttagatatccaaactgttgaatatgcgagtctgcagttacaaaatggatatgtaaatttgggaggtgttcatttatagataacagtgattgctaacgggcacagagtttcattactcaagagtgatgagtattctaaagttgattgtggtgatggttacaccactcctcacatttactaaaaaaaaaccattgaattctacactttaaatgctatgtaaatgctgtgaattagatcttaataaagctgtgtgtgtgtatatatatgtatgtatatataaaatatgatccagcttggcagcagtggctcatgcctgtaatcccagcactttgggaggccaaggcgggcagatcacgaggtcaggagcttgagaccagcctgaccaacatggtgaaaccctgtctctactaaaaatacaaaaattagctgggcgtggtggtgggcgcctgtaatcccagctactcagaaggctgagggcaggagaattgcttgaacccgggaggcggaggtcgcagtgagctgagattgcaccactgcactccagccttgagaacagagtgagactccgtctaaaaaaaaaaaaatgatccagcaactccttttctagaaatttaccatatatctatatctatatctatatctatatctatatctatatctatatctatatctatatctatatttttttttgagacagagtcttgctctgtcacccaggctggagtgcagtggcgcaatctgggttcgctgcaacctttgcagtctgggttcactgcaacctctgcctctcgggttcaagtgattctccttgcctcagcctcccgagtagctgggattacaggcgcctgccaccgtgcctggctaatatttttgtatttttagtagagatggggttttaccgtgttggccaggctggtctccacctcctgacttctggtgatcctcctgcctgggcctcccaaaatgctgggattacaggcatgagccagcactcccagcctacccaaaagaatttaaaacaactcaactctttgaaattgaataatttgtacaaacatgggtgtacaaattattcatattagccaaaagatgaaagcaaaccaagtgtcattgatggatgaataaataaaatgtgaaatatatatacagtgaaatattattcagccttaaggaaggaaatcaaacatacgctacagcatggaggactttatggtaagtgacataagccagtgatcaaaaaaaaccaaaaacaaatgattctacatatatgaggtacctagaatagtcaaattcatagagaaaatagaatgatggctgccaggggctggaaggaggggagaaaagggagttgttttttaatggcagagtttttcttttgcaagatgaaaaaagctgtgtagatatgttacacaacaatgtgaatgtacttaagaactgtacacttaaaaatagttaagacctgtaatcccagctaaggggggaggatcgctttagctcgtgtgttccaggctgcagtgatctgatcacatcactgtgctccagcctgggtgacagagtgagaccctttctgaaaacaaaaaaaaaagttaagatggtaaattttatttttatgtttattttactacaattaaaaatttatgtatgtgtgattacttctgcagtacctttgggcaggactcacacacacacacacacacacacacacacacacacacacaaagtgccacatgtgatttttgttatagtccattaggcagtgatcaaacaggtattattagagctgtgttttactgaggtcaaatgatagaggaatggtatgaaatattgatgtagagggccaactcctgctgaaatgtgcttcatcagaaaatagaaactaaggattagaaaggaatagaaggtaaataaattccatgaaaggagatttttattccttgggattaggaaaattcctaatgactgcgggtttgttttgttttgttttcgtttgttttgagacagactggagtgcagtgacacaatcatggctcactatagcctcaacctcccagaccctagcgatcctcccaccttagcctcttgaggagctgggactgtaggcgcatgccacctcacctggctaatttttgtattttaagtagagatgcagttttactgtgttggtcaggctgatcttgaactcttgaactcaagcagtccacctatcttggcctcccaaagttctgatattacaggcatgagcgaccgcatctagccaactgtgggtttgtttaaaaaaaaaactatcttaagcatgaaaactgagaaaataaatacctaaaatagaattgaggtgttataaaaagtgattaaatataactagagcctaaaaaaaacaagaaatgcaatagaaaagtggttataaactggagcctgaataaacacacagaagagctttcaacagccatgttctagacaagtgttttagagtcataggatcttctagaattgagtaaactaaagaataagtataaagcatcacaacctagcaagaacttccctgcccattttgctgtgatgagtgctcagataacagtttcctgtcaaacaatggtaattctttaaagtaaacatttaaggctcctattttttatctgatattagcagttgttatgaactagaaaaggcatggagttgtactgaaaatttcttgcatttggtttccttctgtataagggaaattgctagcgtaactgtaagcggggctgattttagttttaatgattcatttagaactgattaatgtgccagcaaatgttctatgtgctgggtgttaacaataaaaaaagcaagacaatccttcttaaggatttcacagtctagcagaagtgtcaaacgaagagcttcacaatacagtgtgctatgtattaaaatatataggaacagaatgttgtgagagaatagaaaaagctgtagtgaggaaaggtttcagagtgatgacatttagagggagttggcttggcaaagaaaggaactggtggacagaaaaggcggggtatcaaaatgtgaaagaaaaggagttggaaggccaagcacagtggctcttgcctataattccattgctttggggggctgagatgagaggcttgcttgacgccaggagtacaaggttactgtaagctacgattgtatcactgcactccagcctggacaacagagtgagaccttgtctctctctctctctcttttttttttttttttttaaataaaaaggaattggagacatacatagcatatgtggactggaagacagacacattcattgggactggaattgagattcaaagtcagggcgggatttgtaggagatgaggcctgaaaagataggtcagagccagatagtgaaggatatctatttttgtagacattggatagatgcagcaaatatctccaagcaataaattaatttgattggatttggtttttagtataaagctgatggcaacttggaggatgaaatagaatgtaggatatatggtgacacgcattccttgaagaagattctcaaattagtccaggtgaaagatgataagagccaaaacctgttacatttgaaatgaagaacaaggctgtcttgaggaaatattgaagtaaaattagaacagtttggtaaagaattgaatgcagatatgaaggaagaattaagcctaacttactaaagtttccagttgaagaagtgatgattagatgagttcatgtaggaaagtgtgagataagacagaaccagactgagggacttcatgagtatatattgggtttgtagtactaaaggacatctagatgacagtggttggtgcattgttagaacttaggatatgtaaagatgtgaaaagtaaatctaggagaaccataaggagggggagttctgggaactagtagatgagatgaccctggagacgaaaagctaagtgctaacaatgataatagtagtaatgacaatagctaactgttattaaatgcttattatatgccaggcattgagccaagagcttcacatgcatttcttcatttcatcctcatagcagttctgtgaggtttatactactgttaccccatttccagatgagaaaattgaggcttagtgatttacccaagatcatacaggtaggaagtggtagtgctataggtctgtcctaaacagtaagacagatatcttgagcccacattctgtaccactgtaccatactgcattttatttaaaatgtctccctagaaaatacttcatgatgttcatttgatacatataatgggaatgcataaatttatatagcatatcttaattccaaagaaacaaaagtataggggcatctctaacagattttaataattataaaaaagcaccctaaatatatctctagttgtattagtccattctcatgatgctatgaagaaatacccaagactgggtaatttgtaaaggaaagaggtttaattgacttatagttccacagggctggggaggcctcaggaaacttacagtcatgcagtcatgacagaagagaaagcaaacacatcaggaaacttacaatcatgcagtcatgacagatgggaaggcaaacatatccttcttcacacggtggcaggagagagaagtgccaagcaaagacccttttaaaaccgtcagatctcgtgggaactcactcactatcacaagaacagcagcactgggggtaactgcccccatgattcagttacctcacacggagtccctcccacgacttgtggggattgtgggaactacaattcaagatgagatttgggtgggaaacagacaaatcatatcatcccactcctggccccttccaaatctcacgtcctcacatttcataacacaatcataccttcccagcagtcccccagagtcttaactcattccaacattaacccaaaagtccaagtccaaagtctcatctgaggcaaggtaagtcccttctgcctgtgagcctgtaaaattgaaagcaagttaattacttcctagacacagtgagggtacaagcattgggtgaatatacctgttccagatgggagaaattggccaaaacaaagaggctataagccccatggaagtgtgaaatccagtagggctgttattaaacattaaagttccaaaatgatgtcctttgacttcatgtctcacatccaggtcatgctgatgtaagaggtgggctcccacagccttggacagctctgcctctgtagctttgcagggtacagccccactcctggcttctttcatgggccagtgttgagtgtctctgtcttttctaggcacacagtgcaaggtgtcagtggatctgtcattctggggtctggaagacggtggccctcttctcatggctgcgctaggcagtaccccagtggggattctgtgtggggtctctgacctcacatttcccttccacactgccctagcagaagttctccatgagggctctacctctgcagcagacttctgcctggacatccaggcctttccatacaccctctgaaatctaggcagagcttcccaaacctcagttcttgacttctgcacacccatagtcccaacaccacatggaagccacaaaggcttggggcttgcatcctctgaagcgatggcctgagttgtacattggccccttttagctagggctggagtagctgggacacagggcaccaagtcccaaggctgcacacagcaagggggccctggacccggcccatgaaaccatttttccctcccaggcctccaggcctgtgatgggaagggctgccttgaaagtctttgacatgccctggggaccttttcccctttgtcttggcaattaacatttggttactcgttacttatgcaaatttctgcagccagctttaatttctccccagaaaattgggttttctttcacattatcaggctgcaaatttttcatacttttatgctctgcttccttttgaacactttgctgcttagaaatttctttcatcagataccctaaattacctccctcaagttcagagttccacagatctctagggcaggggcagaatgccactggtctctttgccaaagcataaaaagagtgacctttgctttagttcccaacaagtttctcatctccatctgagaccaactcagcctagacttcattgtccatatcactatcagcattttggtcaaagccattcagtaagtctctaggaagttccaaactttcctacatcttcctgtcttcctctgagccctctaaactgttccagcctctgcctgttacccagtttcaaaattgcttccacattttttgggtatctttacaactgtgccccactacccgataccaaattactgtattagtccattctcatgctgctatgaaaaagtacccgagagtgggtaatttataaaggaaagaggtttgactcacagttccacatggctgggggtcctcaggaaacttacaatcatagtggaaggggaagcacaatcatagtggaaggagaagcaaacacgtccttcttcacatggcggctggagagagacatgctgaacaaagaggaaaaagcctcttaaaccataagatcttgtgagaactcactcactatcacaagaacagtagcatgggggtaatcgtccccatgatttagttacctcccactgggtccttcccaccacatgtagggattatgggaactacaattcaagatgagatttgggtgagaacacagccaaaccatatcattagtagtggtaacatttctcaaattatctaggtatgaaaattattgtttaatatttttaagttttttaatcattcttttggcttttcttattccagtacatttgatcaataactagttatgcttaaataaattgcctttgaaagtagtaataattgaacagtagctgtaattattttctttatttatctagggacacattaatttttgaatctgttgctgactaaattccaatctaattttatttattttaatctaagagatttgattatattttaatatttactgctcttaaatcatagtgacagatgttagtctaatcactttgttatacccaatttagttttattatatattattttcattgtttaaaaaccttgcaattatagtaggtgggttaaggaccagttaaatgcattataagatttttttcttttaaaacagaaatcaagaaaagagaagcagaatcatagacttttcaaactgataatgataattaacaccttagtgtttatccctgatctaaaacactttatatgtattaattaatttagttttcagaacaaccatatgggatagatattggcatcactcccatcttacaaatgaaaccagagcatagcatagattgtctaccctgagggagtacagctagtaagtggtggatcagagattcaaatccagccagtctcggttcagtatctgttttcttaacctatcttactaatatccaaagaagctatggctttctcaggatcactggctagttagtcaaagcactgaacttagaaagcaagtctcctaatacatagtacaattagatttttttttcttcaagtttttgatgagctaagcacggtctacatactctaatcggtagtattttaaaaatttaagaacaagagaaaggtttttcttttctaatttaattttcttaaacataaggaattgcccttcacgttaactttacacttggattgtttttatatgtgaatcagatgtgagcacgatttggaagctaaagagggtaattgctttgtcattagataaagatagcatgaaattagataaatataaaagaagtaggttttttttaacttgaagttcaaaggaaacagaatagtaaaagacaataaaaatcagaacgtttaagattgtaatgaaaggagggataaaaataataaaaagctacctgttttaaaagacagtaagagagtaacattaaaaaagcaaatctaagataaatcacttaatagaaaggttactaacattaggcatatcttaaatgggctgattatcttttggtgggaaatttttgatacaagtaaaactgctttactatagaaatggtggcatttgatttttataaaaatcataataggttgtgttcattccatatatagtttatacaatttattgttttcataaggtctatttggaaaatcttgttcaagtttccttcaaatgcggtaatgagatattataatctctagtttgaagatgactttttctatacatgtgtaatcttggagttttaaaaatatttctgaattattgtctgctttttaaaagctgagcttcagttgagtaatgagcagtttagttgtcttggaaaaaatggtaatgtgctaataagcaggcaaaataaaaatacaattcaggtagaggatagtagctggcatgacagcagagaccatgatgtacttggggacctatgtggaggtctagatggttagaacactagatgatggtaagggagaaagactatagatgaagttaaaaatgcactgagaccaagtcataaaaggctttctcttgtatactaaagagcttgagctttgtcttacagaagcagccattgacaaattttatataaagcaatgacatcatgttttattttttccagtccagcagtagattgagggatgaattagaagggactaaagacggaatgagttaagggctggtagcagtagtcaaagtgtgagacataagctatgaactagcatagtgataggggccatttagaagacagtctagaagtggcaactccaaatctggtaactaataggatggtgtattagtcaggcttctccatagagacagaacctgtaggatatacggaaggggatttattaggagcaactgacacagaatcactgcaaagtcccacaataggtcacctgcaaaatgaagaaccagagaagctggtaatctggctggctcaaagccagtagcgtgtttcagtccaagttcaaagccctagaagctgggaaactgacactgcagtgcctgtcacgcctgacagctccccaaggagccactggtgcaagtcccagagtccaaaagttgaagaacctgtagtctgatatccaaaagcaggaggaaaaaaggtatcctcctcctgaagggagagagcaagcagaaagagcaaatcctcctttttcagcccatttctcccaggtgattggattgtgcctgtgcacattgacgatgggtcttcctctcccaggccactgactcccatgtcactttcctctggaaacaccctcaactgcacccagggacagtgcttcaccagccatctaggaatctctcaatccagttaagttgacacaattaacaatcacagatggggtgagagtaaggtaaagggagaaattcagatgactttcaggttgctaggtaattgagggcacttagtgtaggaaaacaagacaggcagcaaatagaatggttggggaaaaatttggttaagattttagcattgagtttgagatgcccatggcatattattttattatttccctagttctctctcctacaggcttagatatgcaactgattacttgatatctctgactagatatttgttaggcatcttaaacttcacatttccgaaattgaagctttaattttttcaattgctcagactgaaaacctctgattgattctcgacctctctttttcttctgtatccaaactaacagcaaattctcttggtaagccttgaaaaacccagaattcaaccactttactgtctgcactgctaccacccttgttcaagttaccataattgcttgcctagattattgcagtagcctccaagtgggtatctcagtatctactcaacttttcatcctaagtgatcctcttaagtcagatcgtgtcaccacgctcattgtccttactactctgtagagaccctgtccttctaaacagaacattcctagcaggctcccacttcagagcctactggtacttccctctgcctggaatgttttcccagtagtatggctgtcactcactttatttcttgtaatgtcatcaaagaagctattttttaccaacctatttaaaataacatcccttctcattaccctttctgtttcctttccttgctttatttttcttcacaaatgaatcatcttctgccatataataagttcacatctatacctgtagcatctaacaatgtacctggcaaaatagtaggtgctcagtatatattaaatgtatggatggatgaatgaaaaatcttgtccaaacagttgtatacatggatatggattataggagaatcttagctgaggaaatgtgtgtgtgtgtgttcttgttttatatttgttcattcattgttcatttagtgaacatttactgatctccctgtactttgctttttttttttttttttccttttctttgaggcaaagtctcactccgttgcccaggctggagtgcagtggcgtgatcttggcttactgcatcctccatctcctggacttaagtagttctcctgactcagcctcccaagtagctgggactacaggcacctgccactatgcctggctaatttttttttttttttttgtatttttagtagagacggggtgtcaccattttggccaggctggtcttgaactgctgacctcaaatgatctgcccatctcaccctctcaaagtgcttgaattacaagtgtgagccaacgcacctggctctgatctccctttgctttgtatcaggtattctaccagacagtggggataaaagataaaaaggcctatagacttgtggagtaaggcagattgtaaatgcattgcggtgtgtgctgtttattaaatagcaagtagtcaaagccataagaccagatgaaatcattcaggaatttcaagagtatctttctttaattttttttccaaggtgttgagctctttgaaggtaggaattagagggtcctattcatttttgtattcttccctttttttgttttttgagacagggtgttgctctcacccaggctgtaatgcagtggcatgatcattgctcgctgcagccttgacctcctggctcaagcgatccttccacatcagcctcccaagtagctgggattataggtgtgagccacctcgcctggcctctttccacttttatcacctcaacctagggtagtgcttagagtaagtgcttttaaatgaatgaacatttatataacttactaaaattatgaaaataactttaatggtatgaagaatgtgtactatgttggaaaaggaaatgaagggagtttgctagagaaataatctattttaaggtatgatatattttagatgaagacaggacctccaagttgaagcattcagtaaacatttgtacctgctaggctagatttcatagaacagatcaaaacagtagatagaaatttgagacttattcattataattgttaaaaaaaaaatttagcccaaaggatgcttataccttaggaaatgttcaaatttttaaaaaacaagaagaataatcagaaaggaaaaataagatcaaaatagtattgtgaagcaaaaaccaagtaataagtagaaaaagttaatacaaggtctacaatatccccacattttttagtttaaccaacttgttataagcagcccattttaaaaagacatactttcacttttaattttatttaaacttgacatgttttggatagttttatttcccaacatggaacaatttttaagcaaaaataaaaagaactatttttattttatcaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaagtaagtattgttttttacagagtttttctattttagtttgtcttctttattcattgttccttttcttaaaatacctgcaaacgttattttgaagcaacataaaagagttctttaatgcctgttttcaggaagaaagagaaaaactactttgaatatgattgcttttgttctaaaattctttcaactctctaattattactattttttaatcagttgtgattttccagtaagttgaatttaagtgtcagtcacctattctctgtgaccttttggcctaataaatcactacagagagtcattttgaggttccagattgataactggtttgtgagtcttaagaacaatgtcctgtgaacataccatcagttttgagagcttgattcctgcagaatatttatttacatgtaacttatcttaaatacagttttcttttttactacatgaacactggaacttagtactattagcacactataaaatattaagccataagcaactttgactctacagggctgtatattgtttagcaaatttgcttggaacaaagcttctttatgttgcaataatatttttacttctgcaatgcaaatattggcaactatatgaagaaaattattctgtgtattattcaatatataaaattattcttatatgtatgtgaaaggaagaccagcacttagcaaaatctactgcaccttttattaatatattgcttctaattcacttgagcttctaatatcaatctttcttattcccactcattagtaaaagcagtaaagaatatatgagtcacctttcccaagtttcctcctcttgggtgacagaggctcaggcagtcctcccacctcagcctctctagtagctgggactacaagcatgtgccactacgcccacttaattttcatattttttgtagagacaaggttccaccatgtttcccaggctggtcttgaactcctgggctcaagtgatctgcctgcctcagcctcccaaagtgttgggattacagacttgagccatcaccacccagcctcctcttttcaatctctattcaacttcaataatttaggcctttttcctaagaatagtatggcagtgttgcctttttattagttttcttgtccacctgtttctctctaatccaaaacttttgtgagttgccaacagcatttttttttttgagaatagaaagtattaaagagtattacataaaggtaagaattgtttcttaaagcacttgtttctgtaaatatgtatatgagtactgagttatattgcaaaatagtttctggatggcttccaaatgatctttttaattaggttatccaagctcccaaaatcctttattagttcttaggggggatcaggataaattttaaactccttaacttagtacatagattcttcattatctagacactgtcttcccttttaagctaagctaccaccattgcctctaaagtatgaattgtgccagttacatatatctattgaagttctgtcatgatgtcttaatgccttcccttgtttctgtctggatgcttttattcaccatctcttcaacttggaggcaaattctgctctatcctttgaatcagttaaaggtccttaagcatatgaaaaaaagtgctcaacttcattcataattaagtgcaaataaagctacaatgagttacacttttacatctgtcgagtggcaaagatcaaaacatttgacatcctgttgacagggtgtaggaaaaggcactcttactagtagaaatgacaattgagcaaattcaatcaaagtaacagttattctttagttccctgattctacctctaggaatttgtttttttacagatattcccactcacatgggaagtaagatacgtgctagcagcattgtttataataggaataagagaatgttttaataaattatggtatatgctttcactggcatattctgaaacaaaacaagaatgagaaatctccttacatactgttatagaaagaacactagggtatattatgaaatgtcaaaatcaaggatccaagtatgtatcatttgtatttattgtaaaaaaaattaaaattgtatttgcttatatatgcatgaaatcattgtgtaaggatccaataaaaattaatagtatggttattttgaggtagggcaagctagttggctaaaagtcagcggtgagagagtgatgtccctatgtatcctttcattctttttttttttaactttgtgaacatattacttatgaaagttaaaacatatatgaaataaaaatcaatagaaaagatgtttcaaatgtaaccttcttcacattttctctccctcccaaacacacacaactcctttcaatttgattttgatgcttttcagttttgtactcccattgcatgtctattcatagaacctatgcttgagagttggttgttgtttcacttccagtaaaagctccttgaatatagatactgtctttttttatgttgaaaaaatttacctctttttttctcgccacacagacttctaagtacttaaaaatgttgctcagcatatttaacattattattgttcatatttcctaatggggaacagcgtttttctcttacattccagtattgtttctgcctctattaataaggtttctgataatatatatcagtggagatatttctttggacttatatctttcagcttttctttagataatggctcttaaatgttggtctgcaggcaggtgataggcaatgatatgaaaatcatatgggggacttattaagaatatagatcagcagggcccatctctccatatgctgattgagtagtactggggtgagctgggcaatctatttttaaaaaacaagcccttcagatggttccgttacggaggcaggattagaaacagctgtattagatattgttaggaaataccagatttgttcttaaataaataaagggggattatacattagctgtcactaccacctcctgtaggtaaaaagaaggtccttctcaagctcaacatcttggaaagtgaggtaaaggttaactagatttcatgagttgtatttagtgttcgttcacctgtttgtgtggggctatgctatgtgcagtttatagacccatccttgctgtctgtgagcttaatgtctaaataaaataaaggttgttgtcaatatgtagttagaagggcatactaacataatttatgcaactctttgcattgtattaaaatgtgtttctgttttagcttgttgatgactggagtatctgctttctactgctcagaaaaatagatccgactccttggaatatgttttttgctttgttttgttcttaaaagattgtcattttcctttgaaaattttcagctccttaatttcaaggcaacagaaatattacaaaacaagtttctttgattccagtgtattcttagaacacatttagcccgagattatatattatatggaaacctgaagatgatagttcctgcaataaatcagttttacatacaaagtgattcatcagttttcgattttacattgaaaaattatgggcttttctgtgaaaatttcacttacaagtcatattaacaagaattaatcagtgtcacaccaaaccataagacttagagtcattaggaattaattaaaactgcattattatggcaatgactcaagatcctctttttctgagttttttctgagaattactttgtatttgccatagttaattcattgagggggaaggatgtaaattctgaaaagaaattaattgaaaattgtagttaaattgcatgatagatagcttttgatcatgatcatttatttctagattttaatgattgtctaattcactgtaatttctttagacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtggtaggcgttttaaacgtattttaatactttaacttttagaaatatagttttagaaagtatatttagaaatatagtctcaaaaggttataaggattacattatataattatatttttattaactgtataaaacattttttcagccaactgacttactaattaatggtttaagtcttttcagctaccgtatgaggtggttctggccttgtactgcaaagaaagaagtattgctctttcagtaatcagattgccatacatgtagagtagatttggatacttgcattaatactatgttcttaggaattcagaagctaagaaaacgttgcattcctatgtgaatgttttctgccacccctttgagttggaacacacgtagaagtgcgtttctaattctttagctgatggtcttttagcttgcttatagaattctttaagtgacatgaataatgaggtcttacagcaggtgatgacagtaaatataactataaagttttatgccaaaggggatcattgagatgcaacatcatctagtcttctagttttgtagatgagaaaatagttcagttgagtgaggtaaatgatgtacttaataccacaattacgtagaaggagggagggagaaaatgtcatacaagcgtttttcacaaaatcatgaaaagattcaggttatcaagtttcttgttaaactagacttctctcctctactcctttttagatacactatcagtcaatagccagtcaccagtattcctgctagtctcttcctactctgtgttggtaggtaataagtatcatggagaactcaaaacacgtctcctctagtgggtttgattacctttccatagaatgttccttgtatattgcattttataggataatatcataggttatgtagcagagattcataaaatgacctcatctttattcaaaacagggctaattcttttgctgtttttggagtagagttctaaatatcttattttcattaactgatttaaaaatatattttatataagaaatgtgcaggcatgaaaatcataggaattggtaaaagtcttaaggaaagtaaaaaaatttgggggaatgattggtttgtacttatatacaaatacaaaaatctttgggttgaatttttagttaaaactttcaataatttactttctctgttgtttttcatcataatagttgttttgtaatcagcattagaagacaaataaatattgatactattcaagtaaaaggccagctaattttagcttcgcaagtcgtgttacctctcttttcatgtagaaattccccttcagaaatttttttctgaaaagattagcaggtacctattagcctctgaactctggtctgcattcttctctcccaaacagtgaccttttaccacatgtccattcatatgggcagtgctgataattggttcatttagtaacagtagcctccggatgagaactagatgagagaagcttattaattgaaatggtttccaaaaaggattatttcacttacaagttgaaacatggtgtgtttcccctactgaatcagtattctagtgaaacatacacaatatattgtatgcatgagaaaaatcattttattggcatctggccaacaattgtctaattcctatgctatacaatttatcataattttgctatcagagaaggagtgcatgtaaaattattttgccttatatccttttttaaaaaattactatagtagcagctccttatgtcactctaaattttatttactccttatctgtcattcgatatttcagtagatctttatgtgatagtaaaagaattgtgagccaggctttgtggtatgcacctgtaatcccagctacatgggaggctgaggtagaaggatcgcttgagtccaggagttcaaggctgcagtgagtcatggttgtggcactgcacagcagtgggcaacagaaggagaccctgctcaaaaaaaaaaaaaaaaaaaaaacccgaaacaattgtgcctcatatttacatagaatttaaaggttttcagccttttttacacatattacctaatgcaattcttttaacgaccctgtgaaattaagttttttggattcaggaacatgatcagagaagtcaagtatattttcctaaaaccctgaaattgttttatctttttattctgctaagttcctctataacttcttttcgttttagtttcctcatcttttctttttcaagatactattaagctataaaaatataaattttaatcaaaatatttttcttttaaaaatcaagattttaaagactgctttttatagtgaggagctacataatgtctatagcattctaaaggactttgtgccataaatatatccaaatacaaggctttttttttcatttgagaagttctattttaagaccttgatttttaaaattttaatttcataactttgcatgtatgaattagactgtttttattgtctgcattttaaattgtcatacatcatgttcagtcaaaataaattactttgtcttaattatgtaagcctgcctatgtgaatttatattgtcattggataccttccttagtacttacagattgaagattattactaaattgttttaaaaatgatattaaagatgtgcacttaaggtactaccagagtttagatgaattatttagtactagaaaacatgatttgggaaaataatgtataatatagtaagtgtaacaaatatatagaaaatctgaaactttctacatggaagtgggagaaatggtctaaaaatatttagagatttcagtttcatttctttaaattatttgcaaactgtaatacatatttactgtcattttaattcattattataaattatgtgatacagaccttaaatacaaaggtttttatttgctttcttaatttattaaaataattgctttactagaatgtatctaatattgttctttctttaaatattgactagaatgcttttctggttggaatttctcttaccaaattaatacaatggttagcagacaagtttttagattaatataactgtcattataaagatttaaatgaataacaaagctatttctgctattaatggacacaagaattttttttaccctaattccatctgaatttatttttatttttgataaagacaaaatgacacactagtagagacctagattgtattcccactttctcttaatgacctgtatgaccttgggcaaataccatgcacgcagactgagtttcttcatctgtacagtgagaatcattctgatacttgtcccagctacattattcgttgttgtgaagatgaagaggttgtacctaaaaaaaaatttggttagaataagtgagtaaagaaaaatgaagaaactatgaagttagacttataatgtctctagtgtgtttgtgactcttaatagacgtattggactgatttttttttaagcagttacttttaagatagttctcttgataaagttttcatgttctcatacctcagcattgtgtcctcatttgttgcctggttgctttgagtgacactgcttatatactataaatgtgtttatactctatcaatgaagcataatagccttatagtagttaagaaccaaataatgtttataacttcatgactgttagctttataactgtgctgcagattgtttaaagagcatgtttaagttgatgagttaagttgatgagtgtgctttttttgaaattagaaattcttatagcccacattttactctaatttgattgtgtatcagctgctgtttgcaaagtagattcatttatcaagggagaaagtgaaaataaaggttagtagagtgatccaatttcttattcttaaagaggagagttccttgattattaaagtgactccattgcatttaactgctagaaaaatttaattacagttcaaacattttcaaggtggggtagttcattcatgagaagggttgataatgcttaaaatgatatttaaaaagaagtcactgaattatttccacataacataatcttaaacacactttacattaaataaatagcattattaacattttagaactgattatgtaaagcatatgatatagcaaaactagaattaacatgtatttctaatttaaagggcaccttaagttttgagccagttatttgatttcagaactatttattcttcaggaatttaaattttggcttctatttcccaagattgaaatgggaggaaagtttgttaaaactaaaactttttatcttggactgagtgggaaaggatagattgtctcttaaattcctactggtaagactttctagcaagaaaaggcaagtatgataagtattttcgaatcttgtaaatttatatacatactcacctattttgaaaaagcagtattttatatactttgaagatattcttcatagggctgggcacagtggcccatacctataatcccagcactttgggaggtggaggtgggcctgagccctggagttcaaaaccagcctgggcaacatggtgaaactccatctctacaaaaaaatacaaaaactagtcaggcgtggaggtgtgcacctgtggtcccagctactcaggaggctgaagtgggaggatcacctgagtcccaggaggttgaggctgcagtgagccacgatcgtgccagtgcactccaaccttggtaacagagcaagatcctatctttaaaaaaaaaaaaaaaaaagatacctttcatagacaatggctttttattttattaacagacaatgggaaaactagctcagatattggctagcttatagtttgttttgtagtgtttggaaattagctcctttctgaatacatgttaacatcctgatgttggtatagaaacgaggtttgttgtttgtttctaaacggaaaaattaatgtgattttagaagccattatttcttatccattctgatcttgttgtggatataggaatactattaagaaattttaactttctttcagaattatattttttgttgctaaaaacttttttttttctgtgaaaggatcatatactggataacatacaaagaagactgtattctaaataatgaacttgtaagcatcctggaaacttgtacagtagggctattataaggactaatgcaggcagcaggaaatattcttactatgtttagtcagcagctctttgaaatttttctctttcacagtgaattaaaatggattgacatatgttcatgtggactaattttaaaaattaagccatacctgtggctggctgaatgttaaacagcttaaacatatatatatttttagttttattactctaccaagaagttaattaagttttaggaagtcatcaaaaagaaaaagtctcaaaaggttaaattacccagtaattttgcccttaactgtatgttgaagaaaatgaaaacaggtgtccacacaaaaagttgtatatgaatgctcatagcagcattattcatcataggcaaaaaaaaaaaaaaaaatgcagatgtccacctgatgactagattagcaaactgtatatatcatgcaatggaatattattcatcaaaagaaatgaagtgatacatgctataacatgaatgaaccttgaaaacatgtagagtgaaagaagccagtcacaaagaaccatatattctatgattccatttataggaaatgcctagcataggtagacctatagagacagaaagtagattagtggttgccttgggctggatgcagacagtgactactaaagggtatgttcctacttcttagggtgataaaaatatttgaaattgattattttgatagttgtacaactctgaatatccataaaaccattgaattgtacactttaaatgagtgatttgtatggtatatgaattatatctcaataaagctgttaccaaaaaaataaggggagatattctcagcttctgtctcacataaatttcacatacattgccttagagttgtatgtttttacagtagttattgtatcataaccactgtaaaaaatgttatccaacgtctttatataaaattatacagaattactgaaggcattttatgatttattgacttttgaccatcaccatccccccttgtttcctacgtagggccaaacagcctttgatgtagcagatgaagacattttaggatatttagaagagttgcaaaagaaacaaaatctggtatgtttgatgactaataattgcctatattacttaccttaataattttgaatttgagacaattacaaaagtattcttgtgatgttttgtactttttggttttaagttatccttaagtttcactaaatgatagtgaaagagaataaaggatggtgatatttagccttttgtgttgcttatccccatttctatttcctccccttctcaaaatgaatactcatatatgtcctcaagaataacgtttttataatttcattagagtgttttacttaaaagatggaatctataaaatctcatatatccaatagcaggtcctagataagcaaggagttatatcactagaaaacagtttttttttttttttggagatggggtctcactctgtcccaggctagagtacagtggcgcgatctcaactcactgcagcctccacctcctgggtctgagccattctcctgcctcagcctcctgagtagctcggactacaggtacacgccaccatgcctggctaattttttgtgttttagtagagatggggtttcaccatgttgcccaggctggtcttgaactcctgagctcaggcagtcctcccgccttggcctcccaaagtgctaggattacaggtgtgagccactgcgcccagccagaaacagttctttaagtaaaatatcctcagccagcctaagtggttagtggatctcgactttttcagtaaagttggagggatgtaaaaaatccatcttagccctgcatggagctttttaattgtctagtctatttcattctttattcaagctctttccttttcaggtaaaacttaatttatttatttctttgttttgtcttatttaatgtctgaaaaactactttgttattattttaaactctgcatcttagtaatagtatcttaatagttttcttattttcctttgcataactttgtacaaagctccatagtgaaaaacgggacaagaaatctccactaattgaatcaacagcaaatatggacaataatcagtcacagaagacctttaaaaagtgagtaaaatattcaagtacatttgttatttttgttaatgagttggcatagtggccacaggcatgattattgtggatctgggaagaatgaatatattttaaccttttgtatttctaatcatttgaacactgttttcctttaacagcaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacaggtaaaattaaaagataaatgcattttcgttgaattttgtggcagtgtaaaataagacaagatgagacgtaatttttaaatttttcagactgatttgctacttgtttagatacctgccacactactaaattatctttcagtgaatgctagaaacttacatatagttgtgaatttattattatttaattatctggaggctgttgttcacctctgcattttgccgacctatatttaaagaagttgcagaggcttctaagactccttaggtacagataggttgtgagtgggttctcagcaattgagaaatgctcctgttccttctgaggtccaaacgtccaggatgccggtcccaacagcatcccaaattttccctaagaaatagtaaagtaggaatggagtaaaaactctttcctgtgagggtgtgggggaatttgctttgttttgagaaattttaaagatacagaaaagtataataaacaaacattcatattccaacaacctcgacttaagactttaactactgtgacatttaatcatatttacttcaatttcttaaatgaagttaaaacattatagatgtcttttttggtcacccaccctagtctgcttccctttccttccttcaaaggcaatcactgtcatgagtttttttctgtaatcttctagttcatttttatagtcttacatatgtgtattcatatgtaacatataacaattataatattgttttgtgtttttttcatatggtaggaattgttatacatcttttttcactcaaaagttatgttttttatatttgtccataaatctatttctataacttgatctgcattttttttttttagctattgtatagtattctattaaatatgtctgtttccattctgatgaacatttaccttattctcaaactcctgggttcaagtgatcctcctcagcttctccagtagctgggacaacaagcacatgttaccatgcacatctaattttatttttgttttttgtagggttaactattttgctgaggctagtcttgaactcctgtcctcaagcaattctcccacctcagcctcccaaagtgctgggattacaggcatgagccattgtgctcaacctatagcctaaagttatttttatgcagttaatctcctccctgggagacattacttagctctcagtctgtagtcaagtatatcattacaaattaaactatgtgcacaagagagccaagacttgcacccagatctcctaacttgtattttaagtcttttactacttatgtagtataattcaagaactagaagtccaggcatctctttcaaagatttctaggtttttgttcactaaattttttcttcattagcccttgtttgtatacaagtcactgttcaatgttagacaccaaggaactatttaaaacaaacaagagaccttaggccagttttaccactaaccagcaaatcttctgctatcttttggttgaatttccttgattataaaatgagaaaaatcgggctatatgacctggatggttcttaaaactctagtattctattaaatataactaattaccatcaaattgcattgtatttgttcccggtttggaattgaaacgtactaattgctctctactcagtttctcactgagctaactttaaatgttcctttgaagcattgtactatgataattttgttcttcctgttgctagtggcagttgtgccaggaaaatttgactctgtctcaagaattaacccattgtaaacgctgtgtggttcctttcctctcactctcttaatatcagctaggctttatcatactttatttggaaagcttgagaaagcagccatttccctgtagagctacagcttaatttgacaatttgtaaaccatttgttctttctactttttgtaaggttatttccttgggaaactatttgacataaaataactattttgctgaattttgtaaaataaattatttgccaaaacagtttttcttcagtgttctttctcttctcataaagcagataaaaatgagagtgcaaccataagttttagttacctttcaaacaatttacaaatgtgaaagttagttgagaaaatgagaaagaagagtacatttttgcttttagggttctttcttctaggacttttttgttctttgttgaaatcaaatggatagaaagactacagcaatattaataacatttacaaagtaagttggatggtggggctgggtgctgtggatcatgctagtaatctcagtagtttgggagtccaagtctggaggattgcttaagctcacgagttcaagaccagcctgggcaacatggggaagccctgtctttacaaaaaaaacacaacaattagtaggtgtggtagcgcacacctgtagtcccagctactcaagaggctgaggtgggaagatcgcttgagcctgggtaacaggcttcagtgagccaagatcatgccactgtaccccaacctgggcaacagaacaagaccctgtctcaaagtaaataaataagttggatggtggtacatggggtttatcttatttgttatttatatctcctactagactgcaagtgaaggtattttgtcttttcattggctgatatatccctagtacctagggcactacttgaagaatggggacacttattatttgttgattgattctctacacagttaggtggattattttccaagaagatgatattgtgcccatttaactttagactttttaggagtgggaaaacatgctctttgggacatttaaccatactgtttgacaggaatgtaaggtaattattgacaaaagcacttttagatttccttgattaaagaggaaccatcagttttagatcagtaataatagttgtttatccattagaaaattgcatagctactgttaaggttttagttacattgcattcatgcattcaagttttaaatcttaaatttctttttattttcttcattttaaaagtacagaagtcagattctatttgtgcattttattgtcagaagctttgttgtgtatctttattatcttaactatttatttcagcatatatatagagacaagtctagaagctccctgaaaaactgacttgcgaaaaggaatcacagtggggaaagacttttagttaacaaaaccttaaacaaaaatggaatataaaatgattttttcccagccattgagaccaaatatatatggaatcttgactcttaattgtttgtctttaatagataagacaaaacccctggcttctgtaactaatgccaacacttctagtacacaagcagctcctgtagctgttacaacacctactgtgtcatcaggtcaagcaacacctacatcacctattaaaaaggtaagccaaaattgtatttgctgaaaatacatgtattctatttatgtaccacttggactaactcattaaagtaattctgaatttttatagtctgttccaaaaatatgtaagatttcagaatataaatatgtatttatgtttctcagttgaatgagatttcttctgaatcatgtttttttatcctttttgcaattgatattactgttgatattacagttggtagttaacaaatattacatacagttgatagttaataaatggcagaaagataaaaatttttgtaatattaaaatcagtgattgtattagttttttttttctattgaacttttattttgagaagctcaggttttatatcctttatctctattaagtagaggtgtgcatgttgataatttcacacacgggtaaattacaaatactactaccacaagtcaatgagagaactaaaatctaaattttttaaactcatagtacaaagcactaggcaggcaactttggtatgtcagtaggagcatgatctctgaggtcagataaaccagagatgagctcctgactctaccttattagttgttatgaccttgagcaagttacttactatcttccttttgtataacaaaataaagagaaatacagttaatattgtaaggattggttgagatagcctggccagtaaactgagtgtgttttcaaaatgttagtttcatttctttctcttctttctgttctctgtctgttctccatccctctcatctcttctctccaccgaagcagtgttttccagttagtgtgttaatctttttaagactttacgttttcctgcttctctggaacctatctttcttttaacccaaattaacgattaagagtttttgtttgtttatgtttgacctactagtctcttttcaaagatttctcttcacccgtccttttttttatctttttttatcatttccctctctgtccacacatacctttttttttaaccaaacccttgaaaaattgattgcagtaatcataacacttcatgcctaaatatgtcagtatgtatctcctagtacaaggctattcttcattctcaaaataatcacacttaggaaatttaactttggtataatactattatgttattaataactaatatacccagattttcccaattgtcctttgagtatttctgtttgttttttaaaatcaggggtccacttggattgtacattgtgtttagttgcctttgaacttcttattttgttgctcgtttgacattatgtgcatgagtttaaggactgattggtttttaaatcctcacagcatttctgttgtgttgtcagtcttgccaatatttggatttggctttaggtggtcaaaatatagatctttttgaaatcataaactgcagaataaaaaaaaaaatccctgctgttagtaataatccttctctcaaacttcccaaggaaggcagtaatgtaaattattagtggtagaaacgtgttggtttcattggtacatagtttgaatattgagaaactatgaatgacttatcttaccttatatattccaaaactgagggcttcttgaattcagttagaactcatgttcatatgataataattatgtatgcttcagttaagaaattctctaaaagcagtttgtctgcaaaattttgaagactgttaatcatcctataactagcgtcactataaactgctttaattaaagtttattttacttctaagacccccatgtacttcttcagtgaatactaaattcattcctgcatcttttgatctgtttagactataatgttatcagaaattccatctccctggaatacctaggcaagaaactggctatctttttttttttttttctttttgaggcagtcttgctctgtcacccaggctggagtgcaatggcacgatcttggctcattgcaacatctgcctcccgggtttaagcgattctcctgtctcagcctactgagtaacagggatcacaggcacctccaccacacctgactaattatatttttagtagagatgggttttcaccatgttagggtattctcgaactcctgaccttgtgatccgcccacccaaagtactggggttacaggcgtgagccactgcacccagcactggctctctatcttttgggtatttggctaagtaatccctttcctactacagtcaaatgattacggtaaacttcctgtgttcaattttctttttctttttctcacatatagccaacatttatggcaatgtagttctcaatttatacctaatgccctaactgaaaagaaatactttataacctctgttagtatagtgggccagtaatctctttgctgtaaaagttcttattcaaaatcactcttgattctgtaattaagctaatataataacatctgcttctaaatttgcatatttagaaactattttattctcagtttcaagcaccataacttactttgaagattatattgtttctttgttcttaaagttttgtaaccaaattttattcaaaacgatcatgtgtaaaaattttgaattttttttttttttttttttttttttgagacagagtttcactcttgtcacccaggctggggtgcagtggcgcaatctcggctcactgcaacctccacctcccagattcaagtgattctcctgcctcagcctcccgagtagctgaattacagacacctgccaccacacccagctaatttttgtatttttagtagagacggggtttcatcatgttggctgggttggtctcaaactcctgacctcaggtgatccacccgtctcggccttgcaaagtgctaggattacaggcatgagccaccgtgcctggcctgaaattttttttttaatgaagagggggagtccttttttttttttttttttttttttgagatggagtcttgctctgttgcccaggctggagtgcagtagcacgatctcggctcactgcaagctccgcctcccaagttcacgccattctcctgcctcagcctcccaagtagccgggactacaggcatccaccaccacacctggctaattttttgtatttttagtagagacggggtttcaccgtgttagccaggatggtctcgatctcctgacctcgtgatccacccgcctcagccttccaaggtgctgggattacaggcgtgagccaccatgcccagccgaagagggagtcttcttatcaatactgtatgacttttaaaacctgttattttcagtgattcttatactcctgtatctaatttagcatattagtattttttaaaattttttcaagtttatctgtaactttagtgacctaacattaaatttccttaaacaggttgttaatttctaattgcatcttaaaaggttttgcaattatctgtttttaggttcccagtcatgactccacttctaatatttagataaagttatcaagttctccagcttcctaccccagtacataaactatgtatgtgtgcacttgtgttcatggcaagacagatcacaaaaatggaagcacacgaaacagttttacatgcttattttcttttaataacttggggtaactatggtgaaagatagatgtgtttactttaattccttaacccttccgctgaaattaaagaactgtttctgtagcaatatcaagctgatgatttgtggagatgttatctataaaaccatcagtttgattttgtgcttaaaattgttaactaacaagtttatataagcctctctggtcaaaataaattttgttgggatctctaaagcagattatctattcttctatatgggtgtacattccaataaaatgtaaatggcattttctttacttgatggtaaaaattcagaatttttatggaattaagtgttctggttaattgaattcaatgtaatagctaataatttaacaaaagactgctatgtgctgtgggtatataaagtagtccaatcgaaacgtacagatgtagcatgatttaaaaggagaagaaattatatttgacttaaggtagtagaatcaggacattttagataaatcttaaagtaggtagtactccacctgagagaagaagggcttgtaaaccttgttgaaagggagagaagaaaaacaatatgagcaagtggggataatatggaatactttcgcaggaaaaatgaattgttccatttgattgatttatagggtgcatatatacaaagtaaacaggaaaagtagagctatattgcaggatgtcttcaactgtaggataacacttttataatttatttgataagtagtagtcgtggaagatgtttgaacaatgccatgagaggattattctttatagaatattattctgacagcagtgtacagatttgaagatgagaggcttattgagaaaaggtttattagaaagtcattgaagttgcccacaatgataagaatatgaactagagaagtgactctgggcttataaaggagaggagatttagagacttgacctctaatttatggatggaggaaaatgacagagaaggtctaacataattgtgaagtttgaaacataggagattgaagagatatacttagtgccattaacagaattagggaactgaagaagagatggtttggaagtaaaggtgttttattttagacatactgagtttcaagttttcagttatagttctagattgtccactctagaatagtgtggtagaattttacctagaatagacaggtaaaattaggactggaaatttaggagactggactggagaataacacatttgagaataagctgactacaattaatatttagcctgaggaagtaaagaccctcctcctaaccccccaggagaagaaagtagaaagagaatatgagagatccaagagcaggctctggaagggctagcacaaggaaagttgtacacacacacacacacaaacacacacagcctgtataaggaacgttacacacacacacacacacacacacacacacgcacacacagagtcagtcaagaaaaggaatggtcagagtaaaaagaaaaagaaggtgaagatagtgtccagtaaaaaaagccaaagaagagagtttaatggaggaggaggtatagttaagtatttcaggaagggtttatttatatatcaagtaaaattaaaaggtgcttttagacatataaagcagtacttaaatccaagttcatgttgggcagagtggaggtatatcagccattacagtgtaacaaatgcccatttcaaaattgatagatagtactgcctcgtttttctcaactctaaaataacagtaatagtagtatttcattgggtaattataaggttgaaacaggataacccatgtgaagcacttagctgagggtcacacactagtaaatatttgttaaatgttagcttcatttataacaataaatgttagcttcatttataacaataaatgttatctgactgactgactctggctgttttataatgggggaaaaaacgtttgtttccaggttttttgtttgtttttttgtttctgttttttgaggaggtgggagacctaatgtgggtgttggcaaactatggctggtgggccaaacctagcccattacctgtttttgtatagcaaactggttggagaaaaaaaataaaaaaaagtcattgtccctaaagttttattggttacagccacactcaatcatttgtgtattaatattatctgtgttccacaaagcctagcatttacagtgtagccctgtaaactcaccaatcaataagcagctgtctcagtacctatcatattgcacagaatattagagttcgcaaactttcttggtcattggagcccctagtgtttggtaggattttttcacagtgccactggcaaaaggaattgcctgtttgtctcattaagtagtttgatggaaatgtgatcaaaatggcagtttgtgcagtgtctatgagatgtcactgtgcttctctcaaaactttaaaatattctacagagcccccgtgattttgttgtgacactctggagcactttggtgcacattttaggaactgaggaatgcttagacactattgatagcaattcattactggaagtaccagaggtatatctttataacagttttgtccatgaagtggccctcaagcatcatcatgggggctttaacaagccctgttaacctgctaattatagcaaatgttggcaatagatatgaaagaaatgatttttaaaaaattattaataccctatgcttgtggcaactagttagttgctgtattcaccaatctatatagttaactgtggttgagtatagaatttctagaagtgaagttgatgaagtgatctaaagataacagaggttgcatttttagggttgttggaaagcccttaaaatagcataaatatttgtacataaaattagtttttattatagttgaaatagttaatgtttggtggggaaatcagtaaatttaaggctgtgatgttaaaaaaaaaagtattataattggaaaaatatcagttactagtttttgttgattatattggacacaaaattttttaaccagagtatatacatggattaaaaacaaaattcatgtgcagtagtttgttcagtcacatgctatattatctactctgtatgccttttaattgctttagaagtttattagatttttttcagattatctcatgctaaaattagaacttgttcccagtgacttttaaagattggatcattacccaattattggggttaattataaaattattttcaaatgaagaaaatattttttgttcataacttcccttttctgttttcatgctttcaatctttgtctctttacctgtcttattttaattggctttagtatgatttcattgctcctatcatgcctgtggtggaatcagtagatcctgcatcatggaggcagggcttgcgcaaaactggcattgttcttgtgcccagtaagggtgaaaaatctatggtgaggcatttctatgtgcaagaatttatattaggttacaacataacaagtttaatataaattggttccaaagatgcatggttttaagtccttatggtgtgctcatttctgttttctgtatttgcatcataatttttctgtgtgatataaagtgtgtagtgtgttttcttaagtctaacccctaggaaggtagtctatttctttaaaatttttagatctttacattttttactaagacattaacctatgtagtaaaagtgttttatcctgaaactgtaaaccataattttaaatatattatctgtaaacttattgtttccaatttaaggactgatcagctttacaaattcttttttcttttcctaaaaaataaaataaacacagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggtaatctatttcacagtctggtttctatgaaaactgttatgatttcttttccaggaacatcaaatctggtagattttctgctagttatctttagatctaggtatcaagttaattaaccttaatgaattacataagacaaatgtaatttatacagaattataaatactggaaagatcagatgtatttgcctaaaacataaattatgggactatactccgttaaaggaatctattaccttacttgagaatttataatagaactgtattaaggagcaggcttattttgtttattatgattcaagaaactttctgaagtttaaaaaacataggaacacatttattctagaatgttagtatactcataagttacatttattcagtatctgaaaaaaaataccagatttttcatctaccatattacaagcaactttgtcttaatgagtaaatttaataactattttgagaggtggtattaatactgcattatataggatgtaccacagtttattcaatactagtatttatttctacagcatattcagtgcttgaactattttttttgcccatacagttttctttctatacttagaaatgtttccttatatcagaaattcagatgaaatttctcatcaagtaattctaatatttttgcttttttatcagtttactgtgcagttggtttccaggtattttatgccagcttactaggaatgtatcagagtgtcattgtcactacacactcttagccatatttggataaatataatttaaataatatttgttttgactattttgatgtatttgagagcattgattatcaaggttctaaatagcttatataatataaatgcttgagacctctcagtgaacaatatttgaaagtttatttctctggaagaaataaagatatttcagcttatgacacagtattaatctgttagagaagttttagaaaaagtcattaaaatctggagaaatttttttcctttcttagtaaaatattatctgattccaggctaaaagagaaagaaaactaatttgaacaggctgattattgattgacattaattttagagttcagctaggaattgttgaaatactgtaaactatgatagctatgtaattataattattgaataaccttttcttaatacttttagcattgcctatagtcagtacccaaattaatttttacttatttttttccctgttgtgtaggagaaagatagtaaaggaactaggcttgcatatgttgcacctacaataccaagacgactagccagtacatctgacattgaagagaaagaaaacaggtgagtttattttgatttgctttatgcattcactataaaatctttattatctagcattagagttaatacatgagcattgtaattatgtgcggatatgtattgtgggaagagatggaggatattcctgaaggagaaaataccaggtacatagtcctgaggaggtgcaggcttggtatgttcatgaaataatagcaaagaagatgtggctggaacagagtaaggggaaagtgggaggagataaggtcatgaactagtatgagttctctaaatatttggaacatttaggaaaggggaaagaagaaggaaagcccttacttaatcattttagtttgttttaaatatttttgtttaaatattgtttaaatattttagtttcttcctgtttttcagcttatagaattttatttttttaatttaattatttttatttttatttttattttttttgagacagagtctcgctctgtcacccacgctggagtgcagtggcgcaatctcggctcactgcaacctccacctctcaggttcaagtagttctctgcctcagcctctcaagtggctgggattacaggcacctgccaccctgctcagctaatttttttatttttagtagagacagggtttcaccatcttggccaggctggtcttgaactcttgaccttgtgatccacctgtctcggcctctcaaagtgctgggttacaggtgtgaaccactgcacccggccaataactttttaatatacttttaatcatgttataatatctaatttttttatttttttcccctaagatctcataagcagtcttctatgttaatatatatttttaataagcattttttttgtcggcacataacatactataaagtagatcttctgcggttaaagtaagcatctcccctactttatattttgtgatcaaaaagcatatttctataaatatctgaattttcccccatacttaggggaaaaattataccttagggtatataatcttagtactgaaattactttatcttcttgattagtattcctaagtgtcctcccaaaggtttttactagtttcagcttatactaatatttactagtgtaccgctttcttaatcctattttaaaattatgtaccagaatctgaagggtgttcttttaacagagattcttcaagtttgcgaacaagtagttcatatacaaggagaaaatgggaagatgatcttaaaaaaaatagctcagttaatgaaggatcaacgtatcataaaaggtaataatactattcttaagcggtttttatgtattcatttataaaaatatgaggcaatttgtttggagccctcagtttaacatcattttaaacaaatatgtgtttttattaaatacgagtttttgttgtttaaaacttactctaaacacaggatatatatttaaagataggtgataatttgttatgcctattatataattaagcttcaaatattatgaaatgttttttggattgttacatatttaaaaggaactcctttagaaggaactccttgactagaacaacttaaacaggccagtgtcttaatggatctagttgtcattgttgatctggaaagatttggcttgccctagaactcagagctatggaaatgccttcagttggaatgttggtagtatcatattgaagaggaaaaaaaagccctataaacaatttctttactaaaagcaaccaaaaagaataagatgtgaacaagtatcatgtaggcattggttacttccgaggtatctgacccattgctgaaataatttccttcaaaaaaatgtcaacgtcttgttttccctgggtaatacaaaaccaaagtgtgtttttcaggctcagcctggcatgaccatatggtgtggaatagtttcaaaaatatgaaatatcagatcatctttgtcttgttgagaaagttgggaggaggcactaaaatgatacactaccgaattaagtgaaatcttctaaactctagcaagttgtagatgcaactcttggtgctggagctggtggtgtatttaggaacacagtttttaaattttttttctagccttgtaatttatataatgtatagacattaactatagaatacacatacaaacacatcctatatagatatgactcttttgtttagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcaggtaagtcacagatacattttgtgctcaggtctactgtgtgcttatgtatgtgcatgcgtttttgtttagaagattgtggggctctggattttttcatttatcttgttaaatttatttgcagacaaaaattggttccaaaatgaggcaattatgcatgtctgggggaaattttaagttcctgaactatgaactttccttgaattagactgcttaaaatgtaaatttctctctttgacaactctgggtgagctttttggttcataatttaaggatgtctcaccttgcgttttaaaaaaatccatccctgtagtcatgtgttttcagctgctagaaagtgctttcattgtttagctgttttccttttctcttttttgtgttgctgcttatgatgctatagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcaggtgtgtaaaggtcataacagtactgctgatatatcttgcccagtgatgaaagttgttttttgttttaaaaaagatcttgtgaggttgatggccatctctccagtagactaataaatgaaataccctgtcagctcagaactatgtaaatttatacaactagcaattatttatatttaggctttgcgactcacctctgacagaattaatgtttttttgtttaaagtcagtgagcaagacagttgttttcttaaacattttagtttctaaggtggtttatttcaaaaaaaattttttgatgaagaactgaaaacaccacacacttagggaaaattagatgcaacatgacaaaaacaggttttatcattcttctcattgtttcctcccattattaagaaatttgaaggatgttgaactgttttgttcctgttgatttggagaatttcttctcttggtaaggaaagacttctgtgcataagtgtaagccaaataattttgagtatgttgaatacattcatttaattttatctctgatacatagaaagcacttattcagattttttcaaagagtctgaatttattttgtgtgcttaaatatttttaaaagattgctcacttctttctgttgctgcctactggcatggaatcatagatgtacaaaggagcttactaactatcttttgggatttccttgctttaccgaaggaaactgagacccagagataatatgtgactattttacttttgtatgctttattggtgtgagggctgaggctagccccaagattgcaggaaaagtagttcagttctttctgctatattatgcatagtccctagctttttttttcctcttgaaaaaaaataaaaccttaggaaaccaaatgtgagctttatttttatattttattcttgcaaaattaaatgaactatgtaactaatttttttttttactaaaatactgaccagattaactttgttttatttctgtcacgtagtacttacatacagagttctttttctctgttgcctactgaagtgcctggcctgtagtagtaatggcctcacagtaatatttgtgtttgaatatatgaaaagtaataagttagtgttaacttttttttctatcattgcatctttagtttttgcctatatttaggttttgtttctatttctatggtgaaatttagtggtacttttataatgccactgcaagtggttagtattttgtgatttgagtaccagtataggtcatattatattttaattatcttcccctttttcctataaacttaagtcagttttaggttgttgtagtgcttctcagtaagaccacagagccaacagaaattagtatccatcatttaatcaaacttaaataagtttgagggctttgctttttttggtggtggggttgggaggggttattgaaaggaagaaggatcagaagttcttggtttcttactccttactctgccttgattcttaaggttagaattatctttgagtcagaaactcttctgttaaatgaggtgtttgatttatattatttttaacttctagaatcttttctatctctagcatagagattcagtgcttttgaaaatttctccagtgacaaaacctaataaatgtctccccagaatcatcagttgtttcagaacaaattatgattcttaacccacagattgtttattctgctaaagagaattgagttttgacttttagaattagtcctaattagttttaatggaagacattgaagattgaaaattaaacgcttggatatatttttaaacaaacagattctaattgcataagaaaaaaatgtggcaacattttttctcgtctatattatagaggttttttgtttgtcttaaccttgtttcaatgatgtttgcagtgatattgtttgtgttttgttccatgtgaaataattgtttgcaatcttgaatacattgttggcctcttctctttgtcttttatttaaatttcgtcagtggttctgaaatgtatatgatttaaaatttgcctaaaaaatgtatatatgttgatttgagaatatactgtggctaaaacaaaaaaagtcaacacaggtataccctttgggttgctcagaaaatggtaagcatctaaggaataaaattatataccctatatagttctaagaaagagatgcagtaggtcagtgtgatacagcaatgataaaggcaactatggggtttggtgggtatattctaccatcttttaatgatcagctctttgcaattaaaagtacataaaatatataaattatttttcttctctatgtcgtattcttagaggtctcctctagataggtaccccaaaggaggagaaaggaactgaatattaggtggtaattatcaaataaaggaaatgtgtttatattacaaattgataagctatatttttatgctaatttgggatgaatgtcatatggaaaattaaaattatctgcaggtgcagattttatgtatttcagttagtaacttttatccccctaaccttcatatgtgaaaccaggtatgatagatttattgactttcatggcaatttgaaactattgaaaaggaatccaggctcatagggagagagtgtagtggttgatagtactatttgccatggtactaaaaaagagccaagtgtcaatgcaagtttctctgttatacactaaatatgaaacatttcactgtagtcaaatttgacagtagttcacgttcatatttagtttcagagcagctcatgaaatgctaaagtgatagcatgcaccctatctgtcttgctatgaactttttttttccaagacaggatctctgtcacccaggctgtagtgtggtggtgtgatgatagcttctgcagccatgacctcctgggctcaagcgatcctctcacctcagcctcctgagtagctaggactacaggtgtgccatcacacccagctaattttttaaatttttgtagagatggagtcttgctatgttgcctaggctggtctcaaactcctggccacaagcagtcttcccaccttgacctcccagcgtgctggaatacaggcatgagcaactgtacccagcctgctataagctttgtttaaccagattaacgatcacatttaggtttcatctccttttattttttcttctcttcctttggtagaagtccaaaaagtaataacttgcatagggccagtaggtacataaattaaatgaatgaatggaaaaaatagccattggacattttccaggctgatgttcttaggagcacttttctatatttactgaatatgccacaaaatgggtcaggggtggaggattctctatttaaatggtcttgggaagtactgagttaagccaagttaatataggttatatctctgattgtatcacagacctttcaatattttattgtgattttcctagagaaggttagaatgtatagcatttccctaatttatgcaatcattttctataacaagcccctcttatatcccagaattaatgtttcttaaattttaataacaagattattagttattctcttattccttttgaattacttgtcccaggaaactcactataataattataaaaacatagtatctgttatatctaaataaaattaaagtcaaagtataatagtgatggaattttcatcttaatataagtatgttggatgtcccattcaagtaaaactccctcttgtaaatttcttgacttagctacaaatgtaattatgtggaaacagcaagaagaaccagttttctgaactaattttaagcaataagtaagagttaattgatgaaattgaggcaactaagatcttgcgtgagaaattacctggtcatcttagggttaattgtctaaggaggtgaatgctaagaatagtgtcatatattctagttttagagaaacagattccaaaaatttcagggttgtagaaagaaatatgatttccttatatatataaaaagaatgagggctctctaaaaggagttttgaaaaaatggtagatgattctaaggatgtttgaagatacgctatactcgctgaactgagagctttaaaggacacagagaaaaggcataaaactgacagtaaattcagaggtttgttatgattgtatgaatagtgttaggctaaaaaaatgaattacaaattgagaagaatgttaaagctaacaaaagaaagaggcttttttttttttttttttttttttttttttttttttttttgagacagagttttgctctagttgcccaggctggagtgcaatggcgcaatctcagctcactgcaatctccacctcccaggttcaagcagttctcctgcctcagcctcctgagtagctaggattacaggcatgcgccaccacgcccggctaattttgtatttttaatagagatggggtttctccatgttggtcaggctggtctcaaactcctgacctcaggtgatccgcctgcctcggcctcccaaactactgggattacaggcatgagccaccgcgcccagccaagaaagagccttttttaaaagtagcatttgagctgggcacagtggctcatgcctgtaatcccagcactttgggaggctgaggtgggcggatcacgaggtcagaagatcaagaccatcctggctaacagggtgaaaccccgtctctactaaaaatacaaaaaattagccaggcgtggtggcagacgcctgtagtctcaactactcgggaggctgaggcaggagaatggtgtgaacccaggaggcaaagcttgcagtgagccaagatcgcgccactgcactctagcctgggcgacagagcgagactccgtttcaaaaaaaaaaaaaaaaaagtagcatttgaataaagaaaactcactagatcattgcctggggttttgagagggagatacatggagtaaacttaataaatttaaacagcatagaagatagagatacagttgacccttgaacaatgcaagggttaggggtgctgactccctgtgcagtcaaaaatttgcgtaaaacttttgagtccccctaatctaaattaatagcctaccattgactgccagccttaccaataacataagcagttgattagcacatatattgtatgttacatatattatgtactgtattcttactataaagctagctagagaaaagaatgttattaagataatcataaggaagaaaattgtatttactactcattaagtggaagtgggccatcataaaggtcagaattctcttcgtcttcacactgaggaggaagaggagggattggtcttgctatctcagaggtggtggaggtggaaggaggcagaagaggcaggcacacttggtgtaactttcatataagtggacctgcacagttcaaacttgtgttgttcagcagtcaactgtactctggttctataagtgttctctgagaaatgtgagctaggtggtgtaatttgatgaagcgttaatgattgaacttcccaagaaatattgattatcagaggaaagtctttatgttgtgttgcagggctctgtcatatctttgcttgtttgactctttaattatttaacttttttttttgagtctcaattctgtcacccacgctgcggggtggtacaatctcagctcactgcagccttgatctccaggctcaggtgatcctctcatctcagcctcccgagtaactgggagtacaggcatgtgccacatgcctggctaatttttctatttttttgtagcgacaggtttcctcatgtttcccaggctgggctcgaattcctgggctcaagcaatcagcctgcttcagccttccaatgtgctggaattacaggcatgacccaccacacccagccctacttaacttttgacacagattacttgctattgaaaaggtgcataccccgtgacaagaggaaacataggcttaaatttataagaagaaatttagtgaggataaatgccaagtcctgttctttatatcagaaaatcagttacttagaagtaacatgctgatttaaaagctgtttatatataaaaaaacactggaattttttagagcactcaaaagtatgaacaataatatgttgtctgacgtgtcattagtaagagcacactgacaagaatgcagggagaccgggcgcggtggcccacgcctttaatcccaacaccctctgaggtcgagacaggcagatcacttgaggtcaggagttcgagaccagcctggccaacatggatgaaaccccatctccactaaaaataaaaaaattagtcgggcgtggtggtatgtgcaggtagtcccagctactcaggaggctgaggtgagagaatcacttgaacccgggaggcagaggttacagtgagctgagatcgcgccactgcactccagcctgggcgacagagcgagactttgtctcaaaaaaaaacaaaacaaacaaaaaaaagatttagaaaggaatttgatacctgtcttccaatatttgaaaatactgtaggtagagaataatttaaaaccccttttagtaggtcattaagtaagatgcttagattatcacttttgggggatgttttcagggctggagaagaggaccttcctcagttaaaaacagacaaaaaatttactccttatccattctgcttaattgggctaaatgaaatccttctatttttttcaatagagctaaaatttttaatcttcagttctctaaatcctttttaaaaatgtggttccatcttaaaattaaattacattattttaaaaaatgtagttaggaagttaaaatgtgatgttaaaatataattattaaaatataactagttccaatctaaaaagaaattataagattgcattattgaatttcaaagaccattttctgaagacttttccttaaaacttactaagatattaaacctgtatgttttattcatatgcattgatagatatttacattcacaggtattgtatttacaactaacgatttttcaatttactactgtagatcatacctcactcctgttagggatgaagagtctgaatcccaaagaaaagcaagatctagacaagcaagacaatctagaagatcaacacaggtatagttaatgtaattaatatataaaacttacataagtagcatataaaatatatatacacacactgacataaaacaagttacctttctctttttcactttgttgtgaaaatattgatgtcagtatatagtgtgagtaaatccttaaaaggtaaaggttgctgtagttattctagtaattctagtgtgaataaatccttaaaaggtaaaggttgctcatagccttttgtatggttacactgctactattgtatttcatctaattagcatatgcctttgtgtctttttgagtattttttaaatccttattcctaatacagtgtctggcccagagtatttggttagaataaattaatcatatgatgtctaataagtatttaaaagttctatgaatatttggaaatcgggggcagagaataggctcgtatattaggtataaacaactaatatgcaagtatgaagaaaatgtcattcaggctggcgatctccttacctccgttttgccattctgattatgctgtatatgatgtatacttttgtgtctttctgctttcccacagttaagaagctccacagtccagattcagctgtctatccttaccattacttagctttcaagctgaactatttgctagggccttaatatactttttctgtctttatacttttcacttcttgaaatctaacctgttcttcaaggtcaaatcttgaaaaatttatcgaaatctcttttaagccttaacaatcatcatgcatgtgtatatagatacatatacacacatatatatacacacacacagacatatatataaacataaatatttataatatacaaacagtacagatactggctattcttctctagtttgaacttgtggggaacatttatatgcatagagtatccagtacctatcgttgtgcttgctaatggtgattcttcatagaatgaatgtaacttgctgtttccatttgcaaaccaattttaaacatgcatatttgacttttaatgcatttgtatgtaatatatctatttctaaaatattccttgaaacaagctttaatgcatctcataattatattgatctttttgtgtgtgcagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgaggtaacagtatatcaaaagcacatttaagtcaaatggtatgaatagtccttatgatccttaacatacaagagatttatataccaacaaaccatatgcaaaatactgtaaaggattttagctggaaatttgaattactttggcgtgattagtatactactttttctttgaaatgaatttttaagtatttttatgtttttaattgtgtttaatgtttcaaatgggttttgatcttaatgtttcacagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagaggtaagaataccaaattttgaaaacactttgctttcttcatataatcctttggattagggtttcctaaataataattcaacagtaaaggaacagcatcctaacttgtgattcatcgaacctaaacagaaagaatatgaaggttgagaatgagaaaagtagaaaacagaaatagaatatggcctgctgttgatactaatatttttataacctaatacttcacaaaaatcttcatgtccacctacaacgaaaagttaatatcgaactggtgggtgactatttctagaagcagtttactagtgtagtacttctcagatgctttaagctatttcttgcctactgtgtagatcatatcatttaaatgtttttttgtgaaattgttgtaaactaaaattactaactacatgtaatgctctcactaaaacacatttttatgcttatttcttaaaaaatacatttctttctcaactatatattggcatattgatactcattaccatttcctattattttatataaactttctatttaaattctgagtaattcctactttaaatcagatataagtactaaatataggcatttcatattttaaagcctaaatcttacagtattagtcatgataatatcagtagtaatgtagaataaacagcagaaaataaagttttttcccaatttccagctatatattttctcatgttgatcattgagatgtttcagttctttaaacttctatgtgtgaggcctgcattgtgtttgtaaaaatgttgaaccaacatttaaaattagagatactcacttcaaacttcagatttttgccatttcttgaaaagttggctgacctggcaacactggatctgaattctcacataccaacaattggctggagctaagtagtagcagctgcctaccttccatccccctagatagtcccctggcccattttacccattgtttttacaattaccttgcaaaatattgtcaagatatattgctatattgtggttcattgcaatccttaacagagggagaaaaaagagaagaggagaaagaaggagaagataaatcacaacctaaatcaatcagagaacgacgacgaccaagagagaaaagaagatctacaggagtttcattttggacacaagatgtgagaacctattaaaatacattatttgatagtattcttgatagtattcttaatgtgtccaaaaatacatactaataatttcttatatgccttagatttcatattccttaaatcatcactgtgttttctgagttgttaaataagaaaaattatttttaaggatagttaactacttagattgttggtactacttaaaaggagtggttctgacctaattatggaatagaaataataatgtctgaagctcagagtgcatgtattgattattttataataggtaaactgcttcttgtaaaaacatcttttaagaatttctaaggagtctatttaatttcattttcataaatatcattataagatctacattacagattacttccatctcaaagcatgctaaatagacacagtgctttgcttatcaaattacaacagtcttgtaaaaattagtgttttcctggtccttgattgtaggcctgacattgctattcattgattttgtttccattttctaaaaaataaaccttttattgaagtatggcatgtttagaaacataattcatacatgtatagcttaatggattagcacaataggagcatatctatgtaatcaccactcagaatgatgaataaaaacagcagtgtagattgcccccatgttctccctctcaatccctatcatcctcattttcaaagtcagctagtatcctgatttctaacaccgtagttaactatgcctgtttttgaagagcatatgactagaactataaattttataactgttatgtttataagatatatctatgctattttatgtagcagtacatttacttctattgttataaaaatattttttaaagaaaatttctaactattctttcactgaaagaacatggaatcatctgtcttcctgttaaactgacccatctctcactatatgttcctctttatctctaatattatatctgaccttaaattctgcttttttgaaaagcttccttttgattatctttgtataatatatcttttctgttattttcaatttatttgtgttttttttaataaacaacatatttaggtcaacttttttctgaacttttttttaattgcagtgtttcagtccattttaattttacttaattactaattacttaattacatgaaacaaataacattgtcatttgcagtttaaaatatataaagagctaaggcatatgaaaacaatagcacaaaaatatgggaaagtattaaatggagttgaagagttttagtatcttcgcattgtccatgctgtggacaaaatatatattcaacttgatgaatcaagagtgcatatgtctatttaaaaaagtttaaaaagagagggaaaatcatacataaatgacaaagaagggaagaacagatggggaaatcggaaaatagttttctatttttcttttgatttttaatatagaaaagttaaacatatactttatagaagtaacataatagtataatgagccctacccccagtattcattttttcagctaaattcccactccatctcccaactcccatattatttagaagaaaatcctagacatctcattctatctacaaatgtctcaatgtatattctgagagagaaggactcccaaaaataattttaaaaaataaattttgaaattattactaaaatttcctaaaatataaattggcaatctgtttttagagtgatgaaaatgaacaagaacaacaatcagacacagaagagggatccaataagaaagaaactcaggtaaataccattactttttgtattgagaagtattcatattttttaataattacttttaaattgcgttttattatgtttattcatgcaaagcagttattgcatactctacctacatgctgggtatgcaatatcagtgtttgcctggggatcaggattaaaaggactgggaagggtcacaaaataatgttttggaggtgatgaaaatgttctgagtcttgatcctagcagtggttttatggatatacagaactgccaaaactcaccaaattgtacactctaagtggatgtaatttaatgtatgtcatttaaccttcggagttaaaagaaaaagcaaaaaaagaaatagtacccttggccaaaggaaaatatctaaaggataatcagaagtagtggaaatccagaagtagtaggctcagattttatttctgtagattttatttcaaagttatgttctggagaatataggcatcttttaactttcttttacatatatttagaaatttagagtctccaacagatttttatgttgagaatctaaaagacatttttttcctctcagtactgatgaaggacctaaagcaagtttgaatgacaaggctgcacagccagcaagggttgaaagttcccccgacccccttcctgattgtttggctgtgtagaaagctaaaaaatattcaaaatatttctgttcatatgaggatagagctgaacaacacgagtctaaacctggcactgtctagcatgaaatagcattctggtcatattaatattattttcttcattttgagttgaagttccttaatagagctattacatttctttttagtcagcaaggatctacagtaatgtgaacaaaagttggttacctgtgctaggtgacggtgaacattattttagggccaagtttgcctattttgaccccacaattttattttatctttaggtggccagacaatgaggagtgaattggttctgaggttaaattatttgcaggcctaaagctttaactgttacctaaattttttggttatcagttatcagaactccccaatttacctatgtcccttctttattaaacaagaggggaggaaattagtaaaccatccccatctgacacctctcattgccttatcacgcagactccagcccccaccaggctggagtggaagggagattgtctggcttttaaagttgtaattttgaagcatattgatgtatactgtattttaagttttactgttaaaatcatatgagatacgttaagatgaagaggaacattgtttctaagacgaaaagtttttttattttcaatttaagtagtttttgtttactttagattgtttagagttcttttaaagtaatgaataacatataaataaatataacaaatataaataacaatatgaaacctaagtcaaactggattaaacaaagaaaatgtattgtactccagttatattctgcagtcctttgtgtcagcttcatcctcaggctgatgtacctcatagggataggattatagttggcttaggatagacagggcctatcactgaactgttgcagccattttgctaccaacatgggccatgtgtcatctcacctaaacctagtaactgctataccatgagaaaaaggaagaatggatgtagataaataaataaggtgcaatgtatgtgcatagatcaatattttctatattcacatagatattatgtgtccagaaaaggttggttagataacagtggttatctagagaatggagggatgaggaattacacaggaactttgtataccattatgtgaactttacaataccatagtcagaaagatatttctgaatatctttctatatattttaatcttttttatctttaaaaagatatttttactttggaaaattaatcttaaaatttggggaacaagggcgttatgctaaatgaaataagcaagttacaaaaagacaagaactgtgtgattccacttattttatttgggtatcatagaaacagaaagtagaacctttgttgccagagctaggaagaggaggacaaaggaagttgttcattggatatagagttttatttttgcaagatgaaaaagttctagcgatcttttgcacaacaatatgaatataattaaaaatactgaactatatactctaaaaaatggtttacatggtaaattttatattacgtggtttttaccacaattcttaaaagtttttaaataatgctaggccgggcatggtggctcacacctataagcccaacactctgggaggctgaggtgggaggactgcttgagcccaggagttcaagaccaacctgggcaacatagggagacactgtctccacagtaaatttaagaaattagtcggatgtgatggtgcatgcctgtagtcccagctaactaggaggctgaggcagaaggatcagttgggccaggaggtcgaggctgtagtgagctgtgatcatatcactgcactccagcctgggaaacagagcgacacctcatctcaaaaatagtaataataatcagtgataacaccatgatttttaaagataatggaatttgagtgatttctcactagactttttattgttaaaatttaaatcagtgaatgtaagtgcagactataaggtaagatgtattatttttgtttgatatgtagacattttagttcaggaatggccattttactgaatttgattatcttgaaaattgaaatttattctttaaaattgttagttgttgttaaaccaaagaataaatcaataaaagaaaacattaccttaaaaaacaatgtaaggagcaaagttaaaattggttttgcagaggaaatttacagactttagtaaaacatttttagtccaaaatagactttaaacaatcccaaaagtaacctagtaattttacagtatctccaaagataaatataatgggaaatcactaatatttaaattaagaagtttaacaaaccattctgaataaattatagaatcagtgagtatttcaatagaaaaagaaaaggctaaatttgactactgaaaaagactactttggcccccagtaagactgttttaccttattaatcatttcacgatttagataagactttctggaacttcagtgtagcataccacttgcttgagaaaattaaatttcctgtcacctaattgctgaccttaaaggtatatagctagatttcgagaaagtaaattttaaacaaaatatgtatatactgttatgcataaagaaccttaggtgttcattcgtttgcttctattgatactacattaaatttacttataatcataggttaatagtttaatgaaagcataaaaatttagtatgcctatgtttttctctttctttccagacggattccatttctaggtatgttttatttattttttaactgacatttttttcttatttttatctttgttaaaaatgtgttgctaggaatttatggattttgtaagtttatagaattatttgataataaaaaacaaattttgatggccttatcattgttactagctttctttgttaaaggctttacttcaagatcactagtcagagcaagtaagatttttccccaaatctctacaacaaaggtattccaaagtttcttaagttagttcaactatctcattattaacatcagggactgataaaacccacacttggccagaaatgtatttgattaagtattcagaatcttctcttgtagccctgctttagacaaaagagaaccagtgaagacacttttaaaaaagtgtcatctagctcaacccttaatcctagcacttggggaggctgaggcaggagcatcacttgagtccaggagttgaagaccagcatggacaacatcaagactccatctctaccaaaaaaaaaaaaaatttcttaattatccaggcataactgtatgctcctctatttctagctgctggggaggctgagtcagaaggatcacttgagctcccaggagctcaaggttatagtgagctatggttgtgccactgcactcctcactggatacagtgagaccctgtgtctttaaaaaaaaaaaaaaaaagtgtcacctaattcaaaattatccatcttttcagagaacctccactatatccttgattttgatctccattccatttctcttatcattgttaaccacagccctgtaagaccagtaataaatttctgtctactgatgattctattgaattgaaatgcagagccaatggcatctttcagaaaaggtaacctgaatttcagaaccagataataagagaattctcctttaccagtaagatatgtttttcctgcttaggacaaacccattacttgtcactttggatatactttatttcatcaaatctaagacattactcattttaaaacaccattgtgttacctactactgaaaaaaaggaaaggtgctaccaattaaactataatgcatcatcaattgtaagccattttctggttttggaaatattaaaatgtgggaggaagtgtacaatttaaaatattaatcattatatgaaaccagttttggcttttaaacatggaaattttgactctcttcctcaattaatggaaattagtagtattaaaaaaataggctgggtgcagtggctcattcctgtagtctcccagcactttgggaggctgaggcatgtgaattgcttgagcccaggagttcaagaccagcctgggcaacatggtgaaaccccatccctaccaaaagtacagaattaggcatggtggcatatgcctgtagtcccagcaacccaggaggctgaggtagaagaatcacttgagcccgagaagtcgagtctgcagtgacctgagatcatgccactgcactccaagctgggcagcagagtgagaccctatctaaaaaaataaaataacttcccacttattatatatcacaaaaattaatcagataacagagggagactgtgacctactcttttgaactgtcaagttatatgtgtactaggatgtatgttgttataattgtaaaagcctataacaaggttttttatttaaattaatcttttgaagatatgaaaccagttctacatcagctggtgatcgatatgattccttgctgggtcgctctggatcatacagttacttagaagaaagaaaaccttacagcagcaggctagaaaaggatgactcaactgactttaaaaaggtacttgggttatttagttatatttaataaaaagttatcttttatgttgagatactcattcaaatattattttaaaaactcataatgaaatgagtattttgaaataacttattttcagttttcggcaagtgatggttaagtagaatgtaaatagctgtttgtttattaaagggaagagaaagtcatccaagatgattttacatttaagtatctcaagtcattgctatgattgagctggaaaggagcgttcaataaatgggtgcacacaaatgtatacacactttgtttcttgttactaggaagcagccaaacagagaagatggcttttcctaagataatatattggtagtttttcataggtaactgaaaaacttggggcagctcaagtgctattaaggattgaagtaattaatgaataaatcgcagaaactatatcttcttattttgtgcttatagtaaacataaagtctgttggagaaggagaaagcttatggcatttgtacatgtccccagttatctggcagctatttgaattacatacttttttaaaagccaagttaggggaacgggtgagggagagaatcattttacattatgagtaagattcatcatttattcaataaagaactgaactatgctaagtagagagattctactcatgggtaaatggagatgaagatactatcttgctcttgtgggcattttccatgtagtggagagagaccttattacacagtcatactaatgactgtataataaataatggagacagttaacttgaagtagaaaagcaattttataaaagtatataacaaaagaaagtagattgatttccttggctgggtgcagtggctcacgcctgtaatcccagcactttgggaggctgtggcaggccatcacctgaggtcgggagttcgagaccagcctgaccaacatgaagaaacctcgtctctaccaaaaatacaaaattaccccaggtgtggtggcgcatgcctataatcccagctactcgggaggctgaggcaggagaatcacatgaacccaggaggcagaggttgcagtgagctgagaacacgccattgcactccagcctgggcaacaagaggaaaactgttatctcaaaaaaaaagaaagtggattgatttccaaaggaagtgtggtttcagccaaaaacggaaggattactaatagttaacgggcaaaaatgggtgagaaaattattccaaatagagtggaattacaagcacatagacctggtggggggagaatacatgatgcattggaataaataaattttaattatagctagtagagtggaagaaatattcatttgaggcagcagttgtataggctgagaccagatcatgcagtgccttataggccattgtaagatttttcgtatgctaagaacactgggaagccattcaagagtttttaatttgtgggtggaaatggaatggttggcctatgaaaattatgagattttcattttgaaaagttaattttagctcctatatataaaacagattagagggtgatcagggaattagaatagtttagataagagatgatcatagccagaattatggtggaagtagtaaagcagggataaggaagaaggagtgttaagaaagacgaaaagcattagaaaaggggaaggtcttggattttatcctggatttgaaatatttcaggaaatacgtcatttgccttttaactttactataagcaatgtagaagtataatgataaatacagctggtactccgtctcatttttgggaatgcaagagagagtgatgggcagaaaatctcacggactccaaataaagatcacagtgactccttagccctagctgcagttgctgtgcaggtatgtggtccctctttatcagataactgaatcttttttaagataacctgaaaagtccaatttttctgtgaagtcttgatttttgaatactggaactaattttaagactttatatgggacaaacacacttgcataacgaacagtctctgctttgcaaccatgaaggattttttaaatgtatcctttatagctcatatgctacattaagctgttttaatattgcaaagtaatcaatgagaaattttaaagtaataggagagcagaaaagtaatttgttcttttaccctaatttttatagctttatgaacaaattctagctgaaaatgaaaagctgaaggcacagctacatgatacaaatatggaactaacagatcttaaattacagttggaaaaggccacccaggtttgtacccttttctttttgttactctcaaggtaatggttgtgatttatcccatctaaaaatggtattaaaattttttctaatactctaaatagaagtttgataattggtaatagaagataatgctgtttatggatgatttactttttctggagtaaatttaaaaaatagtcatagtcaaaagtcaacttataaaaagccttttaataccaatgttgtggtatgtcaaggttttaaatgtttatttccagaataccaaatgtagcaagtcattaaaacattaaaagcatctatacagaatcatcttatagccatataaaaaattttataatagtttttgtttactacaaatattttatgtttgttcaagtaaaggttattttatattatagtgctggaagaagataattttaatcataactccttttgtaagttccttctatgcagcagtctagagaagataaatttggacaataaaattgggatggccaagcaaaactcacaaccttgtacatatgatctagcaattgtttcccaagccacttttccatttccatggaacattagttctgggagacaggaataggtacatcttctcctcatttccctcctttcaaaaaacaaaaaaaaagctttgtgatcaaagaaactagggaaatactacatattttacatgttaaagactttacagggtctatttatatgctaaaggctctaaggcatcctgtaatttttaagaaaacaaatgtgttcaattttaacctgggactttctagcataaacgtatttctgcagcacaactcttagaatccagctgaaagcatggatctaaaaacagcatatccagatctgtgaatgggactatgtactttttttggtcagtctttacactcatctttttcttaatttttaaaaattaattctaaaaaaacaacaacaaaacaaaaaccaaaaaagttcattctgtttgttgaacttaaacttgttaccagatcctttttttaaccattgttgtgttgtaaagcgattgtctgtgcacggtagctactatgccaaacttctagggttcaggctaacctcaccactcctcaaattccttcatgttaatggaggtttttgtaaagataaacagaaaagtaaaacagaacaagaataggtttcatagtgagatgtcataaaaacttacagtgtcatacacattaaaactactacttatatttaggcttcatggtaaactggaatgtttagcagaaaagttaacagtaaaaatacctaaactgatgttgctgttttttaatcagtgaacttgtcatcatccttcaggttgcattagtatcttagtgagcctgtatacataaaaatataatgagttctctgagcatagcttcagctctagggatttcattataatgttctaagtaaagatgtccactgcagccaggcgcggtggctcacgcctgtaattccagcactttgggagtccaaggtgggcggatcacctgaggtcacgagctcgagaccagcctggccaacatagtgaaacctcatctctactaaaaatacagaaaaaatagctgggtgtggtggtgggcgcctgtagtcccagctacttgggagctgaggcaggagaattgcttgaacccgggaggtggaggttgcagtaagccaagatcgtgccactgcaactccagcctgggtgacagagcaagactccatctcaaataaataaataaataaatatccactgctccctactatagtgttctgtcatggtgactcagctcatctgtgtctccgctacttaatgccttctctgtgttctgctctgctgcctacttcattgtcatgtaattcttcctgtatgtctctcagtcaaaccctgcaagagaggggaattgatagaattagcctgttactacccagtatggagcagcctgttttgttagtgaccatttcataggtcactggacagaaagttgcctgtgggtcaggtaccaatttctgttacctggcaagagaagtaggattaaaaaatatcccagcttctgccttggcaggtactctgagtatcgcatccagtatgctgagttaataatgagaagtataattcataaaagtaaaactgataagcattaaagtaactttaatcaggggttcaactttcaggtatttatcctgaatctactgtgaacttttccaccttttttttttggcattgattgacttcataactattcacaaatacacaaatatttgcgtcagatatttgccacaaatagcagtggcagttttgatagttgcatgaaattaatcttgaagtttaggtctgtttgatactatttagccaagagactctggaatccttgactcttgccctagcccaggtaccctccttcccatatcatctccaaggaagggaaaaaatatgccagcttaccagaaccagtttgctgaataccactttgccaaatgaccatttcaccagatttaaccattgtgattttaacagctttaactggaatgtttaacaagaaagttaactaagtaaaaatactatctaaactgatgttaatgttttctaatcaatgaaattggcaaaccacatataattgctaaaatcttcccatatgaaaaaatctccagtgaaatgctatttttccatgttttgttaatttacatgtgttgttattattttggctatttgatttttttcaggtgcttttgaatgttatttaaaatttttttggtcttgtaaagagtttctatgatttatttttaaatcctcacgtggtgtatcagcctttgttttatatttctagcaattaaatgtttaaattcaaaaccaaaaataaatgagaattaactaagcagtcttattcatatttgaattattattttttttaatggatacagcatctcgctgtgtcactcaagctggagtgcagtggtacagtcagggctcactgcagcctcaatatccctggctcaagcaatcatcccaccttagcctcccaggtagttaggactacaggcaatgccaccacacctgtttaattttccttttttttttttttttttggtagagacggggtttcaccgtgttgcccaggctggtcttgaactcctgggctcaagtgatctgcccatctcagcctcacaaagtgttagaattacaggtgtaagccactacacccagcctcatatttgaaattctgaactgaatttctcacaagaaccaattggaatattgacttttatgtttccagaaagagtaagcacaaaagcttgaagccattttaaaataagagaaaaagtaagaaaacctagccatgattagttctttaaatgttacacaccataaccgtaaaaattgtgaaagagggatcaaaaagtgacttggttataagtcctagagatactaaaacatgaatactgaaagggttggcataaaagaaaattatgtaaagaaatatttttaaaattaccacatttaacagtgaaattgtgtttaatcaatatgtttttaaagcatattttgtggttagcactcataaagcattcttgttaaagtggtcaaaaaccatttttggtaaattagtaaaattggttattcagcaagttggcttttgaggaattcattttcagcaaattgaccaggaattccaagggagatgtttgtacagagatcaatgtaaataaaatctaagatgccactgtttttttctttttttttctttttttgttttgttcttaaactgtgcctgtgcttaatgtccagagctctccagtacaggatacaacaggtaggctaaaacccaaggtgcttttccatcccttaaagccaagcttatatatcaggatttcatcagctttgagctggtcagatagtacaggaagtggaaaaaatgaaaggcctgagctcaccagcagaagaaagctgtacagctagaatttcttataagtgaaagtggatgtgaaccaattgtggagcatggatgattggaaaagaaacctagagtgtgagccaagaccaagatagctgtgggagaagataaaaaggccagtttactggtctggctgcatggatacagagtcattcaacctgctgatgaatatatttcaatcaaggtcctggaatctgaccattctgattagccactcctgatggtgtaggaaaggaaagaatttgagcttcagaaggaaagctacagtttttttttgtttttcttccacatactcactcaccctcacgcccaactaaactatgaaagttcctggggaaaagtgatagagaacataaaatgagagctctggttaccattctatttctaaacattcattgcactctttattattttaatacaaatcctgttttctctttgctttactcacgaacctgtgttttactccacttgaatattgtgatttaatacctattaaaagagaattactgtggtcacccctgaacttttttgcacttatctcttttataatttcttactttgttgcagagacaagaaagatttgctgatagatcactgttggaaatggaaaaaagggtaagtgtcccacttattaaataattatttttttctttcttgttttaggtaaacaatggtaggttttttgtttttattttgttattatggatgacagttttaattagtttaaatatttattgagttaatgtattttgcagcaacttctttatagaattctatggggtttctctaggtatgaaatgaccttgttaaataaaatttaatttaccacataattcttttaatgaatttaaaaaaactgtcttgccttgattctgaaatgtactatacacattttgatagtgaatttgatatttttgaaatgccgtttatctcttatggcctgtacctaaaacgttttaatcataaatacatttattttaattctttataaacctaaaatactttcgttcttgaaataaagtttctaaatctggaacatcaaattttcaaattctttttaaagttaatttaataattttttaaaattttgagtttaaatatttaacttaagtaggctattttaaacaaaaaaaagattacaagaaaatccttatgccacttgatgtctttctgcaagtttttattgattgtaatacattcacttgtatttctcttcacttattgttgctcaaaggtctaggagtagtcataggaataactgtacaagtttagcctcatcagttgaaaatgtataaatgatccaaaagttaaaggaaaagtgcccaaagattgtttgtagtgtagctgagcagtagctagacttggtagggtttcgaccagagaagaaatgacatgctggtagctatgatcaaagagtaaatacttaggagctattgatataaaaacatttttcttccattctattttaaaataaccaatttgcccttttcaccaaaaaaaagagaaatggttaaaaaaaaagaatataaaaatagtgttataatgtctgtcatttgctagttgtaccttgcaatagctaccattttattatgctttctgcaagttttaaaaattagtgttctgagtcatgttttcaaaatggacataataattgctaaaatattgttttaataaatttaatattattatatcctgttagaatatttaactgttactgaattttatctccaggataggcagaaataataaaatcagttctctgttatactaacggttgagatgaaaggcatggataacaaactgtacttaaagtagtatttatttttcaaatacaatcacaattttaaatatttaatttttcttatgaaagtaatatgtttattacagaaactttaacaaaagaagacaatattaaattatctgtaatctgtcatgcagagatagctgatattttgatactttttttttctaacatacacatgatgcagacacattcatactctgacaagctcacctaacctcctttttctgcttgtcaaatgcagataaattacaaagtagctaatccactctctataatcatggtattaatagtaactgctaacatttattcatcattctctgtatatcaagcaggcacaaaattaaacactttacatgcattttctctaaaccatattttttttccttgtgttttttttttgtttgtttgtctgtttttttaaagagacagaatattgctctgtcacccaggctggagtacagtggcacagtcaccgatcactgcatcctccagttcctgggttcaagcaatcctcctgcatcagcctccagaatagctggcactacaggtgcatgtctccacacccaactatttttttaatttctttttggagacaaggtctcactttgttgccaaggctggtcttgaactcttggctttatgcatcctttcacctaggcctcccaaagtgctgggattacaggcttgagccattgtgcctggccagttatattttttaatgttaatatgtttgtcaaacataagaaatttcatatcattttacagatgtcaatttcattgagctaatagaatcaggcagttgggtgtagttttcttgtcttactttaccactaatttaaaatcttgaagacacctaataaaattgaggctcatagggagattacctctcagaagaaatattctatttctgatattttgcaaagtggtaaagatcaaatatgacactttatgtgctagtattttgagaagtgtgatgatttgtatgaatttgtcatgactgtattatttagtagaagaaagatctatgtattgaaaataatgtttctgtctatacaataatgtttaggcatgccgatgttggaataacatggtacttaaaagacgatcagtaggattctgtctactttttaaaatcacataccctaaaaacattaacatttacagtaaatgtactgcttgactaaatatcagcattatttattaatctgggaaagagtgtcttggaaatagtttcagtgtgattaaactaaatttaaatggtttgtatctgaaaggtgaccggcaagagtcagtatcttctgggcggtatgacctaaccagttttacagctcatcaattactgctgcttgctttttgcataacaccccagaatgcttatcatttaagggagaataaaacagtacactgcaataatgtgttgtgtgttggctttgcctgtcactctttgaaacaagtttaaaataaacgctgcagttgcttttctattacattcactgcattaatgctacacataatgtcaacctaaatacaaagctataaagtcagttggataaataatggctagtacacattgtgagtggaggaaatgagcttctcttacattcctctgaaattgcaaagtacacatattttaggcatgtttgcttcttgcttttctgcttctgtcactgtaatatgattgcatctttgtgtgagttttgtttttcttctctgtacagtcttcagtcttgagtattgattcactctaagttttacatgaactcaaaaagtagtttgaatatgttatgtagcatcttcccagaaagtcaaagctttaaattaagagcttgtactctaaggataaagatcttcatatttatttttgtcaaattttggaaagctctttacatatcactggcatcacatcttttctacactgctcctgattggacctttaattctgaagtatcactatttcacagtatagaagaagacttaagaatataataattatataactaacattggtaccttaaatcgatctaggaacgaagagctctagaaagaagaatatctgaaatggaagaagagctcaaagtaagtaaactatgttacttatgagagagagtgctgtttatgtattaatgtttaaaatactattatagatatggtttacattaattgttctcaaagctgattacccaatttgtgaactgtctatatctggtgcttctctttcttcctgaatccaggttttagtgagccagaagagggtctaaaacccaaatcttaacacctatgaaaagaaggagcaaaaataaaataaaaaataaaacccgaattattttgataattaatttgtgtagcacttttgctgttcaggtatagaaaaagttagacaataataataagatgtaggatttattatttattctttatgtttctatatactttcatgttttttggcgagtaagtagtggagggggttactataaaatgttctcctttgaaagtaaaggacattaggggagtgaacaggcagagctgtattttatcaaactccatattacctatagaaataattatgttttgaatgtcttcacaagtagcatagttaattgattacctcttaccacactgtccttcataaaatctttatcacattgtgaattaatgaaccagtgcatagtaagtatattgtacccacagaattagaagttcaagatttagatatttcattattaaattgtttggtttgttattagaccattattgaatggctttgaagattggagacaaatcttttgtattttgtttgcttatgtattacttagtttgaaatagaattttaggaatacagtgtttacctttctgaatctcttgttcctttaagacgtaatatttttaaaaaattacctgtgattacattcttattatactcttttccattttcttattttttattcctatttctttatgttctgattcctgcagaacctgcaccaaataaagcaaattcaatctctgagggagttaaatgagcgactgctgactgagaatagggccttgacaagagtggtagccaagcgctcagggttctataggcaactgcagtctgtgaacctataatttttagtttcatcatttcttcttggtagagccaggcaggtgtttttatattagtaggcgtgttttgtaagagctcacttttacaaattaatgccattgtgtctggagcatatcatataactaattatgcatggcttcttagaatgttagaaattgtcactaattgtatattgcaattgatgagctacattaaaattagggatgattttggaatttaagttaaagacttatctgtacttttgtaaagcttttgcacattttttagctatacagatattttaggacttaaaatatgactattatttacagttctttactagagagaaaaccaacagtatataacattttacatataattaatatattttgaagctgaagattaagcatgcattatgtttttcaaaataatgtcatttgaagtcagaaccacattagtttatatttaagtttatattacaaatattcaaatgaataaacttaatattactatattttatatcttaaagattctgaacacagataagaacatattggttccacgtaaaattaaatcttcttaaagattttgctttacctagttttgcaaatagaagttttacttttatcaagttagataaactaatacattttgaaaactgaggaaagaggactattttggaaagtatggtttagggaccaaaaatatgagctatttcatttcctagtgaaactggcaaagaacatacagttttaatcatccttagtagagtattcagttaacttgtaatattttcaccccttcatcaatttgtctgtaaaacaacagaaaattgagatgtgttgtttgaagatatgaggctatttgcttcaaaattggttatttttgtaatagttggatcatagatacagactttctactttagcttaaacatgatgcactattctaataatagtaattgcttgttaccatttaataagcatctatctgggatcggacattgtttaggcattttaaactgagctactgtaggtgaatcgtttaaggaattttaataatttagaacaagtctaatttcctcaatgttttcctaggtagtttgactttcttgtggaacaatattaagtattatgattttaggtctgacatacataaaagcaaaagtctttggtttaggtgctgacaggaacctcttttaagagcctatcctaacaaaaacaggcttgtcttggctgctggaatgtggtgtgcttgtgagtcataaaatcaagtgatttagtaaatttcaatggaaaatttggagagaataaacctttcattccagcatttatgaaactaattagctttacaaatccaggtgtggtttttttccttcttcctgatacatgttttagatactagaaatatatataactgacaaagcttgatcatgtgttttgtggtgaaaatataacatttattaagaataatgttttatcttttaatattgaaggtaaaacttgatcttcaatttttctctttatagatgttaccagacctaaaagcagacaaccagaggctaaaggatgaaaatggggccttgatcagagttataagcaaactttccaaataaaaaaaaaaaaagcagcaagtaatggaattgcacatattagtaacccagtggaccataattggcagtcactggaagtctgggaagaatccttggagactgtcattttcggatatcctgccaaatgccctcttatctagaatttttgtttcattttgtttaattttctggggtgtttttgttgttgttggtttgttttttgttttttttttttaatcaagaccattgtttcatgttaatgcagctgctgagaagatttttttttaatgactgagaaaacttgtttacagctccagcatataaggaaagtgttcaaggccagatatgcctcagatatttaaccagtaagccttagttgtacataaatacttttgtgtcaacaaaaactttcagctctcacagaagacagttactcaacattttttgatgtgccacagtttcgagtttttcgatatttaaattttttggcttttcatctaagtttgggtttgtattttttccttctaaactcttcatgtggcagagtcttctatgttttcacagctttttcattacagaaaagaacacttgctcttctgtgattattgtcatgtattaggctaatgctgtgttgtctcccacctggaactgaattgcttggtggaacatatgctttcactgtttgtgcaatatgcatttatttcttatatgaatgctttaaagtcatttgaggttagatcttttaattcctattttctgcttcattggtcactttttttttattgtagtataagatgttagattctgtaatcttcacattcattttagcaggtactgagtgatgctgtatatacaaataagtgtattgttttgatttttagaccaccacatggcatgcttgactatttcttatttcaaatgtctgctaatgcagagtaggctactccatgatagtgttaaaaaacaaaatttgctaacaatgtgatataaagactttaaaagttacacattatgtggagccctatctttacaaaagtttcctactgtaaagtgcttttattttcagttttcacttgatagtactcaaccataattaaagttgcataagataattgctttacatttcacatacctatatttatctgagtgctgtctaaaactgttgtgctagccaaagtaatgctatgaaatcatttgcagaattaacccgtgagttaatgttaaatgcactgttattgccatgtgaagaggcatcgactttgataccaccatcatgttcagaccattttatacatttcagtggcctttttttttttttaaggaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgt

SEQ ID NO: 35925 - DNA, 161050 bp, Homo sapiens; identical to SEQ ID NO: 35924

SEQ ID NO: 35926 - DNA, 12766 bp, Homo sapiens
gaaagagtgagagccgcccacgagctctgagcagagagcccgcaggagtgccacgtcccggcggcctcggcccctccctgcctcagtttcccgtggcatcaaagggggcgaggggcccctccaggcctctggtgacgggggtgctgtgcccaggcgggggtccgggggcgaccgagggggctcaggaagtccgcggccgcaggaattcggcgcctccaggccttataaggacatttgcgctccgggccaatcagcggcgggggcgtggcgcgcggagcccggcgcgtcccaaccccgcgccagcccggcggtcccgtcccgtcccgtcctgtgcggccccgtcccgccgcccgcccgccagccatgagctccacgcagttcaacaagggcccctcgtacgggctgtcggccgaggtcaagaaccgggtgagtgaggggcgccccttgtccccccgacagcgcggccgtcgcacgctccgaccggtgcaggagcccccaggcgcccccggcacctcccgggcagggagcttggagacccggggcggacgggcccttgttctccctgacgcctggtggggggatgtctgcgggcaccccctgaggctcccgcgaatcttggggagcacccaggtctgagatctgggggacgagtgacccattcccccccccaacatctaggggtagttgggtctgacttcgtcccctcgccatggccccaggacccccacgtgtgaagcccctggcgcccactcaaccttcgagaaggtccgttcaaggtccgacaacgctctgggggtctgggggggaccccagcaaccccgtcatctcctggccacacttctgcttttggggcctcttagctttgggaggggaaggggcatggccgagtggtttttgagaagtgttacccccccacaaacaggaatttcctggcctctgggacaccttgggggtgtcttggggggaggggcggtagccgctttgcacggtctttgtctcccatctgactaatttaaacggataacaaagaggttctctgaaggtggccctgagatatgtggggttttgcagcctcgaaagaagagctggggcccggcagggcgcgggggctcacgcccgtaatcccagcactttggggggcggagctgggtggatggcttgagcccagcgagttcgagaccagtctgggcaacatggcgaaaccccatctctataattaaaaacaagccagggctaggggagacactttttaagagagcacttgtggttctagctcagagaggaccagacacttctgcagggtcacacagcagggtcctggacaggattcccagggaaagtggggggcgggggttgtgatgcgagacccacggacaggaccgggacctgaccctccaggaccttccagctggaggggggtgtcgtccccgcccaccccctcccccgacgcccactgggcacctgggaaggtgtccttacagctgacttctgcaggggaaactgcctctgcacgctctgagggcaccggccctgccagccccaacagccacctgcccggcggcactccagggccggcagactggagggagaattcctgcttccccgctgtgagcccctgcaagccttcagaccagctcttggccaaaaagggaggctgaggcttggggtggtcaaggcctgagccagggtccccagcccggggctcacgactcctccttcaaggggccatctgcaccctgcattcatagagccccccgtgcagtggggtgggcaccctgccgcaccctgcatacagccggctaagggcaccggtgtccacagggacccagagacgtcgttccagctgcccagggccacacagcccacaagtgacagggccaagaccggaacccagtacctgctgggcctgcggaagtgggagcgggcacaggagggtggggcggcttccggagacggggtggggtggggtgggggcaggttgatacctgccctggcgggggtgaggacagaggctggaagagccgcttagcaggctccccgcgcaaccctcagtctgtccgtttggagggtgggcgaggcgtcggccagcttgccagggtcacggaagggtcgcctcccaattagaaaccagcttccccctggcttcccgctcacacccgctttaccggctgcttgaaacagccagagacccgccccccgccccgcttccccgtggctcagttgactcccggctggacggcacggaggcagctcggatccacagtgtctgcggccttgcatcccggcttgggggtccggacccgctgggaacagctggttcagatttagccggggaggcagcgcgcattcctggcagtttgtggtgaacaggaatgtgctggaaggccggcggccgggcagcgggggggcgggggtgggggaggacggcagcggctgggggtggggccaggggacctgggcccctgagccggcagagacgcggcgcagctgggcaaggcagggctgtgtacccagcagccaccgttctcattcctcgggatcaaagttgccggcggggcggggctgcccccgggcgtggaaagccaagctgggtgggctgtgagctggtactggggggcctccccgcctttgcctcctctgggctacgagctgtttccaggcaggtgccaggtcaggggaccctaacccaaataatcccaggcaggtccaggtcaggggaccctatcccaaataatcccaggcaggtccagctcaggggaccctaacccaaatcatcccaggcaggtccagctcaggggaccctaacccaaatcatcccaggcaggtccagctcaggggaccctaacccaaatcatcccaggcaggtccagctcaggggaccctacccaaatcattccaggcagatctagctcaggggaccctaacccaaatcatcccaggcaggtccagctcaggggaccctaacccaaatcatcccaggcaggtccagctcaggggaccctaacccaaatcatcccaggcaggtccaggtcaggggaccctacccaaatcatcccaggcaggtctagctcaggggaccctaacccaaatcatcccaggcaggtccagctcaggggaccctaacccaaatcatcccaggcaggtccagctcaggggaccctaacccaaatcatcctaggcaggtccagctcaggggaccctaacccaaatcatcccaggcaggtccagctcaggggaccctaacccaaatcatcccaggcaggtccaggtcaggggaccctaacccaaataatcccaggaagagatgaggaagcggaggctgagtggggagctgtccgcgggaacctggggagatgggtgcagagcagggagagggatttgattttttttttccttctctcttttctttctttttttttttaagacagaggctcactctgttccaggctggagtgaagtggcccgatcttggctcactgcctcctctgcctcctgggttcaagcgattctcctgcctcagcctcccaagtagctgggactacaggtgcccaccaccacgcccagctcatttttgtattttagtacagacgggatttcaccatgtgggctaggccagtctcgaactcctgacctcagatgatccgcccgccttggcctcccaaagtgctgggattgtaggtgtgagccaccgcacccagcccaaaccctactttattctccctccagcgtttatctcccgctcccgctacacgacctgcccccatgcttatggccccctatacactttgccgtctgcctcagtgctgtctccgcggtcactagtggctggatagggacactcgaggtccccactggtgcacacccactgcccaggagcacacagcccattccccacggcggtgtctcagagcaccgaaggccaagaaagctggaatggccgggtgcagaaaggtggcagggaatcggtggcaaggagccaggtgcgtgactagaggcggtcagcctcgggggcagctccttcgggagttgctaagaagcaggatgggggccgggcgcggtggctcacacctgtaatcccagcactttggagggctgagacgggcagatcacgaggtcaggagatggagaccatcttggctaacacggtgaaaccccgtctctattaaaaatacaaaaaatgagctgggcctggtggcgggcgcctgcagtcccagctactcgggaggctgaggcaggagaatggcctgaaccggggaggcggagcttgcagtgagccgagatcgcaccactgcactccagcctgggcgacagagtgagactctgtctcaaaaaaaataaaaaagaaaaaagagctgatggttgcacaacattgcagacgtacgaaatgctgtgaaatggtgcggtttcaggtggttgaagtggtaaacgtcaggtgtgatatagcggggaggtgagaaggcagggcggggaggcagatccggccaggtttgtcctgcaccgggagtggattagagctgatgtttatcagtgagttctaagccggttgtcggcctgcttggagggcggtttatctgtgcccgcctgcagtggctggggcgcccccaatgatgggaaaagggagcatctgcgtgggtgtggtgaggggggacctccaggccgctctatctgctgttgccctggagtccccggccccaccctctgcagagcttctgtggggttcctgctgggggtgcccccagcccagctcagtctcgtgccctttgctccaccagctcctgtccaaatatgacccccagaaggaggcagagctccgcacctggatcgagggactcaccggcctctccatcggccccgacttccagaagggcctgaaggatggaactatcttatgcacgtgagtacacgcagggacacaggctgtctcacacttaacaaatcttggtttttctcactttttttcttaattaagaaatttttggggggccgggcatggcctggctcatgcctgtaatcccagcacttttggaggccgagggtggtggcggggggcggtggatctcgaggtcaggagttcgagaccagcctggccaacatggtgaaaccccgtctgtactaataatacaaaaaaattagccaggcacctgtaatcccagctactcaggaggctgaggaaggagaattgcttgaacccgggaggcggaggttgcagtgagccgagatcacaccattgcactccagccggggtgacacagcgagactccatctcaaaaaaaaaaaaaaaaaaaaaaaaaagttagctgggcgtggtggctaaataaataattttttttttttgaggtggagtctcactctgttgcccaagctggagtgcagtggcatgatctcggctcactgcaacctccacctcctgggttcaagtgattcccctgcctcagcctcccgagtagctgggattacaggcgactgccaccatgcccggctaattttttttgtatatttagtagagatggggttgctccatgttggccaggctggtcttgagcccttgacgtcacgtgatctgcctgcctcggccttccaaagtgctgggcttacaggcctgagccaccaaacccagccaaagattactttataagagtggaaacttgaggcctgggatggtggctcacgcttgtaatcccagcactttgggaggttgaggtggacggatcacgaggtcaggagatcgagaccagcctggacaacatggtgaaactccatctctactaaaaatgcaaaaattagccgggtgtggtggcaggcacctgtaatcccagctactcgggaggctcagggctgaggcaggagaatcacttgaacccgggaggtggaggtggcagtgagtctagatagtgccattgcactctagtctgggtgacagagctagacgccgtctcaaaaaaaaaaaaaaaaagagtggaaactgaggcccagagagaggccgtgagtttgcccaggaaggcgtgagcttggctgagatcagcatcgggtcttcacggttcctcgctgctcacagaggtttctgtttcccccgccccatgttgtgccctccagactcatgaacaagctacagccgggctccgtccccaagatcaaccgctccatgcagaactggcaccaggtgaggggctggtggagcggagcagggatggtgctgggggcccatctaacaggtggggagactgaggcccactcactgtccctctcctgcctcttcccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaaggtgaggcccagagaggggcagccacctgcccagagtcacacagcgaggtggatgtagctgctgcattcactcgtttgcaaatttctgtttgtttatttttgagtcggagtctcactctgtcactcaggctggagtgcaatggcgtgatctcagctcactgcaacctccaactcccaggttcaagcgattcttctgcctcagtctcccgagtagctgggattacaggcacctgccaccacgcctggctaatttttgtatttttagtggagactgggtttcaccatgctggccaggctggtcttgaactcttgacttcaggtgatccgcccgcctcggcctccccaagtgctgggattacaggcatgagcccctgtgcccggcctcgtttacaaatatttctgagcatccgtgaggtgccaggtacttcagattccttggtgaacaggaaggacatggtctaccccttatgcagttcagtctgatggcggaggcatgcaaaagtgaacacagcattgtattatgcattatatgtaagctctggccgggcgcagtggctcacacctgtaatcccagcactttgggaggccgaggttggagaattgcttgacaccaggagttcgagaccagcctggccaacatggtgaaaccccatctctactaagaaaacaaaaattacctgggcgtggtggtgcatgcctgtaatcccagctactcgggaggctgagcccaggagttaagaggttgcagtgagctatgaccacaccactgctctccagcctgggcaacagagcaagactctctcaaaaaataatcataacaaaagtaataaataagctctgaactgggagaaatgccttgaaggagaagaatcagacgaatgttgagtgtctagtgatcttcaaacccagaccgggagcgtgggtgggacagtggtgtagaccgggagcgtgggtgggacagtgtctggtgtagaccgggagcgtgggtgggacacggtgtctggtgtagaccgggagcgtgggtgggacacggtgtctggtgtagacggggagcgtgggtgggacggtgtctggtgtagaccgggagcgtgggtgggacacggtgtctggtgtagacggggagcgtgggtgggacggtgtctggtgtagaccggcagcgtgggtgggacacggtgtctggtgtagaccgggagcgtgggtgggacggtgtctggtgtagaccgggagcgtgggtgggacacggtgtctggtgtagacggggagcgtgggtgggacggtgtctggtgtagaccggcagcgtgggtgggacacggtgtctggtgtagacggggagcgtgggtgggacggtgtctggtgtagaccgggagcgtgggtgggacacggtgtctggtgtagaccgggagcgtgggtgggacggtgtctggtgtagaccgggagcgtgggtgggacacattgtctggtgtagaccgggagcgtgggtgggacggtgtctggtgtagaccgggagcgtgggtgggacacggtgtctggtgtagacggtaagcgtgggtgggacacggtgtctggtgtagaccgggagcgtgggtgggacggtgtctggtgtagaccgggagcgtgggtgggacacggtgtctggtgtagaccgggagcgtgggtgggacacggtgtctggtgtagaccgggagcgtgggtgggacggtgtctggtgtagaccgggagcgtgggtgggacacggtgtctggtgtagacggggagcgtgggtgggacggtgtctggtgtagaccggcagcgtgggtgggacacggtgtctggtgtagaccgggagcgtgggtgggacggtgtctggtgtagaccggcagcgtgggtgggacacggtgtctggtgtagacggggagcgtgggtgggacggtgtctggtgtagaccggcagcgtgggtgggacacggtgtctggtgtagacggggagcgtgggtgggacggtgtctggtgtagaccgggagcgtgggtgggacacggtgtctggtgtagaccgggagcgtgggtgggacggtgtctggtgtagaccgggagcgtgggtgggacacattgtctggtgtagaccgggagcgtgggtgggacggtgtctggtgtagaccgggagcatgggtgggacacggtgtctggtgtagacggtaagcgtgggtgggacacggtgtctggtgtagaccgggagcgtgggtgggacggtgtctggtgtagaccgggagcgtgggtgggacacggtgtctggtgtagaccgggagcgtgggtgggacggtgtctggtgtagaccgggagcgtgggtgggacacggtgtctggtgtagaccgggagcgtgggtgggacggtgtctggtgtataccgggagcgtgggtgggacacggtgtctggtgtagacggggagcgtgggtgggacacggtgtctggtgtagacggggagcgtgggtgggacggtgtctggtgtagacggggagcgtgggtgggacacggtgtctggtgtagaccgggagcgtgggtgggacacggtgtctggtgtagaatggaatgggagtgtgtgtttgtgacatggtgtctcacgtagaaggaacagcaaggtcttgacattggaattggctgggctgttagaggaagcgggagctggttttctcctggggtaactgctccaaatggtgttttcagatgccccctgtggctcccagtaacctcacgtggggaatggtggtcagggaggagccgggcgcagacatcccagtgaggggcagagccaatggcctggccatggtgcccggggattgggtcagaggaggtggtggaaggtgagagagaggaagcgaaaaccacgtccccatccccagaattcttggcctgagccctggaaagctgagctgttgcctaagacaaggcacgctgggatgaagcagccccatgggctgggcgcggtggctcacgcctgtaatcccagcacttttggaggttgaggcgggtggataacttgaggccaggagttcaagaccagcctggcaacatggtgaaaccccgtctctactaaaaatacaaaaattagcctggcgtggtggcacacgcctgtaatcctagctacttgggaggctgaggcaggagaattgcttgaacctgggaggagggggttgcagtgagcggagatcacaccactgcactccagcctgggtgacagagccagactccatctcaaaaataaaaataaaaaactgaaacagctgtatgatgggtgtgtggagtgtgtggagtcccagacacccgagagatgtgcctgtgggggctctgcgcggcaggcagaggtgacaggccgcggcctggtctctgtcccgcccccagggcctagatctagggtccctggctgccctctgctggtactcccggcccctttccctcacccaggccaagactaaggggctgcagagcggggtggacattggcgtcaagtactcggagaagcaggagcggaatttcgacgatgccaccatgaaggctggccagtgcgtcatcgggctgcaggtgggcgacagctcccccagccccagggaccacggcattgggggaccacggtgttgggggacagcagcattgggggacagcggcatggagccctgtggtccctcaatttcagggagggaccggaagcttgttgggtgcagtctgacctctcccacgaacctccctgcagatgggcaccaacaaatgcgccagccagtcgggcatgactgcctacggcacgagaaggcatctctatgaccccaagaaccatatcctgccccccatggaccactcgaccatcagcctccagatgggcacgaacaagtgtgccagccaggtggggctcgcccgggtgcccccgactcctctccctgcccctctacaccctgtggtctcggcccctccctggggccacctccagcttctctccccactctcagtctcagccccttccctagaccacctccggcttccctccccgctctctgtctccgccttggatttcagcctctgtcatttccacctggctgtgggtctctagggaagttactacctcaccctgtgtcattttcccttaaggactgcccaaaggtccacccaattctttttttttaatctttatttattttatttatgtatttattttgagataggatctcactctgttgtccaggctggagtgcagtggcacgatctcggctcactgcaacctctgcctcccgggttcaagagattctccttcctgcctcagcctcccgagtagctgggactacaggtgcatgctgccacacccggccaatttttgtatttttagtagacatggggtttcaccatgttgcccaggctggtctcgaactcctgagctcaggcaatccacccgccttgacctcccaaactgctagggttacaggtgtgagccaccgcacccggccacacccagctaatttttgtatttttagtagagacggggtttcactgtgttggtcaggctagtcttgaactcctgacctcaggtgatcctcccacctcagcctcccgagtagctgagactacaggcgcccgccaccacgcccggctaatttttgtatttttagtagatatggggtttcaccgtgttggccaggctggtcttgaacttctgacctcaggtgatcctcccacctcagcctcccgagtagctgggattacaggcatgtgccaccacgcccagctaattttgtatttttgggagagacagggtttcaccgtgttggccaggctggactggaactcctgacctcaggtgatcctcccaccttggcctcccaaagtgctgggattacaggcgtgagccagtgcacccagtgaaggtcccctcttctctccaccatgacctgctccacccctccttcctctccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctgcccatctgggtttttgggtttttctgtgttttcatcttttttttttttttcttaacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctgcttgcctcgcctcttcccccttttgtcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagaccaacagacttcagaccctcagacctgccccggggccaggtggagaaagtgagggccgtacaaggaagtgaaattctgagttgttggggctaagcctgaccccctctccatgctccccgccccaacccactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccagcccctcagtaggttttaaggagcccccagccctcctcccttctgggcccgaccagcttatactgctccatcttccccggccacatgccccgccaagtactgcacagggaccccccacccaggggacctgctccgtgagataatgtgaaatacgactgtggaccaaacgcaataaaacctctgtttgtacgaag

SEQ ID NO: 35927 - DNA, 14779 bp, Homo sapiens
gccggcgcgtttctccgggctacagccggcgccgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccaggtgcaggccggcgggggccggcgggggccggcggggcgggcggcggtccgcttggcgcggcgcgtgggcacctttctccccgggcccgcagtggcctcccacgcgcgcgctcttcatccgcgagttcaggtcgcaggaggggaccctctctctccgggctcgggcgccctgcacccgaggagtgggttgttaaattgcagcttgtgcagctcagcaggtgcgcgtggggtggagtgagcgagcccgcgagtgcttttatgtaacttaaggtgcagagacctacctgctgccctgtctcaggtcaaaggccccgcagtgacgtgggtggggctgggcgcacaggcccgggtgccctgacctcataaactaggcttaagcagttttcctacagccctgaatagtaatcacgaataataataataatgacagctaaaatgtaggtagcagttagtcttaagtgttttacgtgggtaatccttactgcagtcctaaaaggtaggtactgttatcccctggctgtagatggggaagcaagctcagagaggttaaataatttgggaggccacacagccagagagcggtgggtgcagaatttgaacccaggtcgcccacttctccctttcaacctcagcaaatcggctctatctgcttgcctgtgggttgcctattccgggaaggtcagcagcccagatctgtactctgaggactgtgaatgactgagcttctcttgggttcctttcagatagccatccgagcttgtttcctggggtttgtgttcggctgcggcacgctgctaagttttagccagtcttcttggagtcactttggctggtaagaattccttcggaaatactggttttcaggcgagggtggacagatcagagggtctgtagcggcatttcctcatccctgtctcatctgtgaccggcagaaggctgttcagggttctctggaaacgaagtctcctggcttccccctagttgctcacatttcagcccttgtgatttcgtgcctgtgggttgattgtgaatcaggcagaaacagatctccctggcacccccaaaggtgctgtcatccgcagctgtggtgacagcattccgtaacttgagcagcccttcccggaaggggtgcaggtcctcggtggcgggcaggggcagggctctggcttgtcttcatgggcctttttcatctctaatttctattaggtcacatctagtgcatccccacagccactgtaggatttttccctacactatgatttcagtcccttgagccttctagtctgacctggatatgaaccagtggcttcaaggtaaaaagttttatctcctcttatcaatattttgagccatctaatccttctttgccggaattatttcagttttgttaaattttgtatccgacatacatcactcctttatgttgttatctccctctttcatgttttattgtgtgtagtgtcatttttaacggacagaagggcccataatgcctctgtgacctatgggtttgttttgcctgtgacattcaaaaacagtcccttgccgggcgcggtggctcacgcctgtaatcccagcactttaggaggccgaggtgggcagatcacgaggtcaggagttcaagaccagcctggccaagccaggagttcgagaccagccttgccaacatagcgaaaccctgtctctactaaaaatacaaaaatgaactgggcgtggtggtgggcacctgtagtctgagctacttgagaggctgaggcaggagaatcgcttgaacctgggaggcggaggttgcagtgagctgagatcacgcagttgcattccagcctgggcgacacagcgagactctgtctcaaacaaaacaaaacaaaacaccagaaacaaaaacagccccttaaaaactccactttttgcaaacctgaggtagtagatgctgcagatgggtacctgtgtccactctcagacaggtgagaacagggcctcatagacttagggacagctcaggagacccagatgtgcacttatggttaacttggttctcttgtcccaacttaactctctttttgtctttaaataggtacatgtgctccctgtcattgttccactattctgaatacttggtgacagcagtcaataatcccaaaagtctgtccttggattcctttctcctgaatcacagcctggagtatacagtagctgctctttcttcttggttagagttcacacttgaaaatatcttttggccaggttcgtgtgccttatgtccccctctggaggggaaaagggtggctcccattcaggctgaggacagtgacattgattcacctttcaggtctaatctcccccaagcgattttccgcagacctctatcctcactaagctatttataaaggatgagctccgctcatgaattctgcctctggatattgactcgaggacgtgctgaccttttgctttaaagtttgcatcacatagtgcaccatctaatttgaagccccaaccttgagtagttgtgattctaattttataatcagatgatatttagacgtttcatgtaagagtttactggccgggcacggtggcgaacgcctgtaatcccagcactttgggaggtcgaggcgggtggatcacaaggtcaggagttcgagaccagcctggccaatatggtgaaaccccgtctctactaaaaatacaaaaaagccaggcgtagtggcacatgcctgtaatcccagctactcgggaggctgaggcaggagaactgcttgaatccgggaggcggaggttgcagtgagccgtgatcgcgccactgcactccagcctgggtgacagagcgagactcccatctcaaaaaaaaaaaaagagtttactaacaaggtcgggtgcagtggctcacgcctttaatcccagcactttgggaggccgaggtgggtggatcacatgaggtcaggagtttgaaaccagcctgaccagcatggtaaaaccccgtctctacgaaaaatacaaaattagccgggcctggtagtgcatgcctgtaattctagctacttgggaggctgaggcaggagaattgcttgaacccaggagatggaggttgcagtgagctgagattgtgccattgcactccagcctgggcaatgagagtgaaactccgtctcaaaaaataaaagcctccgtatgtggaatgcactctgaaattgaatgtctcacagccaatgaaatgaaatacatgtggctcctgggattcagggtggaaaccttggacccttttttgcttctcttagctatacttgtccccagatgaaggactgagcatgtggccgggggtcgtgaaccagagagcccatcagctgtagcaggagagcatctctttaccatgatgctttcattgtgcttattggtgttttaaagtaaattgatgaacagcataacttaggggaatgtgttttcttatgaaattttaatgtgatgacaaatgctgattgcccagcagcacattttctgtttctgtcttcgggaaaataggttaattttaagcagtgcgaaggggagctcaggccagtgttttcactccccgtgtgtcgttgatgtctctctcccacagaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtataatattaaatatgacactgcttttcttttttttttttttaagtaacattttaaacgtgatattcacgtagcataaaagtcaccatttcaaaatatacaattagtggttttcagtgtattcatgaggttgttggtctcctttaaataataggtacatgttcttcttggcgcgtttcaagtgataatttaataaaagtcaagagaactaatgtagtccttaatgcttttcactatgtgcccagaacctgggtgcgtaagtccttggtgattcttggtgctgttagctacctgctgtatcccttcatcctgtttctgcctctgtttgtttgttttcttttttctttttttttttttggtagagacagggtcttactgtgttgcctgggcaggtctcaaactcttggccttaagtgatcctcccacctcagcctcgcaaagtgctagcattataggcatgagccattgtgcctctccctttctctgccccttcaacctattaatagatctgaagcaccccagagggggtgaggacagagatggggcttagggaagggagtgccctctgtcactcatgtggcagcttggctagttttcatcagaaataggtattaatggggccgaggccatgtgttagtgagctgtgtgagccatggaggtttgttctgtctcaggctgaagaaaaggccttgtttcgtttcttttcttttctttctttcttttttttttttgagacctagtcttgctctgttgaccaggccagagtgcagtggtgcgatcttggttcactgcaacctctgcctcccaagtagctggaactgtaggcacgaaccaccatgcctgactacttttcgtattttttttgtagagacagggtttctcgagttgcccagagccatcttgaactactgagctcaagcagtctgccttcctgggcctctcaaagtgctgggattacaggcttgagctacagtgcctggccttttttttttttttttcctttttgagatggagtctcactctgttgccctgttgcccaggctggagtgcagtggcatgatctcaggtcactgcaacctctgcctcccaggttcaagcgattctcttgcttcagcctcctgagtagctgggactacaggcgcccgccaccacacccggctaattgtttgtatttttagtagagatgaggtttgactgtgttagccaggatggtcttgatctcctgacctcatgatctgcccgcctcggcctcccaaagtgctgggattataggcatgagccaccgtgcccagcttttttttttttttttttttttaaagacaggatcttgctgtgttgcccagcctggagtgcagtgttctgatcatggctcactgcagccttgacctcctgagctcaagtgatcctcctacctcagcctcccaagtagctggaatacattacaggtgttgccaccacgtccggctaatttttaaattttttgtagaggtggttctcctggacggttgcctgtaatcccagcactttgagaggctgaagtgggtgggtcacttgacatcaggagtttgagacaagcctagccaacatggcaaaaccccatctctattaaaaatacaaaaattagttgggcctggtggcacatgcctatagtctcagctactcgggaggctgagacctgagaaccgcttgaacctgggaggtggaggttgcagtgagctgagattgtgccactgcactccagcctgggtgatggagtgagactctgtctcaaaaaaaaaagagatggttcctcctttgttgcccatgctggtcttgaactcctgggctcaagccatcctcctaccttggccttctaaagtgctgggattaggccaggcatggtggttcttacttataattccagctagtcgagagactgaggcacaatatttgcttgaacctgggaggcagaggttgcagtgagctgagatcacgccactgcactccagccagggtgacacagcaagaatctgtctcaaaaagaaaaaaagaaaaagaagtgtaaggattataggtgtgagccactgcacctgctctatgtgtgtgtgtgtgtgtgtgtgtgtgtgtgtgtgtgtgtgtattttttttatttatgtatggttttttgttttgttttgaggcagggtctctcacccaggctatagtgcattggcatgatcatggtttactgcagcctctacctcttgggctcaagtgatcctcccaccttagtctcctaagtatctgcccaggctggagtgcggtgtcacaatctcggctcattgcaacctccgcctcccgggtttgagtgattctcctgcctcagccttctaagtagctgaaactacagatgtgtgtcatcacacctggctaatttttgtattttttaattaatttatttttttgagatggagtttcactcttgttgcccaggctggagtgcaatcatgtgatctcagctcactgcaacctctgcctcccgggttcaagcgattctcctgcctcagcctcctgagtagctgggattacaggcatgcgccaccatacccggctaattttgtatttttagtagagacggggtttctccatgttggtcaggctgttctcgaactcccaacctcaggtgatctgcctgccttggcctcccaaagcgttgggattacagacatgagccaccatgcccagcccctggctaatttttgtatttttgtagagacggggtttttccatgttgcctaggctggcctcgaactcctgcggttgagtgatctacccgcctcggcctctcaaagtgctgggattacaggcgtgagccaccacatgtatttctttttctttcttttttttttttgagacagagtctcactttgtcgcccaggctggagtgcagtggtgcgatcttggctcactgcaacctccacctcccgggttcaagtgagtctcctgcctcagcccccgcgagtagctgggattacagttgtgcactacctcgcccagctaattttttgtatttttagtaggtttagtaggggtttcactgtgttggccaggcggttctcaaactcctgacctcagatgatccacccgcttcagcctcccaaagtgctgggattacaggcgtgagccactgcatccaacccgcatatttcttttttaaaattactatttggctaggcacagtggctttgggagaccagagcaggaggattgcttgaggccaggaattagaaaccagcttggctggccgggcatggtggctcatgcctgtaatcccagcactttgggaggctgaggcaggcagatcatgaggtcaggagatcaagaccatcctggctaacacagtgaagcctcatctctactaaaaatacaaacaattagcctggtgtggtggcacgcatctgtagtcccagctacttgggaggctgaggcaggagaatggcgtgaacccgggaggcggagcttgcagtgagccgagatcgcgccaccgtactccagcctgggcgacagagcgagactccatctcaaaaaaaaaaaagaaaaagaaaccagcttggccaacatagtgagaacccttctctccagaggaaaaaactaaaaatatatctggaagttgtagtgtgcacctgtagtcccagctactcaggaggctgaggcaggaggatcgctttgattgctgctgtactccagtctgggcaacagagtgagaccctgtcttaaaaacagaaaacaaaattatttatttgtgtattaaagatgagatctcgctgtgttgcccaagctagtctcaaactcctgggttccagcagaccttctgcttttgtctcctgagtagctgggactataagtgtgcaccaccatgcccagctaactttttgttttttgtagagatggggtcttagtgttgcccaggcagattttgaactcctgggctcaagcagtcctctcactgcagcctctcaaaatgctgggattacaggcatgatccaccatgcccaacccaaagccttatttcttttttttttctttttgagacagagtctcgctctgtcgcccaggctggagtgcagtggcgcaatctcggctcactgcaagctccgcctcctgggttcacgccattctcctgcctcagcctcctgagtagctgggactacaggcgcccgccaccatgcctggctaaattttttgtatttttagtagagacggggtttcactgtgttagccaggatgatctcaatctcctgacctcatgatccacttgcctcagtctcccaaagtgctgggattacaggcgtgagccatcgcgcctggccgccttatttcttgaaactgtttcttgattctttactcttggtcctagaaaaacttggccaaagaatgtgaatagatcttggaaaattcacgaagtgtttgggaaaagtctccaagtctttgggcaaatccagagatctctcaggcatcccatcagcaatgcatggtccttggtgactctggtgacccctaacggtataggtggggcaaatgatcacatagcatttacaatttttgtttctgaaacatgtaaaaccgccacattaacaatcaccttccctgggaacaaattagttatgactgaataatgtaatttgccataaatgcttgcttcctgtatatgtgtgtgcactagaaccaaagggttttccatacctttttgcccatagattttttttacattgtgctccagcacttgtgtgtgtatgaaaggaacatgtctttcctgatataatacttacacttactgtttacaaaatcctgttttctatcttattatttcaatactgttcataatgtactaaatgatttcatggcttagtaacaggctgcagcctgctatagagaactcccactgtagggtatccccagcaagctatgccagatgtgagggtacaggccccggagtcactgactgggccagtcctgattctgacattcactgcttggcctccttctcctctcatgttaaagtgggggcagctagacatagtggcacatgcctgtagttccccctactctggaagctgaggcaggaggatggcttgaggccaagagttcaagtccagcctgggcaatatagtgagaccctgtctttaaaaaataataaaattttaaaaaaaacaaagtggggatagtagcgtgccctcaaaggtttgccatgagagttgaacagggtaatgattgtaaagggcttagcatggcgctgggaacatagtaagtgctcaataagagaaggtgtgagaggtcaggacatgagcctggctctccgggtggctgtattggagcctaaaatatatattcagaaaacatacagaaaatgtatgttggggaagatgcacatccacaggggaccagtgggcaggtgtaggtgagtggttccctgaggagctggggaatgcttttggccttgaaggactgtttggctggagatcagtgggaaggatgttctttgttttttttgagagggagtttcgctctgtcgcccaggctggtatgcagtggcgatctcagctcactgcaacctctgcctcctgggttcaagcaattctcctgcctcagcctcccaagtagctgggattacaggctcccaccactacgcccagctaatttttctatttttggtagagacggggattcgccatgttggccaagcttgtctcaagctcctgacctcaggtgatctgccctccttggcctcccaaagtactgcaattaacagacatgagccaccgtacctggccaggatgttcttaaaggtggaagaaagggccaggagttcgagaccagcttgggcaacattgtgaaaccccatctctacaaaaaatacaaaaattagctgggtgtggtggcatgtgcccttagtcccagctacttgggaggctgaggtgggagaatcacttgagcccaagcagttaaggctgcagtgagccatgatcacgccactgcactccacgtgacagagtgacaatctgtctcgggggaaaaaaaagaggcaaagtgggcacagcgtggggagggcaggagactggggaagtgggcgaagtgctgctcttctggggttggaaacccagactcagggggtggggttcagtctctggagctctctgagcgtggaggtaatctgctggaaggggcatttcggaagctgagttttgtggcactgtatctcgtgctgaagcagaggctgtgggtttaggaggcagaggcccaggcagctgtggtgtaagcgaatgcatttgtggtgggagggtcctgggcaggaaggcagcgtgcatgggacctcatgttggggagctcacacctggaggtggggggcattgctgtcaccccaagctgagggttgaaatccaagaggttgatcttgtgatttacagatctctctcatgtaagaggagcaacaggaaagcacgtgagaaaggcctgcagcactgagtgctcagggctaaggtgacagtactgctcccagagaccctgacggtctcagcagggcatgggcacagaaatcctctgggtattagagacagacgcctaccaaagcacagggcgtcatcccacggtcaccctgatgagcctggtgtctccctctgttaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctagatttcatggcttaatgaattttttcattgttatatataccaaagaggcttacgggttcattgattggtttgaaaaccagacagacggccgggcgcggtggctcacgcctgtaatcccagcaatttgggaggccaaggcgggtggatcatgaggtcaggcgttcgagaccagcctggccaacatgataaaaccccgtctctactaaaaatacaaaaaaatagctgggcgtgctggcgggtgcctgtaatcccagctactcaggaggctgagacaggagaatcctttgaacccaggaggcggaggttgcagtgagttgagatcgggcctttgcacttcagtctgggcaacagggcgagactccatctcaaaaaacaacaacaacaacaaaaaaaaccggacggacttgcccatcggccctcacgacacgcgtgcagtgggactctagccaaggcggtggccgagccatcattacaatttttctggagtaaaggatccacggtgggacatcaactggcacttactctgtttaggaacttgagttgaatcatttctaaacttgtcctttagaccacgcctagggcagcaaattccacttcctagaactgcaaaccgggagaggatgtagttagattctggcatcctgccccggctctttgagggaaaagttctttcccctgctctaagtagggcgggcccagcctccattcccattgggagccatgaagttgtcttgttgataggtctagggcagctgttggcagctgctggccttgtggatggtaagctgactgtgttggcatttaatgccatcctccatctgccagaggcccaggaagcccaccttcacaccaggcccaccagctggaaggagcccaggaggcaggtcttagggtttcatggtgaaatgctgtctgacaccagggaaaacttgacgtactctgctttggagaggaattccaggggtagggatggtgggagaacattcccaccctgtttataatcccagagcagaagtcagcaattacttagggataaaagatgaactccattttttttattttcttaagacagtcttgctctgtggcccaggctggaggctggagtgcagtggcaccatttcggctcaccgcaacctctgcctcccgggttcaagcgattctcctgcctcagcctcctgagtagctgggattacaggcttgggccaccatgcccagctaatttttttgtatttttagtagagacggggtttcaccatgatggccaggctggtctcgaactcctgacctcaagtgatccacgcgcctcggcctcccaaagtgctgggattacaggcgtgagccaccacgcccagccaagatgaactccttaaggacaggatttggtaagtgattgacttctttttagttccatgatcttgagattatttttagctttataaatttagcagtggcagggcccgtggagaatcaggttaatgaggtaaaggctttctgggtatttgctgccaaggccacatcaccaattttctcgatttaaaaaactgtcaagagatttatttttccattgcaggttttaaagtggagattctgaagtggaaaataggtactgtcagaacaaagctacctggaaacagcatagagtgaagcctttcgtgagggcttgcaggccgctgctgagtggcagtttacagaagaggtcgcggggtgagcctcttagcaggacagaaaacaaggcagcagcgcacctgccaccccttcacgagctgctccttgagcctaaaaagtaggctttattcatcccttctgttcatttaccaacctgggggattgatacgaccggggaaaatgttcctaaaccaggaagctgcgttagccgatcaggctttgtaagatctcgccaacagctagctgcttaggagtacccccacgatacgcacagcacaccactgtcccttcactgcactttcttcctgccttaggtagttgggcttgcccaccctagtttgcttttgtagtggtttggcaaggttagaaggcctcggcctctctgtcatgctgggaagtgcctactctctgggccactgctgcagaggccgtggcacttgtcatgggtttggaagacccagccatctgcagcagaggcagcctatcccattgcaaggagaggaactgaacggagtaattattctactcttctttttacataaatgtttatttaaatattctaaattggattttctttcacagatactgattattctttccagttcttaaataaaactgcacttgatttcactca

SEQ ID NO: 35928 - DNA, 36648 bp, Homo sapiens
ggatcctaggatgcttacatgcaatgatgaacccgaaaacacttgcaaagtgctacgcaaatattgatcacgaagaaggaagtcctcttcccgcctggagactgtgtggggtatggcggggtggtggggagaatgtggtgtcttgctccaccctcctggcgaggggagggcctggcctggaccgcagaggaatcgagtgactgcccctaaaatctcctagaaccgatcccgcggccccgcccctcccgcggccccgcccctcccgcggcccgtcagcctctgccgcggagctgcgtccgccactcatgtttctccgagcaggcctggccgcgctctccccgcttcttcgcagtcttcggccctctcctgtcgccgccatgagcactggcaccttcgtcgtgtcgcagccgctcaattaccgcggcggggcccgcgtggagccggcggacgcctccggtaccgagaaagctttcgagccagcaaccggtaactgcaacgagccggggaggctggggcgccctggggccggatgcgcggatttcccggccagcccccgtttcctgtgttctgcagcgttgacttgagcacaagacagtgacagtggagagtctaaggttgtgtgtgtaggcaactagcgattctggggcaacgcgagtgcctccgggcagggatgggtagggaggaaaagcaaagctgatgagttgcgtggtaggatcgtgagttgttttacccgggccagaacagagttcgcaaagtactggtgggggaagtcgtgcctctgttaacttccttttttgtttgttttgtttgtttgtttgttttttgtttgttttgagacagggtctcactctgtcgcccaggctggagtgcaggggcaccatctcagagctcactgcgccctctaccttacgggctcaagtgcttctcccgcctcagcctccctggtagctgggattacaggctcccaccaccatgtccggctaatttttgtatttttagtagagacgggttttcagcatgttactcaggctggtctcgaactcctgagcttaggtgatcctcccgcctcagcctcccaaagtgctgggattacagccgtgagccaccaagcccagccaactgttcccccttttaaaaccaggactgatgtattattgtcttcaaatgtgtgcataggagaggaattctaaaagaacggggcggggttgtggggaagataatcatttgtgctgggaatgaaggaacgctcacagatagtttctaatgactacgaatgaggactttgtctccacattctaatattaaaatatttctgcacattaatcagaattgggaaaggaaaaaaccccacctttattcagtactttcttccccagctttattgaagtataattaacaaataaaaattgtatatacttaaggtgtaaaacgtgttgtaatgtatgtataccttgcaaaatggttaccacggtcaatctaattatccattgcttctgcatagttaatggctttttttggatagtgaaatatttaagatctattcttttagcaaatttcaagtatatgatgcagtattggtaaccatagtcaccatggtctacgtgagctctccacaatttattcatcttgctgaaataaaactttttaatccagtgcttaatgtgtgctaagcactgtgctaggcactggatttactctgggaactctgaaggtcacagagataaggaagaaggggctttttgttttggttttgtgttgtgtttattttgctgggttttatggaatatatgtggggagaaaaatgtaaatattttgtgtaaaatgtagccagagcaataaaactgatttgcaggggactggagaatttagtatttgaccatccacactaaaccacagagcagtgacttggcagagccagaaggcattatcacatctcttctttatataggaggaaacagcttctctaccccgacttaatcctgatacaaaagaaagaaaaattgctctttgctttaattgcctacagtgtgtgtgatcctcagccaccgcctttaccagctggctattcaagtttgtaacagaaattgcagatttgtgaaatctccctggaaagagtcccaggagttcttgtgaagaggatttgctgagttggcaaacttaaagaattcttgttggtagaggcagtacagtccttgggctatgggcctagaaaaactgattgtttcataatttgcaccagaatagggagagggaataaaggtggaataagaaaaggaaatctgggaatttttgagaaaaaaaaaatgttcctttagggttgccttatcctgatattactgcttattaactatatttatcaagtatcaagtagtatgatataacctacatagaatatagacaagggatttacagtcagagtttataacccaatagactgattacttttgactttcattttacaagacccctgagattctgagataatgtttaggagtgttgcaaaacttaatcagaagttaatgttagtaaactcaactgtaaaatagtagagggcaggggttcttaactctaaatccttgatgagtttagggcaggggacatgacattcctgtaattctgttatatgtttaagtagatttttctggagagaggtctgcaacttttatcagactcctaatgtcaatgaccgcaaaatacagttaagaactgctaggccgggtgtggtggctcatggctgtaatcccagcacttggggaggcagaggtgggtgaatcacttgaggtcaggaatgtaagaccagcctggccaacatgatgaaatcccgtctctactaaaaatacaaaaattagctgtgtgtggtggcaggcgcctgtaatcccagctactcgggaggctgaggcaggagaattgctggaacccaggaggcaaaagttgcagtgagtcaagatcgtgccattgcactccagcctgggtaacaagagcgagactccgtcttaaaaaacaaaaaaacaaaacaaaaaaacctgctagtatagagatggtcactaaatcaaaccatacataaaaacaagaagttacggtagcccacgcctgtaattccggcacttcgggaggctgaggcgggtgggtcacaaggtcaggagatcaagaccatcctggtcaacatggtgaaacccggtctctactaaaaaatacaaaaaattagctgggcgtagtggcgtgcactggtagtcccagctactcaggaggctgaggcaggggaatcgcttgaactcaggaggcagaggttgcagtgagccgagatcgcgccactgcactccagcctgggtgacagagcaagactccatctcaagaaaaaaaaaaaaaaaaaaaaaaagactactactaagagaatattgatagataatattttatttaaatatgtggcaacaatttgagttaaaactgatgtttccgctctttataggccgagtgatagctactttcacatgttcaggagaaaaggaagtaaatttggctgttcaaaatgcaaaggctgcttttaaaatatggagtcaaaaatctggcatggagcgttgccgaatccttttggaggctgccaggataataagggtatgttccaatttatttccttccagaactcagacattgctctgaggtttctttgtgatgtttgcagttcgactttgttgcaacattaggccgtaacgtttttataaaatggaaaaacatttccacatgctcaccttagtatataaaacaagtttttgttcaatacttcccatctggatgttggctcttggacatctcctttggcaggttttcatgtttgtaaagctttgttttgaattataatgcactctttatagctcatcgtcctttttttatttttatttttttttttttttgagacggaatcttgctctgtcgcccaggctggagtgcagtggagtgatctcggctcactgcaaccttcgcctcccgggctcaagcaattctcctgcctcagcttcccaagtagctgggactacaggtgtgtgccaccatgcctggctaatttttgtatttttcgtagagatggatttcaccatgttggccaggctggtcttgaactcctgacctcaagtgatccacccacatcggcctcacaaaatgctgggattacaggcgtgagccactgtgcccagcctttctttctttttaaaccatgtggtttacttgtttcctttttattctttattttgatgattctcaagtctacctttctttttcagatttgttttcagatagggttttaagtatcgttactttaattgggaagatttcatagatttgtagatgttccctttaaaaaaaagagagttaaactttttttttacatcataaatatatacaatttttatttgtcaactaaaaaaaattgtaaaaacaagtatttaatactcatcgcaaaacataaaaagcctgcaatgcaaagggtttctgtggtgtagtagttaccacgctggcctaacacacggaaggtcctctgtttgaaacttgacggaaacaaaaggtttcttttgtttcccagaatctgaccaggctgcctcttcctgggagtccagagctgcgaggaacaagtgataatcctgcctccttttttttttttttttatacttaagttctagggtacatgtacacaatgtgcaggtttgatacataggtatacaagtgccatgttggtttgctgcacccatcaactcaccatttacattaggtatttctcctaatgctatccctcccccagccccccaccccctacggccccggtgtgtgatgttccccaccctgtgtccaagtgatctcattgttcaattcccacctatgaatgagaacatgcagtgtttggttttctgtccttgtgatagtttgctcagaatgatggtttccagcttcatccatgtccctgcaaaggacatgaactcatcctttttaatggctgcatagtattccatggtatatatgtgccacattttcttaatccagtctatcattgatgggcatttgggttggttccaagtctttgctcttgtgaatagtgctgcaataaacatacgtgtgcatgtgtctttatagtagcatgatttataatcctttgagtatatacccagtaatgggatggctgggtcaaatggtatttctagttctagatatttgaggaatcgccacactgtcttccacaatggttgaactagtttacagtcccaccaacagtgtaaaagtgttcctatttctccacatcatctccagcacctgttgtttcctgactttttaatgattgccattctaactggtgtgagatggtatctcattgtgggtttgatttgcatttctctgatggccagtgatgatgagcattttttcatgtgtcttttggctgcataaatgtctttttttgagaagtgtctgttcatatcctttgcccacttgttgatggggttgtttgttttttcttgtaaatttgtttaagttcattgtagattctggatattaaccctctgtcagatgggtagattacaaaaattttctcccattctgtaggttgcctgttcactctgatggtagtttcttttgctgtgcagaagctctttagtttacttagatcccatttgtctattttggcttttgttgccattgcttttggtgttttagtcatgaagtccttgcccatgcctgtgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttcctcatttcttgtttttctcaggtttgtcaaagatcagatggttgtagatgtgtggtattatttctgagggctccgttctgttccattgttctatatctctgttttggtaccagtaccatgctgttttggttactgtagccttgtagtatagtttgaagtcaggtagcatgatgcctccagctgtgttcttttggcttaggattgtcttggcaatgcaggctcttttttggttccatatgaactttaaaatagttttttccaattctgtgaagaaagtcattggtagcttgatggggatggcattaaatctataaattaccttgggcagtatggccatttttgcgatattgattcttcctatccatgagcatggaatgttctttcatttgtttgtgtcctcttttatttcattgagcagtggtttgtagttctccttgaagaggtccttcacatcccttgtaagttggattcctgggtattttattctctttgaagcaattgtgaatgggagttcactcatgatttggctctgtgtttgtctgttattggtgtataggaatgcttgtgatttttgcacattgattttgtatcttgagactttgctgaagtagcttatcaccttaaggagattttgggctgagacaatggggttttctaaatatacaatcatgtcatctgcaaacagggacaatttgacttcctcctaattgaatacactttatttttttctcctgcctgattgccttggccagaacttccaacactatgttgaataggagtggtgagagagggcattcatgtcttgtgccagttttcaaagggaatgcttccagtttttgcccattcagtatgatattggctgtgggtttgtcataaatagctcttattattttgagatatgtcccatcaatacctagtatattgagagtttttagcatgaagggctgttgaaatttgtcgaaggccttttctgcgtctgttgagatagtcgtggtttttgtctttggttctgtttatatgatggattacgtttattgatttgtgtatgttgaaccagccttgcatcccagggatgaagccaacttgatcatggtggataagctttttgatgtgctactggattctgtttgccagtattttattgaggatttttgcatcgatgttcatcagggatattggtctaaaattctctttttttgttatgtcttggtatcaggctgatgctggcctcataaaatgagttagggaggttccctctttttctaatgattggaatagtttcagaaggaatagtaccagctcatctttgtatctctggtagaattcagggtttttagcttctttgtgatgggttcaaacatcatcctttacctcagagaagtttgttattaccgatcttctgaagcttacttctgtcacttgtctaagtcattctccgtgcagctttgttccattgctggtgaggagctgcgatcctttggaggagaagaggcactctggttttgagaattttcagcttttctgttctggtttctccccatctttgtggttttatctacctttggtttttgatgatgctgacctacatatggggttttggtgtggatgtcctttttgttgatgttgatgctattcctttctgttagttttccttctaatagtcaggaccctcagctgcaggtctgttggagtttgctggaggtccactccagaccctgtttgcctgggtatcaccagcggaggctgtagaacagcaaatattgcagaacagcaaatgttgctgcctgatccttcctctagaagctttgtcccagaagggcacccacctgtatgaggtgtcagtcggcctcgactgggaggtgtctcccagttaggctacttgggggtcagggacccacttgaggaggcagtctgtccattctcagatctcaaactccatgctggaagaaccactactcttttcaaagctgtcagacagggacgtttaagtctgcagaagtttccgctgccttttgttcagctatgccctgccgccagaggtgcagtttacagaggcaggcaggcctccttgagctgtggtgggctccactcggttcgagcttcctggctgctttgtttacctagtcaagcctcaggaatggcagacgcccctcccccagcttcactgccaccttcgcagttccatcttggactgctgttatagcagtgagcaaagctccatgggtgggggacccgccgagccagctgcaggatataatctcctggtgtgccgtttgctaagactgttggaaaagcgcagtattagggtgggagtgtcccgatttcccaggtaccatctgtcacggcttcccttggctaggaaagggaattccctgaccccttgtgcttcccaggtgaaccagtcctaatgagatgaacccagtacctctgttggaaatgcagaaatcaccgtcttctgcattgatcacgctgggagatgcagatcggagctgctcctattcggccatcttgattctggactctgatagttaaactttttatagtcttaaagatcagaagtaccagatgttcattatagaaagaaaattcagaagagaatacatcaaaataagaatcatggatagctgagtggtaggtctgtggtgactttttgtcataagtatgttacgtcagaaactgtgacgggtctgagagtttccctgctttcaagagtgtgtgtgtatatgtgtatatattacatacatatacatataaaacacatataatatacatatacataattatacacatataagctatgttatacacatagaataatatataatctatataatatacatatattctatattatagttgtaaattacacaattatgtgtaatatatgtatattttatacatatatatattctagcaagagacatgaggctttttggatcacagagaaggatggtttattacagcaaaatgcagcagccatagcaataccttagcactaatttctgtttatttattattattttttttttgtgatggagtctcactctgtcacccaggctggagtgcaatggcacaatcttggctcactgcaacctccgcctcctgggttcaagcgattctcctgcctcagactcctgaatagctgggattacaggcacatgacaccacgcctggctattttttgtatttttagtagagacagagtttccccatgttggccaggctcgtctcaaactcctgaccttaggtgatccgcctgccttggccttccaaagtgctgggattacaggcatgagccactgcatccggcctagtttttttgttttcaaagcaccggtcaccacggtgagtgaggggatgggatgagaaccaggtgagatccctgtgcatgcaggaagttgcaccaaaggagaagaaccctaaacttctgagattcatttaaatagaaattactggcacatctgcccatcctcttctctggggagagagtgagagagattgagattacttattaagcaaatctccagggttgagagggaaggtatcactaagtttattatcctggagtataagcacatgtttcaggaacaggaagtaaagaggtttacatttctaaatttctccagatttctttatctttagggagatactgtctctgcctttcaaggcctttgctattcaatcaactcgtcagtgtcctttgcttggaaagccctgaccatgcagaaatatcaaaatattcatatagaattttctcccaacgaagtattttccccgttattaaaaatttatttttaattcgataaaccaaagataactcaaagcagataatttattattttcatttgcccattttttttcctgtgaatgagcagcattgtagggctgttaagaattggctcctttattgttaggaaatgacttttattgatcctgggtaatatctaataatattttttgctctgaaatctgttgtctgatactaaatttcatttctttttactttaccctcccctttacttttcctttgatacctgtgtggtgttttattaatcaaaaacccactgcttattattaagtgtttattaatcaaaaacacttgtctgatgatcgtgctctgaacctgccttcaccccaatttattccataactgaatagatcccactctgtgaccacacctacaatcatattagccctcagttttcttttaagtgatttttctagttaatcaagatctgcagttctttgttcttttttgacagggtcttgctctgtcacccaggctggagtgcagtggcacaatcatggctcactacagcctcaacctcctgggctcaagggatcctcttgcctcagcttcccgtatatgtgcaccaccatacctggctaatttttgtttgtattttttgtagagatggggttacgccatgtttcccaggctggaatttaaaaaaaagtattgctgtaaacaattattttttaaaatattttaagaataaggtaaaatatttcacatttgtccacatatttaccatttctggtgctcataagtcatttgtgtagacccagatatctgtctgctgtcattttctcttctgctagaaggaatttcttcagcatttcttttctgttttgttttgttttttgagacaaggtctcgctctgtctccccagctgaagcacagtagtggaatcatagctcactatggccttgaccttctgggctcaaacgatcctcccacctcagcgtcctgagtagctgggactacagactcatgtcaccacacttggctaatttttgtattttttgtagagagcgggtttattcatgttgcccaggatggtcttgatctcctgggctcaagtcatcctcctgcctcagcttcccaaagtgctgggactgtacgtgtgtgccactgtacccagcctagaattaattaatttcttttcttttcttttctttctcttttttttttgagaggagtctctctctctcacccaggctggagtacagtggcatgatctcggctcactgcaacctccgcctcccgggttcaagtgattctcctgcctcagcctcccgagtagctgggattacaaatgtgtgccaccatgcctggctaatttttgtatttttagtagagatggggtttcaccatgttggccaggctggtctcaaactgctgacctccagtgatccgcccacctcggcttcccaaagtgctgggattacaggtgtgagccactgcaccccgccaggctagcatttcttatagtgcaggtctgttggtactctttcagattctgtatgtctaaaaaagtctttcttttgcattaatttttgaatgaattgtaggtaaatagttttttctttcagtactttaaagatgttgctccactgtcttctgatttgtattgtttcagaagagaaatttactgtcatttttatttttgtatctttgtatgtaatgtactccctctaccccccacccctggctgttttaatatttttctccttatcactggttttaagcaatttgattatgatgtcttttggtgcagttttcttcatatgtatttttcctgaggtttattgatcttcttggatctgtaaatttgtttcatttggaaaaaaaatttggccatgatttctttagtttttttttttgccccctcttccatcacttctccttcagggcctccaattacacatatattgggctgcctgaagctatcccacgtcactgatgctcagttcattttccagtttttgggtgtgtttatgggtttttttctccttctgagccttccctcccaccccctgtgtgtgtgtgttttgttttcaggtaatttctattgttatgactcaagttcatcggtcttctatagtgttttatctgctgttaatctcatctagtgtattttcatctctagattaatttgggtcttttatatatgtgttctgtggctctccttaacatgcttatgtttttctgtgccttcttgaacatacggagtatagctatcataacttaatgttcttgtctactagttctgttgtgttatttctgaatgtgtttttattggttagtttcgcttcctggttaaatgttacggttttctactttttgcatgcctggtagtttttgatcactagacatatgatctctagtgaatcactagggcacattatattgctgggtgctggatagtcttgtactttaaaaaatattcttaagctttgttctgggacacagtgaagttacttggaatcagtttgatccttggaagatttgcttttagatcagcaaatttcgccatgttattcaatacccttctgactgcttaaccctgtgatccgggtgttaatgaggttttctcaccatggctggtgggaacatgaactatacctggccctgtgtgagttctggggcttttttttttaaaaaaaaaaacattttcttcttgggtagtccttttcccagtcttgggtagttttctcacactggtactcaaaggggaatctgcagatttctggggttctctatctgtgcagctcttttcccttccacactcagtcttgaagaactgtagccactcaaagttccctaaactcccaccctatcttctcaactcatgtgtctgctgggcgccacctagcttcctcctccctgctctgtggcctgaaaactttctctaggcagtagactccagcaattgtagggctcacctcattggttccctcctccagggaccactgccttgagttgcttaatgtctgatgtctgaaaatggttcatgtattttatctggtgtttttagttgtttaaggtgggagaatgaatctggtccctgttaatccatcttggctagaagctcattgattcctagtggaaatgaacatttttttccatattttctcatttttactttgaatcctttggtacttataccagattgtatagatcttgtctgtgagacccagtcatttttcagttggagaccccttgtgaagtagctatcatttggattaaaaggggagggagaatgttacttaaaacaatgacaaaactatctaaataaagaagagattgtgtatgtaggttatcttcttgcctccagccctggcccaggttggtttgtcttgtacagtgccaccagagtggtcctcctacagaagcacatttgatcatggtacatccttgggtaaaactggccatggtccccctccttaacatggccctcaggccctgtttctccagcctcgtcttttctcttcacacaccataagacccagctctcctgcactactggtccttcctcgtttaccatgtgtatactgtcacacctcatgcttttacaatgccatgacgctgagtttggtgctgttcttttgtttttcttgcctcttgtgcttacatgtttagcatttagtggtctgtactgtaatttatccctccctccctccattttttccttctggacaaggtgattgttgtacataattgtattagcaaaagcatcttgagatgtatatagctattttacctatttgagaaatgagaaaatgctcaaaaaggttaaatagcttgtcttagatcatataactagtaagtataagagctagtctgttgggcttcaaagctagacattaagccctgctgaggggttcgaagtgaaagggagaagtgagggacctactcttggcttctaatctttcatcccagtgaacacctggtcaagtcatattgtaaagcagggtgatatagaggaggaacagggttgggaacaacacatgtatttcctaagaaatacttgtagcagtatgttgttatggtgaacaattttatcttatggttactcttgcaatagtagcaggcagaaatttttgtcagagacatctttgatgatccttacgtactatatcagaagatctcctaatgctcttagtagataactttttttttgtaaggatggagaataatagaataacacagaaaaaatttcccaaggccatctaattaactgaattttctctgagagttgaaaccccaaaacagcccccaaaaccacttgcctatccattattttaaaagagaaaaaaatctccagagtaaaagtttctattctcttagtaaatgttccagggcttagcagcgatagaatcacagattacttcctatttgttcactcttacactaaagtgtaagcagaaccgtgtttcactattgccagtgtaatatctcttccctgtatttgaaatgttctgtactgattcatcactttattcaaccgattaatgcactagcctctctagggcctagtttcctcttgaattcaagaaacaaaatttaagctacttatggttgattatacctttggaaaactattttgtgttaattatactcaacaaacttaagaatggggaataatttatgcttggtgtaagaattgatgtatgttttcctcttagggtaccctctttctagggtcagcatactgggaaacaagttaattgtcaaaaggttgttttgttgagtgtagagtcaggaagggagaaggtaaattgttggtttaaaagagagtttaatttagaccaggtttgaatgtgaacagattatcctttctgaaggaaaatgtctattcaaaaattgcaatattgatttaaaatgtgctgacttgcccttttagaagtaagctcttaaaggggtagacaggactgatactcttttccctagtaatgaatgtagaatgaatgagtcaaagcactttatacctctggcctttataagaaatacagcgtgtccaaatctcactatccaactgtcctttcttgtatttcatattggttttcatattcctactttcatcttttctgagctttgtactgtggatagatgcttgagttagtttctgttgcactccattttgcttctggccagccttactgcttatcagttttataaacagaatgttccttcttgtcagttgcttaatcttttatgtatgttctgatagtcaccctattatttattttaaattggacccataatagcaactgcctacttcttacatattcaattcttttatgtcctttagaccaaagaaaggcattatttagctttctttcttaggtctaatttcctaaacctttaagctcatcattggaccatctattgaatttctttatccttagtaagttgtggagcccagaactagaaacagtatttgaaaatagtattgattgaatgctaagtattagaaaatattagaagagaatatgctgcaattctttgggtgacttaaagtgacgcatattacaacctcttaaatgcaattgtgtgttagaatattttgtataatttccctaagaactgttttctcttaccatatatgagcaaacatacatatttacgtacatgtacgtattacattcattttccaaaatgaattattcttccacttgtgagccatccattttctctccattctctacccctcacctcttcaataaatatacacttcaaatcagaatgggcctgccctgtgactttcagagcctcagagggcatgggttcattcctgcccggtcttgccccttcttttactaactgatcttgaaataaagtagtggtcttaaatctttgtcgattaattaacgagggaagaacagggctgctgttcagctataagcctttatctctcttctaaatgtaacactgccatttcttttcatttaaagtgaaagctatttttagttttaaaaattgagcagtgtgttctatttaagcattaattacatcaagacatattggaatatgtcttaaatctagtcttctgctttacccaaaggaacgggaggatgaaattgctactatggagtgcatcaacaatggcaagtccatctttgaggcccgcttggacattgacatttcctggcagtgcctggagtattatgcgggcttggctgcatccatggctggtaagtcctcacctggtgtctgtgaccagctgataatgaggcagaagagcagggcctagtggtgaagggcaaagattttggaattaagacaaacctgggtgaaagtcttgggtttgtcactttctacctgggtggcctgggaattactttatctttcctaatctaaactggagataataattcctaccttcttgggttaaggattaaatgagatagtgcatgtaaagcacctagcatgatacctgagctttagaccaaattgctgaaaaaccagttttcataagaatcggtttgtcatatttaccagttttatctatttagcaaacttttttttgacagtgtataaagttttcaacaattgatattggaaggttggtagggcctaggaaggttgcaaggaacttacatgcttcccctgctgttgagtgttcctctcatttccattttgtttcatctaagctatctaatagaggctcagtaaattcttagagagttgtaaaatcaagttagatgaacatgtgtttgaaggataggcagggttctctatgtggagagaatacgtggaagccagtggaagactgcctggaacaaatagaagaatggagacagggtgagcctggtgtattgggagaagtggggaggctgcgttgactggagtacaagtcagactggtacagatgttggtgaaatcttggggagcacagacctgcatcctcctttactcctgttttccccataggtgaacacatccagctcccaggtggatcgtttggttataccagaagagaaccacttggggtatgtgtgggaataggagcatggaactacccctttcagattgcctcttggaagtcggctccagcattagcctgtggtaagaatgaattatccctccatttgagagccattcgttcattctctcgttcgttctctccccattctctacctttcacctctctataaacacacactttaaatcggaaggggcctgctctgggatattcaaagcctcagaggacatggctcgttcctgccctgtcttgcccctcaaggagcttatagttaaggttgtacacaatcatgtctagatattctcaggttttatttatttaattttgtatatgaaaagaaatttaattttttcttattaaattgaattagatttgtgctacttataagttctcttcctttctggacaagaattttaaggtaggagttagcacttaggagtttgacttcatttacgaagcagaagataaactcctttcttcatttgggtcttaagagaaatgataagcaaggctttgataagcttcttatcaaagaggagctttggctgattgacataaaatagttttcttacagtatttaaagagaagaatctttgaggaaagaagactaattttatcttagaaaaaattgtaatgttagaaagcattactgttaggacattatattgaaatgcagcttttgtcctgttgccattgcatgttcttgttttagcctatttctctttgagatacagctgtgaaagaggaaaaatagtcactagctttaatagtcaccagaattaagtcactagctttggggactctcatcaagtgaaccattctggtcttcaatgtcaacttttataaaatggagctaatgatacctacttcatactgctgttgaaagtgttaaatgagataatatatgtgaaaaggcctagatatgcaaatgtgagactgggcaactgtagggtttgggatctgtttaatgagagaaaccaagatgaaaaggacaagagttgtttacttattgatatggtttggctgtgtccccacccaaatctcaacttgaattgtatcacccagaattcccatgtgttgtgggagggacccagggggaggtaattgaatcatgggggctggtctttctcatgctattctcctgatagtgaataagtctcatgagatctgatgggtttatcaggggtttccgcttttgctgctgcttcatttttctcctgccgccaatgtaagaagtgactttcacctcccgccatgattctgaggcctccctagccatgtggaactgtaaatccaattaagcctctttctgttcccagtttcgggtatgtctttatcagcagcatgaaaacaaactaatatggttattaataacatttttgatgtaggatttggttggggaagaggaaacaattggaatcatttttgaattgtcctctagtcctgttttcaggggatcactggtcttagaaagtctttttatgtttgtgtcttgggtttatgcaggtaatgccatggtctttaaaccttctccctttacacctgtttctgcattgctactggctgaaatctacagtgaggctggtgtacctcctgggctcttcaatgtggtgcagggaggggctgccacaggccagtttctgtgtcagcatcccgatgtggccaaagtctccttcactggaagtgtgcccactggcatgaaggtgaggacaaaaccagtattggtcaacacacatggcatttggatgtggcaaatccggtcctacccagagtatattttggaggcttctcttttgattttacctagcctgaattgggaatgggaaggagattttattaggcagaggtgtgaaatttcctgtaaaagtatgaagggggaaagggagtacacatggggtgatttgtgttaggccaggtaggggtggaaattaacagccccagcctaaggagaggatgtgtcttagtggacaggggcctgggctgccacttgtattgtttagtgacttaatttcttgtatagaagaaaggatttttactcaggctatttcagatccattattttgacattaatttgtgttctgaactctgtcagccttaaacacagtaacaataacacaaaagaatttctggctatgacaatcctgtgaattgacaatattttttatttttatttttttgagacagggtctcaccctgttgcccaggctggattatagtggtgtagtcacagcttactgcagccttcaactcctgggctcaggcagtcctcctgcttcagcctcctaagaagctgagactacagtcatgtgccactgtgcctggctaagtttcttatttttctgtagagatagggtcttgctatgttgcccaggctgggacaatattttttaaatgaactccctcttctaatgtcagtgcaactctgtggattctcttcagttttctggaatagaatattttaatagccaaaaggcaaaggatattgacaagaataaggctacaggtcacaaacagttcaagatgattttgtaggttcagggcctagttgacttagcatgcaatataatttgtgttaaagttctgaataccttgtccttgttctgcaagatcatggagatgtcagctaaaggaatcaaacctgttaccttggaacttggaggcaaatctccactcatcatcttctcagactgtgatatgaacaatgctgtaaagggggcgctgatggccaacttcctcacacaaggccaggtatgtacctgtccctggaagaggtgtaaaaggaatctctaccccctcatccaacagtgtgttttaaagctttttgttttacaatactttcagacttacagaaaagttgcacaaatagtacaaagaattcccatgtacctttgaaccagatttctcaaatattaacattttaacagattcactttatcatcttctttatctgcctgtacatacgtaggcatattaagtttttctgaaccttgagagtaaattgtagacataaggcccctaacctctaaatataaagttcctaaaaacaagtgcattcttttacataagcacggtacacttagtaaaattaaaaaattaacattgatatagtactgttactgaatctatagcccttactcaatctatagcccttattcaaattttgccacttgtttgactaatgtcctcatagtaaaatagaacaaaaatggttttttttccggtctaggatccagtcaaggatgatgcattgcctttagttgtcttgtctttaatctcctttagctgagaacagttcttcagttattcttgtctttcaggacgttgacattttgggagaacaggccattcattttgtagaatgttccttagtttgggtctgtctgatgttttctgttagattcatattatgaatttttggcaaaaataccacaaacatgatgtcatatcctactcagtggtgatttaactttgatcacttgctttaaggtaagtcctcactgtaaagttactgttttttactttgtggttaataagatcttgtaggaggtattttgagactatcctgttcctcatcaaactttcatgcagtaaatacttctatcaccactgacgattcttgctgaaaacaatttttattatggggttgcaaatggtgattttccaattccatcatttcttctatatttgttcaccttctactgtaagaaagaacttgcccttcacccctgtttgttttccattcatttatttatatcagtatggacccatggattcttatttcattctatgtgttataatccaatactatcattatttatttattttttatttttatttatttacttacttattttttgagacggagtctagctctgtcccccagacggtagtgcagtggcacgatctcggctcactgcatcctctgcctcccaggtttaagcgattcccccgcctcagcctcctgagtagctgggattacaggtgcccgccaccatgcccagctaatttttgtatttttagtagagacagagtttcactgtgttggccaggctggtctcaaactcctgacttcacaatccacccacgttggcctcccaaagtgctgggattacaagtgtgagccactgtacccggcctttattttatttttttattgagacggagtctcactctgtcacccaggctggagtgcagtggcacgatctcagctcactgcaacctccaccacctgggttcgggttcaagtgattctcctgtttcagcctcccaaatagctgggactacaggtgtgtgccaccacggctggctaattttttttttttttttttttttgagacagagtcttgctctgtcgcccaggctggagtacagtggtgcgatctcggctcactgcaagctctgtctcctgggttcatgccattcttctgcctcagcctcccaagtagctgagactacaggcacccgccaccacgcctggctaattttttgtgtttttagtagagatgaggttttaccatgttagccaggatggtctggatctcctgacctcatgatacacctgccttggcctcccaaagtgctgggattacaggcatgagccattgtacccagcctcattatttattttgatgctaaaataattgcagatggctggtgggaatccctttccgtgaccttttgatatgccctcattattctttgaatacttcattactttctggcatagcaaagtgttccagactcatacttcccctggctgtgctctggaaccagccatttctctgaaggaggcctggttccattattgtttatctgtttattattaatttttgagacagggtcctgctctgttgcccaggccggagtgcagtggtgctttcttggctcactgcaatctcggcccctccaaggtcaaacaatcctcccacctcagtctccagtgtagcacaccaccacattcagctaatttttgtattttttgtagagacggggtttcactgtgttggccaggctggtcttgaactcctgggctcaagtgatccaaatgcctcggcctcccaaagtgctgggattgcaggcatgtgccaccgtgcccggcctgttttttattttttgtaaacttttttttatgatttagaaggactatcttcaaaccagtacaagtatttcataaataatatctgattgttttctaaccagttgagtaatttgttgcacgataagccacctcacatctttcagcaagaaaaatactaagtctgaacagtaaagacattacacaatgagttaggacacaattaaaatctgctttaaatatttttttgggggagaggacaccacacttctctactaaataaagagaaacaattttgcagtccagaggtcttttatttttttatacctatcatgccatgaattcatagggaataggttccagcagctcaggctccttcccgttggttctcacacagtgggattccctgggtggagtaggctggtgcttcagctgaaaccaggtacctttctctttggcttccttctttttctgatcatcttctttcatgcatttcagaagctatcttgggtcttagagcgcttaatgtgctcaatgtgcacgttaattctcttggcaagaattttgcccttaatttgtttacagcagtgccaacaacatgctgggtaacattgtagactcttccagtttttcccaggtaatgcttttgggcattcctttttgaatagtacccgttcgcttgatgtctacagtattgcctttcttatagatttgcatgcacgtggcccaaggaacaactccatgttttctaaaaggcctagagaacatatattgggtaattcttctctttccctgtgtttgtcgttttggtgaattactggaagacggcagtaccaaccaaaagccctggttccatttagtggtaaatggtatttagaaaccaagatctgagtgccaggtgtgcttgttgctactggtgtatcattgcttctaggccctctcagaggccagtgctgggaaatacatgtttgtatatatgtctgtgcacatatctagttctgtatctgtctgtctacataataataagttcatccagatactttaattatagtctaataccacagggttcatttctgccttctccctttccatatttgtatttgttctctgacagtaagaaatttgactcccattatccacaatgtttatctaattgctcatcatagaatacacttagtattctaataatagtagtttcagatttgtaaatccatacctctgtggaaaataaaccttctaattagagctcagaatttttttacagttgtttttatattcagcgtgagagtatagtcagaatactgtgttcaaaagttacttgggtcagttctacctttccttcaccctccttcagtgtggttatgatactcatttaaaataacagattcatttgtttgtgtttgtattcatttgggttttatttcccccatccttgctgattttaaaattttattttgattaggcaaaacacaaacatggttctaaacatcagaattttacaaaaacagatactcagaagtgttactgctccccatcctgtgtactctgtttccagtgcctccttcccacccagttttgtccatctcctgtgggtagccagtctgatttgtttctggtttttgcttcctgtgtttctttttccacaaatgaataggtacttgtatatttcttattcttctttcatacacaaaaggtagcacattagaggtactcttttgtactttgctttctttgctatgtgtgtgtgtggatgaatatacacacacaaagaatacatatagtatagaatatatagaataaatatatagaatattctacataatctgtactatgtatactttatatatatatagagagagagagagagcactaaaaataattgtgacgtaatgtgaatttattttattattattattttttcgagatggagtctcactctgtagcccaagttggagtgcagtgacacgatcttggttcactgcaaccttcgcccctggagctcaagcgattctcctgcctcaccctcccaagtagctgggactagaggcatgcgctaccacacccagttaatttttttgtatttttagtagagacagggtttcaccatgttggccaggctggtcttgaactcctgagctcaggcgatccacccgcctcagccttccaaagtgtgggattataggcgtgagccaccacgcctggcatgagccaccatgcccagtgtgattttaaatatgtatcacaatttatccgttcatctggcaatggggttatttccttatcttggttattgtgaataatgctgcactgagcatgggagtgcagatatgtctttaagctactgatttcatttcctttggtatatacccagaagaggaattgctgaatcataggatggttctatttttaattttttttttttttttttttgattcggagtctcacttagttgcccaggctggagtgcaatggcacgatctcagctcactgcaacttccgcctcctgggttcaagtgattttcctgccttagcctcctgagtagctgggattacaggcatgtgccaccacgcctgactaattttgtatttttagtagagacggggtttctccatgttggccaggctggtctcgaactcctgacctcaggtgatctgcccacctcggcctcccaaagtgctgggattgcaggcatgagccgctgttccctgccaatttttaattttttaaagagcccctatcctgttttccttcatggctatactaacttacattcttttttttttttttttttttttttttagtgaaaggaagtttattaagaaagtaaaggaataaagaatgcctactccataggcagagctgccccaggggctgctggttgcccctttttgtggttatttcttgatcgtatgctaaacaaggggtgggttattcatgcctcctcattttagaccatatagggtaaaatgacgttgccatggcatttgtaaactgtcatggtgctgatgggtatgtcttttagcatgttgatgcattataattagcatataatgagcagcaatgacgaccagcggtcactcatcaccatcttggttttggtgggtcttagctggcttctttaccacagcttgttttatcagcaaggtctttatgacctgtatcttgtgctgatctcctatcttatcctgtgacttagaatgtctaacttcttgggaatgcagtccagtacgtcccagccttattttacccagcccctacttaagatgaagttgctctagttcaaacacctgtgacatttcccctctcccttttataaaagaacccttaatcctaagggttgcagagggacaaagatccatcttctgtaaactttttcatgctgaataggggcaatgatattcctgtctaattattagggtctcttgtattcaggatagagaggagctcagtcagaaagcgtcagggtgagggtcgcttataactctgagttccgacaaaaggtgatatccagagttggccaatcagtgctgcagtctatttcttttgggtcgggaggatctcctcagtattgtcccttccatggtttgccagaaagatgttactgcaaaggggccctgatccagaccccaagagagggttcttggatcttgtgcaagaaagaattcaggacaagtccataaagtgaaagtaagtttattaagaaagtaaaggaataaagaatggctactccataggcagagcagcctatactaatttatattctcaccagcagtataccaagatttccttttctccgcatcctcaccaacacttgttatcttttatctttttgataataaccatgctaacagatatgaagtgatacctcattgtgattttgatttgcattttcctgatgattagtgatgtggagcatcttttcataaacttgttggccatttgtatgtttctggaaatatgtctatccaggtcttttgcccattcgtaatcagaggttttttttttttttttttgcaattgaatagtgtgagttccttatatattgtgatgatttttttgtgtgtatggtaaagcctaatgtaaaatttaccaatttaaccgtgtgtgtgtgtgtgtgtgtgtgtgtgtgtgtgtgtgtgtgtttgtattttttttattttttatttttttattttttggagacaggatcttactctgttgctcaggctggagtacagtgacatcatcccagctcactgcagcctcaacctcccaagctcaagtgatattcccacttcagcctcctgggtagctgggactataggcatgtggcaccatgcctggctaatttttgtattttttgtagagatgagatttcgccatgttgcccatgctggtcttgaactcctgagctcaagcaattctcctgcttcagcctcccaaggtgctggaactacaggcgtgagccaccacacctggcctttttgaaccatttttaagtgtagagttcagtgacatttaatacattcacgttgtgtacaactatcatcattattcatctctagaactttttcatcaccccacattgaaaactgtgtaccccattaaataataactctgtttctctctcccctcagcctctggtaaccactagtctaattcccgtctctatgaatttgactattctacgtaccttttataaatgcaatcatacaatatttattattttatgtctggctcgtttcacttagtataatatcttcaggttcatccatgttgtagcatgtgtcaaaatttctttcctttttaaggctaaataatattccattgtatgtatgtatacacacacagcacacatacacacacacacagcacacacataccacattttgtttatccatttttttatttgtgaacacttaggtggtttccacttttggctgttgtgaataatgttgctatgaacattgatgtacagatatctatagtagaagtatctgctttcagttcttttgggtatatatccagaagtggaataagtggatcatatgataattcagtgtttaattttttgaggaaccactgtactgtgccctacaatggcagcaccattttacatttctacaagcaatgcacaaagtttccaatttctctacatccttgccaacacatgttattttcttattttcttgctttctctgtttttgataatagtcatcctattgggtatgaagtggtatctcattgtggttttgatttgcatttccctgattattagtgatattgactgcatatgtaattttataagatattgccaaatccctctctaaaaggaaatgttgcattcttttttttttgtttgttagttaagcaattattttattgctcaagtacatagacaaatttatgcaaccagggcagaggctgtatatgattcatatttccagttgggagagaggactcacttggtcttataatatcgagccaaacagtgaatccggctctctatcagaatcagacagaatttagcatcctcatcctttctcttcctctcaagaagcttttgaacagcaactgctgccttaattaaatggtagagatcttcagggagattaggagcggtcccttagacttaagaattcttaagattttattgcctgtcacaaatcgtacttgtgcagcatcatgtgaatctctcaggatcccaccgatttgtgaaggagtcaggcccttcttggccagtttttaaatctgctccttcatgtcgtcagatgtcaacttcagcccctacttcagcaaccccacttcagtggggatgctgcagcgatagagcaaagctgactgagacagacccttcccagaagcgtgcatgtgacccatgatggcagctgtcaggcagcaaaaggaacattcttactaacgatgcatgagtacctatttcttcatagcctttcttaacagcatatatagtcacaattttaaatttttatcagatagatgagaagtggtatttcagtatagttttaatttcagtttgtttgtttgtttatttatttattatctttgagacggagtctcgctctgtcgcccaggctggggtgcaatgggacgatctcggctcactgcaacctccatctcccacgttgaactagttctcccaccttagcctcctatagctgggactataggtgtgcaccaccacacccagccaattttttgtatttttagtagagatgacgtcttgccatgttggccaggttggttttgaactactgacctctagtgatccacctgcctcagcctcccaaggtgctgggattacaggcctgagccactatgcccaaccttgttttacaattatgaatgacattgaacgtctttttcaaaactcacatataataaaattcacatttttggtatgttatattatgagatatgattttccattaattgttaagagttttttaaaattagtgatgatagccttttatctgaggtaaatgttgcaaataattttattccaattttttaatggtcttggcttagtttaaggtatttgccatgcataaaatttttatttttctatagtcaaatttatcaattttttttctttaattgtgtctagattttgggtaatagaaaacctttttctacacctaggttttagaggaattaccagtattgtctctttttttaaaaaaaaaaaagtctcgctctctcatgcaggctggagtgcagtgacgcagtcagggttcactgtgtgtatccttgacctcttaggctcaagtgaccctcccaccttagcctcccaagtagctgggactacaggtgcgtgtcaccacacccaactaatttttatgttttttgtagagatggggtttcatcatgttgccccagctgattttggactcctgagctcaagtgatccgcccaccttgtcctcccaaagtgctgggattacagatgtgagccactgcgccctgatttcttattttatattttgattcctgatacatttggagtttatttttatatgtgatgtaagatatgtatcttattttatgttttccacattactgatgatttgttctagcaccatttatttagttcatctctgtcctaatagtttagctttcacttttatcatagactagatttccatgagcacttggctgtgtttttggacttttctgttctgtgttcttacagcatttgaacagtttttatgttcctttctataggagggtctaaatagtgattattagtgatttcagagacaaattttttaacaattagatttaagaccacagttcttgatataggtttactgttaagttcccttccattcttaaaatatacagccagattgagccctgatatgaggaagtaggagaggtgctgtgggttatatggatctagtaatggcctttaaaaaatttaaacaagcaaaataagaactaacttttacctcaaagggcagattttgcttgtggagtggtatgtccacaattacgtgtgtgatccttcttattcagtatggagacaatttttagaaatggaaatatccttttaaaaaatgtatagtgtctcttttcagtttaaagtttttagattgtgttcatttttccttttcccttttttctccttacacacatagaaattgatgtcttgtgtttgtcctttaggtttgctgtaatggcacaagagtatttgtgcagaaagaaattcttgataaatttacagaggaagtggtgaaacagacccaaaggattaaaattggagatccccttctggaagatacaaggatgggtccactcatcaaccgaccacacctggagcgagtccttgggtttgtcaaagtggcaaaggagcaggtaagaaataattggcagtagggtggggttggggaagattatactactcctaaatcacatgctttgtgcccttttcatgttaatattcgtatgactattattcattggactattagcatccctggctgtgttctgctttgtacctgcactgggaagactatgtgtttgttcgggatacaattaacatttcaggaatgcattttggggttatatttttaatacaacatatcttttttccttttcggcagggtgctaaagtgttatgtggtggagatatatatgtacctgaagatcccaaattaaaggatggatattacatgagaccttgtgtattaagtatgtcctctttttgtttgcttttagatgatttgaattaaatactgaatagatagagatgaatatttataaaatatgtacatgatataaagcaagggctggcaaattatgtggtcctactacccaagtttaagaagtagaactgctccattatctttgaagccttctgtgtgcccctcctttagggcacccatatgtattagtttatccaggaccacaactattgttctggaagcaaggagctcaaaaatatgaaagtgcatatttgattaaaaaaattaataaatttaattccttgagaaaataaagaatgtttttcatgtgacctgtagatcattgtattagacattttgcattgctatgaaggaatatctaagactgggtaagtagaaaagatgtttatttggctcatggttctgcagactgtacaggaagcatggcaccatcatctcctcctgttgaggcctcaggaagatttcagtcatggtggaaggtgaaaggggagcagacgagtcacatggtgaaagagagagcaagagaggcaccaggctcttttaaacagccagctctgtgtgaactcacagagtgagaatgcactcattaccatggggaggacatcaaaccgttcatgagggatttgccccgtgacccaaacacctcccactaggctctacctccaacaatggggatcatacttcaacatgagatttggaggagaaaggcatccagaccatatcagtcatcaatataataaaaccagtatgtcagataatatactaatctttttagaaattacataatttaataatttttagcacctccattcagtcttaaaaatctagttttgacagtcaaggtgtatatgggcatcctactcccacccatctacttccctcctacttcagaggtaactactattctcagtgttgtttttatcattcttatgcttttctctatcattttatagtgtatgttagtatcccctacaaaaatgttgatagttttgtaggctttaaacaattatatgtaggttgaaccatgttgtataattccttacatcttatttggagataaattaagctggtttttgcccctaaggttaatagtggtgtcagtttttaacaacttcatatttgatgcagtatataacctttaatcctcactagaaagaaccattgacatttaaaagctgaaaacctaatgtccatcccccatgaattaggttgcagttattacatgaatatttaataaataggaaaagcttacaatacattgttaaattaaaaatattggggctaggtgcagtggaacacccccagcactttgggaggctgaggcaggaggatcgctggagcccaggtgtttgagaccagactgggcaacatagtgagacccgatcttcaaaaaattagctgggggtggtggtgcacactgtggtcccagctgctcaggaggttttattttaatgtttgcagctaattgcagagacgacatgacctgtgtgaaggaagagatctttgggcctgttatgtccattttatcatttgacactgaagctgaggttctagaaagagccaatgataccacttttggactagcagctggcgtctttaccaggtatgtggagtgggacactgagagcagttttgaaggagcggggctgcagtatctgcttagatatttaattgatcctattctctcactttagtttgccctcataggagccatcagcactttctgtttgcttcaggttaagtcagaagacaccaaagcagcattttgcagtttgctgtaaatggccagagaaccctgctattgagttttaaattgagctcgtttaataaacacttaagattctgatctatgtaaagcattgggttagatgtcttttgaaaacacacatgtcaaggaatttagaaacctgtaagtatataaattgtgggcagtattcttcaaaaacatgatttttagtggcattatagtagttcctaattggaatgcattataactcatgtagccattttttctgtggttggatatttgggatattgtttctattttaaatattatagtaatatgattaatatctttgtgcataaactttactattacaagtaaaaatgatttgggagtacaatttctttgaaaccaattgcagattgcttggttttatacaaactttgattagtctttggcagtggaaggcagtttgctaaagcggctttacacttgggattatgctgtttctttggtgatacataaagttcacatttttttttttataacttcatggtcaagagcttgggaagaaagcccaagtctcacttgaggacctgatgtaattgcttctctttgagctccgaagaaaagattgaggagctgctcttttgatttggggagtgagcaggttaagtgctcttactttactttgccaccctcgtacagacaaagtccggttacaaaggcgggtaactccaatgtgctattctttttttcttaccagctttactgggataatgcacatactgtacaattcacccacttaaagtgtacaattcagtggttttagtttattcatggagttgtgcaaccatcaccataatctatttttaggacactttcatcatctcaagaagaaaccttgtgcccattaactgttgctcttcattcccactccccacccccagcccctggcatccactaaactactttctatctccatggatttgcccattctgaacattttatataaatggaatcatacagtatatattcttttgtgactggcttctttcacttagcataatgttttcaaggttcatttgtgttgtggcatttatcagtactttattcccaaataatattccgtggtatggatatgtaccactttttgttcgtccattcatctgttacaggcatttgggttgttttcatttttggctattatgaataatgatgctatgaacatatgtgtacaggcctttgtgtggacatatattttcgtttctgttgggtgtatatctagtagtgaattgctgggtaacatggtaactttatgtttaactttttgaggaactgctaaactcttccaaattcgcagcaccattttacattcctccgaacaacgtatgaaggttctaatttgtccacatcctcaccagcccttgttattgtctgtccttctggttttagccatccttgtgggtgtgaagtagtatctcattgtggtttttatttgcatttctgtgggttttcttttcactttcttgatagtcttatttgtagcacaaaattttaaattttgaccaattctaattctgttttttttatctgttacttttggtgtcatagtctaagaaatctttccctgacccacggtcatgaagatttattcctctgttttcttcaaagagttttatagttctcagtctgacatttttaggtctgtgatgcgtttaagttaatttttgtgtatggtgtaagaaagggctccacctttattttttgcatgtagatatccacttgtttcagcaccatttgttaaaaagactgtttttcctccattgaattttggtacccttattgctgttacttattttaaagataccatgtgcatgggactataaaacccaatccatatctgttttgcctggatgataaaagattttaaaacattttgaagaaatgagaatttagtaagatttgagaaccctagaactggcagtgtaacttttcctgttaaagtagtagcctaagaaactctcaataatgcacacattttttttttcttcatagggacatccaacgggctcatagagtggtagctgagcttcaggctgggacgtgcttcattaacaactataacgtcagcccagtggagttgccctttggtggatataagaagtcaggtgaggagctgggaggtgtgaatgcaaactaggtctctagagctaggtcgtaattcagaccttataaaccagtattcctaaacctgtctgcatatctgaattacctggggaaatacaggttcctggtccttccccagatccactgtagcagtctctgggaatggaagtcaagcatcttcccctacccaacactccctaaatctttctggagggttctgatgtatagcctggcttgtgaactgctgatagatatctcaaaaaggtttatcttgtgggtagaatactttttcttcacagcctgtgacttctgtaagcataaaatcactcccttaggggttctgtatcagggatgtccatcatcatccactgtggagtttttagattccatttaggtaaagtgtctttcaagtaatagctcagtaactttgtttcctctgttatgtcaaattaacaaaatctttaaatttatcattaagcaatcaattataatcgttttcattacccttgatggcatataggagtgtgtttccttagccactgctcattcatttcattcattttatagtcagacatatgttaccacaacatataaatttgtaagtctggtatatcaggagaaggtttgaggcatcaggagtatagccagaaccttgaggttctttctttggagtttgttgcctgtaaatattcatttacatatttctcatgctgttcttctagagtgaaaattggtttggactttgtcgaggcaccattctaagagtctgacctctagtttctgtggcaaatatttacagccatcacagtgttggcaaatatataaactctgatgaacactgatgagatggtgggtgttaatttgacagtcttatttgtcccggtggggtactcagaggagtcgtacacacagacacaagtgcaggtgggaaccaaggtgccatcttattaacatgtaacatataacattacatgttaagtttctgatagtccctcagtgcagggaattatttgtttggaatcagcagcttaggcctttggagggcctcctaactttccctttcctttggaccagaccatgctatgtggaatgagagagcgagaaagatggccagacgtgcagagcaacacctggcctaacaggcctgaccagctgtgtgcttaggggatttggaaaggaacaaaagacagagtgaggttttcccaggacctttgtgtgtgataccatttgagtggtgctccctggaaatgcacatatttgggacctcggccttgcccttggaaggcagagcctacctaagtctagcacagggtgtacaggcagggccaagggtgggatactacccttttagcacagtaacctcacccactagtaattgggcagtgtcttgaactctgagtaatcagagggaccttcagtgacccctcaccaacatgagtgggtaggttaagttactaggttgctcttataggtgtttaagaaatggtgaataagcctattgtgtaaagttttaaattagcatcagctttcaagggtgtcaggttgattattgtagagattgcctttaacacttgatataaaatccaagcatttttcagacctcaacccagaatagtagatacctgaaattaagattcctattggtgagaaacaagatctgtatatttccctatccctatccccaaatgccagtgggtcattttccccatgcctagctccattcacagctaatatgtggattgaggctttattccaaaacatttaggttctatattcttccctagccctgattagcagtgctcatctttgaagatcattgtgacttttcagactattgtagtgatggctcaacctgaccccttctcctcctttcaggatttggcagagagaacggccgtgtgacaatcgaatattattcacagctgaagactgtgtgtgtggagatgggtgatgtggaatctgctttttgaaaacctgcagtgaaacctattgacatggccacgctgtggaatgatgtgaattggccctgtttacagaggcagtacaactgaatgttattttacatccagaattttggcgttcagtataagagaatggttcatgttactctttctctctccatcagcttcctcactgaaaatgtgcattaagtgccttgtagatactaatcaagaaagctgtgattctcctcaaagcgtatttttgtgaaatcttttaagagccagtaacatacttctagagaacaggaaaagagactaggataatacatcttccacacatttggcccactgataatgttaattctctggcgtatttcaaagaacttgttcctggctgatccaagtgcagtggtatttacaactaattgatcacaaccagtttgtagatttctttgttccttctccattcccactgcttcacttgcctagtcttgaagaaaaaaaacaaaaaacaaaaaaaaaccttgttcctttataggttcctggtagaatcagtagagatgatttcagctcattgacatttttttaagctatatccccttgtcattccattgagaaagctgacaactgggatagggaggggattagataatagatggggtcaaattctgtgtgaatgtgaacttgcctagtaagcactttgtctctgttcactactgcgatagaggaaatctatctccctatcttgggtccttgaactacagcctgctgtcttacaccagtggagctaccctttaaatgtacaaattatttgtatgctaatgtaatatggtgaaattaaaataaatcacactgttaattgtt

SEQ ID NO: 35929 - DNA, 42858 bp, Homo sapiens
gccctagtaacggccgcatggtaactcaggcgccgggcgcactgtcctagctgctggttttccacgctggttttagctcccggcgtctgcaaaatgaagattgaggaggtgaagagcactacgaagacgcagcgcatcgcctcccacagccacgtgaaagggctggggctggacgagagcggcttggccaagcaggcggcctcagggcttgtgggccaggagaacgcgcgagaggtgtggccagtggaccagggagttgggggctgcaagcagggctgctgcggcgagagagctgctgaagtcggtggctcggggcgggatgcgcgcgccaggggtctcccgccattatttcctcagggaagtgaaaatgggccaggggctcggggaggggcgccgccctggagctgggtgaggggccgccccaggatacctagtgacgatccactgggggcagttgacggtttgccaactcatggacaagtgctgatataaacccacacaaccccgtccccttaattcgtaccaggctctattcgcgacactgggatacagcgggaattaagataggagcttacattttagtgtagtgagagacgataaacgtgtacaccaataaataaaaataattatcttatcttggtggggttagttactgcagggctttgtcggccacggtcaggaaattggattttattgtgaatgcagtggcaggctatgggacggtttaaagtagggaattgactaaactttaaaagctcattttggttcccaggatccgggaactgagggagagaagtgggaattatggagaagagcaatctggtttatccacccctccaagcatcctttttgaccattccaattaaatctcctttttctaagtgctggtgatgccaagtactttcacatacatattattttttggcaggtgaaaatattgagttggggagagggcacttcacgtatatgcttgacactcgttttagtaacggtaaacctggggtttgcacccacgtgtatttctgactcccaaatcagtgctctatgatgatacagccaccctctctgcctgctgttctctaaggtcacagccatgccccttggcctttggagagccttagcttctacaaaaatcttcacttaatataaagttaagctactgcctcttagcctgatttttctaaatggaaaggcctcaaagaaaagcctcaggtttccattttgagcatcatctttccaaaaaggaagtgtttgaccctggcttactaagcagctagtactgcaagtagctaacattggttgagtgctttccatgtgccaagcactgtgctaagtagctatatgtccactgccttgtcatatccaacgtattagttgtcccttccccgctttagtatgacagttttcagacacaaaaaaagttgaaagacttgtaaatacttgtgtgcctaaattctataattaacattttactgtgctgctttatcatatatcttttcatctgtccctctcccaatccacttttacatttcaaggtgaattgcaggcatcactacactttacccctacaccctttaacctgtgtgccattgactagtatgaactctgttcaagtgaggaaattctggttcatagaggtcaaataagtaggtccaaggttactcatctggtaagtgcgagagccagtattttaactcaagtctatgtatttaaacccagagtgcatgctctatgcctaagtgcatgctctatgcctaagagtgatgctgtatgcctaagacccacctcagctaccaggttcttgtgtgactctggtcacatcagtaacctccctgaaaaatgagagttagactaggtgatcttttaaagacccttccaattctttttaaatgttagaattcaagcttatctcacctgagagtagttggagtggaaattgagggagaatggatggaagaggtcctggtctgtaaataaacgcacatctccaaggtttgtaaagtctcttctaccttgggtttcccaaagagcttcagtgctggggattatgatatgacagggttgtgtggaaagaccatagtagttttttttttttttttttttttttgagacgaagttttgctcttgttgcccaggctggagtgcaatggcgcgatctcggctcactgcaacctctgcctcctgggttcaagcgattctcctgcctcagcctcgtgagtagctgggattacaggcgcctaccaccacgctcggctaatttttgtatatttagtagagacagggtttcaccatgttgaccaggctggtcttgaactcctgacctcaggtgatcacctgcctcggcctcccgaagtgctgggattacaggcatgagccaacgcgcctggctaggttttttatctatttagaaatatagcatctgggccgggcgtagtggctcacacctgtaatcccagcactttgggaggccaaggcaagtggatcacctgaggtcaggagtttgagaccagcctggccaacatgacgaaaccctgtctctactaaaaatacaaaaattagccgggtgtggtggtatgcgcctgtagtctcagttattcgtgaggctgaggcaggagaatcacttgaacctgggaggtggaggttgcagtgagctgagatcgcgccattgcgctccagcccgggtgacagcgagactccatctgaaagagaaaagaaaagtagcatctgaagaatatcttctaggttctattaagggcagtgtgctttggtaactgaagtggaaatgggatggatatagcatacccacacacattgcttacatcattttttttttttttgagagggagtctcgctctgtcgcccaggctggagtgcagtggcgccatctcggttcactgcaagctccgcctcctgggttcacgccattcttctgcctcagcctcccgagtagcaggtggattacatggtcgggagattgagaccatcccggctaacatggtgaaaccccttctctactaaaaatacaagaaattagctaggcatggtggcaggcgcctgtagtccttacatattttttgaggggctgccataagtgtgggaccaaggtacttcacagtccatgaggaatagaggtagaagagataagatgtattcacaagactctggcacagtgtggtcactgcccagagagaagagcaccttttagatagtcacgtattcagttattaaatcagtgtagcaaaccttatattatgtaatcctgagatatagatgctcagctagtgtaactttctcagtgttccccccttatagtcaaatattctaaaatatatgaagttccatagcccatttatggaatatgtgtgtgtatatatacacacatgtgtactgcaaatggttaataaaattcagagatttataatgtatttaaaatatactaacagatgataaagtaatttaaccttgaggattcaaaacatattcaatggatctaatagtgccataggtttaacttcacattcagtatttacagtgttcactgatggccagctagtactctatgtcattgattcttaccccttaataggttactctgggaatttgatgaaagctatggatcctttctctggaaaaaatgtatatatgaacataaacacagtttcgttcccaacttcaagaggtatttgggcccctggcgtctatccctgtaccctgggccaaaaatcagtgttcccacttgtactcatactgtgcattcttcacacagtagtagctagcaccatcttttaaaaacaaatcatagcatgacacatagtcttcaagaccttttcagtggctttgtattatttatgtagaataaaatccaaactttaccacacactgtaagttcctgttctgcgttctggccgctgtctacctcttcaacctcatcttcctggtctttttcgctatactttggtcactgcaacctttctgtcccttggatatgccaagcttgtttctgctttggattttctgaattcgctgttttctttgcctggaacgctgactcctgctcctcccagaggttcacatatcaaattaaatgtcatcagaaagacactccaggatcactttctagccactcgttctctctcatcatccctttttcttcatagtagtgatgaagattatgtgtgcaatgtttgtatgtttgtatccctccctaaaacatgagctccacaagtacaaggcttttctgccttgccttcgttaccctcggcacctagaacagtgactgcagtgcactggcactcagtgttagttggatgagtgtgtgacttgtgtaggccagggactgagatttttccccttgtgaaacattttaatattgatttattatttctttccattgtggtgtgtaggcatgtggcgtcatagtagaattaatcaaaagcaagaaaatggctggaagagctgtcttgttggcaggacctcctggaactggcaaggtactcattttctctcattttttaaatctacccaggagaatgatcctagtgtctaagccaaattgaattcatgtcttaactagtctttgtttagctaaatgggttatatgtatgtttttaaaattaatatgcaataatacaattgggtatctaaaatccctgcttctaaaattcaaattatcctggcctacctccagagaagaaagaatgaagtccttgaaggggtctcattgtctctagaatttgtcctttttctctttcaagtctcctttgctgtggaaatacatttctgttggcctagggcttcataaagatcttctgagtgacatcttacttgaggggacaaaaaaatgagtcaagcattcttccaaatgctagctttacgcatcgctattgtggctgtgtgggagatgaaaaaaaggaaaacaagaattagagacatgatttttatcttcaaggggcttacagtctctccagggcagaaagaaaggaaatcatgacagcacaggaggactcagtatgagtgctcagctttgaggtattgactaatattaaatgcagctggaatttaaggaggcagcactgtgggctggtacagctggaagggttgagacttgacattttcccttcagagctgggagaggatttggctttgcagggaagataagggcctttcaggcagaggacaccgtgtggcttcttgggattcgtgaggggactggccagatacttgaaactcaccagagttcccaatttgagcttgcttattcttcaaaagggccgcttgatgtgggcaagtaggagcttggggttgtgtgtgaaaagaaatgggctttaaattccagctctagtattgacttgctatgagacctgaggcaggtcccttaacttttctaagcaaaagcatactctacctatttcaagcaattattaaactgatcgattgtaagataatgacttgcattataattttgaaatgattactgattgtgtatcttatattggtatcttacaagaggaagaagtgctatatttgtgaacagttttttctcttcctatataaaagcaaattgtgaacagttttttaaactgtaaagtgccatacagatgtgagcttcagttacctctctccaggcaacattagcttgtccagtgcatttaccatttatttgcttgctattccttatatcttagaccttctctttccctccatttttcttcttcctaaagtaaataatttagaaatttcttctagaagtttgttggtgggaaagtctctcacgtttgcattcattatgttgcccttgttttgaaaaagagctatgttggctatataattcagttgacagatattttcttcagtactgtttcacagtacttctctctcaatgttatttgctcctttggcttctgttgtttttgagaagtctaattttgagggttttgagtcttctttctgcatgtttttgagatatttttgggtttggtgtttcactattatatgtcagagtggattaatttttgtttatcatgcttaatgctaattgtgcttcttgaatctgagtattatgtctctgctcaattctggaaaattgtcagccttaggagaatcgcttgaacctgggaggcagaggtatcagtgagccaagatcatgccattgcactctagcctgggtgacagagcaagactacgtctcaaaaaaaaaaaaaacaaaaaaactgtcagcgttaatctcttcagctattgcctttccccattctctttgttctttccttctggaactccactgagatgaggttaagattgcagtggttttcaacctggggcagttttgcccttgcaggggactttgacaacgtctggagacatttttggttctcacgacttggttgggggtgctactggcatctagtgggtggaggccagggatgctactaaacatcctgtagtgcacagagcagtttccataataaggaattatctggccacaaacgtcatggagtcaagctgagaaaccctgggctagagcttctcgttttgtcctctttgtcttttagcctctcatatttgttatctttttgactctgctaaattatgggtaatttcttttagatctttgttccagtctaattgtctcttaagctatgattaagtgactgattaatccaatctattgaatatttttttccttttcattttgaaaagtttggaacctacaaaaaacttgaaagaatagtgtgatgagcccctctataccctatacctagatagccagttataaatattttgtgacatttgctttttctctagtttatttctgaaccacttgacagtaagttgtaaggatgtcttcctacatgaccacggtgccatcatcagacccaccttgctaatgctattatattcccccaatttttgtcaattaaaaattaaattaattaatttttaaaaaatgagcagcagagccagggagagaatggtgtctcaggaaccaagaaaggagaacctttaaagaaaggagtaggtaaccatatccactgtggtagagaaatcacaaagatgagggagcctggcagctcatcatatgattccatgagcagttaacaaatgtgctttcaaagacaacgaagttaaattgttttaatgaaaagaaaatataggtgatagaaatcagaaaacatctttccaagttgtttcagtttttggctttttaaaaaacaccagaatatcaaaatgcaatcaaagattacacactgcataaattgttacaagttataatgtcttttttttttttttttgagatgaagtctcgctctcttgcccagggtggagtacagtggcgtgatcttggctcactgcaatctctgcctcccaggttcaaacgattctcctgcctcagcctcctgggtagctgggattacaggtgcctggctaatttttgtatttttagtggagatggggtttcatcatgttggtcaggctggtctcgaactcctgactttaggtgatccacctgccttggcttcccaaagtgctgggattacaggcgtgagccactgtgcctggcccccagatgtattttgttatggcccaccttttttactcatgtgtggcccttcaagagtcctcttttatgttttttttttaattgtaatgtttttgtttgtttgtttgttttttgagacagtttcagtctgtcgcccaggctggagtgcagtggtctgttacccaggctggagtgcagtgatctcggctcactgcagtctctacctcttgggttcaggtggtcctcccacctcagcctcctgagtagctgggactacaggtgcacaccaccacgctttggctaatttttgtagttttcgtagagatggggtatcgccattttgcccaggctggtcttgaactcctgggctcaagcaatccacctgcctcggcctcccaaagtgctgggattgcaggcttgagccaccgtgcccagtcccggttttattcaggggtttctatcttaagtgctataccttgctgagctttcctgtatctacagtctctgaactttcaaggcaaatagtttactgctctgaatgttattatttattcaattctaggtgttttgtaagaggagaggttttcagtggacccagtgtgccatattgctagaagcatatgtctttcattttttttggtgatattgtattgctttcctcccaggaaatatgagaagtgctcagcactgtggtattaccttataagtttgtccactcccttccaatgtgtatgaaggaatttggtgacttctgcttaatggtttgctgcagggtcccaaagtttaggcaacttacctgggtgacaggcagaaatactgcttattttagagatgcaaatgcatggttcatatgcatttccactcttgaggacctcacactgttaataatgggtttgggttttagaagaaggagatattcagatgagattgaaaaatagagatttcttcaaccttcttttggcaacaacctcttttttgtgccacttgtcactcacatggggtgagtacaaaaaaaaatggctttggagattggggtttgcatcctggtgctgctgcttgcggttttaccttgggtgtgttggtaacttttgagtttgtttcttaatctataaaatacaaactagatgatcaaggtcataggctagttggggagattcgatgaggtctatgcagcactctgtagtaggtgtaggaatagtagccatatcatatactttccctctggaagtctttaaatggaggaaacgagacacacatgaagctttttttttttaaccaagtatttatcatattttaatggaagtatgttcatctcttctgtattagttaaagggagggagagtgccattgaattggatgtggtcactgtctttgaagttcaaaactgagggtagggaattggggctggcagagatacaaggaagagaaaggagtaactgggaaggggtggtcctgtccagcctgtggccccacggggagtctgctgttagagtgctgctcctctcattgtgccctttcatgttccagagatttttttcctttgctcttagaagaataccagttttcaaggtgtcagccttgagctcacaagtgcagatgcctaatgaggcaggcaacggggatgagggaagtggctgggtgcactgtggcgtgtctgccttgagccccaggtgctcggccttgctgaaggtcaccatgagactgcaggccaaacagaaccaggctgtgagcaacgagtttgccacttgtgatctagcatggcactttagtactttcatttgacagatgaggaaatcgggcacctgagatttgctgagtgcccaaggtcacactgaaaattagtggcagaaccagcactaatctttctgttcctggctagtgcattttatactgtgctatacactgattctctaccagattttactacctcaaaactatcaccaaaagggcatagaaaagaaaatctgagaggaaccttgactgttaattttaagacaccgtctcagtttcactttgttcttcagtaacaagcttgttttcagtcttagcccatatacctggggagctggccttactcgtgctcctgtttcagagttgaggaaagatgaaaatggcatttagaggccatggcattgcccagttctgtaccaactttaaagcatttgcttgccatacttgacatttgaccgtacacctgtgaagtctggttctgtttagcatttgccagctgtaattatcttgtcaaaaatcaatttgtagtttaccacagggcgtgtttaagtgtaacttgttaagaccaactcatagcttcaaaatcctacttgaggtatccttcttcactctttgtgggctacataacataaaatgaacaatccattcattcattccttcattatttctgatgggttgtagattggtgttttcctgtatttgtaaaaagagaaagcaggtatctcaaagatccagtggtgtattcggagcaattaggtcagagccatatattgatattgagagaacaattttggatgactgtaaagttggcccttcctatctgtgggttccacgtatgtggattctgccaaccacaaatcaaaaatactcaggaaaaaaacaataaaaaataaaaatacaataacaaaaataatacatacttaaaaatacaatataataactatttacatagcatttatattaggtattgtatgtaatctagagatgatttaaagtaacaggaggatgtgcataggttatatgcaaataccctgccattttataccaggacttgaacatccatggattttggtatccctgtggatactgaagagtagactcttctaattatgataacatgatctttggagtcctgctgccagagattaaatctgcgctgccattttctagattatggtacttacgttgcattacttaatgtctctcagtttctcatgtgtaaaatggggagaatactagtgtctatttcataggctggttgtgaggatcatgtgaggcatttggagttgggcctgcactgggtaagtctgagtgaatgataacttgtaattatagggaagataagagatgccatttatgatttaaattgactgtccacaaaagtcatcaaacatttattgtgtgaaacatgctaaatggtaggactagatgttcagctgttcctagttcctggtggttctgtagcatgtgtttctgaactgtcatgttttcaggactgtgaactgtgtttccgttgctttcttttgtagacagctctggctctggctattgctcaggagctgggtagtaaggtccccttctgcccaatggtggggagtgaagtttactcaactgagatcaagaagacagaggtgctgatggagaacttccgcagggccattggtaagtagtgtcacatttgtgggaggagttggtctcacttcctgaagcctgtgcaccgaagcctctttgtggtgaagatgcctttatgactggtattcgtggcactgctgtttttcttttggcacttagtagtgcattatttttcaaataaaacaaaaccccagtttttctcattgaagtgcgttagcaattggagcaactatggaccctagctgtgagcctgcgcttcttcatgcaataaatagatgtgtctaaaagtgtttttttaatgagtcatattttcctggaagtcttattttgccattagagatgactatccactgaaaaggttttggactcaagccagaatctttgtgtgccatgtggccagaatgcccctggtcctggatggcgagccagaagagttgtggcctgtcatagagtgaggagactgaggagtggggactggcagagcttagaggcttatggcgcctaacccttagggcctcaggctatcatagtgagtgcctgtgatgagccaggccttccctcctctgaggggagattatcaatctacatttcgcatttgaagaagcagtctcagaaggttaaataacttgctagggacccagttagtaagtggcagaagtagtttgatccgacatctttctcatttctagagccgttgctgtgaagattggctgtgagaagaaaatggcttctctttcgaatttttgctttttgctagctaggacttctggggcagttttttggccccatttctgctggcacagcactgggcaagtcctagtttccctcagatctgcttatagaaatagcttatttcttttaactgttacataaaagtccagttattaagccatttctgttttttgaacatttagatttattctcagcttttactcttaaaaacaaggctactaggaatatccttttatgtgtctttgtgcacatgtgcgagtatgtttctaggatttgcctgctgagtcgtgggttatgaacactagtcagagtgcctgtaccagtttccaggctctttcattgtcaaaccaaagtaagtattcttaagaaggaaatttaccagaaaacttcaaggaaatgatgaaacttaaaagactgatgaaaaagttcagtttcggagtaagatcaggtagggccatggttaaagcttttgattttacattgaacaaaaggagaagcagttagaaagtgctggtatccctgggctctggttttgcttttaccagacccctccggctgggttgggagtggatagtaaggagggtgagggcagagaggagtctgagcaggacaaaatagtggcttggaccagggtggtggcagtggaagtgcaaagtggttggattctgggtgtgtttgcatggtagcgctgacaggatttcctaaagggttagatgtggggctgaaagaaagagaggagtcgaggaaaattcccaggtttggccatttttggagatggggaagaatgggagggagcaggttgggtgtttactcagcgtctcctggggatacagtggtcagtgcttatctttgtagacacagttcctggcacatagtgggtgctcaggaaagttcttctgagtgagtgagagaagtgggtagactttgaagcagttagaaaacagaagcctttttttttttttttttgagagagagtctctgtcgccaggctggagtgcagtggcgtgatctcagctcactgcaacctcagcctcctgggttcaagcgattctcgtgcctcagcctcctgaatagctggaattacaggcatgcatcaccacacccagctaatttttgtatttttagtagagatggggtttcaccatgttggccaggatggtcttgatttcctgacctcatgattcacctgcctcggcctcccagagtgctggggttacaggcatgagccaccgtgcctggctcatgcctgtaatcccagaagtctttagctaaaaaatatgaaaacagaagtctttagctaaaaaatatgtctgggctatagacatatgttgtttggtttatgaagtattttttataaatttggagctagttgtcaatatttagcaatagggaagtgtcataaagtgctcatttctgcctccttgaagcagctttccttcccacagcaggcggagctgagcgggtacttctgaccaggtccccataagcattgaagtttgtgactgtttttctaaaccagagagattatgaactgtgtccagaggctaaattttgtgttacttggaatatatttatttttattttataattttaacacttcctcagtgccacgatttgaatatttttaaaactgcaaagtatttctgactggaaatatattatttttaccatgaaatattggattttttggtgcttattttaattattttattttgttttagtgccatggtctcactctgttgcccaggctggcctttaactcctgggctcaagtgattcttccacctcagcctcccaagtagctggggctataggtgcacaccatcatgcctgggtttggtgcctattttatttaagttatctatttttaaaacatttttctctttttaaattttttttagagacagggtcttactctgttgtccaggctaaagtgcagtggtgtaacaatagctcgctgcaggctcaactccttgggctcaagagatcctcctgccccagcctcccaagtagctaggactgcaggtgtgcatcaccacacccagctaattttttaaaaactgtatgtaggccgagtgcggtggctcatgcctgtaatcccagcactttgggaggccgaggccggtggatcacctgaggtcaggagttcgagaccaggctggccaacatggtgaaaccccgtctctactaaaaatacaaaaaattagcggggcatggtggcatacgcctgtaatcccagctacttgggaggctgaggcaggagaattgcttgaacccgggaggtggaggttacagtgagtggcgattatgccattgcacttcagcctgggtaacagagagactctgtctcaaaaaaaaaaaaaaaaaaaaaaaaaatttacagagaggccaggcctgatggctcatggtggtgcctgtaatctcagcactttaggaggcaaaggcaggcagattgtttgagcccaggagttcgagaccagcctggggaacatggtgaaactgtgtctctacaaaaaatacaaaaattagctgggtgtggtgacgtgtgcctgtagtcccagctactcggaaggctggggtgggaggatcacctgagtaagtcgaggctgcagtgagctgaaatcacaccactgcacttcaacacaggcaacagtgagaccctgtctcaaaaacaaaatcgggaggctgagacatgagaatcgcttgagcccaggagttggtggttgtagtgaggtgacattgcgccactgcattccagcttgggctacagagtgagacaccatctcaaaaaaaaaattgtttttgtagagatggggtctcactatgttgcccaggtggtctcgaactcctggcctcaagtaatccttttgccttggccccacagagtgctgagattataggagtgagccactacacccatcccagtgccagttttaaacagaggtattacaaacttatagagaaggatgtaaaacattaattaattatgaagtaaaggcttataccgtcaccaccgaaggaacagagcacggccagcacctcagacatgtgtccctccctggtcacaaccccttcctctcctaggtgggacccacaatgtgccataattgtgtgggaatggtttatgtgatcatcataaccttgtacaccccatgtgtgtatctttaaaccatggggcttaattttgccctttttaaagtttatctaaatcatactttatgtgttccttgtgtcttgcttctttagctcagcgtctatatctgtaaggttcagcccatgtgattacatgcagtgtactttgtggatttttacgttgtatttggaatagcagtggaaatgactcgcaggactcctttaaggtttaaaatcttctgagtattttttttttaaacatgtgcccatggttttatttaactcataataaagatgagatgaacagtaagatgttacaactagttcaaatgtctgagtactttttttttttttaattgagacaaggtgtcacactgtcgcccatgctggagtacgtggcatgatcttggctcactgcaatctgtttcctgggctgaaatgatctacctaccttggcctgccaaagtcctgggattacaggcgtgaaccaccgtgtctggtccctgagtattttttttaaatgttctatttacttaaaaaatgtttttctgatattgataaaatctgtgaaaactggctttcacatggatgtatgtgtttgcattgcttaaaggtaacttgaatgctttaaaattcagaaaaatagagataagttccttggcatctgttttgtaatttgccatttttgaggggaggggacagtagtaccattcttttgatggcagcgaggtgaaaagaaaatttcttgatcctaccagagaataaaaaggcaggccattgactatcttcaaaaaggaaccctgcccatcttcctctgcctttgaattctgtgaagttgggagagggggtggggaggaagcaataagccgaccagaaataaaaagcagggagtctgtgctatttccttgatgtgatgaaggtccctgtcagggatatagaaacctgagccagcagatgaaacctgtgtcatttgtgttgtcgttgccagagatagcgccagctcagcccctttcctggctaacagccggtttcattgtccgtcacccacgtcccctgccagcttgtcagcacagagcaacttctaaacaaatgtgggggctagtgagagacgggaatgtctttcttcccctccttgaggaatttcatgccacattcatctagcagtaaatataagtaagcattccatttgaaggaatttatcgctgtgggatataaaaggtttgattttaaaaaatcaaagttcactttaaaagtacaggattttcccagtttaccacagtgttctgatatattcgtgttgtttggagaatttttgtctaagattaatgttcaggaactaagaatttggtaaagcacaaatgaaatgggtcctctcttttggggctattccaaaacttccatttataggctatcagatagaatgaaggtagagtaaaacttttccttaactttaatatctgagagtctttgtcctgactgggtttctggggtagagaaggcaaacagcccaatgataagataatgaccacatttaaaagtgagaagttacagagcgtacctgacactataggtagtgtttcttagtgccattggaatatttccatatcagaacggaggtagcttaatggtgagaacaccaaatccttatcaagccaccctgccatcagaactagtttatgtctccacatttgtgagttgaatagtttttcatttattctttagataactggatctcaactgtgtctgcactttggaatcatggggggaatattaaactaatagtgatggcaggggcccatcccctaggatttggaagcaagtagtctgggtacagccagggcgtgattcattataggggcccctcaggtggacctaaaggttgagaaccatgaccataggctccagcggagatttagagcagtatttcgtaaacttaggccatcagtggtcttacttcaccgggtcccactggtattatttacttaaaatttttttttaaagtagacttggtaattttatgcatatgtacagaaaagtgtgcagaacataaatgcatagcttggtggattattgtaaagtaaaaacccgtgaaaccagcagctaatcaaaaaagggaatgttgccagaactccaaggtacccttgatgtccactcccagttgccatccttccttccccaagttaatggtagtcttgatttctaacagtacagttcagttatgcctggcttttagtgctgaggttgagggtgtttcggtgatacaggctataacattacatggctgactccttagagttctcaggccattaccatatagaacatgtaaatgtatctgcaggttcgtttcttgggtattattagtagatgatgtgcctaatgacaaccccttcactcttagtgacttcattcattcatccattcactctacctgcctatgtgctgtgccctcagctcaggtgtgggcaatctgcagaggggtaggcaaggtctgcaagttatggcattgccgtgggctgctgctgtgccagtggaaacacaggtcaccatggggacaatttggaggatgaggaagaagaatgtgtgaaggggggggggatacgttttaaactgagtctgctaggaggagttgcctaagctaaaaagagtggttcaggaagcagaaccgttatatgcaaaagcatgtaatgaacatagagatcacgttctaaaagttaatttaacaatgattcttggataatgaacaaacgtttattaaagagctaatgtggatgatgtttagaattcagagagaaatttacctttatttgcaatattctaatgtaaggtgctttggaaattggttttgttgttatggccttagaaaaactgtagagcagctgggaatggtagctcacacctgtaatcccagcactttgggaggccaaggtgggtggatcacctgaggtcaggagttcaagaccagtctggccaacatggtgaaacctatctctactaaaagtacaaaaaaaccccaaaaattagccagatgtggtggtgcacgcctgtaatcccagctacttgggaggctgaggcaggagaatcacttgaacctgggaggcggagcttgctgtgagccaagttcgcaccattgcattccagcctgggtgacagaatgagattctatctcaaaaaaaaaaaaaaaaaaaaaagaaaaagggaaagaaagaaagaaagaaaattgtagagcaacacattgcaaataatgcatgacaactgggtatttcttcttggagtatgcagtgagagccagaggcccataacacctggcagttttgagtgtcacccactgttgacatagatacctaattattttagtatgttctgctcaggtttcatagtgtcagagggtgtgtaatgagttattccactggttttaagatttcctttgagagtcagaaattcaggaaacaaggctacaggagttttgatagccactgttctggtggaatagaatagtgtgggttcagagactggattaaaggctaaaggtaaatttcacccccttggaaatgaagcagacaattttaagaattataacttgtctatctagttctggatttgaacctagaaagttcccttaaaaagttgcatttctaggccgggtgtggtggctcacacctataacccagcactttgggaggccgaggagggtagatcatgaggtcaggagatcaagaccatcctggctaacatggtgaaaccctgtccctaccaaaaatacaaaaaaattagccgggcgtggtggcgggcgcctgtagtcccagctactcgggaggctggaggctgaggcaggagaatggagtgaaccggggaggcagaggttgcagtgagtcgagatcgtgccactgcactccagcctgggcaacagagcgagactctatctcaaaaaaaaaaaaaaaaaaagttgcatttctaatagtgcctctaatttacattgatatgtttgtattgcctttttacccatcatgacaccctggaatgtacattattaaggttgatttggcagttctggtgacatggaagttttgggctctcagtgtgagagaaaagattctgcttctcaccatggcccctctgccacctcttccagggctgcgaataaaggagaccaaggaagtttatgaaggtgaagtcacagagctaactccgtgtgagacagagaatcccatgggaggatatggcaaaaccattagccatgtgatcataggactcaaaacagccaaaggaaccaaacagttgaaagtgagtacatgtatgtggcctcttttcccttgactctcccagcactgtgtggctttgggcaggtggtgtaacctctctgcatcccagtttcctgacctgtgcactgcaggtattgatttctcacagaattggttgaggatattgtgtgtataaagcggtacctagcatagggcttgcacataggaggactcaaggaagatagctcttttcttacttactcctaggaaactctgcatgttaaaatgtgagctgtgtggttaagtcaagaaactgcctctgccatcccatgtcccatattatgaccatgcatcaaataccctgggctgggtctgaacctgggcattaatttttccagttatcagtgcccatgctcatagaaagaaacagcattgagtaatcaaataagagttgtataaagatgatggatgggcttcccaggggccacatgcagaatcctgactgcagttgcttgtgtcaggaacctgtggtcgcttcagtggctggttctgtttagtacagggctttgtggagaggccagaatggtgacactggatagcgctcaaagacagtcctcagccacctgtcctgtaagtctttaggatggaggcagtagagtttctaggggaagagcatgagttttggagtctaagtccttaaggaatccctggctttgttacttacaactgtgtggcattaatctctgagtagtagtttctttatttgttgaatgggaataataattgcctgtctttcagggttatggctttgggtgtggcacctagttacctaatgaatgatagctgttaatgttatcgtgagagccttcacttggagaaatggagcagtctggattttaggctttgccttattattattaataaatattatcattatagctctcatttattgtatgtgtcaggccttggactaagtgcttcaacaaacatttattgtcattcataactttatatgtgtatatgtttgcgtgtgtgtatgtgtgtatagttttcctcatgttaacagatgaaggctcataaagaggttacatggttatcctgggatcatccagccagtcatgtggcagagctgaccctctgagtcctaaccgttgtactgtctgcccaccagcttgctgtgtgacctttggaagtcagttgagctctctgggactcagttttctcatctataaactgcaggagattgaccatataatttctccatttttattctgttctacgattttatggttctttgattctctgaggttgtttcttggtcactgctttatggagatcataaaaatgtcacttcttcaaagggccatttttctttttcctaacagggtttccatctcaggaacttgcctctgcaaatatctcttttatacctacccctcgtcacttccattctgaattaattagatttctcagtagcatctgccacctttccagtaattacatcttcagtcaattcatttgggaaattaaccgatataaaaatgcttgaggcaaaaaagaagtatattctccaatgtaggacagataaaataaggcgtacagtttaaatttcagctatttgtaacactgctttgtacagtttctttacaaaaataatgtagaggagaagatgaaatttttcttccaaaatgaatacttttaggtatttttagaatatgtacaagatatttggatagaaggtgctcaaatacttggtggatattcaagtctgaaggagtcttctgagttctagcaacgagaatgccattagtactcatgaccccttcctgccaggccttacctgggggcctcacccacttttgtccttaggcgcacagactcacagcagttctgccagggtctgccgtccccacccagctaaggagaggcagaaccctgggtttgctgctgtggtggtagttttttaaaagctttattcagatagcattttaaataaaactcacccattttaagtatacaattccaggaattttaatttattttcacagttgtacaatcaccacaatcttaatttcagaacattttcatcgccccaaaaagaatcctcctactcatttacagtcattccccattccaactatagccctcggcaactactaatctactttcggttgccttcttttggacatttcatataaatggaacatacagtgtatgtctttttttgtatctggcttctttcaccaagtcctgggttttcactttttaattttgtttgggcaaagcccaagttttttttccaccatagctacattgtataacatagatctccatgaagacctcgagaaacttgtgtttaactatagaatccttacaaaggcagctgtcctagaatattaatcactgagggtcaccagaatctggagaaaagcaacagttccgcaaatctgcttatttcctttcctggagatataagcaggcagacccaagggcacaaacactgggatgtgagtcaaaaggcttgggaaagattctcatttatgtttttctttgaattactgtatacatctgtgattgcacctgggtgctgttgtatagatgaggaaacttagaactgagaaccttatccaaaatcaaaggccctgcaagatgccagctttgagattggtaagcaggtgctggcaggtacttcagttgtggaaagttccaccccacctgaggtgaggcaaatgaaggagtgaagtagggatgatgatttcaagaggggtgatagggcctgtggtcctgtggacagtgggggctgggcccacccgtctcacggcagccaggaccatccttataaaagcgctgctgccagtttacagcctttggaatcaagggaaagaggagagtacgtgtcccctgtgtccctctcatgctcgttacatagggatgcaggtatgctggcccccctattttctccctggtgtgcttagtcccccagccagtctgttgtgtggtacttatgcattcacactcctgcaggtcccagtattcatgcaaacgcaaaacaggctttctccatgcacctgctagctacctcagatcccttacggaaaggtaccttacatggtgtcagaaggaaatggaatatgtattacacttctgatttacatttttttttttagctggaccccagcatttttgaaagtttgcagaaagagcgagtagaagctggagatgtgatttacattgaagccaacagtggggccgtgaaggtaatgccttccttgggacacagcattgtccctgatttgtttgccatgagaagacctaagtgacaagggagttgctttcttcagagggtgtggggtgtgtggggaggggctggtgtctgttatgaggctgatggaaggtcaactagtggccctttatgtataataaagtttgccttccctttatcttcattctttaaccttctcgcgattaaaacagatagtctgttagaaaaaatactaaaacctgttcagagggggaggacagggtgagaaaccaaaacaactttagtcactttcaaattgaaatgtgcagtgtatttaatcttccttttatctctttggtattttcttcccaagatatatgcatgtgggaaggaacgctgcattcgttggcattcttttctatctgattttcagggtcctgtacagtgttcctcactgtttaatggatgggcataatacttcatatcatacaataaatcatccacctacaaaagagtctgagcagctcctctgcctccagttaatctactggatttggcctttatcaggaattgcatacagttaaaagaaagaagggaaaaaggattttgggagaaagtatcaggtgtttttcaacccagtttttggagcccagcgatgagcagatagctcccttctcttggcagcaggggagtggggcatatttggagtttgtcaagtaggctgtcaggcctgcagtgggaactgagacctttatctcacttagccctgtgccatttggggacttggcagtgaaaacttaccaggcactcatgtttctctctttttgcagaggcagggcaggtgtgatacctatgccacagaattcgaccttgaagctgaagagtatgtccccttgccaaaaggggatgtgcacaaaaagaaagaaatcatccaagatgtgaccttgcatgacttggatgtggctaatgcgcggccccaggtactgcctcgatgcctgggtgatctggcacattagcccttttgtatgtgtgtggagatctgggaatgaattgtcagagtcttgctgcctttcttgaggtagacggtccttttctatctgtaatgttcagcaattaacatcgacatgagctacgagggactcctttgttcccattcaaatgctctagtcacagatgatttcatgtgtattgtttcttatcccagccaagcctctggccctgagctagccagcttcctccatggcttcactccagcagtgggctcacacctgggattttctgggtgttaatggcaggagggcaggagtgttctatgagccctttacaggatttcagaaagcctaacaaagctctttctttccccctgcttagcaaaagccacagtgttttagctttgagctggtactgttgtctgcttctcatacagatggatacttatgccttggctagtaaagtgcaggaaaggatgttatcactatatgacatttctaggaaatagtgaatagtcactattagggaatagtttgttttctgacttgaaatttgatccgtgggtgttttgttccttggagctttggtcaagagattactgaagactcatcttggaccaacaggtccccttggttggtgaaatggccatccccaaactgacctcctgggagcccttgacctgagaagagtgctgggctgggagtcagaagtcaggaactgtgttgctccatcactgaccagcttggttaatttgtcactttgggtctctgggttttctgtggtttggggttcggttttgagttccctcctacttggcaaggcagttttgaggaccagacaggaaacatttgctgcctttagctattcagcatttagtgagcccttctgtgtctcagggcctggtaaccaacaggtgatcactaaatgctgaataaatgaccaaacaccagcctcttcctcttgctgactgcactgttaggagcccgcaggaggatgcaggtgagtggtgaacctgttatggagtcagccatgatcagctccaagttaagtaaggactaggctgatgcaagcctgtggtcaaatctagtgagaggaggcacagcaatataatcatggtatatttatacttgctctttatacttactcttatagtccatgtgtccccaaaggcacaggaacatttggaggaagtcctgagtccggttagggtcagatgcgccctagagggcatttgacgtgaactttaatgactgggaacttctaggaaggagaatggcattcctggcagatggaatagactcaaaagcattgagtcataaaaaagcttgggggtgtccagggcagggctggtagtcttgtgtggctaatcaaggaacaaggggttggaaaaagatagggctggaaaaggaggctgggcaggccccacggagcttatacttgccatgaaaggattttgtttgattcttacaggttaggggaacctctaaaaattcctctgtgtttagaagctcctcaggctttgaggaggggtctccatacctcaggatcccatgttgagttgatgagtgggatgcagggggatgaggcttctgtagtcaccttagaaagcagcactgactctaagtcttctcttatgcaggggggacaagatatcctgtccatgatgggccagctaatgaagccaaagaagacagaaatcacaggtaggagaaccagtgtgccctgtgagcaaggggcagggcggagggccccacattctgagatgctcttgcggctctgtgagcacagtcgccctgaggaaatgcctcagaacagttctttcttcctcatagcttagagcttgactctagcctaagtttctggcggcatttaggcagccatatagcacactgtgtgctatctgccccactgcagtcacagtttctggcccctatgaggccccagaaatagggatttgtgtcgcccagctctgctggagcacaggctctggagccttggggctgtcagccccctccctagtagagcacagggcagctccacagaccagctccacatactgccctgcccagtttgtgggcacttcccagagctccacaggggacactgctgctgctcccctgtgaacctttatttaacctgctgctcttcccagctttcctgttgctgttttttttctaattccacctacagtttcgtcaccttaagatgttagttaaacattaaagcaaatattgtctttaaagtttaagccagggcagcaatctgagacctttctgttcgagttgtcagaagcagtttctttcttttcacacggttttcggtgtgcatcctctttggacaatccccgcctcttgcctttggtggaagacgctgcctcagatcttccagttttctatttgtgagctgctccctcctgatgataacacaggagctggtttggaaaatgagcactgagaccttagctgggttatgtaacttttgagagactcatccctctaggagctctgagattgggcctttcttcagagcctttcattcctcaaaggtttctgctcaggattctaaaagcacccacttccttagtccaggcacttgattgaaagttaattaacctaagcattgttgtatgggaccaaaagaaagggtcatttactgagtatagaacaggtaaatttgcatgtgaaaactcatttcacccagggctcccaaactccaatgtctcccagatcagacagagctagattgggtatgtgggaagtgataaggcatggtagggagtgtgacagcagtgagcgtgtgctgtgaagggattcccatgcagaacacctgtgcaacctttttacatttaaccaaactcatcttttgggggaggctgccaattttgtgaccttttaggtgtgattatcactgtgttcagatgacgacactgaaacctggagtggggacacaccctgtctgggatcacatagctagtaggaaaactaggctcctagcatgggtttggattgaattcaggtggaggagaaaaggcgatagtctcccccagccctgtgctgaccttgcctgcccatccttgcatctcctagacaaacttcgaggggagattaataaggtggtgaacaagtacatcgaccagggcattgctgagctggtcccgggtgtgctgtttgttgatgaggtccacatgctggacattgagtgcttcacctacctgcaccgcgccctggagtcttctatcgctcccatcgtcatctttgcatccaaccgaggcaactgtgtcatcaggtaggatggctgcctgccagccacaaggcttttttaacttccatctgggctcatttgttcctcaggatctctccaaaccccatgaggtgggacagggatgaggggaggtcatgttgtttttgagggaaaatgtgccaagtggcttgcctctggcctcatttccctagtcaccaaaggcagcagctgtcctgtcactcatgaggagggtctcccacgtgatcttttgggtgtgatactacaatttggtcgttcaattggagtgtacaaaggtgagatcagacagggctagcctttgatgacattatacacatgaacgtcttcagtcttcatctgcgctctgagaggtaggcattattggcgtcatttttcaaataaggaaactggaatcataacttgtccctcatcgtaaagacaggataagaacccagctccttctgataacaaaaccagcattttctttctttttttttttggggacagagtctcactgtgtcgcccaggctggagtgcagtggcgcgatctcggctcactgcaagctccacctcccgggttcacaccattctcctgcctcagcctcccgagtagctgggactacagttgcccaccaccacgcctggctaatttttttgtatttttagtagagacagggtttcaccgtgttagccaagatggtcttgatctcctgacctcgtgatctgcccgcctcagcctcccaaagtgctgggattacaggcatgaaccaccacgcccggccccagcattttctttctatcccagacctctgaaccacactggtgtctttccatcctcccgctccactctttcccatccctttggcctgcctttgggaagggcagatgttgacccctggaagacaagtgttcatacggtgctcatcctgccaagattggcccaaagctgggccaggaactttcctgcggttgctttttctcctaagcactctccacgctcgtggtcctggagaacaccccatcttcccatctctcaagcccagtgtcagtattcccagtacctggtagttttattgctcttttggttttctgtgatcttgtttaaacattagtgcctggtctctgcagtgctgggggcacaaaggtgggtgatgaggggcctgttttcaagcctgcaatagagtagtgtggggacaaagtccctgaggctgcatgctcagggcagtggaggcagtgggagttagaaagacaccctgtggcccatgagtatctcaggacacagctggagccaaactgagtttgaaataaaaactgctgatttgcctaactcagctctgaatgatggtgggccctatctaagattttagtttgcttttaatagagaagctttattattaagactgtccaagctgggcacagtggtatgcacctgtagtgtactctctgggaggctgaggcgggaagattgcttgaggctaggagtttaaggttgtagtgtgcaatgattgcacctgtgaatagctatcgcactcccacctggacaacagtgagacctcatctctaaaaataattaaaaaaaaacaaaacatgcaaactctggtgttgctggctctgggtaagccccacaatgggggttctgtagtgctgtgagcactgcagtatagcaacagcccttccccctcaggcggtttctttcacttgcaattaggaatcgaatgcgtgattcaagtccatgtggcagcatcttgtagctactctgaatccccgtccgtgatgctctctagacaagaccactgtcataagtgcttcctaagtcttggagagaaagtgtgtgccagatccagcatggctacttgggcagcttctggagacagatgcatgtgggccttatggctggtatgcctggcatgcctgtggctgtctggacttgcttagccttggctaggccaggctgaagcctgacagtgcagttggtgaaagggctcagccttggacagatggtgccccctgctggggagctctgctaataggcttccctccctccacagtagggaacccagcccagcccatacctgcagagcctggcatctctcgtctcagaagtaaggtctctcagtcccatcccactcaggactaaggtgcacagaaaggtggccttgatctcagaacctgctcagtggagacaaagctctggtcagcctgagacccgggagatttggccccagccccatctgggctgatttgatcaagggctgctagaggttgtggagactccttgctagactgtagttactcaagtggaaggaagacactcagaacatggatttttaggcaggtcggctcaggtaacgcagattcggttgtttgctttggaagagaattttggcactatgttctagtaggaaatttgttgtagtggtgataataatgtcaacatggtaatgaaaaaagtaatagccaacaataatagccatctgatatgcttcccacagactccacccctagaggggaactacagggcttccttaccccccagaaccacatctgatctctagagctccgaaggaaagagagggggaagggaggtgactaactgagggcttcctgtgtgtcagaaactatacagagcactctacatgggccatctcatgtcctcccaggacaccctgacaaccctgtgagcagttgaggttatctccagactcaaatgggaggttacctgcccaggccataggctagaaagtgttgccactggaacctgagcccagaggaacgtctgggtccaaactccatgctctcactgctctcccacaccgcttcccagtggaccctgggctgtgagcggggatggagctttgacggggtgctgcctggaggtggcagtggggaactgttggatgctgacaacagattgccgtgaaaatgcagcctcctaggagtgttctttcccaggtagtgtacgctccctctcggcttcttgccgctcacccctccctgtgtaaatgacccttgtggattgagcctcagaagtgagcccactctctgatggccattgtgttttatggagcatgcatttcagcacaagcctggttcccacatggaaaaattacaggcattggagtcacgtggaagctcatgacccaggcgagttccttgacctctctgaatcttaccatcctcatcaggaaatgggaatatcagcaccttttttgcagaattatgtgaagagtagaaaaagtgagtgcaaagttatcacccaggccagccctagagtattgccctcttggaagctgatttcatgcccctgcctggtctgctctgtggacatggcttggcctcagggatctctgagaacccagcaaggcatgaagcctcttcatagcccctcctgaccttgacaagcagcccccaagtcctttaggtcacctctccctgtggacagctgatgtgggagccgttctagaagaagcacctgtccctggtcctcttgatgctccaggctccttctgggaagggtccatccatggatgacagggaggcaaagctctgttgccttcttgcctggctcctccctaacttgccaccataagaagtccctttccttccaggctcaggatcctgaactgttagatgagagcccagcactgatcccagcttgaaaactgggagattttctcttcatattgaggtatagctccctgggattaggagttcttgtaggagtttctcactgaaagtcactttgttgcaccaaaacatcaagacttaagaaacagtatggactctgctcagtgtaaccctgtggcagatagtgttccaacaaaaaaaaaaaccaactttatggagacataattcatataaaatacagtttttttttgtgatttctagtgtattcacagagttgtgcaaccatcaccacggtcaattttagaacattttcatcaccccaaaaagaaactatacccatcaatagtcatcgtccccttctgcacccttacccccatccactggcaaccattaatcaattttgtctctatagatttgctttttctggaaattttgtataaatagcaccatataatctggtcttttgtgactggcttctttcacttagcatgatgctgtagcatgcgtagtacttatttctttttccagctgaatagtattctattatatggaatatttaatagtgtatcttatttaaccattcattagttgatggacattgggttgttgggttattatgaataatggtgctctgaacatttgtgtacaactttttttttctttctttctttttctttttcttttttaaagtagagatggggtctcactttgttgaccaggctggtcttgaactcctgggctccaaggatcctcctgcctcagcctcccaaactgctaggattactgtgagctaccacacctggcctatgtacaacatttttaagtggacatggtttttatttctttcggttatgtacctaggagtggaattgctgggtccagtggtaactgtttaacctttcaaggaactgccagctgttttccaaagccagctgcatcatttgacattcctaccagcaatggacgaaggtcccaatttctccacattcttgccaacacttgtctgtctttttgattatagatattctagtgggtaatgaagtaatatctcattgtggttttgatttgcattgccttaacgactaaggatgttgagcgtcttttcatgtgcttattggccatttgtatattgtctttggagaaatgtttattcacatcctttgcccattttttattcaggttctttgtctttctgttgtcgaattgtaagagttctttatatattctggatactagatctttatcatttatatatgatttataaatatcctattctttggattgtcttttcagtttcttgatagtgtcttttgacacacagaagttttaaatttcagtgaagtccaatttatgttttttcttttgttgtttgtgtttctggtttcgtatctaagaacccattgcctaatctaaaatcacaaatgtttatgcttgtgttttctcctaagagttttatagtttcggcttttatatataggtttatgatccatttgtagttaattttcatgtagggcataagtaaggggttggtccaacttcattattttgcatgtgaatatccagttgtcccagaaccatttgttgaaaagactgttctttttttattgaattgttttggcagcctcatcagaaaatcaaatggctgtctttttagcactcttactgtgtgtccactgagccaaggttaagtggatattaggtgagttacccatcacattacccagagaggtgtttttactgtgctttctgtcagcagaaaagctttgtgttatccgtgtccctgtagttacaggattacataaagaagcatttatgtagtgattcttaaccaggggcaaatttgttccgctggggacatgtagcaatgtctggagacatttttacttaacatgactcagaagtgctgctggcatctagtgggtagaggccaaggatgctgctgaacatcctggagtgcataggacagcccttcaaaaagagttaatttggtccaaaacatccacagtgtcacagttattgtaagaggaaagtagtcacaaatgagtcagccatgttgcacatgtggtggtatatctataggatacttttccagaagtatatttgtcttgcttttatagatacgctgtattggattccaaggagatttgggtctgtggcttcatagctccaaactgtctatctggaggaagctcactaatggccgagtttggacaattgctgaatggtaaaatgttaaaattaatagtagactgaggccaaagccagaaatgaacttctaagatgcaagaataaatctgcagattgaccaaaatgtaattattatccagcttcttattagcagttttataacattaccattatggctgccttgttaaactgtgatcctccccaccccccgttcccccagctcctgctgaggtcagcacatggcctagcaccgctgctggcacatgagggctccactcagccagcccactcagcagcatcactgactagaaccgtctcccactaatatggtttctagaagaaactttctacttcagattcatagcttggacaaatctcagaaatgtttggtctttaattcctgaaaaatgcttagcagtcctcagcagccttttcttttgtttttctcctcaaattcctttttaccacttggtagccttttaatagactttaaaaactataagaaatgttattaatgcatttctataaattctgttcttgtgaagtttgatttgggagtactttatttttctctaaccttttcttctttaaactttttatgtttgttgtgatttatcatgggtggtgtagaattttggatatttttgtccttgggatattttaatgtggcaaaattgagatcttaggatttcctcaaaattaccaaaagaattctcaaataagacttaaaaaacacttatggcctaaatagaattaaaaaactaaaaattaaatgtagttttaaaaggttattttgcttaatgtgaaggttccaggcacaccaaatactgagatttgaatcatgatagaatttcatctttataattcttcttaattttaaaaagacattcgttgctggaaaaagataagttttctctaaagttaacttaatacttgtatttcctattagtttgtttccatatttactttgaagattttaatttttttttgttttgagacggagtctcactctgtcacccaggctggagtgcagtgacacgatctcggtacactgcaagctccgcctcccgggttcacgccattctcctgcctcagcctcccaagtagctgggactacaggcgcccgccaccacgcccggctaattttttgtatttttagtagagacggggtttcaccgtggtctcaatctcctgacctcgtgatctgcccgccttggcctcccaaagtgctgggattacaggcgtgagccactgcgcccggctgattttaatttttttacattagatttaacaattcattaatgtagcattttattctctttttgaattgtttttattgtggtaaaatgtgtgtaacataaaatttgccattttaaccatttttaagcatacaattcattggcattaatgacattcacagggtggcatgaccatcgccactatttctaaaaccatcaccactatttccaaaactttttcatcacctcaaaaacagaaactctgtaaccattaagcatgaagtcccaacccttcctccccttagatcctggtaacgtctcatttatttctgtgtttttttttttttttttttttttttttttttgagatagggtctcactctgtcacccaggctggagtgcagtggcatagtcttggctcactgcaacctcttcctcctgggctcaagcgattctcatgccttagcttccggagtagctgggattacaggcatacaccaccaggcctggctaatttctgtctctatgaatttgcctactatagatatttcctataaagaaaccagaaaatatttgttcttttgtcggtgacttatttcactttgcatgttttcagggttcatcctgtgctagcatgtattttgtttgcattttatttttgcagtcataaatatgcatttttatacctcaactggatagaatttaaacaggtagattttatttttactaaagttaaatttttagcatgcttacttgtttttgaaaccaaatattcagatactaacaaatccagttgacatgactaattctttgttatattgattacttataaccatagactgtacaatcctgcacaagtttaagaatgccagaagtgtagcctttctgctgttaggacccccagaggccaaggcagaagcctacagcacttgggccctccaaacactagctgaaggctggccccatgtgccaccagtggctgcgcagggcacctcagggtctggtgggttggcaaggttcctccctggggtgttattcctatggcttggctaagggttcaagagaaaaataggcaaaagatgggattggacccttctcaaaaagaagtaaaataatatatataagggaatacattcaaatgcctcattagtaatcaaagaaatgcaaacttaaggtgttacctttccctctttttctaaactgttgaaatagcaaaatatttcagaatgagaatactcggtagtgctatgatcctgtgagattagataactcatgtgtagctctataaattaggatagttattcattcaagtagctattcagggttctgtcaagcactacaacagttgctaaggaaatgcttatggctgtatgcatcaaattatcaaaatatcaataaaaataatagcaacaattggaaactacctaaatgctcaacaatttgggttaagtaaaatatttaatggattgttaagtaaatattaaacataattattaagactgttgcaagccaggtgcagtagctcacgcctgtactccaagctactcgggaggctgaggtgggaggagcccttgagcccaggagtccagggctgcagtgagctagaatcatgccactgcactccagcctgggccacagaacaagacccagtctcaaaaacaaaacaaaacaaggagactgaagcaacatgaaaaaaaacaaaaaaaacttgcatacttagtataatttgtaaaattatactatagagtataattagtatacactatatattatactatagggcataattagtatatactatatattatactatagagtataattagtatatactataatatagtatatactgtatattatactatataatttgtttatatatgaatgtttggcaaatatctagatgattatttttgagtatgattttagttatttttttcctccttcccagttttgctatgatattgatgattaccaagataaataagttggtttttttttttctttctttttggaacagagtctcactctgtcacccagggtggagtgcagtggtacactctcagctcactgcaacatctgcctcacgagttcaggtgattctcatgcctcagcctcctgagtagctgggattacaggtgtgcaccaccatgcccagctaatttttgtatttttagtagagacggggtttcaacatgttggccagccgttcttgaactcctgacctcaggtgatctttgggaggcctctgcctcccaaagtgttgggatttacaggtgtgagccactgcgcctagcctgaagttgtttttatgccactggaggttagtctgtttactctggtcctggctctgattcttaggctgcctagccagctgcttgtggtgtgagtgttggatctgtatttccagtgtcgtttcttgtctaacagaggcttaggtgatgggattaattttgccccttacagaggcactgaggacatcacatcccctcacggcatccctcttgaccttctggaccgagtgatgataatccggaccatgctgtatactccacaggaaatgaaacaggtgagcctcccttcttccctcctgctctcttctctcatttgctcccagtgttcactggtggctgtgcagaaaggtatctgcggcttggatctggctgccattcaccatctcaccacttagctactggcctcgagcaagtcacattactccagagtctcagtctccccatctgaaagatggattggtctaactagacattgccccaagtgtcaacagaagctcagctccctgtcttggctgttcgcttttctgctgttccccctttgataagctttaggaaaaggatagtgaaaaaatcaacatgatgatagccattagggaggctaccagctctataaaaaggaagcaataaaatatgatttagtgatagccttttggtgaccaggccagaatatgcctgtggccttttctactcagaggacaaggccaggctcgctgttccacctgaaccaacagcaagccagctccagcagggtacagaatgtagccaccctgacctggaagaggccagtgcttgtgtcctagcagagcctgtctgctgtaaacagcatgacaagtttctcggcagctttggaggccgcccctgggcaggtctgtggctttgcaatagagtccttgagggcttctgccaagtccacagaggtgatggcgagacagcatcatacagcttagaagagcacctgaaggagggagtttgtgaaactgatcatataataagaggcttcattggaggacccttggaagcatctagctcagtggctggcacaccgtgcatgccctgaagtctgcgtgagctgaatctgggttaggctgagttgggagacgacagggatgtatgagcgtgggctttatccaaagggccacagtcccagttgtccctgtaggaattgcctcttgcttggtttggagctagagcacaactatgtgccaagcataggaataccattggactaggaatttctagtcaccttcatggtatttccaggtattccatgtgatcaccatctattttattttttacatttgagtcatggagctgtaagtgcaggatgcaaagccaggcagtgccctgtagagcccaggccatcttcagtggtacataccctgaattggtgtctccgaggcagcatgtgctgtgctctttcctctgccctgcccacctttgccccaaatgttctcttctgatgggctctggcatgcagccatggttggagatgctgagcagactggggctgcagtgacgtctcgatgcgctttgcctggaccttgtcttttcaccagagcatggcatctttgttgagcatcgtgttgagcaggacatgcctggccagtttgattccatttgatccccagtaacccatgaggcagggagaactactgtcattgccattttaaaagatgaggacattgcccaggcatggtgactcacacctgtaatcccagtactttgggaggctgaggctggagggtcacttgagctcaggagtttgagaccagcctgggccacatagtgacacccctactcaccaaaacatcaaaaagttagccaggtgtggtggtgtgtgcctgtagtcccagctacttgggaggctgaggtgagaggatcgctttagcccaggaggtcgaggctgcagtgagctgtgatggtgccactgcactccagcagagtgagaccctgtctcaaaaaaagacagatgaggacactgcgacctagggtaactaattcgcccaagttcataacattagtcagtggctagcaggtaatgggactggctgtaatccaggctttctgatccggaaacccgtgttcttaatcaccgtgccacccagcttccctcctgctagaaatctctcatctcattgtcattaggattcatgaggtggctttcctctggcagtttgtgagcaggacctttcctttggagcagtcagggcctctcctgggcctttcctggcacttctgctgctctcctgtggctggaggcccagcctgggcctgccagcatctcttaccgcatgcaggagtgctgtggggatgcatcaggagagtcacagatctccctttgtaaccagcattggcaaattactgaagcagttatggttcatagtagcaattgtatatgttacctaggagatggtgtcaatggccgggggcctcatcgccacgtaagggtgtcttgccaggtgacttgcaagggtgactgccaggttgaagccaaggcattcactgaacggaggcagaagcagaaacagtcccaggcaattcttggaaaactggcccattcttactgcgggacatagcaccttactgttgggtccaaaaccccatgtgtcctgccaaaaaaggcagcccagcacagatgtgttcagggccagagacaccatttgcctactgaatgacttgagcaatttggtgcatctcaccgagccttcaccttctctgttaaatggaacatctcctccctcctttgcaagattgtcattaggatttgtgaggtattggcaataacgggccctcccatccttcccattgctgttgttattactgtattcatagctttgtgtgcttcataggtaccctctagggtcctctacgtacaacatacaacagcttcgcaatagccagtgttggaggctccaagaacgagggtcctgtggctatgtggagagtaagcagcagagccaggactgccactcagagctagttcacccttgctgccgccattcgaacccagagctcctggcccaaacagtctggaatgttctgtactgtgcttctaggacagtgacttgccaggccaactctgggctggggctgtcttggctctgtcaggagggcctctcctcaggctttctctcaggactcgtggctttgttcccgctggcccaggcgataacctcagcatttttactggagcctggggctaggtttttaaacaaactcaatgtaacttgtgtactctgcaatccaagccgacaccctcataaactatccctgcaggttattaaatgattaaagatctcatttatgaactgtccattttcgagcagcctgagacagacgctttcacgattgctctgacctgctgctctctctagtgagagagagagagcagagtgtccctgacattctggaagctgagccacagattcagtgcatctcactgaaggcgaggcacttagcttaagctgtctcctatgaccaggctccaggattcaatatttacatctccctggagtttcagaaggtcatctggggacatttttcttggcaagacctggtggtttcctcagtcccagctgtgagtgagaagccgtttttaccttgaagctgtgttcaggggggagttctgttgtgagtccctcccagctccttttcttggttgtccttgtaccatccagtaacttcagagggcccctttttgcccagctgcatttagctttggatttcagacagtgaagcccctcctgcataagctaagattgtttcagtggagctcacaccctggcagttcacccatgagcccagcagatacgtttcatgtggcctatgcagtgtttgtgaaatgtttgaacaagttgctgacatctagacatcaggacatttctttctttctttctttttttgagatggagtttctctcttgttgcccaggctggagtgcaacggcccaatctcagctcactgcaacctccgcctcccgggttcaagcaattctcctgcctcagcctcctgagtagctgggattacaggcatgtgccaccacacccacctaatttttgtctttttagtagagatggggtttcgccatgttggtcaggctggtcttaaactccagacctcaggtgatccacctgcctccgcctcccaaagtgctgggattacaggcgtgagccattgtgtcctgccaaaatcaggacgtttcgtacaaggatctgagttctgagcctgtcttgagaaaagggaagactgcagacaacaccttgcagcagtggtggccgcgggtggaggggctgcctccccagggtgtttgctggccaagcatttcaccctcacctggctcatcgcagccgctctgtcctgctggggctttccaaggcctttcccatctgtgggcagccaatgtgctgtcccccaagcccaaccgcgatcatcagagactgggctccccctgcagctcctgcccgcagggtcccagcctggagagctgacaggcgaggcttgatgtggccacctcagtaaacctctggctctcctccctcctggaaggctgaagctgggactcagtctttcccagctcctgtgcctctacactgggtgtgcttttatggctttaatttcaacaagggcttcttgatatcttgtttacgaagctgccaaagtgaaaaattcctgtattatatgcggctcgaagtcctgcagttatctcagctccacaacacacaacatcattatcctggctgccccttatcactcagtgctggtacgcctgcaggatcctggtccaccgtgttacagcatccccgccgccagcctgcctcccctccaactctaccaagatcttcaaactgcaacaagcgtcagcctcttcttgatagattagatatctcccggtgatgttatgaggcctggtaaatctttaaaagtaactgttttgatttatttaaccatcatatttatcaagcaaataaaaaatgtcccttcttgcctgagtgcttgtaggcagtagtgcccatgctggagaggaaggttagagcccttgcaggagccccgggtaggttagaagaggccccagttctctgcctggggacaggggacgggaggacatggaggcaagagtgagccacttgggaagctgcatacctccttgggcaccagccacacttgagtcagttgaatacagcacactggccgtgatgctattcatgcatactgcagggccgcacatgcctcctggagggtgccgggccggcagtgctgggcaggcgttggctccctgcccaccaacccaggtctcagtttctcttatgctgcacagtgagaaatctgagcaacattgtctttaaagcactttagaaatggggcacttgaggtcagtcaccgttgatcatgttttttatcctttaaaagatcattaaaatccgtgcccagacggaaggaatcaacatcagtgaggaggcactgaaccacctgggggagattggcaccaagaccacactgaggtgagctggtaccctgggcccgccggggcctccccagcacagccagggccctcgctggggtcattctggacaataaaggcaggtcccttcctagggcatgggactctatccatccgctcttcctggcgcgatgggtgccagggcacttgagtttcaaatgcagaggatctatctgatggtttttaacaagctagagtaagggtgaagtccccatgtcctgcagcagatgctcccctctggtggagagtgctttgaccctgggccttcttgtggcagagaagatgcacagaactagagagcagggaccatgtggtagctcattagccagggccctggctcctgttctcccggtggtgttatgaggcctggtaaatctttaacttttttgatttatttaaccatcaagcaaataaaaaatgtctgggtggtggatatggagagccagggaggagcgcagacatagacagttctcctaattgttctccagcggctcaaacacaggaccggcagagcatgtcccttcacagtggcctgactcattgtaaaatcattgcttcacagtcctcagcccttccctacatcccttgagtcagttcttgctcctgaggttgaaggcagaaatgcaagctgtgaggtttggatgaaggggtactttttaaaacggcagagtcttcatgcctttggatgggcatgtacttccagctggctatgttttcatttccctgccatgttaaatatccctatctgtcggacacctgtatacatataagtttgcagtccttttccagtagcagtgacattacttcctactggaggatttgtagactgtactaaagatttggggaatagcacttatgtcttcttggtggctcctggaccctctctgatgggataatgactgcagctctctgagaagtgacaactttgtctccccttttctgtgttcgtagcagctggcacaagcccagcactgggctctgctcctggtgccagtgctgcctactgatgtggggggaaggtgctttcttcggtggccccagtttcactccagccctggcccctgtccactctaggtactcagtgcagctgctgaccccggccaacttgcttgctaaaatcaacgggaaggacagcattgagaaagagcatgtcgaagagatcagtgaacttttctatgatgccaagtcctccgccaaaatcctggctgaccagcaggataagtacatgaagtgagatggctgaggttttcagcagtaagagactccccaggtgtgcctggcctgggtccagcctgtgggcgcttgcccctgggcttggggctgccgtccccactcaggcgtggtctgcagcgctgtcagttcagtgtggaaagcatttctttttaagttatcgtaactgttcctgtggttgctttgaaagaacccttccttacctggtgtgttttctataaatcttcataggttattttgattctctctctctctctctctaagttttttaaaaataaacttttcagaacagtt

SEQ ID NO: 35930 - DNA, 191300 bp, Homo sapiens
gatttcctgagcatgcctagggaatgacaggcatctccacaggcaggctgcatccaccttggctggggtgtcgtcattggctgcctattagaaaaacgacaggacaatgcataccaccgcctcccgactgtaaacataggggatatgtgttcacttagcatggacttctgggaggggccaaggaagggcggtctggagttttattgaatagagcagtgtgtattcggctgcctgcctgcccgcctgcttgctctctggctgtgctcctgcttaaagaaatcagtccttcctttccgacttagtcctcgggaagaagtttcagactacaaggtaaggcacagaaggctttcttttttatcttctagagagaatctggggactttctccggctttcagtcaacattcctggctaaggtagctggagatgcaagaatgttcaaggcaataaaccatgcaaactcccgagcctgactgggcttcactgccatacggatattcccggaaggcaaacaggatgagatttccagttttgtttttagaattgggacaagaagagtgaccatatagagacttacatttagggaacactggcaactttgattaggatagccttttgtttaggacagccatatgagattatacctgatatccaaaggccagtgttagcaagcctactgcaccagactgctcacacagtctcttctgcatcttttattgccaaagatttgaagaggttttgctttaaaaacaaaatcaacaatcctttaggttgatgagaagccaaaagggaatgatttttttaaccaaaggcttttgcgttatagtctgctgccagtatttaaaactagacttccagagttgcaaggaaatacggtcagagatggagagatcactagcacctagcactggttgggttaatgtcactgatgggatatttgctaagacagaagatgcctaggctggtctgtttcctataaaacctaataacaagagaatgcatgcgctagtgggtgtgtttttttagaaagcacatttaacgtcctaccaaactattttttaagaaatctttttttctgtttgaaagtgtgcctgagtgtgtctagagaatctaaagagatgtcgattggcaatgtgtttcagaaaggaaggaggcaggcttttatatctagatagacatatttgggtgtctgaaacagtagtacaaggcagctagttggtagtagcctggaattccttttagaaagagctgatggcaaggggtgggggaattttagtgctgtggcaatacatggtcaaaaaaagtggatgagaacaaagtgcttgatatttatagatgccttctattaacaggactatgcagatggacttgtaaactgaaaatccttctaatgtgtttgtcaaaaccagacatatacagctagaacctgagtgaagactagatgctatatggcaagcagggtaaatctgatgattttttagtagtgctggctattaaagactaccagctgcaaatgactgattcaactggattttattccatgcaatgcggtagtttggggttgagattcattaaataaagttttctctttgtatttagaagtttggggataattttcttgggaatgcctatttctccttctagaagtgatatatgagaacagaattccttgtgaatttccttccctggaacagttctgagtaagtgtgagagaaaagctgcaggcaaaagctatagtttaattactgtccttccctcgaagagatcaagttccaaactattttcacagtgtttttaatgtcaatcaaaatatggagagcaatttttcttttaactgttctctaaaccatgaagggaatgcagtttggaaggagatctataatcttgggatttgaggataaattccattttgaaaccaacatctccgaatccctgaaagttcaaactgtgctatgaccactctctccagatcccccatcccccttctcttgggctccccacccccaacaaccataaaaacactcatttttttccaagtaacactttaggtgttctgctgttataggtagagatagagtgagaggatttgagtttatgctgaattttaggcagttctttgtgctacttccttcctgttgaatgttacctagaacacatttccccacatagtgaggccaaaggagcacaatgaaaacagtaactttcatttcagaaatataatcacaaaattccagaacaaaaagtcactaagagttgatcctaggacacacaaggaatgtatgtacaatggattgatccataagtaaagtgcagggttgtttcaagtattcgaagcaaatagaaggtgtaatttaaatcattccagtcaaaagattgccttaagtaaatacacaattcttatattaaagttaggagaaggagaaccaggctcaaactgcagtttaaaggattttaaatgagatacatgaaagcatttcctgacagtaaggcaactgccttattatgagaatcattaacaattctaattggctcctgtgactggcctgagaatctccttgtcttaggtagatagaataagttgatcttatggccagccatgtaaaggtccagaatctagcccaggtattctctgttctgataaataaaatgcacctcagcaggcatttttgtagaaacacatgtaattgtctccatttgccattttcttgatagcatgattaccagttagtcattccttagcaagacgcaaaagtgattcagagatgggcatgaaaagagatttgctagttccccatttgcctgtagtctatcacatgtctcagaaatgtggtcgggggacaggaaaaatgctgatagagtggtatgcaaatagcatggtaggactaaggaggaggttagaaagatgctgccaaagaattttcagacttcaaaagggcgttttctgcgttaagttctcttagggcctgagaagataccattagctccttactgaaagtccttcatctgtcaggctaatccaagtttgctattggagagatgcccataagtcctgagtagatgggtagtttaaagagaaacttttggcacaggcttaacttatgagaaccactacaacatctcagttctagtattggttcctctgcttaagtaaccctgacctttttgaggaaatcatcagcttttgacttcatctgttgagtgaagaacggacattggtaatgcttctccgatgtcccacagtggttaagacgtccaaatgagatgaagctgtttgctccctcttccctgcagattctataccctgaactgcctatcatttgagtcctctggacattatgctcatcttggctggtatcctccacttcttacctagtatccctaatgatctcttcctttctcgtatttaaggacccttgagtgatatcttctcgctcctggttatttctagagccctgagccgtgtccagtgaatactggtctatcccaatgttgtctgaatttttactttgatgatcacagactaagaggacacaaatataaggaagtggaataagatgggccatcagtggtacaaggcaccaggaaatccaaagatccacttgagcataagaccagtgagaaagtgctgacaacagaaagcccttaagtaattgaggcagcttctctgcctccagccaaaagcatggaatgaaccccggaacgtcatgcctgggccttgtaggaagggcaaggaaggcaggaacacctggctgtggttcctgttggtattgaaaccagactgctccacggagctcgcctctcacctctttgcttctgtctttagtgctcccagctgtaaccgaccctagttgcatccctaacttccttacccccaggcctccacctgtaacctcttccccagctcccccatccctgtaccggatagggagctttcttgatccaacattgacaatttgcaggggccagctctaagatgaggcccagagtacagcagaacactctagcacagataggttctagctagggaaagccacttgcacagacagaggagatgtcagagcatgttttgtggtaaggacccactctgcttctcaccccaaactcataattggcaggctgtgggtaaggctatgggagcggggtcggggggaaactatgacctgggctgtgagggaggggtgatgaggttgttccctgtgttgttcttccctgtgttgttgctatggaaacctttgagaatctgataaaaactgtgaacccttaaggtccctttgtaaacccacgcttcatgattgacaggtaagagacctttgagctggggcatgtaagatggggagtggggtcagatctggattcccatagaagacaagggtggatgggatcagaacatgagtggaggtgtccatgatctggaaggaagaaaagagggggtaaatacacagatatataggtggagattgcgtcatatgacctccatttcaaagaaaaagaggtcatttccagaaaagaagcaattttctatggggagctcgtgggggctagagaaatccaggaatggctgctattaagtgtacgtaaaaagaacacccagaagttaataaaaggcttgctaagcagcagtaagggaatagttgaaggaaaatacatttttaaaagattttagtatatcgggcactcattttagtacatggcttttctttgaaaatatatgtatatgtataaatgatgtataacttgaagataaattgctttttgatggtatcctgaggcttctggcattgttttgtgaatactccatgaaagcacttgactaaaagggaataatctcacttggagagaaacatattaagcaggaatatataattagttcctctgacacccacatataacattccccctcgcttgtctcaagatacattgctggggaaccaggctgacttcaccttgtgctgaagaccagaaggaccaaggcaaagtgcccaagagggccaaggaccagttggcatcaaagatattagttccactggggtcaggaggaccagtctaagccagaatggatatcagttacaaaaatgggctaagttgtgcatgacagccaggtgagtaaagaagaaacagcaaaaatcagaagtcaggcagagcttagtgaagtagtgtatggatgaataaggtgaagtctgggagagcacatggcccagtgttaggaagaaatagacctctatgtgagcaaactttggtagctcaagtaaagggccaggattgtaagacacagattaacgaacggatgaaatcacagggatatccaagagcagaagcccaaataggaccagggcccaaagagagtagagttagagtcaaggtgggtgagaggatcccagccgcggtccatggatatttactccatccctttccactagtgtgactcagctcagcgcacgtgtctgcctctttctgttgttctatcaactggaaaatttcttctgtgtttccaggtccagtcctgagagaggagatctgattggttcagtcaaagactattgtctttggcaaatcctttagtaggaggaggacatcaaaggcacaggcgcgcctaaggatgaattactctaatccaggcagtggtcacccctgggcaaagaagagctcaatgggtaattttagttagaagagaaattgagcatggaaggcaaattagctgaaatgtccaacagctctcaatgggaatcatttgaattttgaggtgaataaactcctagagaggcaaacacccaatgaatgatcacacagttcttgatgatcactgtgacccactgagccagtgttaagggagattaatctagaagtttgcaccactggtaactgaaaggataagaatcatccatctcagaaagattttgggaaaaaacattctggatattattgttggcaagaaacttcatatgaatcttccatgtgatatggctcccttcaaatgaaagcagtcttgaagatttaatatgtaatcatttaacaattttaataaataaaaacaagcacaactcaatgtaaaccacagtacataataaggtgaatgcataaaagctggtgtactcttaatcactggaagtttcagatctaagcaatatttgctatgtaatttttaatccattgagcacccatcatggtgtttgtcaagtggactaaaatatcccctgagttctgcatagttcggatcccatttgggaacttgtgctctgttctgggctcatttttctgaaaggcatggatacatatgcattctagggttagcatcaaaggctggagggagtcaggaggcaaaacatatgctgaaccgataagggatctagagctgtttatcccaaagaaaagaaaatgaggccacataaatatcttctaatatttggggtacttttatatgaacatgggagaaggcatttgtgtttctcaaggcagcagaacagaactgaatatataaattcatagaatttttaagctgggcaagaccttaggagctcattcagcccaaggagtacatataacttttcatctgtatgccagctccaaccaattggcatgttaagaaggattctgaggatgaatctaagctcagaggggaggggaaaatgtggtcactgatagtgatatctgttgtggaagagaagggccatatctactcaagtaccatgttttagtcttcattaatgtggtctgtaggtttttaacctctgggtggtggatccctgggaggccacaaagtcattgcaagaggtaaacaaatctgtatatgcagcaagtgcttttggcaagctactctgagtaaataatatatcttacatcatatgtgctactatttttctaattctatacatacattataatgataaaatgctaatttatttaaaagagttattgaattcatagtagcttttaagtttgtgtttttgtgttttattaatgagtggacttaaaacatataattatattatgtgtgggaaggttgggacaggaaatttgggatcttaagtagaaattctttttaaaatatgaaccagtgatctattttttattctccaaagcctagccacaccaagtaaaattatgtatgtatttgtaggtttcttcgattaatgtctgccctgtcttattggtctgtcagatatataaggacaggaacctctatttttttttcattcgtatatacccagtgcgtggcacacggcagaatctcaataaatatttgttgaatgaaataacaaaccaagtgacttgaccaaagtcatccagttaattagtggtaagatagttccaaaacacacagctcctaagttccaagcagttaaccttttcaatataccacattacttcccctgatagtaagagagcatgttttaacagttagcaaatttaggttatacaatgctgcccaatctgcctatatacccatgcatcttaaccagtatcttaatcagaatcaactgtagagctttttgaaaatacacatccctgagacctatcctctagagattctgattcggtaggtctagaagggggtccaggcatctgtagtttgtaaaagttccctggtgactctgataaaacatcctggctcagaaacagttctgtgcacctatcgttaaaataattgatagtagatgtatgtagttacttattcctcagaagcctatttctttagttttgaataatttctttctaaaaattatagttgcatatgccaaataatccgtttggccagaagagcaaaacctttagttttgcttttttttcagtttaagcacaaagttatcaaccctgtaaggtcaaatttttctgatgagatttccagtgtttgcttttgtaaaggactggaaatgtggcaagaataaaatttctcatggtatttcccacttccttttccagccatcattactaagggaaatttaggcttagggggaggggtgaatctaggagaaaaaaaattttaagtatttctgttcttaggaggttttgagcagatatttcgcttcctaggaaaagctgaagatgtttttctctgtttccactttgtggtgaggatgcacaaatcctgaagaggggagaagcttcctccacctccaccctcacccctacatcttctctagggcaggagtcatcacagcccctggtttagatgcttccctgggtggcccttttgaaagtatgtggaccctaagagacaggagactttgagtgcatggatgggggataatttgcttttgcagaaggacagaaaatttatctctaggttcttcctttattcggcagttaggaattacatcctctgtattgcacagaagaatctaccatattcagagcactgagtacatggattatattcactaaagattggagagccaaaagtttctctgcaagagtgacctgatctagtaagaatgtcaaaattgttactatatttgtacccatgctcttcggtttagagggcaggtgcttccgtgtgtacatagaagcagagcttgttggagaagaggagctaaaaaggaattagattagaatccacctctgtacaatggcaccatctggactcagtctccttcatctctaacactgtccccactttctctgcaccccaaactcatactggctcccaaaagctcattgttaaactttcgagaattttgagagccagttgtaaaacacagccattataaaaactaaatcatataaacttacaattaaacacattatatgaagagccaagataataaatactcaaaactcttcctaattattttgctatgtttcactattatctattctcttgaggttagttacatctattgtggctatatggtggaaatactgtataaaatgctgtgcaactgagcttctcctcccaattcttcattcagtgatgtcatattcagaacttgaaattgaccatgatggaagtaattacaccacagaaatcagcccatgctacaaagcagactcccctcccctcacccaagaacttgttgctaaacattgactagcacatcactgaccctaagggatgcggtggtaaaattagcctctgcattggagagccaagcggaatacctctgtggttcagttacatgcatattcataatgtatgcttatgattgcatatttgtttgtttgcttgcttatttatttctcatgctcctagaacataagctctatgaaagtagagactttgtttggctttttcagtgctgtgatttgaacctaaaaatgtgctgtgtcctgcacatagtattaataaatgagttaaatgagtgaaagaaataaatgtcaggctggtagtggtagctcgtgcctgtagtcccagcactttgggtggccaaggcaggcagattgcttaagggcaggagtttgagactagcctgagcaaaatggtgaaacactgcctctacaaaaaatacaaaaattagccggccatggtggtgtgcatctgtagtcccagctacttgggaggctgaggtgggaggatcacatgagcttgggaggtcgaagctgcagtgagctgagattgtaccactgcactccaccctgggtgacacagtgagaccctgtctcagaaaaaaacaaaaagtaaaaaaaaaaaaaaaaaaaagtctacaatttctactttaaaaatacctgaagccagtgttcatgttggagctcattgattcctcatgaattgtatcattgttcagtgtttagaacagtgcctggcacatgctaagtagcatgtagatttttattaggtaaaaataaaataagttatcttcataacagctaattttacagatgaagaaactgagttacgattagattaagtaatatagctaaggtcccacagctagtaagtagctgggtcaggatctaaacccgggataatctggaggcactgcccaccttctttaccactgtgctatgctgcctcttgctagttactccacgtcactgagactcctcttttgtatgtggctctagaaagaattgagatctatttgagaacaaactttggagtcaggagaacttgagtttgaatctcaaatttaccacttttttcacttacaaaatggggatgatttctcctccactttgtagttgtcacaactactagaagtaatatcttgaaactgctttgcacgtacatgatagacactcaattacaaatggtcagctattggctgtgatttcctgtggaggctacctgttagcgtggggcttagccacacactgtcccctgttgcctcctctaggccatcctgtagacagattaaaaagggctcactgcttctacatttggggtctccaggaggtaagactaggaccaatagatacaagttctaggaagtcctatttcagatcagcttacagactttctaaatagatatttctgtctctgaagcacgaacctcgctgctctacagaagcagacaacttccactgtcctttccaaccagaaggtttacctgcttgcccttatcaacaaatctatgctgcctttaacattttaaatcattttatctagtatagctaaagagttgtattattcctgagattgggttgttttgcaggttttcagtgttttagacctggaatgagagggagtaagaaaagagggagggagaggaaaagagaaaaagaaataaggagagagagagagagagagagagaaaggagaggacagagagggaggaagggaaaagggggaagaggagggaggggagaaggaaattggaatttatctggagaaaaagtactgaacttgggagagagactgaagagcaatggattgatagttatctgaagtcctcacaggttaaggatggttgagaagataagctagctcattcagctaccttgctggcatactagctatgtgacaggcactgttctggttgaggactgctctctcagagcagtaaagtaaatcaaataacttgcccaaagtcacactgctggaaaatgccagagctgttcaaagctcctccctaactccaaccctctccaattctctacagctatctgctctgtgtcttcccccaagaaagcgatggaaaccagagcaggaggtttccgtaaccagtcattataatttgtcagggagccatactgcagttcaactagacaagcacattgtcattccctgccatataaggaaacagagctaaacaccattgctttcactattgactggagaggttgctcaagttagagttagacaagatgaggatctagacctagagcagttaaattaaattaaaaaaagaaagaaagaaagccagagaagtagttttgtgttttcttttcctggtaccagagatagtttaacaagcagtttccatccttctccctgactcaacgggagattttccctgacattaggcactaaaggattcaactactcgtacaaatacttcaagctgttttggtgtttgattatgtcaaattttaagaaaaggcagaggatcagttcaggtattcaaaaggccaacatatccaaaaggtattcaaaaggccaagacagagctgcttctgtgtgggtcaggtagaaagtcaaggactgtatttctctgtccattgatttacaaaagaaattagtgtccactcaccttcccaggtgagatactacttattaagaaataaaatcagaaatactacttattaagaagactttacatttaagtttgaccttcttgtccaaagctaagaatattcacggggtcactctttgccttaagactcagacacaatgggcactttatttgtttgtttgttttttgagatgaagttttgttctgtcacccaggctggagtgcagtggcacgatctcggctcactgcaacctctgcctcctgggttcaagcgattctttcacctcagcctcctgagtagctgggattataggcacacgccaccatgcccagttaattttttgtatttttagtagagacggggtttcactatgttggccaggctggtctcgaactcctgacctcaagtgatctgcccactttggcctctcaaagtgctgggattacagggaccatgcccggccacaacaggcactttagaatgcaggctcagtaaccaactttatgaagggagaaacagaggcatgaacagttgaaactatttccttaaagacagccagttccatcttgccatacagagtgcccacattttcagataatccgaagaggcatcacttagtgtccccagggaaatgaaaaacaaaaaacaaaaaacaaaaaaacctgtaaatagtctggtcatcttctcctaactatcatcttggaccagattgcatctggagtactagtttattaggcatacccgagactgggtaatttataaagaaagaggtttaatggactcacagttccacatgattggggaggcctcacaatcatggcggaaggcgaatgaggagcaaagtcacaaattacatggtgacaggcaagagagcttgtgcaggggaactcccatttataaagccatcagatttcctgagacttattcactaccacgagaatagtatgggggcaactgccgccgtgattcagttatctccacctggccctgcccttgacacatgggattattacaattcaaggtgagatttgggtggggacacagccaaaccatatctgatgccacaacaaaatgcacaaacaaatttatttctggatggaggttagaagtccaagatcaaggtgtcagcagggttggttccttcaagggctgtgagggaagtctctgttccagccctctctgtttcacttgtagatggttatctttgtgttcacaaggcattctttctgaacgtgtatctgcatccaaatttcctcttcttttttttttttttttttttgagatggagtttcgctcttattgcccaggctggagagcagtagtgccatctcgactcactgcaacctccatctcccaggttcaagcaattctcctgccttggcctcccgagtagctgggattacaggtgctcgccaccatgccaggctaatttttttgtatttttagtagagacaaggttttgccatgttgggcaggctggtctcgaactcctgctgtcaggtgatctgcctgccttggcctcccaaagtgctgggattacaggagtgagccactgagcctagcctcctcttcttataaagacaccagttgtattggattaggggccaacttaatgacctcattttaacttgattacctctgtaaagaccctatctccaaataaggtcacattctgaggtcttaggggttaggactgcttcaacatatgaatactcgggggagatacaattcaacccatagtatgtcccaactcacaatggtggtagaaatccatatggcacattttctgaagctcaagtgccaaagaccctactgctgctggtattctatctttccactgggtctaagggaatgctttgctagaaatcccttggccttttgaatttgcctttgacatttactttctgcctttctcaatatgaaattctgatcccattaaaagtcaaaagaggttttcgaaatgacgcactgaagtacagcttcacatactgtggcctatctgtggacagctatgaaaccacggcggcagaccatctggtatgaggcctttaggagccaaggacggggctcagtgggaaggcttggccagggcagcctgcaagccagggaggcaggcgctgagaggggagcagcttcagggcagctggccgggccagggaggcagccacagagggaccttgtgcatgcctgcacagggcccaaagagggtggcccttttccgtcatttttatatatgctgatcacaaccacaaatccccagacacaaggaaaaatatttgaagcctacacatatttgcgctctgaatcatttgtctcttgtctttattttcctctctctcctctctatctatccttaaatttttatactttttctctcaacagtcctcctcactttatctgtctttgctctagttggtttcaagcgcccatacattgtgtcttgtctgcattttccatgttctatttttaaggtattttattttagcctttttgtcccttttttgtccctttcctaaagctcttcttggtgcccatttcccagctttggtcctgctcatggcttctctgtcttaggccaggggtagtctatagacaggatgactataccatttatcgtcaaactgggacacgttgaagagggaaagaaggggcagttaataatttccctaaaatgcagtcccgaagtgggactgtcccagtgtggagtggatgcttattctatccatggtgtggttttctgctttccacaaatctctcttcacctatcaaccactccctccatttatgtaccattttttttttttaaaccttttatgttctggtccttcttttttatttcaaccccaagaagctttatgtgttcttgtatttctgtcttcttttatctcctcctcattccttcactttactctactctgctctctatcttgtctcaccacttcaattcttcttctcccttgatttccttcttttgggtacagactggactgcagctcacagaggccatgcctgtctgccatgatacatgcaggacatagtccctgcatttctgaaacaaatcaaggcacagctgagcacatacacacacacttcaaaataagccaccaaatgttacaagctgctttgggtctcagatgagccctgagtggactgttcaccccttcagcacctctacccagagactagaacaatccctacaccacgcaagcagccatgcctgttactgttacggaggcatgttctgtgtatgtgtctaggctcgcacgggatgcatttcctataggtgtacctatgtacactagagttgaaaaatgatgaaagcatatgacccgaaagacaaaaagaaagtgacaggtgagctaactgtgcattgcctttgttatgacttcagtaatctggatcatcttatcctctaaagaaatgtataccaaaggcctagcaatggctgccataggttttttgttgttgttgtcaattgaaacagagtctcactctgtcgcccgggctggagtgcagtggagcaatctcagctcactacaacctccacttctcgggttcaagtgattctcctgcctcagcctcccaagtagctgggattacaggtgtgtgccaccacgcccagctaatttttgtatttttagtagaagtggggtttcaccatgttggccaggctggtcttgaactcctgacctcaagtgatctgcccgcctctgcctcccaaagtactaggattataccatgcccagcctgctataagtctaacataagtaacaataaacttttaggcaacaagatagaataaatatttttttcagttctttttaaatgttctcatgacacagtcatctgcaacttatggtttattctgaaaaatcacttcaattttccagatattccttagacttaaggttgtgcaaggaaggcctgaaactccttcccaacttgaaaatgagaaaggaagagtattttcctcttgtaagtcgctggaagccagtccactgatacctgaaatacttgacagaatggcactgtgtcagctgtcaggagctgctctcgtcttttttatttatttatttacttatttgggaattttgaccacaattttctttctctttttttttcaaatactctaaaaattaaagaatgaggaaagaagactgtgtccccacccaaatcttatcttgaattggagcccccataattcccacgtgtggtaggagggatccagtgggaggtaattgaatcatggggatgggtctctcccatgctgtcctcatggtagtgaataactctcacgagatctgatggttttatacaggggagttcccctgcacatgttctcttgcctgccgccatgtaagacatgattttgttcctaatttgccttccaccatgattgtgacacttccccaggaactgtgagtcaattaaacctctttcctttataaattacccagtcttggatacgtcattattaccagagtgagaacagactaatacaacagtgaaatagatattttatgaacggaaatacaggttttgttcaagttctctccttccttcctctctctttcccttccttccccctcctccttttctttctttctcttcctcctcattcttcacattcttccagtttttgtttcttctcccactgagattgatatggctggaaatgtgctattatgattgggcagccttgtgctttatccatggtggcctatagctctcttgcttatatatatctttttatgaagatcgatggtaacaaaaaatacttcacccacactctgctgggaagatgcgacggtggaatggaaatatctatccagagagctccctacgaccctaagacttgacagagtcatccccagccagcctggagccactgacccacctgtgtctgagtaactgggaaacaaggagtgtaggagtttgagagttatttttgttttttacttttttaaactttcatgcctttccatatttctgctcttagatattctgttaaaataaaacaacggctctttccatgggagtagtttctagcttgctaattcttttttgagagagtgtttgcatgaggttttaagtttttaaagtcttggctcttatattttgtaggagccctagactccagatagtggtctaatagaaaattagccctggctcctgcctcatgtccacagctgataatctgtgtgactttgaatggcctccttgtgcctcgggcttcttaattataaactgccaacagccttttcccttctctatgatgccaaggtggggagcaatgtgatctttaatacaaaaggatgttaggcagtaaagtgtcttaaaacacagacatggatttcctttcttcttcctttgaaatatgaagacttttcctggttggttttgggggaagatagaaatcatatattcataaaggacacaccccatattcagagttcagaatttggagtttccaataatcatctcatgcacgagagctgactccctctgctggggctgccccacccccagttccagcctttccttctttcatttttatttatttattttcttagagatagatagagtctcactctgttgcccaggctggagtgcagtggtgcaatcatagctcactgcaaccttgaactcctgggctcaagcaatcatcctgccctagcctcctgaatagctaaaaccacagacacagcaccatcacgccaggctaattttgtatttttttgtagagaaggggtctccctgtgttgcccaggttggtcttgaactcctggccccaagtgatcctctgcctcagtttcccacagtgctgggattgcaggcatgagccaccacactggccccatcctcatctttaaaagcaatattgagaatcatcttgtttggagaaactctgaaaccctacagtgctgaaaagggaggattgagacagactgccattcaattgaagcttttcctctaatgtagtaagaattttttttttctttttttcttttttttgagaaaaagccttgctctgtcgcccaggcttgaatgcagtggcgcgatcacagctcacggtagcctcagcctcccaagtagctggggctaccacacttggctagtttaaaaactttattttttgtagagacgaggtttcattatattactcaaactggtttcgaactctagggctcaagtaatcctcccaccttggcctcccagtgtgctgagattacaggcctgagccactgcacccgacccagaaaacttttttaaaagctttatctgaaaccaaagcacatagtgcacaatggcagactcttagactcttgttgccctcagattttctaaaattgtcttttatcagcatttaagtttctaacacatgagatcacatatgtgaaagtgcttgtgctttgtaatatctgtgattttactatctatagcagaatatattaaagtgtaaaagtgctccaggaacctaagaagagtagaagaaaagcatgtttgaccccagcaactgtgcttgcagccaggcttgaacgagcaatcatgtgggtgggttaaattgtttattttttatttttgagacggagtcttgctctgtggccaggctggagtgcagtggcgcaatctgggctcactgcaacctccgcctcctgggttcaagcaattttcctgcctcagcctcccgagtaactgggactataggcacgcaccaccacaccggctaatttttgtatttttagtagagacggggtttcaccatattgtccaggatggtctcgatctcctgacctcaggtgatccacctgactcggcttcccaaagtgtttggattacaggcgtgagccaccatggctggccaaattgtttatttgtattgttctttaaataaaagtttattttagaatacttttaaatttacagaaaagtagcaagaatattacagagttctcatatgccccacacccagtttcccctattgttaacattaaggcacatttgtcacaaataataaaacaatattgatgcattattattaatgaaagtccaacctttatttggattgttttaggtttctttaagccccttaaaatagaaaaatgtttcatatggggaaaatgtaatgttcacattgtagctatatagttggaactctaatacatgagtgaaaatggtttaagctaactcttttcttgaacatatgcttactggactgacaatctcttgaggactttccacctgtaataccttaggcctcttctgttctctggtttgtttcccttgagaccgttagcagattgctcagcctgacccaccctggtgccagatgttggaaccctcttgctgctgccaatctgactagtcattccaaacagatggtaatatccagcatcacaccccctcccacaatttcacagttttaggcagaagccttagagtgaacacatttacctggctgttgaattgctgaaactctgttcttaaagttgcttcataccacagtgacttgtgagagctttgacattaatagaaggtccaaaagaagacctgagtgacgttcccccaaatcttgagatctaaagactttggccagtttaaaaacactacaatttatggaaaatacctgttagtaacaaatagagaaattataaaggagattgctttttagaaatcaccccaatgaccgtattccacatcccgagcttccaagctttctttgaaatacgagttaccagcagacactagtggaaagaatctttttaattcaatctctgcctttgagcaacttgctgactgacatctagaggcatctcagtcttctggggtggcaccttatggtggaaaggctggactagatgtggtctctcttagttttaaatctgcttggattggggctttataacgttccctcagaagtcttgttggtgtcctttctaccagatttctttttctactgtttcactttcattaacaaattgcttcacaggggacaaaattctagatgtagttcaaatactagttacaaatttgctgccttcaagatacctagttatttgattgatcacagttgtttttaaagttcattttaagtagagttatgatcaaacatgtgcaactgaatcaataaagttgaaaatatatcacgatgaggaaatgtaggtatcttctttggtatcttcatatcaaaaaattaattgagaggaacccttactaatgagtgaaactaatattcttgactcagagaacttcctcaaagcctcaaaataacaacaatttgaattggtcatctaagtataaataaagttgggaagagacacctttcatgaaaggaatggttgaactaactctcaaataggaagacatcaaagtcaaggaagaaagtaagagctcacggcttggggtggaaatggttactaagtttagccatctgctttggtctttcctgttccacatgtagctatatagtttacataaaagtatctctccagaggatcagaaagaacagatttatggaaccagatgtgagttagcatttctacaggtgtggctctgcagctgaaagaacatgttgtaccagggatgaagtttcttattatgtaatcaatataaattaccactagacttttacagaggttgataaagcaaacacgtgtcattcggattggccttctggtatataaagagaccctgcttcacaacgtgaaaaaatgtaccgtttgacattcataaaagacttggtagaaaataccatgacaataatcaggcaaggttgttcccccttgcacacagaggggatagctggtggctagatggaaattgtgttcatatgtttttcttcatcaagaaaaacaaggaaattttcataaatatttttaaagtctctcagaatctgataagaaagggccaagaggatgaaaatgagaggactggggaaaaataacagaatgcaagagaaaagatgaaaaaaggcagaattagttaacctatagaggaatatatccttaggtggtatagaaaatcagggttataaaaaaagattggtaaattgcagatcatttaaacatttgcacacaaaaagagaattttaaaattctagacaataaaagtaaaaatgttgctgataaattaatttgtgtcaaagtatttaatacaaatgttttgattttttaaagctgagtgttttatgctagattttacaatgaaacaaaaagaaaaacttctatttttgggcttctaatttgcttaaactttttcaatttagtttaaatgtattgctcaaatctctgatattcttactaattaaaatttttttcttaatcaattcatttctcagacaactgtgccaatctcccataatgattgtggatctatgacagtcttcttataaaatttctccttataaaatttgccataattactgttcatgtttctaactatgttgcttaatacacataagtttatgatttttacatcttaaagcatattttgtctgctattaatattgctacatgtttcttttgttatttacttattacataaatttaaaaccttttatttttaatatttctgtctaattatcttaaagtgggtctcattaatagcatatagataaatttcaaaatctagtcacagagatttctatcatttaatgtatgagataaatccattatatttgttattatggattatgtacaggatgtctgaaaatctgaaaacagggcaaacttaatttaaacaatatattagtcacattttaaaaatacttgcttaatatgttttcttcaagtttcagacaacatttcaagtaaagtatctttaaatttaaagcaatgtccaattttttaaccctaaaaagtataatgaatacactattttctgaatttccagaatttttagaccctatgtaatgtatttattgtacaaaacataggagcatattatttgaaatgtatctaacctacagtataagtgcctaccctatattttctgatttttttggactcaaggtaatttagtcttatttttaacatcatattttgtatttcttctttcccatgtgtattcttcacgtctttattttctcccttcctagtgttttattatgtttattgattcccttttagtctttactgttttggttatatacatccctattctagagaatatttctattaacatttaatatgcatatattacaaagtataaactttattttccctcaaaactatccgtgttcatcctataagctattattgtttaataatctgtttcgtttttaaaccttgacaaattcatttttttttaaaacagccaattgttacaataatctaccaatatattttgttgatttctttgctcacccttgcttctagcatctcactccctatttctgggttcaaattcctatttgctgaacttattctttagtagttcctttagagagtgactttgggttgtaagctcttagactttgtaaaaatacactttttgcttttacttttaatttagacctcactcttggatattcgtttagctgagtatagaatatttttgcttggtacattgaagaaatcacattttcttctctctctctctctctcttttttgaaacagggtctcactctgtcacccaggctccagtgccgtagcacagccacggctcactgcagccttgacctctggggtcaggggattctcccaccttagcctcccgtgtagctgggactacaggcactcaccactacgcctgctaaattcgtgtatttttttaaaagatgctattttgccatgatggccaggctggtctcaaactcctgggtttaagccatcctcccatctcagcctcccaaagtgctgggattacaggtatgagccaccacacccagtcaagatattattacattttcttctcacatctatttaggagaggttggctgtcagtcttgctgtcctgtcttctgccaatataattcatgttttctctctggtcacttttgtaactgaagtaaaaaagcaaaatttccacacagagaaatattcagattttaagtgtaatatatatgtgtatgtatgtgtgtagtatatatatatatatgtatgtctatatataaggtataagtttgccatatatatgtcaacatatatgtgtgtgtgtgtatgtcatatatatatacatctgtctatatatgtcaatttccattaccacattgcctaccttacacatctactgttctgatttctatcaccatagatcacatgtgtctattcttggaattcatataaatggaatcaaatagtatatattttttatctggtctgttttgtgcaacataatgtttttatgattcatccatgttgttgcatgtataagtagttcattttttaaacttaataatatttcatagaattaatatacataacttgttttccattgtcctattaatggtcatttgaatcgttcccagtttgggatattatgaataaagatacaagagatgcttctcaacttatgatggggttatatcctgataaagctattgtaagttgaaaatattttaagttgaaaatgcatttaatacacctaacctactgaaacatcacagcttatcctagcttaccttaaatgtgctcagagcacagttgggctaaattatctaacacaaagcctattttataataaaatgttgaatcttatgtactgcatatcactagccagagaaaagatcaaaatctgaaatttgaagtacactgaaattgcaacagttccatactgttgtaaagtcaaatcttcgtaagtcaaggaccatctgtgtaagattcaagtacctttttccgtgtttgtgtgtgtaaacacaagtttttatttcttttggctaaaactgagaagtggaattgctgagtctaatgtacatgtttgtctttacaagaaattgccaaactgttcactgcggtgatgctgtttttaacacttacaagcaataaattagcattccagtggctccctatctttaacaacatttggagtagtcagtctttctaatttaaacaattctagtagttgtttagtggtatctcattgtggtcttattttgcatttgtctaatgacaaatgatattcggcatattttttgttcttattgaacatatgtatatcttctatgaaggatttattcacgtttcttgcccaatctttaaattaaactgtttattattattttgtaggagctcattatactttctggatacaagtcagatatatgtattatattaatacatattttctcccagtcagtggctcaccttttcatttccttgatgctgtattttgataaacaaaagttttatattttaatgaaatcccatttatcattctttaaaattttatggctagttctttttcttttctctttaagaaatatttgcatactctatctaggttgcaaggatcttctatttaaaaaaaacttttagtttttgtttttatgtttagatctgtggtccatgtagaatgagtatttgtgtatggtgtcagatagcagttgagtttcatttttcccattcatttatccaattgttccagaacaatctgtcaaaaaaccttgtctttatgaattgtattgactccttgttgaaaatcattcatctcctgcataggtgtgggtctaatttttttttttttttttttgagacagtctcactgtgtcacccaggctggagtgcagtggcacaatctcggctcgctgcaaccttcgcctcctgggtttaagcgattctcctgcctcagcctcctgaatagctgggattacaggtgcaggccaccacacctggctaatttttgtatttttagtagagacagggttttgccatgttgaccaggctggtctcaaactcctgacctcaggtgatccacccgcctcggcctcccaaagtgttgggattacaggcgtgagccaccacacccagccaggcatggttctatttctatagcttcttttctgttctatagattcatttgtcttttcttgcaaataccaaactgtcttgattactgtggcttcattaatgttagacattgcttgttacctttctactgttggagataaggatttagtacattcatacaatctccccgttcaatacggcatcttccccatactttcaatattataataattgtatgaatacttcatagcttaccacatagtatactatgattacattttctttctatattaccactttccttgctactatcccccatgatttaataatgacttcgtttcttttacctgtttgttttctatcattaatgcctgccccagggtatctgacaggaatgtcaaaccctttttaatacagtcaaacacatcaggtaatttgtcaattatttttctttaaagagacttttctggaaacttcttggcattttctaggtttggtgcacagcttgctgttctaaatcttcacttcacagtcatctgaggcatttccttcctaggactgaaaggaatttcctttgtatgtgggctgaaatttgaatcctccatttcctggttcccattattcctccttctttatactcttgttttgatgaagaagattatctaagagcatcttgaacaagcgtccagggacgacaacatttcttagaacttaattgtttttagtatctttgatttaagacatacttgattaatttattggctgggcatagaattctaggctggaaatcatttttcctaaaacttccccaaacatacctgcactgtaacctcccaacagggtctccttgcccgcttcctagacagagctgatttgtcaagatggggaattgcaatagagaaagagtaattcattcaaaaccggctgtaggggagatcaaagttttattactgctaaaatcagtctttctgataactcaggatgggaatttttaagggtaatttggtgggtagggggccagtgagttgggagtgctgattggtcgggtcggagatgaaatcatagaagtagaagctgtcctcttgagcttagtcagctcctgggtgggggccacaagcccagatgagacagtttgtggatttttattcattctgaatactatgggcctgttcaatccagaaaaacacatcttatagttagaaattttcttatataattttggtgataatttccttctcctcatttcccatgttctgatacacacagtctcctctgtcactgaattattgagagcttgaacctcctaaaccaactctctgattttgtattttcttaactatattctacttttctgtatcttattctaatttttgagagtttccttaactttggctatatattgtttttagccatagtatttttaatttctaagggttctttgttgttgttgttgttgaacatttctttttataacatcctgatcctctttcatagatacagtagttctctatgcccctggaaatatcatttatattttcagtgcctttctgcccctgccttatctgagttttctctgtgttcctgttttctattatttgtgctagtctctgtctttcattcttccctcagaatcctggtgatccttggctgtctgtccatatataggagcaaggcagtaaaaagctgattaaaagctatgggttcaggagtgctggctggcagaaaatgggccagttatctttcttcccatggcaatctccaaatacccatatctctagatcctttttcttgaacaagtttatccaaagattttctttttgctctgttacccaggctggagtgtggtggtgtgatctcggctcactgcaacctctgcctcttgggttcaagtgattctcctgcctcagcctcccgagtagctgggactatagacacgtgccaccacacccggccaatttttgtatttttagtagagatagggtttccccatgttggccaggctggccttgaactcatgacctcaagtaatccaccctccttggcctcccaaagtgctgggattacaggtgtaagccaccacacccggccccaaagaagattttccaaaactcttcctctgagttgtaagcaaagggtcaacattctgagaagtcttagggcattacctgcattgcagagccatccccatggcatagtttccccatttgcctttggtaggccctgtcagtttcactggttctaggccatgtttcacatcagtgtcttggctggaattcctaagcagatagttcatatttgcttcccattccctcccacaaaaaggggtttttctccccccagcccacggtttagcttcctcattagtaggctgtcatgggtagagggtttccatttgtgttcgtagatgaaatgccacctttctagcttgtggctttacacaggcgctcagttccagttttctgccgtgttaccaatgaatgctatcatacccttaactcaggccaacttctctgtctttgagtttcctctgtattctggaacctggagatgttcttctcttgcttacaagctcatttaagtgttgtttgtaaatgttttgcttattttttctgcaacatttatgcatttgaagcagagtagaaatgcttcttggatctgcttagtccatattgaccaaaagtctaaagttattgattcagaattctggactctgagagcaatcagtaaattatagtgcctcggtttgcttgtgtgtatattatcaatccttcgccaacaatttttttctgttaaaaaaattcctgttagaatttttataatacttatttttctatatctgtccattagtgtaacatggtggtcaaaggagaatttttttctggtagtttttcctgtcacaacatggctcccaaagagtagatctagtaaatgaaacagattgccttggactatcttaataaccattgccatcatttttcccccaaatttcacctatttattcattcagattgcattattaattgaggaaaattaaattatctagtggagatttagctttgaaggtaatttcagacatgacagctgtggtcggaggaagattctcagtttgtatgcaagtggagaagcatcatcatgggcagaggacttagcccctggtcctaatttctatttttccatgctcaaccttttaaatagaaatgagtcttgtaatgggaaaaatggaaatattgctccttgaggatttgaagaatatgagacctgaagacctcagattttatatctattaaaacattggcacaaccatgcaacattctttccatgataccatgactggtttattgaggagtctcaactcactgggggtataaagaagaaatgatttctatttttccctatcagtactgttctgtgtcaaacttccttttattactagctacagggggcctttaattacatctccgaccagtttctaaactcaagaaggataaattgctcctaccctcaccccactcccccaggctagagtctagtggcttagaattgtagggttctggctcttaaacagcttattttccttcattccagtgaataaccctggaatatgggggagcatgaagagggtggaggaagaagaggtctgtactagacttctcataataactggtgttatgaaatgacctaagccaatctgcctcttcacagttgtctggagtggagcgatctcagctcactgcaacctccgcctccctagttcaagcaattctcctgcctcagcctcctgagtagctgggattacaggtgcccgccaccatgcccagctaatttttgtacttttattagagacggggtttcaccatgttggccaggctggtcttgaactcctgacctcaggtgatccacctgcctcggcctcccaaagtgctgggattacaagcgtaagccaccgtgcccggccgattatctccaatttttagatgtaggcaccatttcctcccagataacctcaataccaggtgatatgttacaatggaaacaagtctcagagactaaattctgccacacatgaaacaaataggcataaaaacaattacaaagcctgttccatacatttggtaaagtccccattccatctttttttttttttttgagacagggtcttactttgtcgcccaggcttgagtacagtggtgcaatcatgtttcactgcagctcccaactcctgggctcaagcaatcctcccacctcagcttcccgagtagctggggccttgggcatgtgctatcatgctgggctaattttttttttaattactttttgtagagacaacgtctcactatgttgcccaggctggtcttgaactcctgggctcaagtgatcctcccaactcggcctgccaaagtgctgagattacaggcatgagccaccacctggcccccattctattttttaaagtgctctgacaagtgcttttgcactttaagcaaaagatccactccctggcaaaagttacaatattctaatggcagagccagctcatgttctagtcaggccagaaagtttcattaaatgggcacaggcctgaatagaatcctagatctatggcacgcctctgaatgctgggtttgtcagatttcttaatccctgtacacacaaggatggagatgcctgaataagtctttctatccaatccaatcacatatattgaacacccactcatttgcctggtgaagcattatttctctgtcctttatgccaatttgcagaccttcaggatttagagaatgatattgaaaacatcaatcttaggctttctggagtgtgtactcctgactagagtccttcatatgctaacagttcctagggtgcagattagaattaatttacatatattgtctgcactgaagtattttaaaacaaattttcaacagtataacattggtgacaatgctgagccaactcttaggtgatgaggggctcattgccaagggataaaaaagtagttgaatattttaggatgaaaataaactaatgttaagaaaatagtacaaccaggggagagactatctcatagaatatctatatttactaaggaaagaatatgaaggctagaatccatgaggattttatattcctcccagcaccctacttttaagctgaaattaccagtaaaagttcatgagagacactgtagtacaataccggggacacaggtagtatacgtactacaatcctgcttatgggctcttgctaatgaatcatggttttaaattcttttaaatttttatggttttaaaattctttttaatgtagtattttgggcagctgaagctgacgggtcagaactgatgcataagagagaacttcattgtaatacaaaagtcactgggtctgtcctagctgtgagaacttagataaaatattgaatcctttgcgcttccatttcctcatccattaaaagataggggtgaggggtgggagttataagaactaaatgaaataatataaataatttagccactgcctgttgaggctggataaatatcagttccctcctcttgtagccacaaagttttaactaagctgatatgtttgttacattctgctcatgtcttttccaggagaactccatctagaacaaaatgtgcattcagcaaggtataattgtgtatgtttttattgtcagttttagtcatatctgtcattttttattttccaacatgaaaagagaggtttagggtagtcacattggaaaacaaagaaaataagattaaaattccctcaaatcaactttggagccctaaaatattaatgccttgacggcttactcacaatcacaaaaggctgtgagccaacattcagctttgtattgcagaggtgatgagaacatattttcattgctagaaaaaaaattaagctatacagacagaaatgggacatgggagccaaattccacaagaacacccttgagtttaagggtttttcccccatcttttgacaatatttagaaaaccaaagactataaacttttaaaaggaatcttggatgacttacagaaatagtaaggtcaccaaaacactttgtagatattgaatttttataaaagtatttaagttgattaatattattctcagaggtagcataaacttaaggatcataaatgcttactaaaagtgaacatattgggactagttgccaactgctgcctaatcaacccaactggtccaatcctgcattttcagtgaattgacttaaatcctactcatatgaaataaatcagtggtcggagatagcaaatctgccaataggttactctcagctgtcttaattagtgtttcctacatttttccagtttctggtacacctttgaactgccagattacacctggcagattacagctgatggaggatctatttgccctttatttagttatatcataattcatgtataagaatatgtattatgagctcactattagtagggtacatgcatgctgtttttcaaagagtcaatatcctcctgcctagcaccctgggacaagagtgtcccctgtgtgatggctccctggggagagagctacaacaaccattgaactggccatcagaggatcaaaccattgactttatctttagggtttctcccatgatagctgaagatcttctctttctctgcacccacatgagtgtgggccaatttttgaaacggcagcagtttcataaaacccaaagtttacctgtgaggcctgctcaagccttcattctgtgctcagcctttgcattctcagtctgagaatgcctcccatcctcttttagctgacgatgcagcagctaggtgtgtgggagttagcctcttggcaactcctgggccatggaggaatggccaaccacccaagttgcctacagattttcccaagcacatgtctatcaacatgtgctgtcagccaggcaaattgtttcattggtcttggatgcttttccattcactctgtactgattgaaaattaatccataattcaaggttcagctcatatacctccaccacttccttattgccccagtgagaataaatggttctccttttgggttgccacagcacaaacctccgtgtattatatctgaccaatagggtttactactctcatctccctacttcattaaaaggcaagaacaatttttattgatccttgtatatcctgccctcaattctagtgccgaacacagcatcaaacacaaagcagaggctcaacaaatgctgaatcgaactgaattcaattaattgaagaaagggttgtttactgacactgtactaacacttctaatattatcctgcctcactagggagtcttcactgggggcaggggtctggagtacaatcagaatcaactggacagttttccaaactatacaggctaatggtagtggactgtgttaaaaagctattcaggatactccgaaattatccctgctcacatctcaccaatccttatgctagttgaggaccttcaaagaaccctccctgtccaaaatacatcattcagaatcttctgtttagctctcttcattttagtgaaagtctcctaaaactagtcctggatgtgttttcatcacacttgaagtttaattaactgataactcaggcacaatggaaatacttagatagatgctcttaaattacatttaaacaaaactatttacaagcgatctagtaaaaatctgtgtctttaatgggctatttttaatgtttcctaaacaaattattgtaggtgggccaattttccctctttacttgttacttagaagcccatttggacatgttctaccccgatctggttctctcaccccactggctacagaatagtgtgtttttgtttgaaagggtcaaaacattaagaatgtgacatccaaaatatgtgctatttttttttcctggagtcaaaacccctaaagtataaatcgtttttaaatgaagaaagcagtgccaaaaggaatgaaacatatttggtccttctccaaaacagagagatagcactgaaacaggaagtggatgatttaaatatccactcggcatcttggcaacatatttatgtttaagggacttaaggttaaaaggtttttgtctggcctgggaacactctatcttccctagggtttggaggtttggggaaaacttttaacaacttatcaaatatttgcaattagccattttttggagaacaaattgttactgagaatgtcataggaaatgttccctataagctgcatgctaccattactctcctgcttcttatgataatctctttagccacctagcttcatgtggtagaaagttattattttctataaagaaagaagaatgtggttcgagttcttgtaactacttctcccaaagttggaactacacagaatgactgaataagcagaatgcaaaattggggtttaattgattttgtgtgtgctgtttccaaggaccacttagtgggcccattcttatagctagaaatcgacaatatcgggagtgtttacacaaggaagtaggccttctcctacttcccacccttcagagatgagagactgctattatccatttaccagcgcaccactggaaagaatagttaaaaaaaaaaaaaaaatgagctcaaggtttttggtctaaaagactggaataatggtgttttcatttaccaaacttaggaagaacatacaaggaggaactatgggagtgcaagtcagtagttcagctttgaacattttatatttgtcacaacaattaggcatttgattggaattgttaaataagcagttggatatacaagtctggggttcagggaagaggtcctgaatatatttttttgggagtcaggcatttgcatggtatttaatgccaagagacaagacgagaccaagccagtgagttattagatagaggagctcagtcccaggataatttttagggtcttccaacatttaaaggtcagagtaaagaccagcaaaggagactgagaagagtggccaatggggcagaaagagaaccaggagggtgagatgtgctagaagccaaatgaagaaaggacttccaaaagaaggaagtgatcaactgtgtcaaacgctcatgtattaattaagatgagaattgagaattgatcattggctttggcaatgtagaaatattgatgatcttgaaaagcatcaaggatggtagagaaaaagcctgattggcatgggttcaacagaagatgggaggaaaagaactcggagcagtgaatagagacaacattttcagaattttttttgaaagaggggcagaggattggaataggagctggagagttgtatgggtttaatgaagatttctttttttcttttagcttaagactagatatattttgacatgcttgtatgatgatgagaataatctagtagaaagagatcattgatgatgcataagagaggtgacaattgctagagcaatgtccttgggtagataagagagcatgaaacctagagctaagtagggttgaccttcaataggagcatggacaaatcaggcatcgttgcaggagtaaagacaaactatccagattcagctgtaagtatattggaaaatatgatggtagaagcctgtgatgctcttatctgattgcctctattttctcagttcaataaggaagcaaattcttcaactaagactaggttagggaagcaggaggtttggagacttcaaggcaacagaggatgtttggacttgggaaacagcagacttgccaggtagcactaaggacccagttgacattactggtaacaaattttaagtaaaagcacttagcttagctgcgtgttttcctccagctggatttagcttcctgtctgcttgctacatggagagcagtgtttagagtgatgaatcaggggatgtcagctggtaaaggacggtgggtggctgaggcatgtgggaacacaagatcattggaggacagaagcccaaggaactaagaggccagggtattagaatgatcacagacatgaatgttgaaatcgctgagaattatggcagaagtagcattggaaagagttaaaaccaggagctaacatctagaaatgaagggaagtaatgcagggatcaggaaatgactgcaacaaggaggggtagaggataatattttcaggaaggaatatagctgtggagcaaggagacaattgcgtctacttccaggctctgtgatacaaagggtatggaagctgtcggaagagctataaatcacgagaggaagtatagagcatgaagttgcagggaacattcaaagaagagtttgagatacagggtcttggctaatgacttatctggagttccagagaaatcagaaaggggaaagacattgggtcagagcaggagatgcatagagccagttggctgtgggagtaggggttccacaaggagctggaagtcctgggggtcttgcagaatgtaaggcatcatgcagtcagtcccagtggtctctcatgaagagtgtagtggtgagactgggactgctgtggagggatttccttccaagaacacacagaattctggggctccctttccctttctactgaggttgattggaggcttgggaaggagttggttactaagagcacacaaagccctggggaccaccttcattcctctaaccctacggaagatgctatttattccataccttgtttaatgcttcagtgcagctggtccacaagtgtttgctgtatccagaagaaggtcagataaagagtgaaggcacacccctgttggaaaagaagcaacagtctctctatgattgttgattcactgtttgcctgttgactcctggaattaacactcaacagagtcaagaaacctgggtattggtcttgactgagtgtccttggataaatgcctcccccagtttgaatttgaatttcttctctgtaaaataagggagctggatcacgtgacatctaggttcctttcaagccctgaatctgagtctttaactgtggcttcctagattttgggattggcctacattggcccctgcttcctaccctttattctcagttttgccgtggtctagcttttcatttcttatgtcaggagcatgggccagccacagtacttttgactaggttgcttgctgtcccttaggtgactgtgtcctcatcatgtccggacaagtgatgccaaggattgctgcaactctagctggcctttggggatgaagtgggttagaacccaacacacactaatatggttggaatttaggctgtgcatattgtctgagaagcaactatcaaattgcttgtatgtctgtgacacaaagaacaagaagagatgaaaggagaacatatactccatgttgtctctccggctggtcctcaagttgtagaatttctgcctcttttttccccagtgctagtgggacttcccagtcccagtgcctcctggagaagtttcccgtcattgttcttggataaggaaaactctgcttggggttttggtacatgtcactcttgctttgtgaatatttactaaacatggttttggctgtatagctctgatgcactgtaatgatatcattcacctatctgaagtctcactgtttagaggggtgaccctctaaaccatttctcatgttttttaaggttgaaggaatgtttagctgagcctatgaggtcctataccaaaattttacctatcttctggaagctagcaaggcctaggatttttactaaactgaaaaattcaatgaattagtggaactgagaaatttggtgtttagagaaaatgaaaatatagacagaatacttaccaccatttacaaatatacaatattctcaaaagaaccaattatcaaataaaacattttaagatatctatcctttgaaaaacaaagcctattaattttttaaaaactatcctcgaactggcatatatcccctttgtaaaatatcaattccttaagaatctttctttcaaaatagcaattgtgataaccagggtcattcacttgtgaacttgtcttgtctcctcttaactagatccagaacatttgttttgctcagtgctatcctgctttcactcagcctatctaaagttttactaatttagttcagttgtataacttccctccaggagtagtcatctccagctttaaaattttatttttctggaatcatgcaagagtttgttatgcacaaatatggactataggctttaaaaaagctaaattttatgtcaaattggaatttatctcagtgtctgattatataatgtgatgttgcaaatcaatagatgtgtccctagcactgcatcaagtaaggatgaggaacacaggggccatgtcaatccaagagcttcacagtttgtccattggcagccatttattgaaggaaattgctagattcttggattttccacttattaattttcacatgctggaaaaggtgcgaatttgactagttccatttagtctgcaatttaaaagctaccccaaaatatttgaaagagcttatgacatcattcttagatcatgtgtacatgctcagaaaccaaacctattcctgaatagcccctttctcttcagccaatttaagcaatcagtagactgttttgtatatgcaacattaactcatttggaagatttatgcttatgctgttgctctgactgagctggtcagaggattttagaagtttccaggcgaatgggtaaaatgtagggagtaagcacactttgaagtgaactgtgccatcataggatcaatgtattcaaatagacactggagaagacatttccactgtttcccatactagttacatttcattgacaatcccatggcttcaataggtgagactctactgtgtcagaaggtagaacaatgagcttcagtcttcttgaacttctcttgtgaaacctgtttccttcctggctttattaaaaaattatgtcttctgtttttggaaaagtagctgtcagaggattagagacaattcattgaattggattacttgttgtcacaaatattataatagtattgtagagcacagaccaacggagagctgttcccatttgctaggatgttgttactgcttcggttttatttttatttaaattttttatctctgctattctcctttatggtcaaaattgtaaagagtgcatctttggaggaatgcaaggtaggcaagcttgctaagagcttctacaagactaccttaaaagaagacttatatttaacaaacagaatctcaacatatggacatacaccctcttgagctggttagaaaggacttttttctttatttgctctttttgaccactgacatttattttaatttttttcatttttaaacatttttattttgaaataaagtaaaagattaacaggaagttacaaaatagtatagaaaggtcccaggtacccagttttccccagtagtaacatcttgcataactacagtgcaataccaaaacccaagaaattgacattcgtgtgattcacaacgttattcaggtaagaaggtctttttaaaacaagaaataattcattacaaccacggggttcctctaaaaactgtccctttaactgaagaacacctgattgtttgttgtttattcagtacttctccacattttgcagaggcacacaaaatcatttttataaatcccaacctatgaaggacagaacaaagtcattgttctatttttcaaagtatacaaaagctaaacgagaaaaaaatcatctgggaaggcagaaatccattggtgcaaagtttttagaaagctaagtgaagtagtaattatcttactcattccattattgaagacctcttcaaaattttattcatttacaataaaatttcaataaattcaattccattctattacaataaaatttccccatatatttctaaaaagtcacagttttgtggcaacaagatttagaattttcaaacaatactttttgtcacacttgccgtcagcccattttgttataacctcatctgtaataaacccaaaagagtttactctttttctttatttcttggttaactgtttttgagttttatatgcacagatagcattccttgaagaaagaggcaaggtatacatacacacagttgggttgctattttttttcttacaatgtatttatactgttgtcaatttaaagaccaaaatattctcaggaaaatacaatattttactttttaagcttcatattctatgagtaataaatttagttttgagggataagatagcaaaccataaatatggaagcactctcttaaggtcaacattaaatctgataatatgtagaatagatttaagactatttcgaagtttcaactagagtttcacccagtgtgctttcttcttaggttttaatgctggtttacaaaaggaaaagtaaattgctttctggtaacaaattattgcagaagatcttctacttaaagcatagatgcatttttatttttcatttacttctctgtttttgaagggttcagtgtttattcggcggaggtttatgtcaattatttaatcagaagcaggccccagagtttgccagtgatattttggaatgtagggtctacttcaaagaaaggttccatgtctcttgacccagatgaagccaatttttcatagtgaagagcaaggtaattcgattttctttttcagagcaaaaattatttttagactgaatttgatgggtcatatttctctgctcagtaaatcttgcaattatcactccacactggaaaatgtaactcaatgacccaccattgcgccagagcttctgtgggcagccgagctccgagaggcagctggacatgatgtgaagttggtgtctatgacatactgcaagatggaaaccaagcagtcaaccagtggcagtagttcacatgccaacatttttgtttatttgtaatggaaaactttaggaggaaaacacaggagactgggtgccatgggtgtgaggtagagatttcaatcctgttcagtcacaggaaaatccaaattggccacgctaaaccagatccaaaatcccagactaatttcctctcctctttcctctgcgagtgtttctgatttcacacaaggcaagagcaactgagaacagggagcctgactagatgaagtaagaaccgtcgtgaggcccaggagcaagaaaaaaaggcctggagttgtagaacatgctagaacatgaatgacagtctctgcggaattaagaagcattctccactctattccatggcctcttgctgacctaactcctagtcttccttcacatctcaccttaggataccacttcctaaggaaagcttaacagactcaagtttgacttattacctttctctgtgccctgacaattcctgataccctctccagagcagggttatcacaccacattgtaatatttaatattgacatccctactggactgcaagcctaatagaacttgggccataccgctcaagtttacaattgcatgctttttgcttagcactgtgtctagcacacaggaaatgcttaatatgtatgcgttgtttatgttatccatgccttaatgtttgggatgctccagatggcttaataaagtgtttaactatctttacaacctcaacccagtccaatgtattgaaatcatctctaccaagctttgggaaattcaatcagcatctaagaagcccttgtaaaaaacattttagtacccaatgatgactatacgtaaaccctctagctcctgacccagatgtgatggcacgtgcctgtggtcccagctacttgggaggctgaggcaggaggaatgcttgagcccagaagttcaaagctgtagtgagctatgattgtgccactgcactccatcctaggcaacatagtgacaatcccatctcaaaaacaaaacaaacaaacaaacaaacaaacaaaaccctggttttaagaaaacaatgaagatagccatgaaaatacacactggcctataaatgtatatgctaaaagagaatggaaactgaaataatggatctaatgaaaatcaggcatggttttgaaattttgttaatgtgcttcttttttcacccttctattcactttagttggattttcatggaaattcagatctaagagagaattttgagttcatgtctacacagatggtaaccagaaacttctaagacatattctcagtgtaattttcagcccataatgatgagggtggtctgtctacattgtaagaagattaaactgacagatctatgatcttgtacgtatagatggacaatgacctaaaagctatgcttaaaattgcccctggagacattttactcctgaatctgttggtttccatggtaaaatattcagttgtatgttgtcaaaaaggtgaaaaataaaatctaggagaaatctgtcatgggtagaagttggtggaacacatttaatccaccagataaaatgcttccggtctaaaagctgctgaaagatacttgaaagtctagatgttgggtgatcttatccagacagcattataagatatacaaaatatttgaagtaacgtcatattacaaggagaaaaatcattttcactgttcctggaagaagtctttctgtctacactttacccactacaaatgttgagatgttctgaaggactaccttgcacctttagtaattaatatcatttaaaaattaatctcttttaaaatgagattttccataaatgctagatgcccaatttcaaaggaaaaatctatgtgatactctgacatattggtcaaatattttattctaggggacatggtgggtagcaaggggtggtcgtggactgtaggaagtgttgacttcaaaatatatattagcatttccatcattttaaaagattttttaaaagactaacaatataacatatggacaaagggatacattccttagaaaaattttaatggtaacatgaaaccacagtaaacagtgaaggagaggggaggagaaaaatgatgcaaactatttacttccccttagaggctagaatgcagttgttttctattaaacttagattacgtttatgcgtaactgactcaattataaaatgaaagctaagcaactgttggaatttgtgattacaccatgtaaatgttacataccttggcaatgtaaaataataatataattttttaaatagagaagaaagagactgtaagaaaaaaagtaagtgtacaaatttccctatgctttatagtagggattcagataatgtctagtgataatatctgtagttaaaacaacaacaagcccagtcttttagtttttttcataattttaacttttaaaaacccatatctcattgtaaagaaacatttatctttagttcatcaacttctatcattgaagctgtttctctttgttaaattattgtaagtaatatttctaaatattagactacatttataaaactatttctacctatccatctatttttataattttagagatatccagaattttgttcaccaaatgttaacaatttatttctgagtgctagatataggtgattttttttaatgttctttatacttttttggggttaactttttaaaagagtcaacgacattttttttttttttttgagacagagtctcgctccgtcacccaggctggagtgcaatggcacaatcttggctcactgcaacctctgcctcccaggttcaagtgattctcctgcctcagcctcctgagtagctgggattacaggtgcgcaccaccacacctggctaatttttgtatttttagtagagatggggtttcaccatgttggccaacctggtctccggttcctgaactcgtgatctgcccacctcggcctcccaaagtgctaggattacaggcgtgagccactgtgccccgccaagagtcaacaacattttaataaaagagatagatgtttatagagagagatagttgactctctctctcttcatttctatctatgatttccttttttctttcaaaggtttaacaattaattctttaaagcattcgttcaattgtggcacaccgacctctcttgttggccagaaacttataggggtaagtctcaataaaactattgagtctaaaatcacaaaacagctgacaactttgtggcacatcacccaattcttggagacagtgccaacccttggacaggtctatattatcttgggcacgagactgcttgctaagttaaggttatatattgaagagaaatcagacatttttatttctagaattttctgtttcatgagggactgctggctatcttttatttgggccaatgcctaggcccaaaagaggtttaccagatgtgtgagaaaatgttatttctgctttatttggtgaatgataatgagtaaatgggatgaagggaaactttctagaatttctagaatcatatcttgtctgaacaagatatgaattgatcagttcacttgtcaaacaagaaagacatttgtatctatctacaaattttattcttcagttgaattcagaatatagtgatttttcataagaaacgacaaaatttaataagttatgcatttgttaaaaaaatactaacttgtctaacataatcctggaatctcaaacatattctgtagttgttttctgagtgaatgctaacactcactgtaaataaggcattgatacttccttgtataaaaatattttaaatttctaaaacctctcatcttaccatctccttttcaaacttcctccccaaatcttcagacaacttattctacttcatttgaagagaattaagtatggttttcattcattgcatttttctattatatttctacactctatgttctatttggcgatatagttagttgcctctatctccctggctagatcatgtgttccttgaaagcagaaactatgctttaatttatccctgcctctccactgtaactagtttagtactttacatgtagaagctctgtactcaagtcaacaatgtggaattgccttaagatgaaattggtgaataggtctgtagaaaaatgacttctccgtgggtcaccctgcccaccccacctgtccctccacatgcccccttaaaatgcaaaattgctggaagcttggggaagatgtatgcctctatatgtacgtacatatcatctcaaaaggaaaatttctgtaattttcatctaaaagatgcctatgagaacaaagccaaacaagtagctaaggcccgaagcactgaatgggatgaataaaatatctcgatatttacatggttcattttgaccgtacccacagggcagcaaacatctgcgtgaaaagtaaagaattcagcctgttagatgactggttgtgaagagccaaacattgggtatcatgtcatccacatgtctggttgattgaatatgaattgccccctttttatccagatagcttcagcaatagataaagcatggagatttttccacattttacatggtgcttggtgttgtagaattcagcctttgtgtgttcttttccccccgtcttgctattgcctggatctcattaggaaccattagtgatgtaatactaaacctatggaatcttaaacatgcttttaaaatcctgtggaataaagatgtctcctaccaaaccaaaaatgcagtgggaatagacaaagttacatttcttcaagaaaaaatgactcatttcatagttcccaaactgttttgactgaagcttctcaaaataaactttctggaatatggagcctttgatgtctgactttgaaaaaaatatatcatttctcaaacatacaattcaatccttttggggtgttcatgtatttctgcagattaacttacttttatttcaacaagtgaatgacacaatattaaatagccatctgacaaagaaagaaaagtatgtttgaagtggtcttaactcctacataaaccaaatataaagaacatgccatatgattttttaaattgccacaaaaatagaattttcagaacattaccagaagggggatttggtccattaagaataacaaaacagtttagatgtcatgaaagtagaagattaggagtgccattaagcttactaatgagatttttgattcatatgctatttcctaggctaggcaacatttttaatttttcacagtcttgaactttaatccttgaagggtaattcaagtttcagaacttacatactgcaatttgtttggggtggcaatttgccattgatttgcctctgggttcttttgttctctttcagctgggggactcaaaggtggtcatttattaagtccaggtctacacatgaccgctgaaacaactggttttcaatcaaatcttctaaataatccaaccatttttgtgcagttgatcagattgatttaagatatcaattgctctattcaaacaacagtgaatgaaataattgtatgactggacaatctttacttttctttcctcctcctccttcttctccttcttctccttctccttcttcttcttcttcctcttcttctttaataagagtttctctttggagtggtggaaggattggttaagatctgcattctagcttcaactcttccacctctatctgatgcttgaaaagtttctcttaacctttcaagcctcatttttcttttctataaatggagagaacaaacactgaccttgtgctatgtttgggacattaaatagatactgtggcatttgatacacaattggcctacaataaatgtaattttttcccagttccccctcaattgtacatacggagttttctgctttttttcattttctattgtgatgataacttctcaacagaagggttaaaagaatatttgacacccattatattacgctgttaaagaatattagaactagagatatacgtcacttggtcagatctgagctccagggcctgatgtctctgatgatggcaagaagagactgttgttggaatttgtgttattctctgagactttaagaatactacctttccttcagaggcttttaaatatctattatgcagtaacatctctaaactactcttgaacctatgcacatttttatcatggtaccagcattgaaagtaatagattccaagtgtttaatacttataatggaaagaggtttttctattatttgacctaaaatgatcacttcaaagctttaagatttagataaagtggggagaaagggggataggaaaaggagcatgggaaaaggggtaaggtaattaacatttataagatgatggccaagtttattagaaaacagatggagtcatacatttgggtagacctgaacttcacttccagctctgtctcattccagggcagagttgttaagagaatgtaatgtacccgcattaaaataaatttgctttgttaactataaatttaagtttggatttcctctttccaagcatttatttttataagtgattagggtaatttaaggtctttaaattgctataaaatatctaagcattaaagaggggtgagaaaaattagcattttaaaattctctatataaggataattttatactctaacttttggatttatagatatcttatgtatattttcccagaaaaaatgtgaagatttcccttttggtgaagtcatttagagttcattgttggttggtataatctgcaaaattatattcaattatgcaattaatgtaaaatattacatcacataataacccaaggtcattttatacttacaataaaaaattgttttgacccttcctgtagattaacctcccaaatgatttattggtcattaatagctcaatttttagacccaggggtcagagctcagggcattgcaactgagggtagatccctgtacagactgaccagaggagccctgggtatgccggggagaaatacatgcacatttctcaatgtctcaggctatgttttccttcagtttcaccaacaccatcttaattcaggtttcaagaatctccaaacttacctacacactctagtttagccctttcaagtatcattccatcctgtaaactgattttaaatcttcccaaactactgtttatataaaaaaaacttagtctcaaaatctccccaaactactgtttactttaaaaattttaaattaaagaggggtgaacaaaactagcatttttaaattctctatataaggataattttattattctattgtctgctccaaagaataaagtacaaaactgatatccaaggacccggtcaacattcctgctttctcccaccctcccaggcaggcttttgaatgtactcacccacgagcacagctgcccatgaccacaactgatgtatttctgttctgctgatgttgctccttcgtcatgtttgaaatattctcacacctcctttctagttatccaaatcttaactctttaagtgccaatcatcttcctgaagcatctcctaagtactccagcccacctaatcaacacacaccggagcttttctagtccattcttcaactttttacagtttaggagacccaatttgcagagtttgtgacttgcctgaggtcacaaagcaagttagtagtgtcaccatgacttaaaattgaggtcttttaccacgaacactgttgcctgaattccctaaactatcatgataacagacattttactgataatattggttttgtattgttggttcattgttcctaagtatgaaacctggatatgcccaaattgttcctggattattctttcatttcagatccaaataaaataattggggcctccatctcaatatttctgagaatccccaagaaagagataaggtggtgggatgccttatatttttgtcacctcctgctccaaattccagtcacccatttacctcctcagtccaacctctacctgcttaactctgagcatggaaaagttctttttttcttcattcccacaaagctgctgcatttaacagactttgatgaatggtttatggtgatagaagggcattaaaatgcagcccacactggatcacagctcaaaattaaatattttaatttgagaaaaaaattaactctttagctctttgccttaattctctcccatgtgattttggagtggacagggccattcaacttttacaaccacaaagcaaggtcaggatatttatgtaaacaaaatacaatagttatctaccctgggcttatgcccttagtaactctaagaagcaatagaagttttgacattagtttttctttaacttggcccaggctgaaatcttaggcagatctccctatctcagtggaccaggacaatgtcaggagccaatgggtattcatttgctacattcttagttgggaaaatgaatccagcactattttccagaatgtagtaagattaggaagagagtaaaaacagaaaatgggcattttttgccatttgctgagctttttctccataccaggttctatactgttatacacgttaccccatttccctctcacaacaaccatgcaaggtaggcattctccacttttcaatggagcaaataaacaatttgccaaagtcatccagtaagaaagtggcacaatccagaattcaaacccagatctgcctgactttaaaagcctttctggacttggccagatgacaacggcaatggcccaggcacaggaaagagtgaggaccatatcacatcacatgatattccaaatttatcagagtgctgagagtcagaataaacagaaatgtcagtcaaaggtgttatttggggaaggtgatggagggtccacgatggactgaggttcagatagagatgacttttttcattcattcttctgtttaaagctaccggatttaacacaaactcaggaccgtctacagaatctgaattggatatccccaggtcacttagtttttataacccaacaagggcaacatattcaatagactatcaccaagagcctttctgagcagcttgtatttattcatcttgcctgtgactgggcaaagggggcaggtgtctggcttttgttactgcatagaaatacaactttggtttcgttgatgtgaacagataagcactgcatgtgaactgaaatcacactatgtctaaacagaggactctgtggcacttttcttactaaaaagttgttaagtttggcaatcctcactctgttccagtcaaacattttcttaaccatattaggttatatggaaataagccaatatcgcggctggtgtatgagtaggtcctctgcaccaaggcagttttcttgagagcattttctcactggtttaaaagcaatagagacaaatgtggctcagagtatatttttaaatgtggctggaaagaaaaataaaaattcactgatccaaaaagaattcggaatcgcagctagaccaaagtcagatttttaagctggaagacttggagagatttgggtatttgcttgcttcttattgaaagactcaatcaattttttaaaagcccagccaaccttaacacagatataggagaggaaatcagaacaaaactgcatcatctgttccataattgtccaatgttgttctcgttgcttaatctcgtgggttagaaacccagcatttgagctctggattcactacattctgagtaatcctagacactgggcttaatttcattgtttgtcaaatgggggatgatatactacctatatcataggattcttaggaaaatccaatgagataatgcatgattcaactattaccaaaaaagcatattataagccttctgtttttcaaactacaacacttggagaaaagtagcagcagagaaaatagcttttaggtctgcccctggttgctctgatacagttatctgcttttcatttagatttatcatattctgctttgacagctaataattattcatctatatattcattcttttattcagaatattgagcacttagcaagtgccaagctcttaattaggagctcttattctcatctttgcaaatagatgataaatctataaagctccccccccatcttatcattagatactcttttgaaatatttttatttcaagatacatgttggccattcattcattccatgtatatttattgagtgactactaaatggcaggcaactgcaaagtgctgaggaatcattagtaaacacaataaatacatcctcatggagatttcagtctagtagaaaagacagatattaaatacataagtaaccaaacataaatatcattgcaaattgtgattgtacatgaagacaaagagcagagacttacaacagagaatgacgtggaagtaacatcttaaaactctatgtctaatgcaacaaattttaatttacaataccttggcaataaatggataggatacgtgaaaacgttatcatctgattgtactgtaacacaaaaattggtgttttcagggtgttgcaattatttagtactattccaactttgactttgtgggtttaagaaaggttaagaattatccaagtaagaagtatgcctttgtcattaggtaatggtgagggactcatttctggtctctgtggccagtaagctctagatccatgcaagaaattgaaagcaagcttgtgtgactggatcacaaaagagagaggcacaagaggaagctggagaggcaggctgagctagattatacacgacattgtaggccatgggaagagttggatctgtattctagatgcactatgaagctactgaaatgttttaagcatgggagtgacatgattagatttatgtttttaaaagggtaattgtttgcagatggctggaagatagaacagaaagaccagttgggaggaagagtccagatgagatgatggtggcttggatttgagtgacagcaacaataatgaagataaatgaaccattttaggcaaatatcctgaagggagaatcacctggatttagtaatttactgtagagggagtaacggtagatgaggaaggaggaagtgtatgaaatgattcccaagtccggagcttaagcaaccaggtaaatattggtgtcatttgctaagatgggaaaaacttgggaaacaaggactgtgttcaattctgtcctgtttgctgaggaaaaaaaaaaggggccagggagtagtggtggaactttttgtgagttatagagaggaaacaaaagtataaagcttaacacccatcttcagaatgcttgcaccctaagcattaaatccactgttgatatttccttaacaggctttctcaaaccaccagaggctctactatgatgtgtgttatctcactcgtagaatttattctttcttcacccttcctctgtgtgtgtccaaatataatgcagttgattttaataatttaatttgctacacctttgaattatctcatttatcaaggcatcagtcaatcttaaaaattagatctttattttttttttaatttttaagctcagggctacatgtgcaggatgtgcaggtttgttacacaggtaaatgtgtgtcacgggggtttgttatacagattatttcatcacccaggtattaagcctagtacccattagttatttttcctaatcctctctcccctcccaccctcaaccctccaataggccccagtgtgtgttgttcccctctatgtgtccatgtgttctcatcatttaactcccacttataagtgagaacaagcagtatttagttttctgttcctgcgttagtttgctaaggataatggccaccaactccatccatgtccctgagaaggatatgatctcaaaccagatttttaaaggcaatatattttttttggtgcttctataatcttggcagtgaataatgacaatagaagtctttaccattttgtcttcctgttatttactgtaactcaactacaaatattccaacttctccagtggtgtatgtggaaacaagaagagttcacagaaagaaaattatgatcagtttgattcccctgagagccgctgatagagtactaagctctacattacttagcaatgcaaaaacaaagtggtagagatttagtgatcaagatttatgtacaagaatgtccatcacagcactacttataatagcccaaacctgaaatactctcagtgtccagtgataagggaatgattacatataactgtaaagttatcatgttttaaaaattgtgtaaaaaatatgtataatataataagtgaaaaaattgagtgcataacatcacatttgtttttaaaatagaatcttacctttgttgaaaaaaaagactggaaggaaatatattgaaactttaaagtaatctcagggtgggaaggatgaaaagagactttagaattattttctgcataatttctttctttttttttgagacggagtcttcctctgttgcccgggttggagtgcagtggcgcgatctcggctcactgcaacctccgcctcctaggttcaagaaattctctgcctcagcctcccgagtagctgggattacaggtgcccaccacaacgcctggctaatttttttgtatttttagtagagatggggtttcaccatcttggccaggctggtcttgaactcctgacctcgtgatctgcccacctcggcctcccaaagtgttgggattacaggcatgagccaccgcacccggtctctgcataatttctgtattttctataataaaatgcatatttgtatactttctataataaaatgtatatctatatagcactcagagatggcataacttctagagatttgatgatttttgttagtggaagagatccgagttatctgcgagttaccggcggcgaatctgtaggggtccacagcaacttcagtccttgcctcctcagaagaaagaattcaactgaggggcgtgtaaagcagaaaaagagatagaggcaagtttcagagcaagagtggaagtttattttaaaaggctttagaacaggaaagaaaggcgcgcttggaagacatccaagcaggcacgtgagtgttaaagagagaaggtcgagtgtcccgtataaccgtgatcctaggacttttataagcccgtcttttccccatgcgtcttccgtagggtgggcatgcgcacagcccttcttacgcttgagaaatgcgcacgcgcagtgtatttagggagttatacacatgcccatctgaggctttcttccttcttccagcagagagtacccaggagatcttacttcgtcatttttgtctcttaatatgcatttccagaaagctgtttctctctggggtctgcactcagttaacacttttaaatgttaacaggtatggaccatcaggagattgtctctttctggctgctgtgaattatcatttttagagaggcaaagggataattgccaaaccatcacctgacatttctagtgggtggtgggagagccctctcctgctccctgctcatgactgactacctgtaacaatttgggacctttttcagtagagtgaaatagaaataaaagcagtctggaaaaccagcaatgaataattgtcaagtgctgcctgagatactgtggggtataaagttgtgtgaaaatgtgattgcttattcatggatcttatgatcaagttcccacactcctggatttcccttgtttgggttcaaacagcctaagaacataataagggcagttttgattttcatatctgagtttttcttttaagccacatcgggaaatgaaggaacacagacagacagcgggagaaatacactcgcaaaacaacctaagtatctgtgcagcctcaatatcatttaaattctggctaagtttaaggtttttcctttttttggtttcttccttcactcttcaagtgtattccacataatgtagttgtagctctgctcaaggttctggagtagcatttctatgcaagcttagttattttaagttattcacagttatttgttttttaaccctttaaaagtaatttgtcacaatcacatctttatgtgccagatatataagaattattgtcttgtctctggacagtatgttttagaacttttccttatgaagctgcaagacgtgttttacacttatcagctctatttagcctataactgtgtctgcataatgccagaattgccatttcaacagagaccaagaattccccaacagttatttggtggcaactgccaaaaatttttattgaattaatttatctttttcacttaattcaatccacttagctatgaatgttgaacccagtgaaacttctggttttggggggatttttttggcatatgaatggaagcattgctgtgtttaaaaatactatcctttggagataaacattatgggatgttcaatatgaaatatcttattaatgtggaaatgggtttcattaacccatctgtatctgcacgttatccttcatctggttaaaattccacattttaaaaaagatagcagcttgggtttaagtttgtggccacgtaagactgaagtttgatactgtccacgttaccatcaaccagctaatgtattaccaataaaaacagcagtactattcttcagtgagattctcattgtccaccttgtgtcagttttcagtgtagccctgggaagaagggcactggagaatgatgtttccatcaagatttagaagtggaaaaaattgagcttctggagacctcacttatttattcacttaacacacatttattgagaaactgctatgtgatcagagctatgctagacactggggatacagaagtgaatatgacataaataatttaatatttatttgcccactagagtgttagccctctgagagcagtgaccttgtctttctccatctctgctgtctccttagcaactcccatttaataactggaaatagaatcccaagcggggcctaactttttgtctcatgagataggaatagtagaagagcaaatctcaaacttttcccccatatgaggaatgacattcacagaaaagacccacttagaggaagacaaataggcctttttcttccacggaagaaagatgcctagaatccagttgaatgaatatcaagtttatatggatagctttgaatccttcctaatattttaaaaagtaaatcacatgaaacctcacatttctgatgatacgtcagagtagcaacaatactgtgatcagaactccacatagaaagctgctgtggtgggccaccatacctgatggaagatctattttgatgttcaaatgctttgagattaggacggttgcttgaagtatttatcgcttgttacactttctctgctgtgtgattactgcaaagacaggccagattgcaagggccacaaaggatcagttcttgagataattatatgaaaactgtttagcccatgatggcagttagaaatcgagcagtggattcttccaatatccaaaaacagatgtagtgattgatttgtcctaaaataaaaaataaccagctcctgctaaatggacttagttgttaactaatcaaacacaggcagaatggtgttctacaaaaagaacagatttggagacccagctcctcccatcactagctgagaagccttgggtaaaccatttaacctctctaggcctttctaggtcttatttataaaatgttgccaataatacttgtcttactgacctccagggtttctatgaaaatcatttaagaatagagatatgcaagccctgtttactgtaaaagggccatgtatttgtattcttaacccatttgtgatgtcactaggcacttggaaatcagcccacaaatggctgatctgattgatgatagaagcataattgccctgtgaccaacccacttcatccctaccaaacattccagacatttcagtgcaggaacaaggtctatgggaaaaagtcaaaaggagactgatcagaggaattccactggcccttcccagggccctgtgcacaaaatggtcccctgtgcattgttattttgctgtgtttgccgatgtccacagcttcctagacattaacagatggatatctgggtgatgatgaacagacagagtgagtgtgatattttaccagttttctagtgcaaaggcctctgtatctaatctatgggcttgcagccttcactagttactctttcagctgaatgtgcaaagagataaagtactgcctgcctttctttaaaatgctgaggaatgacatctagtgaattttttcaaggctacacatactgatggttttgcttttggttgcaagggtaggacaaggtgattctagatcctgacctgagccctgtgtcctgctgctgcccagattctctctgtcagtgtttcatgcttggcaccgactgagctcaaggctctggattaggtcttactgcacagctctgtggcagagaggagaggtgggcaatgccagttggttggaacgtgggaaagaggaacaggataattccacttagggtgttattttgctttgttttttgcttgctttaagcaactggccataaaggaaatatatggccctgtccttaggtagttaaatttcaatcagtagtcaaaactaacattagaaaaagttttaagcatactttaaacaaacaagaacatattataaataggaacatgaaatgaatttattacatcaataaagtgtgcctaaatttttcagagttgacttaattgcacaatagataatccgatcgtgatgacgtgtagcctgaactagaatttattgacttgagacactctttctttgtgaatatcgaaaatttctaagtacaacctttattgatgagattgtcaaaaattgagagtctaatagcattaaagaggttcaatttggccaaactggacattattaagtttatcctatatgctggaggctgtgctaaattctacagataaaagataaatgaggctaggcgaggtggctcacacctgtaatcccagaaatttgggaggccgagtcaggcggatcacctgagttaggagttcgagaccagcctggccaacatggtgaaaccccgtctctactaaaaatacaaacattagctaggtgtggcggtgggtgcctgtaatcccagctactcaggaagctgaagcaggagaatcacttgaacctgggaggcagaggttgcagtgagctgagatcgcgtcactgcactccggcctggtgacagagtgagacttcatctcaaaaaaaaaaaaaaaaaaaaaaagataaatgatatgactcttacccttgctcagatgtccatcctgtttcctcagctttgcctcctcaaccatgagggttctaatcttcatagttgcttctgtttgataagttctatttatttaggaagccatacacaggaacacaggcagaagagaaccagaagactgcatccattggaaaatttaatatacataaaaattaagtgcaccatttcttatcacttgctgaaacttaggtaacttaacatcatgccttacaaacaacagtcagtgctcgttgataatgatgacagtggtagtggcagtggtgatgattacgatgatgaaggcaagagaaacaactgccactaccttttcacaaactttggactttttattatctacactaggtctttcgtgatgagtggtagttatacccagctcaaacttcaggtacactatgactctgtgaagagaaagatacatttttctcagtgtctctcatgcctgtagccacgggaaacttatcaaacactgacgtcagctactttcccatgagaagttcagaaatttcataagaccgcaaacgactttctctttcctatttgcttcagacaagtacagaacttttcatgaagcttaaaaataaacatctgaccttcatggatacattctcattgcttctccaatcagaaatcatcttgcctgtgaaaatccaccctcattcttctattaacaattgaaacatcttggatgatgcaaatagcatcgcagattactcttcattcaatgattgtccaagagaaaggagaaaaggctgcaatgattaggcaccattttaagataccaaagcccatcttttgtactatcatagaacaggataagatctgtttttttttttcataattttaccatatgggcttctctgagaacatacatgtaagctatatcctttgcactccataaaattttaagaactcagcaaaatttccctgggtagcttgctagtcttgggacctgatggcttagaaataaactaagaattgagccattctactttctagatgcagaataacaaagaaggcagagaaagaagctgataatattaaacgagggtcaatggcatgctaagttcaatactaggtactttatatgttatctcaatcatcactcaacaacagacttttttctttcgttctcctttttttttttttcctgagatggaatcttgcactgtcgcccaagctggagtgcaatggcatgatctcggctcactgcaacctccatctcctgggttcatgcgattctcctgcctcagcctcctgagtagctggcatcacaggcgcacaccaccacactggctaatttttttaatttttatttttagtagagatgaggtttcactgtgctggccagactggtctcaaattcccgaccttgtgatctgcctgcctcggcctcccaaagtgctgggattacaggcgtgagccaatgcacccggccaacaacagacttttatgaagcatatgatatatgccagagaacatgctaaatgcttggtatggagtgattgataagaccatgcccttaccattgggaagcccatactcatgcaatgctaccatagaggcattaaccaagtacaatggaagaagaaaaaaacccttcagcgtagtaattactatcctcattttaaaattgaagtagctgatacctgttagttatctttgttaaagagcttctcttaggttattaagtgtagagttctatgtgacccatagtcagtcttacaattccatgctgttttaatgggaaagatctatgttcaatccaactgaatgatttaaagctttgtctgctatccaataaatctgtttgctacagaatgccacaaaaattctgactttcactgaataattgactttttctttaattataagaaaaatttccttaatttcccactttagcctgtttggtagctaaattcctaacatattatcatattaatacatcttgtccctcttatctactcatttatacaaatatctgtatacatttccatatgcataataattccttaataacacagaaaacatatcccataaaaatcaagagattctcatacagacataaacctatacactaaactacaagcatactatagatgaatttgttcaagatacatagggaaaatctgaaatggaaacatacaattttaaaaaataaagaggaaacattgttcaaggacttgatgcacaaaagagctacaagaaataatttggggaaggtgggtggttaaaagtgaggacaagaaacagtggatactaagcaaagggctggatggatggtgaaattgcatggcattcttaagatgataagtagtccctgtatttggattgccttggtatggaccacttgcaaaaacattcaatatttcacttctaagatatggtaagccaaaatacatatatggaaagttcactaagtcattggcaaataatccagtgttgacttttaatttagaaataactggccaaattgatcccagccttcccaactacaattctccccctgcagagtacattgatttgtattatcttattgttttctctcactgtttgtctttctttttattattttattttcctactggtacaatgtatgacaagagatagtgaactttcctgattttatatattttgagctcataaattccctggagttgtcatctttccagactaaagtttcatctttttctattcacatgttctaaaaataatctttttaatgatgtgtaacatatagagaagtgcacaatttataattgtacagagtgatggactttcacagaatgaacgcaactgagtagtcagcatccagatcacaaaacagaatactacttgcattcagaagcaccctaaatgtcccttcagagtcatgccttcccccacccagccactgcctcatgataaccattattctgatttctaacatgaagtattaattttgtctgggcttcggtttttatattaatgaaatcatatagtaatttttgttgtgttgtttacattatgattctgagattgattgcctgagcaaaacttagatcattctaattgctatatagggtttcattgtttgcctcccacaatttatccattttgctgttgatagacattgaggttatttccttttcatggctattattaatagtactgctatgaacattcaagttcatgtcttctggtgaatatatgcatggacttttgttgtatatatgcctgtaagtaagatttctgggtcacagggtatacaaatattcagctttagcacatgctgccaaatctttttcccaagtgattttgccaatttatattcccatagcagtgcatgagcatttcagttgctcaccaccattttgatttatgtcttttaaattttagctattctagtggtatgtagttttagttcatcataagtttcaatttgaatttttctaatgattaatgagattgagcactttttcatacacttgttgatctttttgtctttttgtttttgttttgagacaaggtctctctctgtccccaggctggagtgcagtgtcacgatcatggcttactgtggccttgacttccctggctcaagagatcctcccaccttagccccccatgtagctgagactacaggcatgcaccaccacacctggctgatttattttttagttgttggcaattttaaatatcctcttttgtgaaatgcctgttgaaatcattactcatttctctattagatcatccatctttttctttttgatgtgtggaaatttttatatattctggatacaagttctttgtcatccatattgctaatattttctcaatctatggctagcatctccactctttttatggtttttagttttaatgcaacacaagtttttttatttttatgtcccatttacaaaatctttgcctatcccaaaatcatggagattttctttttcctgaaagcgcaaatgtgtaagttttcacatttagatccacaatcaatctgaaagaatttgggggaatgatgctaaatagaggtcaagttttgattttcctttttccatatagatattcatttaggtgcgggatgatgttacttttctacagacaggggttgtcttaccttctggttgttttgatagagttgggaaagttctcttcagttaaatggggctgagctgatctacaactcatcttccattttgcaagactccttcaacctctggtttgctccttctccgtggctgaactctccaagtgtcctaatgcctccaaattaattttggttttgtggaatattatccagagtttctagttattctcaatgaaagcactggactgccacaagctattccatttaggcagatacctacgtcagtctagctacattccacaaactcatcaacaatctcctccaaaacatttaaagaaaaatgttgtgtagaactcaaaaaggtaaaagaaaatgtcagtgttggcagctatggctgctccatgtatcctgtcatggaaggagctttggaataaaacaaacctgggttttaattctaacttgtcatttattaactgtgtgacaatgaatcttacttccaagtggggataataaaaaacaactagtttcacagttttcttgtgaagattaaatgaaagaacagatatcaaatacctcgcaaatagtaggtattcaataaataatagatattattatgtaatatattataatttctcttagagttataaaatgcactcatctcttagaaataatagagaaggagtcgggataggtggacttgaaaagcaacactcttctctgagcaccctgttagatgctgaaaagggggaacttggttgaacttgttttattcaaaatgatatcaaggtcattcacatacacaatacatttttttcgtggaaagatggtagaaataaatcatctgaattgagtactgtggcaaatctattccaaatgcttcattttatagatgaagaaattgagtggttaaatgactcgtacaaggtcaattcacttgttagtatttatttaaatgacccaaattccctaagatcatatatttcttttcttctaacatactcctagctcccatgtttaactataaatgtaaagcagagacaattaataatgtgttattattactagctcattctaactaaaacccatcgatctatttttaaatattttattttaatttccatccccacaaattatgtgacttcctgccaactatgattgaaataggtacttgccattcctttcccattttaaggattatgtcctgtagcttttcatttttctgtctgttattaagaaatgatctgccttatcctctaatgtatgaaaggagctcgtgcaagcctgtagaacacagctctcttgaagtctacctagcaaaaaagggagtggggaacctccatccctctgggcactggatacaaaggtgatcatgtgcttctttggcactttcatctctgggcagggacagatcctcatgctttccagcaaaggcagccctgtggggatcgttttttggtaagaccctgtgtccagcacatctttcagcattgtgtactctacgaacagacatatgagcctgaatcccacatggactgagtaacttggaagtttcatgatcccagagcacacagccatctcataaaagcctcacaccaggcttctcaagggctctgcctggaacatgcttccttcagatctttacatgggggggcttcttcctagaaatgtgtttttagcctagatgtctccttttcagagagactatccctcaccatccaacctccagggaccctcagtggacctctttacatcctgctgttttttatttgctcactcactatcagaaatgtatggtgtctgaactccagcagagtataagctccatggaagcagagcccttgtacatcaccttgtgctgtgtcctgaagcagaggactcactcagtgaacaagcaagtgggctcctgtatccaccaaatacacccagcatggtgggtcaggccctggctttgaatactggcctcaccactagctgggtgaattcaggcaaatgacttcagccaagaaacttctcagtgcttatcctaagataagaatatgtattttacaaggttgttacagtcatcaaatgaaataatgtgtgcaatgtgcttagcacagggcctaccactgaaaaatacttaacaaacaatagttattattattatttccataatgaaagcaaatcatattatgaaaaagtcacagaggaattgttttataaaaatggtaatgttgaaatcagagaccctaattcaaccatgtaagataaaattttaaattaatgaaaatctgggtcttcttgttagttatttacaattatttatttttgtaaaggatccctaatttaacctttgcaatgattctctgttgaaataagttatcatctcaccctctgctcttagtatccatttggaaaatgccatctttctgagaatacttgcagtagaaattttaaattaggatattaaccatctcctgtaaatatatgctagcaatgtttttctatttgtttaatctagaaaggtgctagttacagtttttcatgctactgaatgactttagctagaggtttcctgggggttctaagaaaatcactattcttaggggactagaaatctgatcaagagggaagaaattacttctttctttttattacaccttggttctcctatagtaaatgttttcatataaaactcatttctccccatgcccgaggagatggttaaatcaaaggagcaataactagtgcctggctgtttgccactggctgcaatggggactcggggaggaagacaggctcatttgcctaacagggcccagctcccttcccgtcttccttcatcttgggccttttccttccttactacctccggtctagactcagctttccctgcagagacctttggcaactgcttctgagccagggcagccagcatctgtgtgtcgggcactgcattaaaagctatggcttaaagggctcaagggaggaatggttcacccgggcgtctatttgaagttgcgaggtaactgatgggagagaaagatcttaaacagggagtaagagctttagcaactctctggcccttagaccctaaatctgaaaatagaaaggaaagagattatctgaagacaaactccactgttagtgactctgccattcattttatgttttctcttgaaagcctttctgtctttgtctcactaacaaggtagttcatggacatacatagacactacagaccaaaaaagttttccacttataacattttcttccttcagtttccctttattcattctcaaattttgaaataaaattactgaggggattgggagcagtgaaaaagaaacttggcaattagatactatccctgggtttgtcttaactatacctccttctccagaataatttattcagaataaatggatggactttgcgataactgtattttccttaaaatgcaaatgcacaatagctatttctacccctgccttacttctccctttagattctaactaacaacagtacttgaggaagaaatgatatttgaaaatatatagtctgtattagctaaaattcattcaactgaattatgtttccatcctccttttattccaggtatcattggaacatttcaagatcatcaaatcaaattccacagggattggtgaccaaccagaaggctcagacatctgattgctgacctgtgagtaaagtttatgttttattaatactttgggctctgctcttaggaattacacagcctctgtgcctgatattctaaattcttacatctgaagatgcactgtgagaaaccagtttttctgctgtggccctcctactttacttgccagttaattaatcagttagaatctatcaagttttgaaggatctatcaagtcttttatcctgttttgtaatctgattttttttttttgctttatttttaaatgtttcctgcaatgtaatatctttcacaaaacagtcctggatcaatcatgaagtcttcacttcctgtgaaaaatgctagtgacttgaatcaataaagacaacatgagtcagccttccaaggtgaataagctcacctttgtgcaaacactggtgatctcaggagtgctaagtacccctcactttcaacaaatctctctcacctgggaggaaaacttctaccagaacaaggaccacctagggaggtgaaagaggggatttccactttagaggatggagaaaccaaagggcatttcactcattcacagttttgctgagcttggctccagtaggtagaaaagttcttcaggagttcagcacaccactcaggcaattgttgtttcaaaattctatctgttgcccccatgcaagttttctcaggctaccatagtgaaaatccacagactgggtggcttaaacaacagagatttcttttctcaccattctggagggtagaagtctgagatcaaagtgttggcatggtggatttctcgaggccctccttgcagatggccaccttctccctgtgtcttcacgtggtcctctctccgggcacacacctgtctggtgtctttctctctgtgcccaaatttcctcttcttgtaaaaacaccagtcatattggattaggcccaccctaaagacctcattttaacttaatcactctttgaagaactcatctccaaatgcggttacattctgagatcctgaaagttaggatttcaacgtatgaatttgggggaaataccattcagcccataatgctgccaccatcattttccctctctaatatgctgactttttgtttattgcacgtgggcttccctctgtttctcccctcctgaactcttttagcgattacattactctcagagcatctgcagttcttagagtgtattataatcatttgggtacagctctcatttccctatgacattctataaattctgaaatcagagagtgtgccttttacatctctcatagcactagaggaggttttgtatacagtagacattttgtaatatttattaaatgaatgaatgaatgaatggaaagaggattagatgcagcctctgaacctgcaatttatttgctttaagactgtctccaaatgatgagtattaaagatgctttctcctcacttcctgccccccaagacaggtagaaataagttaaggctgaggagaaaaattgaaagaaaggtgtgattgactaatagcaggagagttacctttctcccagaggtaggaaatagtaaatagcacaagcatgccccagttaaggtggcctttccacaagaaaactgttcggggatccaagagggacttactgagtttgaagcctgtgggacatgcaagggcatgtgtctagaaaacaatgcatatgcaggtctgaaggtcaggtgagaaccagagatgttcacagtcaccacctacaggcaggaagcagcagtgtgtcaatgaatgaggccaccaaggaagactgtgtagagggagaggagcagtggcttaaagattccatcagaaattgtgtatggaaatttttcctgctagataacaggagaaggacccgtccaagaggaagaacactgcacgatacttctaatgaagctgtgtgagaacatgtagatgagctaatgtgtgtgtctattttttctcccctagtgtttttggacctattttgttccttctctgtcctgtcttttgggggctatgccccaaaccattcctgtgagccttctcctacccacctttgctcccttctagctaactccacctatggtcattgtccaactcccctgctgcctgctcagggaatcttagacaaacttcctttgggcccattttcttcatcagccaatcagagctgatcagaatggacaggaggggaggccaggatgagaatccttaatgaccaaagagacagaggcaggtcgttttcagggtcaggtggctgtgacgctatggtcacagagcatcatcttgtttagtcagtaaaggccccagataggggtggagggctgtgcctcttttgccctgaactccctcctttgtccattgtcccctgctgattgtcccactccacctgttccccagaataagctttggcagtattttagggtttccctgccagaccagagagtggaggggccaggccatggcccctgacagtcattaccagcctcccctctctaggcctcaccatcaaatgtcatttctcacggagccatatttacccctgggctgaatttccctaatttgccctgctagcatgatgcaaataaaaggggtaaaggtatttattcatctctcttttattttccaaagtgttatttcttttcctttaagttctctccttgctttatgtttcttctctctcccttagttctccttccttagtagaaacccttgagcttcagggtgattttctgattatgagcagaagaggctatcagagatctggaagccacctcctgcatttctttattccccctcctcacccaattgttttaaatgtacattgagataccagctttcttcaagaacccacttccacactttcctctttgtgttcttggagtagccaggaaaaagatgcccattttctcgaaggtacccaaaatgtcagtgacacttgggtcagtgattttatgcaaattactaattatatcaaatgagaaatgttgaaagcaagaggaaaccctttgcaatccatgaatggtctagttggggtgttccaatgaatgatggccagtggccaacataggtgcctcccgactgtgtttcattaatttcagtcagctcgtgggcttggagagaaagatcattttcctatgagcacgtaaaagaagtgctttgagttgtaagcacttcgaaggctttgcccttgttttcgaatgggagattttataaccactgtgggccagtatttttgaagtcagtcgaagctccagatggagtggaaagagaagcttgggtttttattttcttcttcttttcttgagttttgcagaatgagcctccctggaaaccttgacaaagtccttagtctcctttggttcaggtgggcccaagctttttatagtaggatctgaagggatctttcttaaactaagattccttcctgtgggtttttagtagtggctgtagaactaggcttatatgggagaaggtctggaatccactcccttccctgggagtctcctctcaaggagaccactctcagggtccttgtcatgagatatgagaagaaaagtccacaatgagcctgggcatagtccagatttggttaaggattgaggggacacgaggtcacaggtcccatgggactcccagcgttctggaaacctccatagtaaagagggtagaggacattccaacaccaccacgtgcagctttagtaaccttgcccaaataaacgtgtttccccggccagggaattgcacctggtcttaagaggcacctccatgaaaacacacctttctgcctggcatgaccattgacagagaaagactgtgctgagaagggggatacagcagggagaaaaacacacaacggtgccaggagctcttgtctagaactcctttccaggctttttttccccataagcgcaagtgagtacacaagtaaagagaaaagaatgattgtgctatttagctttgaaccaaaaactatcaagcctttcctaaggttccaactggaatagcatttgtacagttacaggacacagactcaattgcttctgaactctgctttaggatgcctaacaggattaagttgtgaacatctcataccacgccgtgcaacagtactcaaataggacttaagcagaacaaacagtctggggaaaaaaaaaaagccctaagacattttccttcctactattctctgtatcccaggctcaacttaatgccaaattaaatctggatttttttttaatagacgtttcctagaggaaaaggcagagctgcattccctgaaacatattttagcccaaacttataacttggattttttctttcctcctccctttcgctaattcaaaacaaaatgtccatcacgcactctaacaccagcctctaagagctagagacaaatgaagtctgaatattcacgccaatgtggtacaaatgagctgtgatttcaggatgctggctgttttactgacaggggaaaagggcagttgactagtttaatatatttggctgaaaacactttgctaaagagcagtgaagaaggccaatgttaataatgaatcctgttctttaatgaccaaatatgatatatcatggaatggggcatcctgagtttgggggaaagcatttcaccatatccacaggatgcagacgagaatgaatgcaaacatactgcattcatgttgggccctaatgaagaagctcttctaggagtattttctccaagttcctcaaagaattcctcccataagtatatgataccatgattttgaatctgatttcacacagaattacaaaattataaatataaagacatttgttattatgagagactccgggaatctagctaactgtctcccattattggctaatggtttataaattttaaaatgcaattataagttggggttgatgagggaagcctgtgaccaccattagcaccttccttaaatatgcatattcagtcagtcgttaattcattcattctacagatatcactggattggaccttctccatctcacgtgccatattagttctgtgttacatttgcaattctagtattccttaccataaaatgggcttttttttaattaaatgcaatggaaaattttgtgaatccaatgacgtgttcagtgacgtaaattgtgatttctaatactgtatttatttttcattggcttcgtcttggcaaagggtcataatattttaaatttctctgccctctcatccacctatcacactttattatgcggtttataggcaaaacacaggcatgcactggctatatctgtaaatctacttttctgcaaatcacttgaagggtaatgcataattgccccctacattattgtttcctagattctaacttttgtatagaatgttgttaaaagcagattataatgtagttccaagtatgctgcttcctctgtatccataggggattggtttcaggactcccgaggataccaaaatatactgatgctcagttccctgatatacaatggcacagtatttgcacataatctatgcatatcctatcgtatactttaaatcatctctacctctaacacctaataaaatgtaaatgctatgtaaatcactgttatactgtatttcctattatattttttattgttgtatggtttttttaattgcgttggttttttttaaaaatatatttttctatccctggttgattgaatctatggatgcagaacccatggatatggagagctgatagtaattgaatttaaaagcaaaataagggtgctgtgatatttttatgaaatgctcatgagaatcaaagatgagagaccagaagccaatttaccgtgaagtcagtagagtttaagccgcagggcctctcatggggagaggtccctgcctcaacacccccatgcctaactttttacatttactattgtattctggttttccaagaaggcctctcaaataatcttcaggtcccacaaaacctggatctgccctgaaactgacacagatatactgagatgatttagcatcgtgtctaaagctaattaagtaagcaaagcaaagaaatggtcaaagtgtgaaatgtgatcatttatttttttaaggctttaagacaaattcagcttattttctaaagtgaaccccacttaagtgaaataataaatcagtttgccaaggcacaagtgaacataaacagaagattcatttttacttcattaataaacatcaaatatgaacggaacctaacatcaagcaggccaaggcctcctgctgacaggaaacagctcctagtaagagcatttgtagaagaacataaatccttccaggcaatcacgtgatcatttcatcattgaggtccttgctacagtctactatgtattatccatttacaggtcttgtgagatgtaacagagtgttgtgattaaaagcacacaatctggggctgagttgcctggatgtagaccccagctctaccacttactagctatgtgaccttgggccaatgactcaccttctctgggcctctgtcttttcatctgtaaaatggaaataataaggattgtcacaaggatttaaactgatattatcacagttcttagaactgtgcttggtacatagtaagtgctacataactgttgtcgaaagaaatcaacttatccatctagaatgaaagctatatgggattgcttgtgggttcactcttgcaactcctcacagtgcctaacatggcacatggtcagccatcagtgaaagacagcaacccagggcccatgctgccctgcaaatgtgcttcccttgtccacccttgatgtggtttggctttgtgtacccactcaaatctcaccttgagttgtaatattcctcatgtgtcatgggagggaccaggtgggaagtaattgaatcttgggagtgggtttttccctgtgttgttctcatgatagtgaataagtctcacaagatctgatggttttataaaggggatttcccccacacatgctctctctagcctgctgccatgtaagacgtccctttgctcctcattcaccttccaccatgattgtgaggcctccccagccacgtggaactgtgattcaattaaacatctttcctttataaattacccagtctcaggtatgtctttactagcagtgtgagaatagactaatacaagcatttttttcaaattttgagtctgaatgctcatagggatgcagggatgcatatgttctccattttcccataagctaccactccccaaatagttacctctttggtcctttaagctatttgagtttgtcatgcctgatataaatgaatgatcccataatacacgaacactgcaacagttagtggcagttttatggctcactggagtaaagagatgggcccataaggaagtgaaatatgagtcacttccactccctgatgctctacctgcaaacagtgttccggttaacctacctatccctgtttctaaactagaggtctcagaagggaaataggaaatcaggaatctgagcaagcacttgcttagaaacagagacgagtacaacctaatgtcagagctggccaagactctatcagtcatgacaagctaggttatgctggtgtcagaaacagccaaaatctcagcaacgtcaaaatgaacgtgtgtttatcactcatgctttgtcactaaccctggataggcaagggtttctagtccacatcactgtcatccatgcttagccacccctactgacaatgactgtctggaaatcttaccaaccatgatggagagaaaagagctctttggagggtctcctattggcaagtctaccccagaagtgacatgatacttctgctcaaaactcattggccagaattagccacttggccccagatgaccacaaggggcaagcacaatactataatgtgcccagaagaagtaaaacaagaatatggggcaaacagcacaaaggatcacagctgtgacattatttggaacttggagtctcaggccagaattcttaagcttttcaatgagttcaactcagcaaatatttccattcataaataactgcacagcaaagtactcagcactgtgaggggatgtcagaggagatgtaggccttgacactgagcagcttcagacttggtcaagagaaagtgatggtacaaaacatttgaacagcaaggccatatagtattgatcaccaagaacaaggccaataattgctgtagaagctgaaagggagggtggttctgggataaagataggacttgagctggactctagaaaaatataggggatttgcaggagtggagggcacttcaggttatgggcagcaagaagccagagacaaaggcccagaggcagaaatgagggtgaaattattgcaggattcaggagtttggcttggctgtaagttgtgtttgcatgggagggtagggtggggagaggaatcatgtgatggatagagtggagccatttcacagtgagtttctgggttctgcagagaaacaagatggtggtatgtgggaggaagatcatttttcctgaataactccattcaaaaccaaggaatttgcacctcccaatcaccagcctttcccagcacatttattccccaaaacaagagtcctgaatacccaacagcttcccagaccttctaggcagtcattgaatggagacagtagtaaaccctgggctgctcctgcctccagtttaaagcatctttgatcacttctgctgacaaagaatatccaagttcaagtgaaatagcctcttattgctggggtcagtgtagcctttttgctatgtaacatctgtttttaagattcggctgagagctgagaccttgacttaaatctgtttaacttaaaaagcagcaagagaacatcttgttttcatgaatgtccaggggctgtgtgtcaacaaataaaaggtctgcttgtggtactcaaagtggaaaagctggttgtgagatgttctgccactgggataaatttattatggactgtttgtctcttggaatcatgcaccagcatttgaaaataaatcagcatatttctgcttgatggcgtgttagaaccatgcttttattgtcggaagttcacagagctggatgggtctagaaagatgccctctttcatgcctcccaccttagctgcatgaagttaatgtcttaacgtggattccccgggtctgcatgaattctggcaacagtttctgatggatcattatttttatgtgacttatgtaggacctgaagtgggaaagaagtgggtgagactagttcaccatccctcaaatctgactagttgcttttctcctcacccacctatttaggagagagaagtggaaaggaattttatttatctgcacctaggggagcaaatgtctggcatgtactcgatgtcaatttaatttgttgaatgaatacaaactccagtcttataaatttatgttccccgtatgaattcatgtctctatatatattaatgtcattccttttggaaaaggtgattaccacccagatcttattctaacacataggaaaccattagatcgttcctgtagttctctctcatagtagcttctttttttcttctttttaggtttcttcctaacattaacctaatttgtattttatttgttgattgcccatctccaccatcagactacaagcaacttgaaggcagaatagctgcattcacatcttatatgctacactaagcaaggtagctagtacatgaatatttcataaacatttattgaattttttatttatttatttttattatactttaagttctggggtacatgtgcagaacgtgcagcttgttacataggtatacacatgccatggtggtttgctgcacccatcaacccatcacctacattaggtatttctcctaatgccatccctcccgtagccccccacccccaccccgacaggtcccagtgtgtgatgttcccctccctgtgcccatgtgttctcattgttcaacttccaattatgagtgagaacatgcggtgtttggttttctgttcttgtgttagtttgctgagaatgatggtttccagcttcatcaatgtccctgcagaggacatgaactcatcctttttatggttgcatagtattccatggtttatatgtgctacattttttttaatccagtctatcattgatggacatttgggttggttccaagtctttgctattgtgaatagtgctgcaataaacatacgtgtgcatgtgtctttatagtagaatgatttataatcctttgggtatatacccagtaatgggattgctgggtcaaatggtatttctagttctagatccttgaggaattgccacactgtcttccacaatggttgaactaacttacactcccaccaacagtgtaaaagcattcctgtttctccacatcctcaccagcatctgttgtttcctgactttttaatgatctgcattgaatatttttattaaagttctcattgggatgatggttgtagagtctcagccactcttgattgtatctgaatttaaatataatgcagaagacgacaggacttataatgcagctgaatatgtaggggccttttgtttaatgacacactcacattcatttggccatacacgctactgaaggtcacggcgggatgggctaaactaaccatctctattttctcaatttaaggtggtcagctacatctgtcatatagctggcccggattaatgtcatagcacagggccatagcttaggatttttttcccctcaaatgagtaactcattcctggtgggataaatctgtgactttagccttattagcaagaaattctggcccacgaagctatctggtaaaggcagtgtgatatggtttggatttgtgtccctgccaaatctcatgtcgaattgtgatccccattgttggaggaggggcctggtgggaggtgattggatcatggggaaggatttcccccttgctgttctcgtgatactgagtgagttctcacaagttatggctgtttaaaagtgtgcagcacctcccccactctttcttcctcctactcccgccatgtcaggcatgcctgcttcctgtttgccttccactatgattgaaagtctcctgaggcctccccagccatgttactcatacagcctgcagaatcatgatccaattaaagtcttttctttataaattacacagtctcagatggttctttatagcagtgcaagagcagactaatgcacagtgcaaggatctagggtcagaaaggtgttttggtgctcaacagacctatggcttaatgtccacgttcacttgtccagtggtcaatgcagatctttctggtgatcaagcacaatatgaatactctcacttgaggggtacgaaggtggattcatttgctccatttttctttggcttcctgtgtagatggaattgaaatgggaatgatatgtgcattccaaaggatctcaagagaaatgctcattcgtttacaagaggtgcaatcccacaatagtttcttgctttgtatacttgaaaacattcccaaagaaacaaagttggatgcagaaaagatattgggagaaaagaaaaataatactccaaattctgaacaattctactttaacatgttgatctgtctgccagctggccacagggttgactacttgtaatatatacttttggtaggccacatgtagttcttggaactgtttatattcggctgcagaaacttaattattctaaaattggcagagtgatctttggttacttaatacaaaattgcttagtcatctttaaacatagtgtggacagcttttgtttaagtgtgaaaaattaggaattgcaaatgtactccaaagagattttaggtcagggagaaaaacaagaaagtatcattctttcaagatatttagcccggtggttgccacatgttttaatttgacaagctaggtaactgtcgagttgaagtccttgattacaagtatttttccattttctttgtagatattgtcagaagtagaaagctgttgctgctgcttcttagatggtattctaatcctacactctgcaaagtataggtttttcagcaagagtgtgaggaactctaacatcagctgctggaacagctttcttgttctacgaagcgaacaaggatgccatttcaagctggttgtcacaaagatcctccttttgcctcttttggtttgaatcctcgaactgttgccttccacgtatagtacagagctatagtgctttagcgaggaaacaggcaggcagagtgagcttctgcattttttaaagtctaaagtggcaccggaagtttctagtttttccaggaatgcccatggcaacctcacacttttcctgtgatctgggctggggctcctaagagagatggtgagaaaagataaaagtcctgtagccaatgggtagccacgcgaggcctgggaagggtaggttcccaagcaaacctccagaacggtgccttatgtttctaattactgagcatggttagagagcaaaatcaggcaacagtttttttagactgatggaaacatttaattggctctgaatgtcagtgttttctaattatgatagaggggtagcaagaagtttccaaaggctgcggaaatttgaagtgtatcagctgaattctgattctcttcttttcttattcatcctgtcttctttttctttcaacatccaagaacaaacctattccctcagttaaatgcctaatactcctcttcctgaaatcgaaatgtctctctaagaccaagttcttttccactagagaaaaacaaccacaactacaaatcagaatataaaatagagttccatagtaaaccaccaccattcccaaggttactaagagctcagccagagaaacagccttttgataacgtcttagccaagttcatttgtttaacaactaagttcaacaaataaacactgccctggcatctgttccaactcaacaagtgtgagcctaatgcggagtataagaaaaacagtcagttaagaactttgagggatcacgaaagacagtaatcatttctaagagataacaaccttttacagaagacaaatatgtacttggtaattaaaatacaagctatagactaagtgctccaatagaaatacaacatgggtatcagtacaaactcaggctattgagtcagttgttcaaagatcctatggttttgcgctattctttttttttttttttttttttttttttggagacagagtctcgctctgtcacccaggctggagtgcagtggcgcgatctcggctcactgcaagctccgcctcccgggttcacgccattctcctgcctcagcctctccgagtagctgggactacagatgcccgccaccacgcccggctaattttttgtatttttagtagagacggggtttcaccgtggtcttgatctcccggcctcgtgatccgcccgcctcggcctcccaaagtgctgggattacaagcgtgagccaccgcgcccggccagttttgtgctattcttaagcaggccccaactgtgagccattccctacctgaggaaaagtccaggtatccccaaactaataaatgagtgaaactgctatctaaatgactcattactatctaaattactatctaaatataaagaaagaggaagcaatctaagtacttttcaacttattatttatctgtaaatatatatgcttaaattatatgtctgttacatccaagggacatagcagataacatcctttagttgggtttcaaacctttccaccttggattataaacttctagaaggtagtttttaacctgctttgcagttccagaatacagtaaacacacttgatgatcatgatgaatagaagtcaaataattcactagagaataattagtccctgatcagtaacagcttgtccttcacatacaaaaatactgctattaacaaagcacctctagaacacacctttgaattgttttcagcactataaatggatttgcatcctgccatctaagctatcctactttatattagcaagatagctggccaaggctctgtatcactaaactggaagtgttagttgaacaaaccagtcacaaaaagcaggcacatgagttgctgacttttttttttttttagctgagtagttcagcaagtccagaaggccatgcacaagttaaactacttttatgtaaaatatggtgatctctgcagcatgtttacaactgggaaaggcccatggcttctgaactttcattccatgtgaaccactcttgggccttgttacttaacttgaagtgtgatctttcttcagccagtgtctcagcttcttttgtatttgccaagcatttcactttctcagttgcaagtgcccagtcacagctagattgcccccatccaaaaagcctccataggaaaatggagagagtaccaatgagggaattatgagagcacagccatgctttgagatgctgacccatacaacaccccacaacttaccacatcttttctatgagattgtaaggtctttgaagacagaaaccatatctaacataccttcatgtctctgaagtgcatagcattacttcactcagtacaatcatttcatattaggagttgaaagatctcttttttttttgagacagtcttgttatgtcaccaggctggagtgcggtggcatgatctcggctcactgcaacctccacctcccaggttcaagcgattctcctgcctcagccccttgagtagctgggactacaggtgtgcgccaccacacccagctaatttttgtaattttagtagagacagggtttcaccatgttggccaggatggtctcaatcccctgaccttgtgatccacctgcctcggcctcccaaagtgctgggatcacaggtgtgagccaccacgcccagccaggagttggaagatcttatagtagagctgtccagtagaactttctgcagtgatgaaaacattctctgcaccgtcttatatgggggccactaaacacataatggctactgagctcttgaaatgggactggtgaagctgaggaactgaattttaaattttatttattttcaatttaaatgacctcgtggctggtggctaccatattggacagcatagccttagaatcttaaaaaatatattttcgccataaccctaaatagatggccacttcttctccctggctttttcagggataggggtctaccctttccatgcacccccatttttgggtagttgcgctggagccagccctccctgtatctgaattatgtgtgataatattgtgaatgcctctgttagtcaggcatacatttagaaagcatctttacatatttgttgcaagtctacgcattttttctcacatggacacaaggtagtggagaatttccaccttgccttagggtttacgcttgtgtcatttgttcttctctagtggccaatagagcagcatgcctattctgatttagcattaaactctgtctttcagcctaattctccttgagttcatcaaggaaaagtatttaaatgcttgaaaagaaaacagaagaagtcgtgtcccaaattttcacttctcttcattcttctaagaaactttcaagttggtttagaaattagtctaaatgccaatcctggttttccactgatttgtagtggttaaggagctaatgtcaaagctttatatgtctcagtctcctttcttcaaatggggttgaattgattcttcttacttgggaggatcaaataatgataaccataaagttttgaaaaatataaagtgctccaaattaaggtggtgatatttgtgataacacttgaagatgcaacctaaagtccctaaacatggtgtcttcctaagtgttgaagttagtatatacaaaaaccatcatttcacaaatctaaactactcaaactgtctgctactcagaaggtgaaagaaagggcataaagacattggctttaataatgttaaatctgccaggtcttctgtttgctagtggagaagtacaaatagagaaatggtaatgctaagagattgtgcggggaaggcaagggaaaaacaggtcataacctgttaacctgcccttagtatgttggattccattgattagagaaaagaaacaccttgagaagacaaagtgcctcaggttgattgtattcactcttatttctatgctgctgttcttgacagacctgccttggtaaatgcatgtatttttttaaagtagcacagatttttggaacaagatggtgaaggttgagctaaagttaagtgcaaactgtacattataatccatttgtttatttggtttttcaatcccaaatgaaccattgagctcagaaaagagcaaagtgggttgacaaattgattttttttgaaaagaacaaaagttcatttggtacagtcggaaagaaagtgctgccagatttactgtgtaactactgcaaatgtgggtttatataatttttgagattcatacatagtcaattaccaaggtctttgattcactttgtaaacactgatcagtcaataaagtacagagagatgaattggcttgagttacattttccatactcagaatggtaaaatctagaatagaaatccagtggctcaaattggctacaatttctgagtgcctactctgtctcaattgtggaaaaatttttttaaagactatatcttttcataagtggccttaagaacaaaagcatatggaaagtaaaatactaatacaaatatttaaagactagctaaagagaacaattgatgagctgtagctgacagtgtgttattgattatcaacatgaattatagatattcaaggagggaattgtcgcttttaagctagggttctcaggaaagggtatcatgagggaagtaaaatttgagcatgaaattcatgattgaataaaaatatggatagtgaagatgtagattaaaaagaatgagtaaaaatgtagaggtagaaagttgtaagacatatttgagaggtgataaaatatttttatgtaggatgctgtggtatgatcagcttgaaaggaaggttaatggtttctagatcaaaaaattaaatgagaacagacttagatactcaacacatttatgtctgggaaggaggaagaagcatggatatgtcatgtgtgatacctccagctttgctggctcaagcaggtatacagccatagtattattatgtggcgtaagatgaaactttgaatattatctctccaaccagctcactttatagagaaacaaagctcatagagcttcagtctcagtctcctaggtctcattccaggtcactatttgccaagggtttgtgaaggaaaacagttaaagggtcaaggtaagcgatgatcattgcagatcagaggtaggaaatctgctggagtatgttgtacccagaaatcacccaatacctgtaggatgaagagaaacatcactgagttgcagcgatggcccaactgaaatgaatgcaaatctttaggatatacacgacatgctccctttctcccacaaagcactgaatctcaagaacacaaaacagaaagcaggtgataggtgtgattcaaggttgaagatgggtgtgacaagcctggtggaactttaaagaagcaagaaagtctaaactatcaattccaggaaggcaaagaccttttctgtcttgttcactgttataccccagtgtcgagaacagtacctggcacatagtagctgtgcggtaaatatttattgtatattgattgtataaatgtttttgtgaggcctcactgaagtagctgaatcatgaaatttacagtgggtgcaaaatgatggctagtcagagaggacctgtctaataatggttttgagtgttccaagactagagttccttgcgagagcagagaaatgatgatgttgtgaatgaggatacagtgggttagaggaggaagatgtgtaatgaagaaggtacaatataagagaagaaactaagatattgaagaaaagtatgcaatgatgctgtcgaggatacagccatcctgagttacgaattttacaaagcactaacaataaattaacagagatgaaataagcatttggaaggctaattcaattgagatcttttgtgacttgataattctatgatttaaaccaaacaggttgtaaaccgaaggcataggtaatttttaggattatttcttacctaaggttatatgatccaatgaatcaatgtggcaatcactgataatagtcctctcagaacttctttggggcactcttgtttgttccctgaaatgggaaacaaatcctagagagaaatagtggattagtcctattatagtggttaagtgtatgcactttgaaattccataaaatggggattatactagctacctcacagatctgttacccagataaagtaaaattacttatattttaatggcccagcagagctatcagccatgaaaagacttgaaggaaacttaaatgtgtgttgttaagtggaataagccaatcagaaaaggctacagacatactgtatgattccaactatatgatattctggaaaactcaaagctgtagagacataaaaacatcagtgattgccagggttttggagtaaggagagggaagggataaatgagtggagcaggtggggtttttagggcagtgaagctattctgtatgatgctactatggtgaatacatgacattcggtatttggtgaaacctatgaaactgtgcaacaaagagtgaaccttaatgtaaactatgaactttagttaatcataatgcatgaatactggtttgtcaattggaacaaatgtaccacactactgcaagatgttcctaagtttcctagggctgccataacaaagtaccacacactagttggtctataataacagtaatttcttgtcccactgttacggagagttgaagtttgaaatggaggtgtcagcatggccaggctccctctgaaggcactggggaagggtttgtcccatttctctttctcagctttctggtggccttaggtcttccttgtctccattttctcatggcatctcaccatgtcttcacattatctcccctctgtgtttgtctgtctctgtgccaaatttccccttttcataaggacaccatcatattggataagggaccaccctaatcacctcatcttgactacatctgcaaagactctatctccaaatgcaggagaaaatgtgggcaggagttggggaggggggaatatatggaaactctgtactctctattcgctttttttctgctctaagaaataagtctattcattaaaaatgttaaaggcttaaaaaacagcctgccacatagtacatattcaataaatgttagttccttttggatgctgcattaacttattcagtgcccctgacacaacagattttattcttcttgcattccaagatcaatactggcactgcccaaaaagtagataagacttagcttcttccacatggccttgtccctaagtgttgagtgctgggttagccacctgctcacaaacatctcctgccttgactgcatttacacacgtgctcatgcacaggtgacacaggtgagcatacccacacacacctaaaatggcttatctgccaccaacactgacccaaacaaaagcagaaacttactagttccccttataaaggcatcacaggaaatatctatagtgagggctacatgcccatagagggaaaaagaaaaacagcaaaaaagaatataaaacataatacatttcttggttgaaagatgcacatcagctattgaactaaatttttaaaggaaacgagccataaattgattttaataaatataaatatactttcatttccgacacagggtgggagacagagaagaaaaaaaagtcacaaagaaagagaaaattttttttaatgtcagaagaaataccactcaatattctgcctttgaaaagaggcagagaaaaaaaagcaaggaggaaggaaaggaaagagaggaaagtcccggaagccctggcgtggtggtaagatgcaggacacgcctctcgtcacatcatgccaatcccctgggccgcaggctcgtggctttgttcaaaaagaagggcaggctgggtgcggtggctcatgcctgtaatcccagcactttgggaggccgaggggaggatcacctgaggtcaggagttagagaccagcctggccaacacggtgaaaccccgtctctactaaaaataaaaattagccgggtgtggcggtatacacctgtaatcccaggtactcaggaggctgaagcaggagaatttctcgaacctgggaggcaaaggctgcagtgagccgagatcgcgccattgcactccagcctgggtgacaagagtgaaactccatctcaaaaaaaaaaaaaaggaagggcagtgtgtttggtgatttgaaatcttttttctttccttttttttttttgagatggagtctcgctctgtcgctcagactggagtgaagcggctcaatctcagctcactgcaacctccacctcacgagttcaagtgattctcctgcctcagcctcctgagtagctaggattataggcacctgccatcacacccagctaattttttgtgtgtttagtaaagatggggtttcaccgtgttggccaggctggtctcgaactcctgacctcaagtgatccacccaccttggcctcccaaagtgctgggattacaggcatgagccactgcatctggcctgaaacctttaacactgacttatttcttaatcatggcagtttaggcatgccctgttttaaaagaaaatcctatctatgagaatccatattgaaaacacagacatatccataggtaatgacatctgcctctgttaaggtttttgtttttcccctctttacaaaagaagtcacctcagtaaatttttcaatagcatgaccacagtccctcctccagcacaaaaatttagattttcataaaactctccgagaacgcatcatctgtcactaacatcaatacttagctctttcacactactctatttgtgacacccagagcctcacgactgatggaatcaccctgtcttgacttttcatcccttcattggttgagagtttgtttcctaaccaatgttgctgaaaagaattcagcactgagtaggggtagggcaggaaatgagggattactgcctggggactggggacgtagaagagaaaaagaaaatcacttaccattctacctagacatgtctcctcttacaaaggaaagatgctagagaagggctgaaaagctctgtgatataagggtgcagggatgaaggaggatctccagccccatcctgggttgataccgagagccattttcataaacacatacagcttctctcccccacacaagacacacacaccaccgagagtcataccacatggtacacagatgtggttttgtgctttcctctaagctacacccactcgtgtgcacaaagcctcacctagaaaagcactggtctgtaggaaatggcacacgctctctctctccctctgggtgcccccacatgtatactcagcagcattcaaatggcaggtagtttttctatggctgggaaagaaaaagtgctcaagtaagcaagagaaggtgaggagtgggagaagagaatgggtaggagaaaaagaatttgcgtgggttaagagccagtgaggatggtcagccaaactgacctcacgatgttagtttcacttcccttttaagtattccaagacactgcccggctctgcagaccatgtgcatctccagcctgcttggagatattcatttcactgctcattagcacctctaccagaggtataggctgagaaccactgttgctgacaaacagccagaatgactacttaaatttgatgaggtaggagcaaaaaccagacagaggcttagaggatgctcttcaagctacttggataaattttaaaaggtaaaattgtttgcttatagacggacctctttttcccatgtctgtttgctattgctatagttattcaagaggcactttatatgcaacaaaagaccacatggaaggaagagaagagtctaccctcccactgcacctggcattcgagtccaggagtttagaccctactgcccacagggctgtcctcacacactcctgccctgtggtcagaacaggagcctaccccagggagaagggccctgggatgccctcttagggaactctcaaatcactttttctttttccattcagataattacagactagattggaaagtgtagaaaaatttctttatggtcgatgaaataataagaaggaaaatgggttgtttccttcataactagcaaagcctagggaagtactcttggtaagagtaagatagataaacatcaaaaatttaaaaccccaaataaacaccaagatttgaatttctaaagatttataagcagcattaataataccctagaggataaaaaaggggaaaaattcaaacattgtatagttttgcttttgttggctgaacttttatttttgtttttgtggggtttttttagaggggaaaaaacctttgaaaataaaataattggacaatttatttaagaaggtttctgaacttggcttcaaaatctaagttttgttttttgctccttcaaacaaagatgccttcaggtgtgatggctttaggttttgtacagctccttattttttcacacagggcaaatggctcgtctcatgtgcacataaagggctggaaaatatttctgtgattcgagcgcagcagagagtctaggattccagaggaagtggaggcctcccattccgcacaggaaacaatcttcaagcaggccttaaatgccagattccaggctgagtttaactaaccactgacagctctgtaaacaaagcaaggacaaaaagagcccgcttccccctttctggtagtcattttgggtttgggggctgcaggggaattctggaatacttgactccatggcacagaaacgcaggggaaacgggctcctcatttaaagagctggaaggggaaggtctttccggaattaaaaccatcacagaggaggtaggaaagggtaaaatggttgggttacatctgtagaaaagcagtgattttagagcttggaaaacagcttgatcaccacttaactgcttttaaaaatgttgcttcatgatgtttattcatgatgttactgctgcagtctttattaaaatcctgatgcttctttgagaatatgcacattatatgcctagacactgtattattttatttctcgctttcacttttctcctagttcctacaaatacctcttcttgccacttttcttttctgtttgtcattcctgttttcctcctcctttgttcactttttcataactttggtctggggttcagaaagttacaaagagcaaaatcattcattagaatttcaagtgattctaccaatatttcaagtcttcaaaacctctctgtctccggaggtcttttttaaagaataaataatcttgggatcttacttatttgtctctaggagattcatgaatgagactgaatttaactcggctcaggagtcagaaattgatcactggctaccttatcagctttctaagagtaaagaaaaatcaggagaatgacaaatgggaaagagggcccatagtaactcaggagaagtaacacactgagttatcaatgatattgactctacctcctctctttcaggtccagacatcatctggtctccctgaacctgaaatcacaccatggatgattttgagcgtcgcagagaacttagaaggcaaaagagggaggagatgcgactcgaagcagaaaggtaaggatctagggtgaaaaatacttgtattcccttattaacaaccttggtttcaggcctcaaagaccatccttttgagaggccaaatgtggtcatatcgcacaccaaactgttcgcaaaagtagttatggaaaatttttctgctaagactctaaattaagcatttaaaaaaggaaaacaaacaagaatcaagaaaaagagagatttgagaggaatcaattgataactgcatattgataattgcatttaatcaatacctttcacattggaatgttttaaatgacaaaagtaatgtgtgaatgaaggtttaaaaagcttatataataagaaatgacaaaaaaatgtcaagtattgaatattggaaccacttaggacatgagagtcttcaatctaaaaaatataaaggcaaaaagccctggatgaatcttgtgaaaaattttcattcttattagaaaagtatccaactctagggatctgcatagtacaggttaataacgggctatgttaccgaggagattctgggtgtaactggaagctgttaatgtcgtgtgaggcctctacagtggtggctatgaggtcaaattggggagataaagcattggcatataaaacctggggcataaatacatattttaacattttaggcctcagaacaaaggacagtgtggtatttgatgcgacttaaatcagatgttcttttgagaaagcaggttaggcattcacagagagaaaaatgttaaacaatgaccttaaaatcaaatcgatttttttcccagtaactccaatgctcagatgaaaaatgacactttaacgataccacagcacaaaactggaaacttacacctataatgaaaagtattgttcttatgttctacttatttgcatggagaatgcaaaagcaaaagataaaataactgcctatgatgaactgggccagagtcagctggcattcatgaactgactaaacatgtccacaaggcactatggatggtacctgcattctgttggttcaaatcctagctctgccatttgcaagctgtgtggccctgagcaaatgatttctctttaagccatagttgccttatatataaaacaggcataatatctacatagcctgtgtgattgttgggaagattattgagcttcataaatagcctagtcaggtacctagcacatagtagtttttcataaatgatagtttttcataaatgatagctattattattattaaccattatcactagccaaacaagaaatagcatagcagcatagccagagctaaacaatcatgccaagagaaggaaaggtagtcattatcctgcaatggaactagtcagagaaagtttcttggtggaggtgagccatggaggaggtaatgatggcaatgaagagggaaacggagcctgtctaggtgaaggaatgacaccggcaaaagtgcagaagtggaaataagaatcctggtgcaagaaacctgttgagtgtttaagggaaaatggattggactggtatatcttggctgttcctatttgccatacaaggaatagacagagacttaacaagggagttatgtgcgatgacactatgctggagaaacttatctacagtggactagaatatggggataccagcactggaagagatagtatggtaatgagggcctgaatcaggtcagtgagtatggaaatgaagaaagatcaaatatgagagtctttacagagggagaattagcaaaccttttaggagagcaaagaacttatagacggttccaaagaatatacatctgaggagctggaaggaaagtctctgctttgtcctaaatggaggatttccttcttgaatcgtcagagaggagcagtgtttaatttcaggtagaaaccacatccaaaaggggatttcctgcaggcatgtggagataggaaatttcactctttgttcaaaaagggagagaaattattattagagtaataaatttgggcagacacagtatggtggtgctagtacaaaagctgaggggatattcccaaaaaagcaagtgtagaaaaagtgagcggtcatcaaggtataatggaagccatcaaagaagacaacgtaccagggagatgggggagaaccagggagagtatgaggcccaatgttgagtggacatggtggacatggaagtcttgcgggcagtggccgggctcagtgaaccacacctcttattccttccaatgctgtgttatttcacctcaggttctcatgatagtctacaaaatatcttcatccaacaactatttattaagcactaaccaggtttaagtgtgccaggatgggaaaaataatggtggtaaagaagtagacatggttcttgcctttatatacctcacagcatgctaggaaaccaaagtgtaacagaatcaggaagcagacaggccagggtgtaggggcagacctgatagagttgtggctagagaggctcaggactgaggatgtagacactgggcatcaggctagattgccattgtcagcttctttcctttccacgtgaacagggggtcagggaatcattgacagaggtgtgacagaactaaagtgctgtggttagagccatactgtcattagagtgaataaacccagtttcttcaggttcaggactttgcttaagaattgaccgcacggctacgtggttcgttcctttgacttttttgttttgtgtggaagaatttctcttcttttaatgtcagatgtaaaaggaatgtacacagtaagtcttagttatgtaccctgaataacctaaaataaacttacacaaattaatcctaaccttgtttaatttatatttctgtctgtattacttcttttgggatattatattgttttcttttctgttttttatttcttctttccttcctttctttcttgcttccattcatttccttccttcctctctctctctctctctcgctctttctttcttcttaagagtagtacttacataattccttatacttgtactaagtttacctttccatgtttcaaggtgagccttctagttctgctattctgagatttggtaagcccatgaccacccttcaggattttgtaaaatctgatcatttatgggaatagtgaaagtcaggcttcatggttcagccagctctggtgggaaagtgcagggtgtgtgcaggaaacaggtggccagaagctgaaatcaaggccatctaaaatcatggttttgatctgaagacaaagagcacatgagaccctgagcaagtccctcttcctttagctccagaccttggcttcctcctctaaaataagactagccattttctctggggtattggtggtcactttaatttttttctcgcttttggtattattgatttttctttactacgatcatatgttactttatttaaagccaaataaaaatgaaggcaattttctgttttgaaaaaaaataattctatggccctatgcagtatacctgagcccagatgggagaagacttaacttctctttgaatttagggaactaaaagaaagatttcatccctgatctggagggcagttaccaactactggaaatagagtggctccaaggctcagagctgcagattcatttacttactctcaacacatttttactgggcatctattccactacaagctctattttgggtactgagaatagacccacagagtaacagtgttgggaagtgtgtgcttagtgctttacaacctatctaaaatgaaaaaaagatcaagaaattatacttttgtatcctcaaacataacatgtaccccgtatgggttcatacttattagagatgacccacagcctttgtacacctgacccctgcagacagtgtgggggatggggtatactacagagaagagaaagtccattgactttccttacccataaaagcttttcaaataaaaataccctgttatttttatttaattagtattgagtctgattgccagatgcagttttactttgaaatgataaataatttaaaacttgtacttttacccggtgttataaccacagattaaaataaagcgaatttttacacattttattcttcagaaacagaccttttcaaagactattttgcaagctaattgaaggctttgtgccatgctggcttgcatgtgcttaggactggcatttattcactgcatccgagctgtcctgagactctgtcgtccacatatctccttctaagggttttagcccagttcatttcaaataacctcgactgcaaacgtagtgcatcaaaaacgttcttccagctgggcgcagtggctcacgcctgtaatcccagcactctgggaggctgaggtgggtggtcaggagttcgagaccaccctggccaacatggagaaaccccgtctgtactaaaaatacaaaaagtagctaggcatggtggtgggtgcctgtaatcccagctactctggaggctgaggtaaggagaatcgcttgaacctgggaggcagagggtgcagtgagccgagattacgccactgcaccccagcctaagtgacggagtgagactcggtctcaaaaaaaaaaaaaaaaaaaaaaaaacttccttctttgtcttgccccttagcctgtgcaacttttatgccattacctcgtccttccttgtcttccatttggctttctcactctgagttcttgagataaggtctttagatttggcaaaaaggaaggaagtacttcattttgtcataaaaagaaatacagatgctgaatacctacaaaatgcaagatactataccgaaccataggaatcagtggtcaccagtagggacagtatcccagtagtcactaagctcctattctaagggtattagtaactttagagcaatcgtgaccaaaagagggagaaaaaaaattcagtaggcagaatggaatgagcagtaatcagtgaaaatccttaatgcattgtttctaagcaaaaggcactatttgctcacatctcaaattaaactgtattttaaaagcaattactcatttgaacaaacagataaaaatttagttttgctgtttattattctccaccaatctcaggggagtaaaaagttaaatagatacattctggccggatgcaatggctcactcccgtaatcccagcattttgggaggccaaggcaggcagatcacttgaggccaggagttcgaaaccagcctggccaacatggtgaaaccctgtctctactaaaaatacaaaaaaaaattcgctgggcatagtggctggtgcctgtaatcccagctactcgggaagctgaggcaggagaatcacttgaacctgggaggcagaggttgcagtgagccacgatcatgccactgcactacaagctgggcgacagagcaaaaacaaacaaacaaacaaacaaacaaaacaaaaaaaacccaaaaaacaaaaaaaaacactatattctgcttccctttctgtttcttttatttcaatccctctcctctgccttcatctctgttttccttggtgcaccttcatgtgcctcttccccggtccacgtgcatcttcatcaacacttgatttgtttgtttctgtgtctcttcccatctgcactcctaatctgtctgctctgaattatgtgtggatgtgctgttgcatcaccaggaaatacatacttctggccaggaaagagggagagagaaacccagttctcttcctgttcagcaagtataaaaaagtgctagacattttatgtgtgtctagtaaagacggaccgccgccggccccagaattagctatgtctgaatggaacatttttgctctatatgaatgaggcaaccccaagacacataatgatggcaggcagtacagttggcagttaagggcatgagctttagcactgggcagctatagtgtcaaatcccagctctgccacttactaactatgggatctaccaaattattcaatctttcaaatattttgtatcctcccttacaaaatgggggtagtaaaagtatccacctcactgggtttttgtggggatgtaaaaaggtaagacatgaaagtattaacacagtgttattcatctaataaacattcaataaactcattattaattattattatttaatttgattctctacaacatggaaataaaaaaataaaaatatgaaaggcttgtggattgttttgcacatcatagatggtacaagaaccataggcaagatgaaaggcaggaatgcgtgactgactgaagagctttgagtgactgtgatcggtaacagtttttgaggaaggactgtgttgtctcagctggaagaattagcaccagtttaagttatttttaaaaatttggccgaaagaatgttgagctgtggtgtattttctttttttctttttttctttttttttgttttcatttttgtttttttgagaaggagtctcactttgtcggccaggctggagtgcagtggtaccatctcggctcactgcaatctctgcctcccaggttcaagcgattctcctgcctcagcctctcgagtaggcacacgccaccacacccagctagtttttgtattaattagagaggaggtttcaccatgttggccaggctggtctcaaactcctggcctcaagtgctccaccggcctcagcctcccaaagtactgggattacaggcatgaggagctgtgatgtattttctgagaaaccagcagtgatgcttttatccatgagaaaatctccagcagacatacttggccgacaccgggcttggttccccaacaaatggctctctcactttccaagatgtgctcattacgttcacagcatctgctttctgcacccaacatgagttcctctcactgatcagaagaaaggcccctattgtagagttacgttatcagattcagaagcttacagacataaataaagggaatgaaaacacttgctgttgtcatcattcatacatttttatgggcttctgaaatggcttgatgattagacatttgaaagtaaatatttttactacactataaaaagaagcaattttttaaaatccatggggtctctaaagtcccctctcagaactgtatcactgagacttttttacatgatttaatagaaacagccaatgaatgattatacaacacacaacccctcacacacgcaaacccaacacttattcaaaatgcttagcatcaggaccttgacatttttaaataaaatcttttaaaatgaaattactgttattttatcatcagaacattattttccattaagaagttaaatacgatattcctttgaaactatctaaattatcaaagtagctagatttgctcaaaatttcccttcagttctctcagaaaactgatcactccaggggacaaaagaaagttagaatctgccatctagttttctacttttattttttattttttgtagagatgtggtctcgccatgttgcgcagtccagtctcaaactcctggactcaagcaatcctcccacctgggcctcccaaagttctgaggttataggcgtgagtcaccacatactttcaaattaaaagatctgtcactgggcgcggtggctcacgcctgtaatcccaacactttgcgaggctgagccaggtggatcacctgaggtcaggagttcgagaccagcctggccaacatggtgaaaccccatctctactaaaaattcaaaaaataagctgggcgtggcagtgggcgcctgcaatcccagctactcaggaagctgagacaggagaattgcttgaacccgggaggtggaggttgcagtgagccgagatcacgccattgcactccagcctgggcaacaagagcgaatgctttgctcaccccttaaaccatctgtgagcccagattttcgtcaccgtgggacagacaagaaccctgtctttagctgaactaaggaaagtcctgcaacagcaatagactaaacaaagactattgtgcctagttgaactattttttatgcttcttcaggtaaattgcttatatgtgtaggcaaagtcattgttttgtttgccctcagaaaatctcctgtgttattcccatttagcagaaaaatagaaacagagaagatcgagtttccctgcttaaggcaaagaaggctgttgatatgactattcttgacttttcactggacttttttcaacaagactgtacatcattaggacagggacttagtcacatcatcactcttaaaaacttaaggctgtctctgaccttatgaatcatcttccgcaggggaacattatgtattcagttttggaccacacactatttttgaggcactgatgaaagctctggaccctcctccaagaaaaatgcacatatgcacccaccaaacttggcacttacattcagtggcatcatgaacctccgtccgcagacctcctgggggccgatgccttctggccaagaatccctgatctaatgaattttaaaactgcctgttaaatattaagaaactcaagcctaggagacatatccccttaagatcacccagttaagctgtttgcatagtgtgggcccctggacaaacaaagccatcctgatcttgctatatgtaaaaaagtctatggctattgattaggaaaataaagcatattttggaaaagagtgtattctacaatgtactgcatgtagagtgctttctaaaacttaaaaaccgtttatggataatgtttctaaataaaggagattcggtcagattacagtgaataaagtgaaaaataaagaaagatgagtggataggcagaatgataccagttaatagtcaggaactgggaatcaaagtttggcgtctttgtcaacaaggacaaaaaaactttggtgatttactacaatcccattttctatcaattttggaagtcttttatttggtatatgttgtgttagcatgattccttcaaacaaagcttaattttgaaactaagttatgtaggatttctccattcttaccagtttttagaaaattcatcaaatgacttttctctctaaatatgaaaaagataagaactgatttgattcctaacagagaaacttatattttacatttatcactactatctttggggaggatgggacagatttggagtgggacaggtgcctttcagagagtaggatctagagtcatgaagacttagattcaaatcccagaatcccagctggattcaaaatggttgttctactccgcctctctcagcccatttcatcaagtggaaaatggccatcgaaacagttcttccttataaggtttaatgcagattataaagcacttagtagtccctaaaacatgactagtgctcattctgttacctcttgttgctgtttttctgctggctgaaggacatggtaagaaaggcgctctcagaaaagccctctctggggtcacctcagaaactcagccttttggcagctaccatctggggtatcactgaacaaggtacaactccatgtgtcagatggctcagtgtctaatcttttctctgtttcagatctgttttagcagctaccttgaaagtgatgggagaattatggatataaatgtctccctgtaaaaagaaaattacctttttattattaagagttcttttccattttccctacttgtttgaaatcaagacaaaagcatgcaatagtctggtacatatcaaggtctttgtcacaatgatatatacatatgtgtatgtatgtatataatttaattaatcatgtatggtcagctctccatacctgaggattcaaccaacccagatcaaaaatgtagttaggcctacaatggttgcatctgtgctaaacatgtacatacttttttccttgtcatcatttctgaacaatacagtataacaactatgtacatagcatttatattcccctgctgatactgagggatgactatatttaaaatactctttttgccttgtgaaattatcatttctcttttcatattgcataatctatggtttcattaccattaaagcatcaaccagaagcttctcaatgccaacattatatataaatattgtaataataacataaggaaaatcatatgcctaattgttacaaaatgattttgaaaaaatgtatcccaaattactaatttattcattttaattatgaaaaaactgatgcatacaaagtaatcctatgtaatatatatggaagttctaactcatcctaatgcgtatcctataaactcaccatacagcctaagacctagaacatttccaatgccccaggcccctctccaatcccttcccttcacctccccacccacagaggtaaccagtgtcctgaataattcatttattttaaaataaaatttgaaatgagatcatacgaatttaggtactagcttctccagggccctgggatccaggcattccaaagattctctccagactctcaggtaaaggtgtcagtgagagcccacttccctgagagggcaagaagtttgtctttctaaacacacaggacaggctgggcatggtggctcctgcgtgtaatgtcagcactttgggaggctgaggcgggcaaatcacttgaagtcaggagttttagactagcttggccaacatggtgaaacctcttctctactaaaaatacaaaaattagccgggcatagtagtgggcgcctgtaattccagctactggagaggctgaggcaggagaatcacttgaaaccaggaggcagaggttgcagtgagccgagatcgcaccactgcattccagcctgggtgatagagcgagaccctgcctcaagaaaaaataaaaataaacacacaagataaacgttcttatgctgtctaaagctgcaagaagtatacagtgtgaacaaagaattctcatcaaaataaaataaaaatacagaccaggtgcagtggctcactcctttgggatcccaacactttgggaggctgaggtgggagaatcacttgagcccagaagtttgagaccagcctgagcaacataggaagacctcatctctacaaataataataataaaaaaaatagctggatgtggtagtgtgtgcctgtagtaccagctactctggaggctgaggtgggaggattacttgagcctgggagttcaaggctgcagtcagctgtgagccatgattgcactactgcactccagcctggacaacagagggagaccttgtctcaaaaaaaaaaagatgtaatgaaagctatccaatacttatattgaacctctctcttttgccctatggttttctcattggccagcaggagtgacagatctgcatttgcagctgtcatttggtcaggtggaactggcagacagaaatgatgacttcagttgctttcaagtcttccaaggaagttcttgacctttattatcccaaaggtccctaaatggtgctgcaagaaagtaccacagggcatgaaacatgagcatgttggaccaatgtggtggctgtgtaagtgggctgtgtaagtggattctcattcatctgtgaatcaggttaaagaggaatcatgtgcatattttgtgaataaaatcagttctttccactagtttgctatctaatgagcactattcatcagcagtggaaaatcagtttttagcctatcctaaacctgcattaacgcagactgtttttgaatttttaatcatttattcaggaacattagtaaagtacaactttgaattatttataaataaagtctttggttaacatgttaaatatgtaagctacattccatggcttagtttttaagtactggagagtacaacttttttttaaaccttttaaataactttaaaaacattcactgacattgaacagcttaatttgttaattataaatcatttgtatgtattcaccatttgaataagcttctaatgttttgccagcatgatggaagttaccaggtaggtagacttaaacatttttcaaaattaaatttcttttaaggtattttataatttttactgggcttacttctagttgatctattttagtgagacctgacattgcatttgagatgtgtaccaatgactaggttagaatgtgagggcttattttccattttaataactccctacatcacatacagttcctttgttgggataaaaatctcagtaaagtacacatcggtcactataaatagcagctacaagcctgtacattcaggagagtctccagagtgtattttaaaccccacattgtttagaataggaaattcttccaatgttcatattttccattgtgggtgacatggactactatcccatgtcacatcttcactggcttctgttttcctgtaccatttaggaactcaactgacggtttccagcagattgttcaatatgtgctttttatttttctaagggtagcctgggtctttttgtccagtgggaattttgcatgcttcatggggctctccaaataaaagctagataactcagagccggcaccagcactaggtaatgaaagagtcctttatttctggagctagtagcactactgtgcccgcttagaataacagcagtcaacccattttttattcccacagaaaactttacactgttggaaggttttctggaggtggggggagactcaagagactaatatgaaaaataactgagcaagaagtgagcaaataaacaagcaggatgagatgatgggttatcaggctgattcaaagacaagaagcatcatcaggtctaatcacactgcatctttcccaaggcacaattggcagctacagtacatgtatatctctgcccacttcttccttgaacaattcttctgtttctctcatcaaaactgttgtgtagatcttgatctttttttagtggagtttcatttgggggatctaacattccctcactatttgtcctttgatgaagaagatgagaaaggacctattattaaggggcctcgcgcaaaagttgtgatgtagaaagaactgatatctgacacctgtctttcctgctactaccttttaagatcctttaactcttcctatctaagcaggagagtgtattttccctgagccagcatcttcatagcatatcctggctacctagggattatcattgctacagatgctcagcggcttttgaactgaacagaatgaagttttttttaaactctaggttgaggctggagagaaattcccaaatcctttagtccctaagtgcctcatgtcatataaatgatgtctcattgtggcattgtcagagctatggtagagctgaaatcagagacatatgcgcttcagaaaggtgtcagttttccatgagaactctgcctgaagtgcagaattacttctagaagacagattctggtgtccagttgggttatgtcatcagaaattaacatacactctctttcctacgttctctgaaagggggttggaagcccaaatcattggacccaggcttgtagagcaacatgtccaagagcacacagtcagtggcagggtcaaatctggaaaccttgtcattttctccaactctggcactttttttctttgcatcgtgtgaggccccactctcaatttattatcacattagagctaaatgtcctctaactcctgctgaagagactggcttttaaatcaaggataaaagaaaagacactggataaaagttcagcagatcagggcttccttatctataagagagaactaacacttctcagggtggctgagaaaattaagcaagatacagaaaaaatgtcatcgaaagtataaagggtaatgcgcatgacgtacgtttatcatgttgaagtgcctgggtgattacactggattcacttctatattaactatatgtagagttgcaggtttcatgctggtcatgtgctgtgtttcaaaggaattttcacacttctaaccctgctgccttatgctagctgactggctgtcaggtattctagtctttcagaaatcagatgctgagaaaacacaatgaaataaaatgtcacctgtcaccctccctagagcccgtcacctctggagagggcttaggacctcaattgcagattagaagaaccaaagccattttattttcccttttcctctagttgtgaattgaggagaaaatgcagacgatttaaaatcctggctttatcccaatcagaaggaaactgtgctgtgcttacgaggagaaccctactcccaccttgggtcttacgtcgcactttttacatatgttaattattatcctctattttatgtttatttgttctcgtatctgttttctccaccaaattgaaagcaaccgtagatcagaaactacatcttactcacttttatttccccaagaccagcatacaatgttgaatgaacactaacacttgtgtatcaaggcacaactgtgacaaatgtgctaagctacttgtgagggaggcagaaatgttagtgacactcgttgtgtcttctaaacactgacaccatcaatgcctctcctggggtttcatcacttctctgctgagccttcaagccattgcaatttcaactccatatcttttctccagagaaatgaagagatttatctcatgtatttttttgattattaaggataattggacctttacaacatagaattttgaccacttatgcttatttagttgcattgtggaggcaaatgatattaatatggtaagagtccatttccttttgttggcctatttactccggtactcaagcccttggtatatttgcaattagtatctgcattataaatcagataatcatcaaattacagggtttatgccaaacgtacaggagtccaacagtgaacaaactgtataatcaaaaatttctctaatgaaggatcaagcttgtggtcaggaggagtaaagtatccagttaatcccagaagaatgggcagaagtaggataagggtagggccaatctctggcatgtatttatcaacattctttctgataatagaatgtttagcatacaatagaatggagtgtttaacatacaagttgagttcaaagtttagatttcaaatggtaaatggttttccaatattgggatgtaatgatggaccaaaaaagaaaaagaagaaagtaatacattagagcccaatactttttaatcaagatatgaggacttaattatttttttccagtaaagtcgagcatttttataaatggtttatgctccttgagtggtactatttggaagaaggaggaggagtatttataaatggattttcttcatcataaaatataccctttggttaatttgttaacataaaatttgtaattaaaataaagttagtgaactggaacactcaaagtacgtaaacccagaagcacaatcgaatagcctcagaactgtatttcttaggtaagaaattttaatttttgattcttagatctactgggaaagagtcagaaggaaaggtaatttgaagttatcctagaaagactctgaattctaaaatacttaggagaatctcagattacttcagccctctctactttgcaacatattttagaaagctggattcatatttcacatcattggctttcaaatttgaagtgactgtcggctattttttttaagtatcatctattttatcttttgttgttgttgtcttcataatgtgttaacattaaaaagctttccagatggcttctggcttttaaatgagaaaattggatatttttactaaatattttcccttaaaaacctgccaggctggtggttattctataaattagtgagattaaaaaaaaggccccatttgcttttcctgttttaatcttaataagagcttgatttcactactcaataatgtcaaagtaaaatagcatcttaaaatggaaaagctttcttctcctactctatttctaatctcctgccttaggctaccatcataaagatacctaagattctacagaagagcatttctgataaatacaattcataagggtcaaactgcattaggtctcccagatttgaacaagtggagtccaactgtaatccacgatattagtgagtgtaaagaaagaatggccagtagaagctggccgcggtggctcacgcctgtaatcccagcactttgggaggccgaggcgggtggatcacctgaggtcaggagtttgagaccagcctgaccaacacggtgaggtctctaataaaaatacaaaattagccgggcatggtggcacatgcctgtaatcccagctacctgggaggctgaggcaggagaattgcttgaacctaggaagcggaggttgcagtgagccaagatcacaccattgcactccagcctgggcaacaagagtgaaactctgtctcaaaaaagaaaaaaaaaaaggaatggccagtagaagaagcctgcatgtctgccaagttcaagacctggtttggccctggggatctaggaatatccaaatgagacagaccttgaatctcagggttggttgagtttcagggtggtgacatgagatttatggcttgaatctcacagagttgtgacatgaaaagtattctctccacttggagaagtgtttcctcatgtctcccactggcttgggtaaaatattacctgtgatgatttcaccccgctttgctctgacttcacactcatgaagaagtcgctattgactacgcagcttcctaacatcctggcttggggaatgggaggtgccctggttgggaatgagagttctccaggcactgaagatggagagcatttattctatcttaattggcactagagaaggcatcagtctcttgtgcatctgtgagttcatcaatcttcctgatacctgtcgattctggacctcccaagatccaatttctggtgcagaactgttatgaatactccaaaaaaaaaaaaaggccaatctttagaaacctttggaaaaacaagccaactgaccttggtgcagcgtctctactccatcgttgtccctcttcactccagagaaaaaatgacaagtacttattggccatctgctatataactaacaccctcctaggctgtatcaggtgcaaaagtggtggtaggaaataccccttccagcaaaaatgttacactgtaacttatttggtaaaaacaagtatatacacaggaacaatgaacaaataagactgtgtatttgtatttatccatattttctttctttcttttatttatttatttttttgagacagagtctcattctgtcacccaggctagagtacactggtgtgatctcggctcactgcagcctccacctcccaggttcaagcgattctcatgcctcagcctctggaggggttacaggcgcacaccaccatgccaggctaacttttgtacttttaacagagacggggtttcactatgttggccagtctggtctgtaactcctgacctcaggtgatcctcctgcctctgcctcccaaagtgctgggattacaggtgtgagccccgacacccggcaccatacgtttatttctatctgtagatcataatcaagtgctgatcccagtcagaggttattacaaaatataacagaacctaataaagtgttattatataatgtaaataataagcacaacacctaaagtatctgaaacacataatggattatttctctagcaataggagcaatatgctttcatccaggtctgaccaccccccaaaaagaaggaaatcaatattttttaagactttatatggtatcactggaaaaaaatctggatttcattccagctataaaagccatgtgtaaatttaatatccagatgcaaaaggtggacacccacaaataaatttatgattgtggaaatatttagacactttgaacaagagtggtacacactgagaattctgtggcttaggaactaatatgcttcctttgaagatttgaccttttcttctgcactagaattatctcctgagtccttataataatttccttcacaacctgtacctatgaacaacaaatctacattctaaaatatatcactatggcctagattcagtttcttatgggtagaaatcacattcttcatgtacacacttctttcctagaattatataaagcaggtattattattatcgttttcaccgagaccagaaccagaattttgtagatgtgcaccagccaccattcattcaagaaattgttagagccctgctatttccaagcaccgtttattgttttaaagatatgtttcaagttggagggcagaaaggagttagaggcatgatccttttcagatagaaacttttcaggaaaagaaaatagtccagttgtttaaaaaaccctggattttaaaaagagcttagagagtcggcctaagtaattggtgcaagacagtttaaacagaaacagggagtctcacagcaagttggctggaggagctgactcatacattgcaacataattatttcccaaataacatgcaaacaagagtgggctcaagctttctggtctctctctccctaacaagataaattagaaagaaataaagtcaaatccaggaagacttcatagaggtaaggcctggaactggttcttaaagaaccactagaattcagagaagcaaaaggagtaagagtgggcataggacttacaaagcaattcatttggagaagaaaaaagaaaaagcaaaaaccctggatatagcacaaaactgaatgaatgatctctctaagagatgctattatcaatgtgaaaatgatgttaggatgtgttaacaggaacgtggcaggaagcactgggacttcagccaggccttggtcagcttttattatgtccaattttggtttcccgtttgaagagttgttatagtcaggctgatattaaaaggatggaaaataggcattggcgtctagcctagaaaagacgagactaaaggatgacttaatacctgtggccctcctagagataagtaggtttctatttcagcaacaggaaatctagttcgataacaggataaattgagcgtgagagtgattaaacactgggaccttgatcacaggatgtcacctactgaagtatagttctttagctctactgctttcagagtactgttcactttctgtcttataatagaatttttgtatacatgtcttatctccctttaggactgcccttcttatctttgcatcccccacagcacttagtgcaatgacttgcttgtagtaaacattccaatagtgctacgcgaagcaaagcaaaaaggaatgtgctgggacaaaataaaactacatgctcaccattataagggcaataagacagtgtcacaacccaagcccctattacaggcctagagacagatgaggcaaagaataattaagaaacgtgtatcagcacaggccatgaagacgctggtgaagaaccactggaagactaggatgaggagtaaactgtgatttttccacagcagctcctgcattcaagatcacaggacatgacagagcaatatagtttaagtgaacacgttcaacgccatggcaggggcaggggatgggagatgccgtcgtctatgaggggaaaactatgagaggccaacagaaaggaggaaagagatgctgcctttgaatatgtaaactcctttacctacattcctgttcaccttggggtgggggaacagctgtctaggcaagattttttgcctagttctaagagtacagagcctatgaatttcttcataagaaaatttatctccaacagccttttcaaacgtcccctttgtactactcgaactgttgcctccctagtggtagatttcccttaggtttatgtgtttccatagtaagtgaatggctctgtgcatgttatgtgtgtgcatgtgtgcgtatgcatgcatgcgtgtatatgtgtgtgcctgtgtgtacatgcatgtctgtatgtgtgtgcatgtgtgcgtatgcatgcatgtgtgtgtatgtgtatgtgcatgtgtgcatatgcatgcatgcgtatatgtgtttgcctgtgtgtgcatgtgtgtctctatgtgcctgcgtgtgtatgtgtgtgcatgtgtatgtgtgcgcatgtgtatgtgtgtgcatgtgtgcatatgcatgcattcgtgtatgtgtgtgtgcctgtgtgtgcatgtgtgtctgtatgtgtgtgtatgtgtgtgcatgtgtgtcataagcgcattagggcatatgcacagcacttcccacatacctctcttccctagggaattgtttcaaggtagaagctgttcttaaacaactgctgcagactctaaagtctggaacagatcttgtggtccggtctcccacctccatgaagtaaagttatttttaaaaaatcatattttcttaataaaggaccaccctgtggtgggagctgttcctttctattacagtctgacctccctcaaaccttcccagcccagaatctctttgatgaaaaattaaacaataaagtgtccagaaacaaaggatactatgagtaatctcagaatggcccagactttcatttttcctagtaagagtcctgaagcatcatcaaattcatgatacctattatcttgctgaaggatgactggcccacttgttcatggtgccaatgaatagtcattagttcacttctcagagacaccagttctggcagctggacactgggtaccattctctgctatgcagtgaaagcacacaggcctgtaggtctctgcaggaccagaacactgtgcacaaataacctttagattgttatttctcaatcctcttaccttgcctctccagccccaggcaccaggtctcagaggactcttggaagcacttgcctagcccagccctgctctcagctcatgattcacttgttatctctatgcgtcttcccgcgttgcctgtctttcattggcctttgtgttcttcctcttcccagagagtgtctgaaccaggtccaagactcacttctctcttcactcttcccatgtcagtaccctaccaggtagcatgagctataacaccactgggttttactatcacaaactgaagacagacagctgcttcccaaatgcatgcccctaataacaaaggagggtgcgcgctgtttccctttccctcttttggcaattagggaaatagcctggtggacatcctgtgtacagctggcaattagcacactttctgtacatggattctgcacatgagtggaagactactaaattcttgctctcctccatggagaatactggccagaaagaaccacaatttttttttctaggtttttccattttatgaacctattctgaatatgccaaaaccatacctgtcacctcagaattggcgtggggggctggggaggagggaatcaggaggtgatagctttctcgcatggctgcgacaaataactagaaacttggtggctttaaacgacacaacttattctgtacagttctataggttagatgtctggcacaggtctcactgggctaacatcaaggtgtcagcagggctgtattccttcctggaggctccaggggagaatccatttccttgccttttccagcttctagaggaagtcacattcccaggctcttggaccccctctccatcttcaaagccatcaccagtctgtctgcccaccctgacagataagctcctctaaccacagctggaaaggggtctctgattttaaagagccatgtgattcattccagcacacctggataatccaggatgctctccccatctctatgcctttaatttcatcatatcgacaaggtcccttttgccacgcaaattaacatgttctcaggttctggagatttgcgggaaacgttattccacctaccatagaaaaccaccgacttttgtaagtaattgaagggaaaaaattaattgggcaaaattcggtagaaagagaagcagcagaatgcctcgatacatgtttctgtctcagttctagagcgagaaactcaggacaagtcagtgtatatttaagtcctcttgtgtgaaggcagatgtatctctacttttatgggtgtcttatgtgctactttcatcaatatatgttcggtgatcatatgtgtaatcagagatatttaaatgcatatatacataatgatatatagagataattaactttaagtttattaaactgtatttactctataaactatgacttcattttttgttttgttttgttttttgttttttgagatggagtctcactctgtcgctcaggttggagtgcagtggcgccatctcagctcactgcaacctccgcctcctgggttcaagcaattctcctgccgcagcctcccaagtagctgggactacaggcacctgccaccaagcccgggtaatttttgtatttttagtagagacggggtttcaccatgttggccaggctggtctcaaactcctgaccttgatccacctgcctcagcctccccgagtgctgggattacaggcatgagccacctcgcctggcctataaactacgactctgatgaccgcatagtatttaagcaagaaaacaaccaaaatgttctagctaaagtggagaccacttaacctaacccaattaaactttaagttgaacacaagagtagtagatgcagttcagctccatgacattgggtgagttgtctaaatgctctgtgctttggtgtccttgtctgcgtgtgacatgaagccgcagatctcaaagatctctttcattccgtgaaagcgctctcaatgtgtgaagttgactgcttctcctgctgtttaccaagagaataatcttaactctacattgtggagatcggatttgttctcacttgacagaaagccagtcccacgagcagcttggtacccaaataccagtctgtttagtgctcattagagatgaagaaccatattcataagtcaagctgagacggagtgtcatctccagacagaatcaacaccaccccctcctcaggaactgggatttggctgctttccaagccgctgctgaccaggttccattgcccagcttggctgatgagatcactggcagagtaccatgggtgcagacggggcctgctgtttcaacatgttctcaggagggctcttgcccacatttcttggagaggtgtgagcaccaaacatgctgaaccatccagcccatcactgagcagggccatctctcttcatcccttttcatttggtttgcatttttatgtcatgctccttccctggataaaagggataagaggagtttctcagatttgatttctcagtgggaactgtttgctttggaagccacctacaccaatgctaattgagaacagagctcagaatgggagcctgagaactgcacccggatgaactttttggtgggctgatttctgttgatcttgtcagaattaggttgtatatgcatgtaataccatgatcaactattttccaaaaggctgagcaaatgcatcagtgtctttttcctttgaccagttacttaccttggaaaaattatttgtagttaagcatataaagtcttcatcaggaaaactactggagatcctggccctgactacccagcaataacatttctggaactcccgaagcaatcagtgctctctgatcgctaaacatgatgggcttctattagagagattacagtaaaaaataacaatcagctctctgatgatcctgtgaggagggaacgggttgggaggagtagatttggctgaggacaagcccagactttcgtcacagggacagaccaacgtgttaacacaaagggagaacacgggagcatcctgcaccgtgcatttcagccacagatcacatggcccctccgcgggcccagcccacgccctgaccgcccggcctggccaggtctccgtatctctctgccccgccgccccttcccaactgcggacatgctgggtggatccggatcgcatggaagacgcagcctggccgcgctctcccagtgagtcctcatttcgtctctttggttttttcctttcttttttttttttataaaaaacaaacgaattgttgtaaaaaaaaaaaaaaaaaaaaaaatgtgggagtgggaggggagaggaggagacaccaggcaggaaaggaatgcagtgagtgtgtgagtttcagacctgtctgaaactttctggtttccacttcatggttgctctgattcgctggcttttctcgtttccattttaatggtggtttgtggaccatttgccaggagtttatacctaggcacgggtttctccgtttcaaataccaatccataaagcattgtgtttctaaaggtctgctgttaatttagaccttagccctccgttcagaatgatccatttgcagggctcagagattttggctaaagcacacattgcccaatccttagagtaaacagccaaagccctcaatatactgaccatctgactaagacagaacaagacccagagcatatgctattgatcagggaattgttcagataacggactccaagggtttaggatcatgaaatcctggaatgttaaagccagaagggaggcctttagactctttggtgcaatgctgtctttcaataggcagggaaacagaaaccagaggggcaactcaacttaccccaaagcagacaacagtcggtagcaaagccatgtctttgtactctcatgcaaagggccgttttcacactggtgtttatgaggtttgaaaaacttactgggtcttgggaaaaggtaccgcacaagaattagaacaccaaatggcctttcagtaaatcttttccatttttgagagttttggcaccgattcagcatgacaattgttgttccagttgttccagcgtttgtgcaacagttaatcaaataaacagagaaactcatcagggtcctaaaaacaagacccatgtccattacattagcagatctcttggagagctagtttccgtaagtgtggttggttattcacgtgggagagctcaaagggactttagacgttatctgtatagtccagtgcttatcaaactttttaaaaaatcaaatttaatcttaaggggaacgctattgtataaaggagatgttctggttaaagaaaaggtttgggatctagagctcctcatcctcgctctactctgcagtcatagcccactgcacaattctacccctctcctcatccctcttctaccccacctccccaccctcttcatcaaaacttccttggaatcctaggtctccatggaatagttcagaaaccactgatctcattgaaagccttcatttcagatgaggaaactgaggcacaggaagggcttgcccagggtcacacagctgatcagcaatagagcgtgggatgctaggaaaagagcccagtctggctggctgtctctctctcaactcatggtcctgaggcttgtttccactccttcatgcctatgattctatcagtctcctttctctgtgtctctcttctctgtttactctgccatttcctggatttcaacagctattacctctcaccgggatggttgtcattgcctgccatctggtcctcggcctctgtctctctcccctttctgatccagccccctacagcccccacctatgaagataaagtccattctccttactacagcattcaaatttctccacaacatgccttcactatttcttcccattctgacttccgccagggagaatgttaaaaacattgtggggaaataaataaatgatgggcataattttaccagattctgcagaaatgacaaaagaaatgcacacagggatgtcgagatttgtaaaaactataggagtacctgatccggtgaaataagatcactcacagctccccaaactcagcatatacaagccaccactgtttcttgactcattctattccctacacagggaataccctcaccctcctgtttctgacctcctttctgttctgcaaggccctgatcaaatgctcccttcctctgtaaaccttcctcattcctcacttctctcactctaataacctttgcccatccttctattactagctttgtaccgtcaatcgaggaaaatgacgaggcaagtctcaatcattttaggaggtttacttgccaaagttaaggatgtgcctgggagataggtctatgcctttatctgaagatgattttgagggctccagatttaaaggggaaagggtggggatattgagaagtacacaattttcatctaagtgaatctgtgttttgtacataagatcacataaacaaagggggcagaggaaaaatgcggggaatctgcattttacgtatgataacagacaaaatggggtagggcgacactcagatatgcatttgtgtctggtgggccagggtgactgcacctataaagataagctgtccatttgcattgccatggtgaagttttaacagctctctaggaatgtccttgtggacaaaatatgggggaggcttgtgtagcttttcaccttgtagccatcttatttaggaactaaaaggggaaggctttgagtgacccagttcccggcttgacttttccgtttgtctaaatgcgttcggggtaccaaaatttaatttcctttcaataaagttattgttgaacatagctatcttccctcccaataaatggcaattcacttgagggcaggaatgattttgaatctttgaagcttcagcatccagaacagtgctgatgctccagaaatattctttaagtttcctattattgagtaaatcaaactcaattccccttagtttacctttttcatttgaaccgtttgaacacacaaagccttcactccttttgctttgctagacgtactaggttaaatgctaaaacaggtgctcaacaaaatgaattctaagttcctttgcatttccatcagataatttatctctgtttcatcacctgtagagcaagattggctgtgattttttaatgagacatgttaaaattcctgaatgccaagacctacacaagggccatgttattttcaggagcagtcgtgaatggttgttcagttatttagatttcaaggcatgtttaatttgttcctaccaagatcactgagagattctgtcacttgcggtttaatattttcactggtacttttatcattttcccaaagcctaaggaagtttacttgcaacaagatttggggtttcctgtaaatatttgttttagtccataaagggttatttttcttatagagaagtgtgcttttatatatcttgcagctgaaagttaaaagttttttgtgtgtgttacattttgtaacaaacatggaagggtatgtaaattgtaaaatcatggagtcaaggaaacgtaggaaattatttagttcatcccactgttttctgagggaactgaatccaaaacagtgctgggaaataaataaataaataaataaataaataaataaataaataaataattggcacaatttttaaagattctgcagaaatgacaaaggaaataaacataagaatattgagatttgtcaaaagtttaggaatgcctggcttattcaatgttatcaggaaatgtagcattataattatccaggatgctaaatttggttttatatatgtatgtgtgtgtgtgtgtgtgtgtgtgtgtgtgtgtgtgtgtgtgtgtatgtatttagtggaaactctttgccttcattaaagcagatattacaacacatttaaaacattttcaaattgctaggagctgtccttatgaacatagttttttaatcatgctgtaaaacagtgatacctcaggggataagactcccatccaaaaatgggtccagttattatgtgatgtcttccatcacataatattgatgcttttaaatctcttctaatacctattaatgcatctgcctgtcatggtcccgctccctgttctgctgtagccaagagtaacaggacacccatttgttagaattacgttcaaagtaaaaatcaacaatctggtgagagaggccttctctcctacaaagtaatgggcacttacattttgtgactattggtttgtaggccaaagtgttaaatatagtgaacttccagtttctcttcaaagaatcagtatgtcagtatgttcagctttcttattttttaattcttgatttcaaagtttaacttcctggttctctctgcccacttgcttctagtttcagtaaacaactttcccaccagtcctattcagtaggttcacatctgttcccctggtcacctgctctgtcctgtctcatcctggtcacgtgctttgacctgaatcacccctggtcacctgctctgacctaagtcacctttggttacctgtttctaaccatccttcccgccaaactactcaccctgccactctggctcatatccctgccctctttaaaatagccagtcggaactggcttagactgtgtggtccaaccctagccaatagggaacaacacagcagtaggggccgcctgcatcaggaataagaactcctgcccctcccctgtccaggtgtgctctcgccattgttccatcttcgaggggcaccctttctgcagaaagtaaattttgcctttctgagaaaattgcatttatgttccagtgctatttctttgtggcactgggaaacaagcattttgcatttctaacactgaccaatttgtctactttttggttcaaagaaaggtttcaaatgatctggaccctttatctggttatggataaaattgctactgctgtttatagattaaaaataaaaaagaatggcagagaaataggtcactgtgctttgcatgtattgggtactcttctatacaagatattgcagcactgcacgagcagtggtgattatggaggtggtcttgaccttctgtatatgtgtcttctctacaaatggccagcccacccacactcacactggttcaatacctggtggccacaagcctttcaaacctattgaacagcaatttgcattgctgtctgcgtttttccctctccttacctttgatctattgatccttgaaatgagccctgcctatgctgcttctcacattcctctcagcccatcaaaatcactttatagagacaggcctaacagtggcaagaggaatgagaaatggggaagaggtcctctgtcctctggaggcgaacttacccctggcatttttaatcagactagtgaggatccgtttccctatagaaacacagcttcgtttctccataccagcttcagacacaccttgggtttaaaaaggtggttgtaggctggtctgagagcccgactaccatgtgtcatgctgttgaaagtttcaaaagccaatttacaatgaaggtcttggaaacaacctcttcataaatgtagtgctgcctggatctatttccaagcctaattgaatttttaagaggagtccttagaaaatctgtaaacctcattcatttccagtcattcattcagcaaatactcattgagggtttcgcattctagtgaatactgctgtactgactgagcattaagaacatcaaaaaggacaaagctcaggctctggcctcaagggttctgttgtcttctgacctcccacccagcttagcattatctacatcagtgttctcagttttcattttttttttcctgtgaccttctgaaataaatgcattttattttgtaaccccagtacctatatacaatatatatatataaatatatatatatatatttgaagcaaatatttcacaaaacggtgctcacacttgctgtgtacaaagtcatctgatattttctatacgattctatttcattttaaaacgctggtcatccactaaatagatttcagaagctgcagatgggtcacaaaccgaagtttgaaaaccactgaacatatcacatgaccttggtatctctggtccctgccttcagggcagcttaggaagctatgttggctggtgacaacccaggctgccagctacaagggtcagcatggaggttttttgttttgttttgttttttgttttttttaatctaactaattttgttttttcaagggaaggtctctggtcactcagtctggagtgcagtggcacaaccttggctcactgcagcctcaacctcctgggcttaagcgatcctcctgcctcagcctcccaagtagctggggctacagatgtgtgccaccatgccctgataagtttttgtatttttttgtagagatggggtctcgctgtattgcccatgctggtctcaaactcctgggctcaagcagtcctcccacctcggcctcccaaaagtgataagcctccactatctcggctcactgcaacctctgcctcccaggttcaagcaattattctgcctcatcctcccgagaagctgggattacaggcgcccgccaccatgcctggctagcctgggggtttaagaaaagtttttttggatgggagtcagagggtctggattctggtctaactccttcagtaatcagtactgtgatctgcagcaagtcgcttcaacttgctgcgacacagctatgaagtggagatgctgatgcctgttctgtgtaattcacagggtgagcaagaacatccagtataataatgtgcattaaagtgtgcagaaaaatattaagtacagagcaaatccaagttattattaaacagtcttacttttacaattaaaatttaatatcagaggaacaacttggagggaccatttgttctttgtagatctgggaaaggattcttgaacaaggctataatatgatgcaacttcataaatggaaatctcagggtaactttttttgtgatattttaagtagatttgaattgaagaaactcagccaagttatcctggtccctcttcccttaaatacttttttttttggttttattttttatttttatttttttgagatggagcctcactctattgcccaggctggagtgcagtggcatggtctcggctcactgcaacctccacctcctgggttcaagcacttctccagcctcagcctcccgagtagctgggattgcaggcgtgatttttgtatttttgtagagatggagttttgccatgttggccaggctggtctcgaactcctgaactcaggtgatccgccaacctcagcctcccaaagtgccggcattataggcgtgagccactgcgcctggccatttttctggttttaaaatcaaggaagcaactaggtggttgttgggtttttaagtcatgaacctatttgtaaaggagcgtgctttgcctgatattatctactctaacccagtagatttataaacactaatttctactgttttaagaccactttttattaaaagcaactaacagtaaataaaaccaaccactaaaagagataattttatcaagaagggtttaaaacaataaacttttagatcaaatatagtactttcctcatttatctttcacttttccttttgtaactatcctagacctcatttcacacatctcacacagacattggttagaacaaatgcttctttctttttcttttttttttttttttgagatagagtttcactcttgttgaggctggagtgcaatggcacgatctcggctcactacaacctctgcctctcaggttcaagcgattctcctgcctcagcctcctgagtagctgggattacaggcgcccaccaccacacctggctaattttccatttttagtagagacggggtttcaccatgttggccacgctggtgttgaactcctgacctcaggtgatccgcccgcctggccctcacagagtgctgggatttcaggtatgagtcaccgcgcccagccagaatgcttcattcaaggcctgctgaattcctattcggagcctaacccaccctagagctgtgccttacaggctagctctgcctgctgcattagctccctgtgtctttccatgtctgtttattgatctttcttttttgtttttgtttttgtttttgttttgagacagggtcttgctctgtctcccaggctagagtgcagtggcactatctcagctcactgcagcctcaacctcctgggctcaagcaatcttcccacctcagcttcctgagtagctaggactacagatgcttgccaccactcctagttaatttaaaaatttttttttgtagagacgaggtctcactatgctgcccaggctgctctcaaactcctggactcaagagatcctcctgcctcgggatcccaaagtgtagagattacagacatgagtcaccacacccagtctgtttgctgatctgttttaaaggaatgtctacattcaccttttctaggagtcagttctccaaatcactctacctttcactttgtaagtaacggtggggaagaataaaataacaataaaataaaataaaaacaaaactatattcactccaaagagaagaaaataattcccttttgtcctttaaagagtgaaaatattcattacacaaatcagcaatgtccaccaaaggccactgctcatcagcacttagtgtagtttccagagaaaacatctaaaatgcataaaagttaagcagtttttgtatacctagcttttagctgatttcatgactgctgtatagcttctttgtagatagtttctgcagctgtttcatgaatgttatggtatgcctgcgaattgaattgaaaaagactgagttcacacggcttttgaatcagtaagctgaagcccagaggggttaggtacattggactggaagcagaagggatggttttaaagagcagctggttgttcatcttcactaactggcaggcagcctttctggggtgtagctgcgctgcaggttgcacaaaagagtctcaacgcccctcctgctacccaggcctagccctcgcagcactaaatgggtacattcttgacaaataagaaactggggcccgatatgctgattcccacatctgtatttagatcccactcatgacacagtgtatgaccacaagcaggtcacttaatttcactggcctaagtttctccatctgttaaagacatctgttgtctgtcttataggtgaaaatgaaaggaactagctatgcaaagtatataaaccacagtgggtgcctgatcagtgtgacatttccatcttttccctttccctctgaacattcccctccccaaagacccccgaagagaaatggcatgatatcttctgccaacaaactgatagacgccagggtgaaatcagcggaattcaacttgtgattggcatgcatttattaaaacatccttctgctttcaggaaaatcagagctctttatttcagatggagttatctcgttggcttactatttaaaataagaatttgtaccactatacgttggctaactctgatgttaaaggaaacttgctgaaaactgatttttgttttggcaaaatatagaattactacttttcctggtgggcctaagccagattcagtgccaagagggaggtagggagaagtagggttttttttttttttgccagcagatgccatcaatcttgaagtattctggacaagtgaggagagcataaattaagactattgacgtcaaaatccagataaacttgaatccaaatcctagtctcatcattttatcaactatgtgcccttgagcgaattactgaatctctctgagtttctcagctgattgatctacaaaaagaggaatatacatgtaaagtggctagcacagtgcctggtgcttactcagtgctcaaggggtgggaatgggggaacgtaggtgtttcacaataattattgccatgaactgggtatgtaggagatgaatctgggggagcttctgggtaatcacaaaagcatgagtgactgtgatgagttgtattagcttctgagggctgctttgcttgtaaagtacaaagtactatgagccgggtgtcttagaacaacagacacttattgtctcacagttgtggaggctagaagtctagaatcagggtgtcagcagggccatgctccctctgaaacctgtaggggaggatccttccttgcctcctgtagcttctggtagccccagatattccttggcttaggccatcgtaactccagtgcttccataatttcatacggcattctccctatgtctcttcacagaggcttccctctgtgtgtgtctgtgtttgtgtccaaagggcaccagccacactggattagggctcatcctaatgacctcatcttgattacatctgcaaatattctgtttccaaatcaggtcacatcctgaggtactgggggttaagactttaacatatatttggaggtggagtatacaatttgacccatcatctgagtatacatacttctagattaaatgcaacgagcctgggcattacctccacattctaaaattgggcacaatctccacacattgggcacatttcttgcaacctagagaggcctattgtgaaaaatgatattgtgatattggttagctttctaagtgaatattttctcgtcacaaaagagcaaaagttccctagactcaagcgtaggcagggactttctttttaaccccactgagtgaaaggcaaccaggaagtgtgtgcatgtccattcaccccaaaggaaacagccttgcatcatagacagagccatcccaggtctacataagttcataccatggagaatatttttcctacttgctttccctttcctgtatatatgttcaaatgtctgacattaatgaaacattcagtgtgatccagggaagtatcatgagtctgtttttcctgaatctgaaggttttggggctgggagggagatcatgtaaaccaccccctactcccaggaaatggagtggctctgtgatccagctacccctgggagcctaggaaggcttaggtttcatgagcccacctcggagctacagggaaatctccatccaagatccccagataccagaggacaaaaggaacacagcaaagggaaaaactgaacatccaagagaataaatttacaacctacaacagaaggcatctgaaaaagtcaggtggactgccgcttcagtgtaatgaaccactcacctgaataaacagtacaaggtgctggaaattgtggaaacatgattattaacaaagtagaatccttcaatccttaaactgactactgtattactttcctagggctaccttaacaaagtatcatgtactctgtggcttaaaataacaggttgtccttcaataggtgaatggataaatgacttcagtggatgagtggataaataaactgtggtgcacccagacaatagaatattactcagaaccaaaaacaaatgagctcttaagccatgaaaagacatgcaggaaacgtaagtgcatattactaagtgaaagaagccagtctgaaaaggctgcatactgtaggattccaactatgtgacattctgaaataggcaacactatggagacagtaaaaagatgagtggtttctaggcactagggcaagaagagagggatgaataggcagagcacaggggatttttagggcagtgaaaatagttggtatgacactacatttgtccaagcccattgaatgtacaatggcaagagtgaaccctaatgtaaactatggactttgggtgatactgatgtgtcactgcaggttcatcagttgtaacaaatgtactacacttgtgagggatgtttataatgggagaggttatgtgtgtgtgagacggaatatatgggacatttctgtatcttcctctcaattttgccatgaatgtaaaactcctctacaaaaataaaatctttaaaaataaataaatcacaagcagggttggttccttctgagaaccgtgaggaagaatctgttccatgcctctgtcctcacttctggtggtttggcagcaagctttggcatttcttggcttgtagatgcgtcactccaatctctgccttcacatggccaagattgtctccctgtgtctcttcttagcgtctgccctctgtgcaggtctgtctgtgtctgaagccaaatgtccccttttgataaggacatcagtcatattggattagaacccaccctgataacttcatcttcactcagttagctcggtcaagtccctgtttccaaataaggccacattctagggtactgggagttaggtcgtccacatatcattttttggaggacacaactgaacacatgacaaatactgaaagatttaaaaattgtaatgtgcagtttcataatttaatccataagcaataagtgggataggctaggcatggggcctcacacctgtaatcctagcactttgggagtctgaggcaggcggatcacctgagatcaggagtttgagaccagcctggtcaacatggcgaaaccccgtctctactaaaaatacaaaaattaaccagatgtggtggtgcatgcctgtaatcccagctactcgggaggctgaggcaagagaatcactttaacccaggaggcagaggttgcagtgagccaagatcatgtcatcgcactccagcctggggtacagagcaagacaccgtctcaaaataagtaaataaataaataaataaataaaagcaataagtgggataattattgaatacatttaaaatgccagctggccatgcatggtggctcacacctgtaatcccaacactttgagaggtcgaggtgggaggattgcttgatcccaggagtttgagactagcctgggcaacatggtgaaatctcgtctctacgaaaactaaaaaaattagctgggcatggtggcacacacctgcagtcccagctactcaagaggctgcggtgggaggattgcttgagctgggaggtcgttgttctcaccactgcactctggcctgggtgacacagtgagatggtgtcttaaaataaaaataataaaaatcaataaatgaaatgccagctggctgaagtttgttggggcagggaggacagctgggtccttccctcacaggtaaaaaacctgtataaaaccattgggtctagggagcttttgcctctttgtgatcaggaagtattcgcttcttagaaagctaactaatctccctgcatcgagctctgatccatcaattctccgtgaagtctgggtattaaaccagccccaaagaagaacagaaaaggggattatcctcttccactaggacacatgccttttctggcatgggaagataaagctctctgatgataaatttccaagtacattttaatgagaaatgacatggattaagaaagagatagagaaaataagagatgaaaggcattctatttgttggacatttttagccacagttctccttgtacacccctcaaaaaagaaagagaaaagtaatcaacagggaggaacaagggaacacaaagaggagataagaattttcttctacatgtattctgcgtttctcagccttctgtggtgttactatcatcaatgaaaaggcatttaagatccttaagttagaaaaatcttttctgcccaattccccacttcttgtttggaaacaagaacatgctctgcaagacctgtaagcacagatttaatttccatcatgatgatgatgataaaattttaaaaatggtgaacattcatatagtactaactatatgccaagcactgttctaagtaccgtgcaactattagttcatttaatccttacaactccactatgacttccgtggttagctaataatgtgttacctccatttgcagatgaggaaaatgaggccagaggggttcactcacttgcccacttcctccctgcttggacgtgtgtaagactggtgcctggtttttggctccaggctggctcctggtggctcccctgctctctccagcttagcatttatgaaagttattccctgtgttttcagagttctaaccgctagtctttgagtgggtgaatctggcagcagctgtgttattacatcagatcctgcttgatgagcaaacttctcctcctggaggagcagggctggagggctggagaggaaggatctagcaagagactttgagttctataactctttcccttaaatatctagcccaggggtctaaatactgctttacaggccctaaaaagaagtcatgagtgtacctctttccccagcaggagacatggacttccgtataactagccaatcctctaactccattgttattaatctcacatgactttgtatgccaattcaaggaaaagaaactcggcataattttggacctctctatatcttttttttttttttttttttttttgagacagagttttgctcttgtctcccattctggagtgcagtggtgcgatcttggctcactgcaacctccttttcctgggttcaagtgattctcctgcctcaacctcccaagtagctgggattacaggcacccaccaccatgcctggctaatttttgtattgttagtagagacagggtttcacaatgttggccaggctggtctctaactcctgacctcaggtgatccacccacctgagactcccaaagtgctgggattacaggcatgagccaccatgcctggccggacttctctatatcttaagttctaacccctgtcctgtcaaagccagagaactgagacctggaaagaaatgaatgggctttgctgtcgtgtaaagagcccccactttggggttggccgggtgatggctaaaatgctgtgtgtataatcctgggcaagtgatttgacttctctgtgccaggtttgcacatctagattgtaaaatagagcaatcatgtctattcaatgttgttctaaggatgagatgagatgcatctgcctggcaccttgtaagtcctgcacaaatgcaaattatcactgttaagtaagcttcaccatcctgtaaaacaatctgtttgactcacttattccaagtaagattggctggacctgtacattcttctttatttaaaactatcaatgttactgttcatttttaaatagacagtggctatgatttttagtttttttagccttacaaatgagaaacctagaacttcaacaagcagtaaaattgagcaggttaggtattcctcactagcagcataaacccagcagggtgaggtgattcctagggcctcctatagtctcctagcagccctgataccctttgtttacgggtccctgggggaagttgaggacttaaagtctctctagtaggcttcagagctccttatttgagcagaactgtgacatcttggagaaagaagagaacaccaccagtcagaaaagcccacaattgtagtggtgtcccggttctgaatacaagttacctaacgcctctgagccaatttcctcaactatgaaatagaaataatagtgcccgtctcacagatactataactacgaagatcaaattagatcgcatatacatgatgaaagtgttctgtaaaaagttgccatctgtctttgcttggatggacctgagttcctgagttggctctgaaaacagcttaccacgaaacaggataggattagtgggacagccttgctgacacagatcataacagggagatgtctcattttgacttggaagttgcactgatatcatagaaaataaaaaaaccaggtttaactgttggttggtaccttgtgagaagaggaagaaggtgataagaactaagatcagagcatagtagagaaagtagccctgtaaacagaggagaagcagaaagagagaagggaggacagagcttttattttgctccaggttaaaaagaaaaaaaaaaagcacattacaactctatgttcaggtgtctgtcccaggtcctagaactggaatagaccaaccaagcccaacccttcttaaaagtaagactaggtgcttcctgattatatattcaactgcctggaagcatgcaagtaaaatttccttgatggcatttctaagtttcaaacatattcttcctaaaaatgcatttacaaaaaatattaggattgtgtttttttggtttggactttaaaaaaaaattgttttcaaaaccataattgtggcctaccccaaatggattctcctccctacagtgaggatttcatttttccagtccccccccgccttttcatttttgatgaactgcacatgttgtgggagccactcgtgggccctcagacacgagcaatccttctggccgctgccagtgtcctaataagggaatgaacaagcgcctattggtgagggaaggggagtcaggcggtggatgatatttttgctgattaaagaggataaggtgtggtttggcaggtatctcattggtttggctggctccagacctaggttttttctcttttttcagtttgaattctgtagaacagactgctaagaattgttttttcacagatctctaactgagctttaggaatatcatgctgacacagtttatctatgttgaaaaaagataggaatttggggttacatgatgttttcattaaaagaggttgaggatataggttaaaatcttctcggtcaccaggcgatgaaggtgatactggacttgatcaaatttagtcatggagagaacaagggatataccattggatatatttaacacatgtttaaaaagttttaaacatttatctatgcaacaatattaagtaacacctacttttgcttgtaaatatttatattctccaattttaaaataataaaagaaacaaaaagagcctggcacttaggatcatagtgatgagttgctcatctatttcctgtctgatcactaaatacctgccagtgactcctctctccactctattttctgaatgactcgacactgccttttaacttaactgcatctggtccacagtgttcttaagtcactcattatacgtcagtgtttctcacatgagctgcaggctggaatcatttggggagctttcaaaagttctaatgtctagatcagacctcgagcaggattctggtttaattgatttggggcatggcctgggcatcaggattcttaggcacttctccaggcaattctaatgtgcagctgaggttgaggacctcgagaagcaactgctactctgaaatgcatcctctattggatcatctggccccgtaaagggccaggcagtttttcttcctgacattttgaaacctctcaagaaaatactatatatatatatatatgaaacaagttagacaggtttcctcccaagttggtagattcagttcggttgtttaaaactcaacagtagagaattgtgctttcaaccaaaatcaacttctagacacatgggtattgtttaaactttattttccatgcatataaggagtgaagtactctgccaggtagttgaaaacagtatccatttcaaagtcataagtaatgagatgagattttttatattttctctgtgtccctgcaagttattcatcccttgatatttaatttagttaatacatgcctcttattttactttttcttataatattaagccaacttcacatcctggaattgtgaaattgctgtagcaaggataggatgatatgatcgagaagtttaaaaaaaattttcagattatcaatttttaaaagtaagaggatatggaagtgcagtgcctgcatggagagaagttttgaattttgaaagaattttggattaatcaggtgtctagaattactcattactctcagcttccttactggatatttcattaccaaggaagaaggccatttagaaattcaggagtgcaaaggctgggcgtggtggctcacgcctgtaatcctagcattttgggaggccaaggtggatggatcacctgaggtcaggagttcgagaccagcctggccaacacagtgaaaccctgtctctactaaaaatacaaaaattagctgggcatggtggcaggcacctgtaatcccacctacttgggaggctgaggcaggagaattgcctgaaccggtgaggtggaaattgcagtgagccaagatcacgccattgcactccagcctgggagcctgggtgacaagagcaaaacgcagtctcaaaaaaaaaggaacttcgtttggaagtgcagactgagctgggaatataaattagagaatcctcaccttaaaactgacagacaagttataaacatagatgatattatccaaggagcatatgttggataggagaagaaaggagttgaggaagaaacccaataaaaggtacaaaagaaactacaaaataaatttaaaaacagagaatctcaaaaagggagatgtggtcaacagtgtcagagctctctgtgggatcaagtaagattgagagcacaaagggacattggacaatttgtctcaaaggacagcttagaaagcacaagcccataacacaatgtcattttggagttagggctactaatacctggatcaaaaatattgaatatagtcaatatagtgttccgatatatttaataatgaaactgaactgttcttttgatattttgatcaactggtcaagtgattaagatgtctggaactaaaaatcactagccccgtagagatccatctcaagatgattttaggtcaactaccaagtaggttaaactaactgataaacctaactccaaaattgaatgtaaactgacaagacagcccgtgatagggtggatttaactattttgggctattaatgacttatccattgaatttcagaaccagttttggctacagcacatgaaaatatttccaaaggactgctaaatcaaacatgctcagtttacctagttgtactgagttctttttgcttcccacagacattgcaaaaggccaaaactaacactaggcttgatagtgaaaagagaaagaatataagaaatttgcaagggaagatggtgcaggaggagttatggaggtaaaaaggcatgtgctggagttgcaggaaaatatagaactgctctattcatgagccaagccaaggccaatcacatgacaataaaaaagactgatggcacatgcacacacgtacacacacacacacacacgctcttgaagcaggccaaagtccacagtctcactggaaaacaccagttgactccgtttgactttagcacctgatcattgactaggttcaaaagtcaaatacttttcctgtccataatcacttggtcttcttagtaagtaaaatatccattttccagctctgaactcaaggggattttctgcatatagttgcaacataatgccatctccagagaaagtaacatgggaatgagaagcaaagaaatgcattaaaacatttgcattctggaccaatgagcaaaatgcaccaagaacctacctaagcaaacactggcaagaaagtttgtggctagtaattgcttctgactattggcaggaaggaattgaaagaagtgcaaagtgttgggggttccatctcctgtatttttttctaaaaattcttctgtctccaagcctagcttttagtaggctgccgccgccactcctcggttggtttaatatggttttgtcatgatgatgaaactgaaacctgagaggtcatttcctttttcttttttttttttttttttttggtgaatgatcaggcttcaccttctggaactgatggtcagaaagcgagccctgcagcccatagcaacatggcagcaggtgtagccaggtattcctggttcatatccatgagccagtatgaagtgtctgcttttaaagccactcacaaaacttccaacagagtgtatgtgtgctctgtgtgtgtgcacatgctttggttttggggatgaccttctcccgcctctgttactgagagaagataaagctgtaataactttaaacaccatttttgcagtaaatactcataagcctagcatagaattgtcagcctttccctacacatggactggagtcatatttcattgatctgccttttaaggaagcactgttgttctgtatatgacactaaaacttttaagtcttggagtatttggcctttccatgttctgatttagatgaatccacatgagcttaggcagttcacctcttattcaggtataggttagcctcatgatggctattgctttgtgttttaatgccatatgcctttcttgactgcagttaactaaaaatacttattaaatccctgctttatgcaaggcactttgagaagggtgctaaaaatgtataaaacttgacttgctttcaagaaacacatgccataatatgggagataatacacaaataacagcaatagagcaatatgtgataaataactggaacaaccacagagatttcagaggcattaaagagctccttctagttgacttccatgatggaagaatgtagcatttgagctgacattgatggacagataagcggggtctcggtaaaaatggagagaaggaaagaaccacttaagtgtaatcaaagagagcaagagagtataaaatgaagttgaaagaaaaagaaagaaagctttactgatgttcgttatgctttctggcacgagcacctcccctcaatttccgaccccatgtgactggtcctgagagcatcacacaaaaatagtgccctggaaaaatggaacatgagtcccctgcacccccagaggggagaacagtggggccttcgcttggccctgtcttttcagcattctgtgactcaaggcagtttacttgactgggtaaatggatttaccagtggtaaaccttatctagtttaaacttcatgaaatagacctgtactgagaaggatttctgcagaagcttcaagcagaggtaacactaataatgcaaacccaaggcaacgctgacacttacacacggagaggacactaatgcttgtgaacgcagaccagtgcgtcctcagctcacactttacctgttcctttcagcaaggtgagtttacagcagagagggggaatctcactgcttttcagaagtaactcatgagagaacagatcttttggaaaatggcagcatttttttgtgattttgctggtgaaaaagatgtaaacatgtaacctatcaagactatcatatcttcatactccaccttggaaacattttctaatgtatttaaaaatctccccagtgaagaatttcagtaggttttgaaactatttatttaaaatgtaaaattgaaacaccttgggattactttgaactggaacaactgattgacatcaggacagacaatttttgatacaattttctaggcaaattgtatcaaaaaattgtgcatggttagtggggcagatttaagatattagtactgtgcttccacctgtcaagccaattatgtgtttctttgtatatctttggggattaaaaaaattaagcggggctgagcgtggtggctcacatctgtaatcccagcactttgggaggctgaggcgggtggatcacctgaggttgggagttcaagaccagcctgaccaacatggagaaaccccgtctctactaaaaaaatacaaaattagctgggtgtggtggcacatgcctgtaatcccagctacttgggaggctaaggcaggagaattgcttgaaccagggacgtggaggttgcagtgagccgagattatgccattgcactccagcctaggcaacaagagtgaatctccatctcaaaaaagaaaaaaaaaattaggctatgactgtcatttaaaactaaatgcctaaataaactgaacttagaaccagaccttcacattatcgattacaatgcattcagccaagatgtttcaaaaataattaaagttttatgaacattaatagattaaatttaacattactttaaatgtatctttgttttattgtcattctgtccttttaaatttctgttcattgtgttttgtaatgtctacaaacatttaaataacactacatgtaatttataaatgactatacatatacgtataaatgtatatgcatacataaatgtatatatcagtgttattggtgcatgcttaatttttaaaattgattgtagtatagtatgaaaagtcatttagaaaccattggcttagatcatggatcaccaaacttttttgtaaatggtcagatagtatatattttcaaatttgtgagccatacagtttctgtcataataattgagctctggcactgaagtgcaaaacagccatagatgatagaggtgtggttgtattcctataaaactttatttgcaaaaacagagtgggctggctttggcctgcaggtcatagtttgccaatccctggctcagatgactgaagctctttgttagtctccagggcaccctaagaaagcttcctattgtagaaagaaaacaggtataggaacttgaagacctgggtcaatcctgattttgtaattacttttatgagtcatttcacctcttagatcccaggttaccaagtataaaatataaagcttgaattcgaaataatgtcaaaattccttctagtttcattaatctatcatcttagatgctcactaccttgccacaagcagtggatttcagctgggctctgaatggaagcagaataagtgaaaatccaatttaatacgaggtgggcaaagtgagttcaaaacagtggagaaggtgacaagaataaaaaaggacagaaattccattctgaaaaatgtaaagtcacagcttatggctcttgaggggtcctccatggtgctgctgttctaaatgattgtaggacttgctcaactgaagtctcctcttgcagctaagatggatgggatccttgatatggggtagctggccctaatttcttttatttcttggggaaagctgcagagtgaaatgaaacacctggagtggagattgaaactagaaaatgtgtgctgcccttccgggactcccttccacagggccatagcctttggaaagagccttatacttcgttaaatgattggtctgctcttctcagttcttcgaagccatctttctgtatgtaccaagcacgattggcgcctcactaatgcccttcatgccttccaagccctagccagatggaattgtgtgcttttccataaccatatttcccgattctgcaaccttgctatttgagctttctgtacatggaaaggtcctctttcattcccccagctcccaatgctagccatcccaaaagagccagcttgaataccactttctttatgaagcctcctctgatcccttagctggaattgccttcttcctcctctaaactttaaatcactttaagtcttctgtaatatttaccacattctacctattatcacatccttaacaggtcttaacttccctacagattatgaactcctttcaggggttgaatttatcttggtttctgccctcactggcttgaatggagtaaatgttcaataaatatctgttgaatggatgtgctaattccagccacctgtgtgtccatttccaggttatagcagcaagcattacctaccagcatcccacaaccgcaagttcagactccaccttggtatctggcagatggttctgaacaatggtttgccacctcctcctcagaacctaggcccccatgcctcctcctcggaacctaggccttcatgcagcccccttgctgcccagagctcaccactctgatgacagttctgaattgaactgtccttgcctccaagtctaggttccacgtggatcagtcagggagaggaatgtataccagattagcaacccataagtcagtgccagtgctgtcactttgtaattcagaaatatgaactttttttttaagtcaagtcagtgatcttcaccactgaagcagttcctcctgtattaggtaacaagtttaaggaattaatgattacattggtgatctagtcagaagacagcataagccttattggttagtaaactaatctaaccaatgaattaggatggaattgccttgttgggatagaaatctgttccaggagagacaggaaccctcaagtcatttaagtgctgtagaatgtctctaatgctcatgctccctctctcagagtcctgattccctgagtcttaagctgttggtgattctaactcaatttgcacacacaaatgtgggtgcttagttatttaatattattctatctgttaaaacattcacatttttataggggtcttctattaactcaaagggagtctttaagcatagaagattctacttggtttggtttggtcaggctggctttttaccaaatcacaacaaatgggtgtttgcttttctccctccacattgagcaggccctgtgttaagcaaggtttccactgatttaggaagatgatctatcaagagcagagaagactccttgacttcttttctcaacagtagggagatgggacccatgagcagtggttgactgccaagtcccctgcaagaataaatattctcttcaatgggcaaagcatccatgatttggcccttcatttcccatttcctgtctccactcaaggtttgtctttttactttctgccacttgtacacaaagctctccaatgctagcacatggagtgggggtatgagccaactggatgttagataggtgtgtgcaggacctctggagtcaggcaggtagggttcaccccattcttgttagaatggcagtgacttcttccctagcagagctagcaacaatgccccagtgtcagatctatcatatattacagtttcctgtctgaagaagagatgaggggtacaagagggaggaacaagatgggaggcaatgccactcgagtggaaaggagccctgggaaggaggaaatgaatagtaaatctttttccaattaagaaaaatgagagtggaagcagaaaagctccagagggcacttttaggggagggaaagatcataaaaggcctgttatgaaaatctattacccataaatttccccacattaagcagagcctgtctagagaggatgctgagaattcactcagctgacacaagatatgtgacttgatttagtggcatccacatgctgtgtaccgtttccattggcatgtctgcaataccactttcccttgcagggatcccctttaattactcgcaggcttataatctccatttaaggacatcttgcttccattttccaatcgctttatgtcttttgtcagatgtttaccgatgtgatagtggtaccataatttgaagctcaaccacatgagattatggactttagtattgcatcacatgaacatttcagatttagggatgagtcgaacttctagatcactctaaatataagacttatctaaaaggagttcatattttttacatttgaagacgacagtggaaatttctctttctaggtgattgtcttcagatacgaaaataatgtgcttgtttatatacctgtggtcaaatgtcattgcatccaacttagccagtagaaatgtgagaatatccctacatcctgctctggagcaggtgtgattcagttgcatatccagatctagacctctatgcaagagaaagagctggaaaaatatagtgctgccagccatcgacacctgggtctgaactgtttcctaatgttttactttttttaaacgactaagcccaaggtttattgtccacatctacgatgcacattaaagcaaaattgtcctttaatagataatagcagtcaaagaacagctccaactcagattttacttttgattgacaacattttttaaaagcctaagttcactgaggatcatatttatttaaaaaaaatttttatttttttgagacggagttttgttcttgttgcccaggccggagtgcaatggcgtggtctcagcttactacaacctccatttcctgggttcaagagattctcctgcctcagccacttgagtacctgggattacaggtgcgcaccaccacgcccagctaactttttgtatttttagtagagacggagtttcaccatgttggccaggctggtctcgaactcctgacctcagatgatccacccaccttggcatcccaaagtgctgggattacaggcatgagccagcacaccaggcctatttaaaattcttactcattatttaagactgttataaacaaagaattctaggttggggatgaagaaaaggtaaagttcatgaaaacccaggtagtaactgggcttatcttttttagccacatttataccagttgaatcttaaataatgatggaaagagaggaaggagtttggttattttattttaattatcttcctggccacttaagcattcataactccttttcattcatttcagctaaagtttaattcaagtaactaagtcaggagcaatagatatcttctccaccatcaaccctgtctttccttacatattctttgtaaacatttataaattaaaaagtgaatgtttgtatctgagcaagcttattgatttaatagggtggggtagatggggtggtgcaaattctgtccctgtttgtggcaagatgaatagattttagtttatcttaggaaactgtcatggacttatccttccaaaatccatatttactggggttggcagatgcactatttcttttaaaaataaatgtgagaaaaatagcaactcaataaaagataaatccagtttctattcattttatttgtactgaatatcacaaaccatttctggatgttttaaaagaaaatggcaccaattgaaaaagaagttaaacatctatcccatacaaattataatctcaagaaatgtttggaaaagcttgtgcctcatctgttgttataaactacagctattgatataaacatagatgaatctcaaaaacatcatgtcaaataaaagaatcacagaatgcatgcagtattgttatgcatagtttatttaaggcaacactgaaaaatatgctgtttagggatgcataccatgctggtaatactacaaagaaaagcaagagaataattcagagatcttaaaattcaggctggtgcttatttggaggcatataaaaagagatagggatgcgattgaagaggagcacataaggatccctaacaactggtgctgtttacattgggtagtaggcacatggttgtgtgtctgattgttctttaaagtagtcatgtacatggctaggcgtagtggctcacgcctgtaacccagaactttgggaggccaaggcaggcagattgcttgagctcaggagtttgagaccagcctgggcaacatggggagaccctgtctctgcaaaaaatacaaaaattagccagatgtggtggtgcacacctgtagtcccagctactcagggggctgaggtgggtggatcacatgaatgaacccaggaggtcgaggctgcagtgagccaagattgtatgagtgcacaccagctgggttacagaggagaacttgtctcaataagtaaataaattaataatagtaataaaacaaagtagtcatgtaccatacattcatttgtaggtacaatataagtcatgataaaagtctttttagcttgaaataataaacccaaacaattagaatccatcattttaaaatgtcctgtgaatatgtgcatggattcagaaatgagcctgtacgcttggggatccgcctgccctggagcaggatcattctaaaaactgtccttttataactcagagtcagaatcagaactctcagtactccctgggtgccttctaaccatacaggacccaccagacctgatctatttgttggacaggatgttccagtcataatgatgctaagaaccagactgctatggtatgtgtagacacaagaagaggattttatgtcaccatgtactctgttctgcagcatatttcccctgttagggtctgtaattatagaaactcatccaattatgggatgtcaccattgtataaagcaaatgttgggctggtggtgacaacttgtgagtacatacataagaacactaaagcttccaagtacacagtgttttattattgagagcccaagtatggttggtatgcaaactttagtgactctcaaatatgtctatgtatggggagatggggtgggagaatggggaataaatgaagtgggaaatgctttgcttccttagtaactttcttccaagtaatatatccccttgcatgctctcaccccaggaaaaggcacaacactgatacagcaatgaaccccacaatgaaataatacagcacttttccatgaaaattttttttcttctaaaccaagagggctttctttcactctatcctgtattaataacagaccaattcactacagactacttactaataaatgtctaaacatattctgatatgaaaaatatttttattttcttgattttttttcctccataatttttaatgcttgccttttaaggaatccaaggaaaaaaattcagagttggattttatgtgaattaaatgaaaccacaacattttgcagacaccacatataaacaaaatcatatttaagagcctggaatgtttctataaacttcttttaactttcaaacatacagtaaatctgcaaggcaaatatgactcatttcagtagctcaggattttccctcctgatcacagtatggtctgagattttgctaagaatgtttgagcaatttatagagctatttggatatgtttggagaatgtgcttgtatttcatgctatgaaataaaatccctgggggttttggtacatgaaaaagaataatgaaagtatgtgtgagtcattttgcctccaaatagttgataagcatgtttctaacctacatgaggtttttaactttttaagttggatcccaaattaagacccaggttcagacaatgccattagcagaaccaataatgatgggaatcaaataaaagtaattgactaagaagtcatccttttttgaggctgtgagccccaggcattcttctttggggtgtggccttcatggggagtgtattgctgcagaaagctggggacagaatagtgttctggattgagtatctcagttaccagcctgaaatctccatcgaccaacactgccttctctcaaatgacttcttatatgaaagtggacagacagtggaatgcagaaattttagagctgatcttggggaccggtcaactgtctactggccagtaagttactatgaattcaaaaatggtgaacttcaatagcattcattctgtcagatagtgagtttatttgatctgttggaattttaggtgcagagttctttttcaaaatataggaatgtgcagaaacaattaaggaaaacagacttggaaactttgatctgaatggagtcctctttaagtcttttataactgggcttcactacaataccttgagccttttgttttctctgaggctttttctcacttaacctgtgtgtctgcatctgtgtctgcatttgtgtgtgtgcttatcaagcacagggaatattgaagaacacaaaaaagtttgaaggtgacaattcaaagtctatccactggcaatcttgtaatctctttcaatacagcaattgttctctagcggtgaagattttgaaagagattcccaaattcatgtccacaccaagtattttctgtagtctgatgaacagttgtctcatgtatgaaagactgtttttcaaataagcttatatgcactggtttataatatacagattcctttttatgcactattgaatttatagatattttataaaacactttatcaacaaataacaaaagtataagcaattgtcatgagatcttaattttttcataatgttttaaaaggatcctcattcttaagatgttagaaaccattgcaatacaagatctagaagattacatcttttctctaatcttaccagttagcagtggctatcttagtgtgtgttgatccaacttggctatttgaaatgacaaagcatgggaatgtaaattaaaacaactgctgtggtccggcatggtggtttacgcctgtaatcccagcactttgggaggccgaggcgggcggatcacctgaggtcaggagttcgagaccagtctggccaacatggtgaaactctctctttactaaaaatacaaaaattaattgggcgtggtggcaggagcctgtaatcccagctactcgggaggctgagacacaagaattacttgaaccaggaggtggaggttgcagtgagccgagattgggccactgcactccagtgagattctgtctcaaaaaacaaaacaaaacaaaacaaaacaaaactgatcttttaaattttaaatttaagtgaacacatactatttcacttctcaatatctaccctaaagaaatacttgcatcgtgcaataggggaaaaaatgaaagaacccaaaatgtctttctatagaatggttaaactgtgctatcctattacataaatgatgaaaataaaggtatgccctagtgaactgattttggcaagtcctcaaacacattattaaattttttacatggcaaaataactatattatatatcccatgtatgtaaaaaatacagcattgcaagatgcaaatccaaacttgattaactatttggttatctaggtaattactcagagtaatactgtgattatcaacataaaataagtaaatatttgtactctctatagacttaaactgttctttttcattctctctgagtctttaatgctcctaaacatgtaataaaatcagcaccctccccataaaaatgtctattatttttccctgatttaatttttaaacatggcttcctcataagagatcttgtcttgttaataaaatactattgccacaattttacttgaacctttaaggatgatgtcctatagtctcaaaccagaagataccaaaatggagaaaagacaaaatgaagggaataagagcaacattctttaaactacggggaacacggagtaaaaaaatcaaacaagacgacctatactatagttgagatgaaaataagaattttgccagtgttgcagaagttttgagaaatatttgctagggaagctggggtcgggggacactggggcaagaggaaaactcgttccttgctccagtgtcttgctacggaagcttctgcaagttcttctggctctcgtctggcatatatttagaccctggcccttccaaatgtaataacatctcattggtctcctcatttgccatgtctgcaagactttaattcatttgaactttctatctgaaaggcacaaactaaaacatggttatcttgttacttaaatacactgaggcagcaaggcctggtgttaaagacctaaaatatcttcagtgtaaaagccacagcattagaagagagctttcccattgcatatatatttttttcttatcttgtaacaccagggcccttaagcaatggttccaggaatggaagaaaagccaatcctctctactttttcatgctactcgtacaatcaaataacatcatgtggttattatggacttttaaaattcgttgcatttattcgtcagtgtgaacacacacacacaagattatttctctttctccaaaatatccaatgagccatgttgctgtcagctgacctttgctgcagaaaggtacctttctccaagtgtttgtgccaacagatgagctaaaagcagttaccaagtaacaaagtggaatactccacaataaaccctcttccaaccagcataggtgggaagttcatggattctggtcaaacaaacattttatttcatagagaagtactttatagatcatttgtggattgccagtttttttaaaaaatagatccacaataaaatgcatttgatttaaactctattaaacaaaattcaataattctcagatgattcagataaacttcaggatcccacactccttctgaatcatctgggaacatcacttggctttgttctgtagcatatggcaaacaggttaatactggcatctgctgaattttcacagaaggaacaaatggattattatgcttttattacaatccagtggttggttaggtatgatttttactagtcagcagcatttcaaatacatttaaatctggcgtgtggaaaatcagaaatgtcaacattttgtctttcactgaagcatgaagcagaccctgtgctatcgtttgatataataaggatcctgtgtacttgtctttttggacaaattctgctttgtggtgaaattagctttcatgcattactggtattaaattgacaatttgtcgatgattatcaaaagcctttaaaatgagcatactcttaaactcggaaattaaactcagaaattctaacttctgagaagttttcctaagtaaataattgaacaagtgattaaagtgagtctgtaataatgtccttagcagcattgtttataagaagatataaagttgaaaacaatcttaaatgtgcctcagtagaaaattggttagtcataatagatccatgtaatcattatgtatgtgtatacctaagtggtaatactgtgttgctattgaaattatatattgctaacatgttaaaaatagtcataaacaaggtaaattaaagaaatggtttgtgaaatgatatgtatgacataaccctattttattaaaaacaaaaatgtctgtgcatgcacaggaaaatggtagaatatatcacatactcatcatgttcaaatctgggtttgcatgattctcgggagtggcttttactttctcctttatatattttgaattgtttggttttaaaaaaaatttatgtgtgcgttgcttttaaaatccaaaagaatgaacaattcagggtacttttttttcaatttcggaagaaaaaataataaacctgtggtgttagtaggatgggaagctcaccatgagggagaggcctaaaagctaagaaatgactgtttgctttgcttgcctaacgctaatgtagggagcctcagagttgaagaattttcacccctatcaagtcatttggcatggacacaattttacctataaagtcaactgatatgttcttgaaccagcaactggacatgttatgattgaaaatgccatgaaaccattttagctctttttttgttcttaactttgtaaataattttaatatgtttctttattagtagtcataaaaagatccatagatattttgccccgtgatatcgttaggctttgtgtccctacccaaatctcatcttgaattgtactccccgtaatctccatgtgtcaagagagagaccaggtggaggtaactgaatcatgggtgcagtttcccccgtgctattctcatgacagtgagttctcacgagatctgatggttttataagggggggctcttcctccttcacttggcgcttcttcctgccacctagtgaagaaggtgccttgcttccccttcaccttctgccataattgtaagtttcctgaggcctcaccagccatgctgaactgtgaatcaattaaacctctttcctttataagttacccagtctcgggcagttctttatagcagtgtgaaacggactaatacactctagtagctgtgtatcctagaaaatgggctcccaatggagaatgattgcctataaactttaagctgtaccaagcaagaagaggtagaagagatagtggagatgatcggttgttcaggttgctccactgagaaatcaaagatgaagagaggttacatgtgatgtggcctacgtggcaaatctagttcatgtcagagctaacagccagcaatatccagccatgaagcccagtgggtaggtgaaaagagaaagatggtaagttctgaaaatagtgggaaattaaggacttaaggttatattccattaaggggacggaggagttttgcttttaggataggtgtataagttcgttcttgcactgccgtaaagaactgcccaagatgggtaatttataaagaaaagaggtttaactgactcactcatagctggggaggcctcaggaaacttacaatcatggaggaaggggaagcaggcaccttctttacaaagcagcagaagagagaagagtgagcgaaggaggaacttgccaaacacttataaaaaccttgagagaattcactcactgtcacgagcacagcatgagggaaccacccccatgatccagtcagctcccaccacattccttcctcaacacctgacacgggggattacaatgcaagatgagatttgggtggggacacaaagcctaaccctatcaatagggatgtcccatacggagttttatgcctcttgcttgtcttggaagaagaaggccccaagtaacagtcatgacctcatggctgatccagagatgtagaaaagcaaattgagacttcctgtttgattagtttaggaagcagttattaaggattgattctccctgttgcggttaaagctgtctaccaagaaataagccaaaggaacattaggccaagaatctgaagggtgaagccaaaccactgggaagggctttctacttcaactacaatgtgattgaattagaaaggaacattcgaatcctgtcatgtcacctcaaattcaacaagtctaaaattgaactcatttttcctcacgaagcggctccttaactgaactttcctaataacaggaagacactgcagtgtagaatgctttgccacaacatatctatctattatttcatttgattgtcacacacaagaaaatttaactctaaaatttaactttaaatttaactttaaaaggttaatcaaagggctgcaaattagtaagagaccaattctaaaacccaagttttctgaatcctaatctagtcatccattatcaactatatcacattgcccccccatatttgtgaaataaaccagcccattttatagaattactaagtgacattttatttgtattggcttttgaggattgcacatgagcagattttagtaaatatgaagtcagattttctcaagtagcaaagaagaaaccaaccaaccttcggaatcattaatcctgttttttatgagatacctcagtgaaaaaacattcatagcattcttattattgaagtcaaaagatgacacagatgaaataaagtactgactctaagcctaaaaatgcctaacttacaactctaacatgagcaaaccatcatcagttatattaggttaatatatggtataagtagtatggttctactgttttgttttaatttgcaaattattttggctttgcaatgatataagaattataagcctgttctagagaagtaccatgcaacattgtacctatagttaacaatatggttaacaattttaacaatttaaagtgtattgtacactttaaaatatgccaacagggtggatttcatgttaagtgttcttaccacagttttaaaaagaattattagcatgaaatgtttacatatctgggtttctattttgtagatatgtaagtaacattgtaataaaaacactgtaactctccaatacaaaaagcagcttcctacacaatgcagccccatacccatacccaacccattgacccatcaagccagcacccatcctttcttggcactctgtatctcagtacacattctaccttcaaaaacagctaagtcaaacgtgtcaaaatagctatttcctcttgagtttgagcatctgcagttgcccagccccaattctttatttggaaataagtattaggagaaacatatctagcatagtgatattgatttgtaatttcctcaaatagacattcactttagatgactacaaaagctaaatagagctcaggagctcgagaccatcctgggcaacataatgaaacaccatctcttaaaaaaaaaaatacaaaagttagctgggtgtggtggtgtgcacccatagtcccagctactcaggaggctgaggtgggacaattgcttgagcctgggaggtcaaggctgcagtgagctgtgatcacaccactgcattctggcctgggtgacagagttagactgtgtctcaaaaaaaaaaaaaaaaaaaaaaaaagctaaataatatatacacatgtgaagtcctctgtgtctcttctgccttcttcagctcatagacatctatctaaatacacacctgtgggccattgtgatgtgcccagcatgtgggtggtatgatactaaggcacattttagagcaaaagaggggggccttaaagggagctgccaccccttcaaaatgcactgactctgaagcatcctaccaattgtcagtaacaccttctctcgccagggaaaaggaactggagggaaaaacaaaatccaagcaaagaagatatcctactcccaattttaataatatttattatttaatataatatttaattttaataatatgtattatttaataatatttattataatataatatttattataattattaaataattttaataattttggcttattagcaccaaagtcccggttggtagtgtaacttgattcttttctgatcttcgtgacagtgtctacacaaataactcatgcaacatgctgtatcttttgaagtaagcattttgtttatttttggttcaatactttgggtcccttcttctaaatcttacaaggccaggcccggtggctcacgcctgtaatcccagcactttgggaggccgaggcgggcggatcatgaggtcaggagttggagaccagcctggccagcttggcaaaaccccatctctactaaaatacaaaaattagctgggcatggtggcatgtgcctgtaatcccagctgctcgggaggctgaggtaggagaatcacttgatcccaggaggtggaggtggcagtgagccgagattgtgctgctgcactccagcccgggtgacagtgcaagactgggtctcaaaaaaaaaaaaaaaaaaaaaaaaaaaactaacccacagtttccaaaggcaacttgcttttgtgcagaatgttttagtttaagttgttatttggtcattgtaaattatcttctgtagctattggattcatgtttttcaaatagttaaaagtttgaaagctagctgactaggtcgctaaacttaaggaactgaaccatccttttagacgtatgtggttcattaagcagtgaagttcagaaaagggctcagggctgttcctgccaagaggttggtgaagacacgtggcaagtggcacgctcaagaggttgtctttgtaatgttgcagaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacaggtactgtcctctttgggacggggagtttctaacttgcgtcttagcctgtccgttgaatggaatttgttgagcagagcattcctttctcagcccaactcaaccctttttcaatctaactggtttaattattttgcagtcattttaggcaactaatctgattagacaggcaatctgatttagacactaggacacactattctatttctctccaccccgttcccatctcataaacataccccagttgaaggcttttatttcatttcacaatctagcatttgtttaatttaataagtatggtgtgctatatcttaaaaataagtatggtctattttttctgtttaattctttctttaaatttcaatagttttgggggaacaggtggggttttggttacacagataagttctttaatggtgatttctgatattttggtgcactcgtcacccgagcagtacacaccacgcccaatgcgcagtattttccccctcacaccctcctacctttctccccgagtccccagtgtccattatatcacttttctacctttgcatcctcatagcttagctcccacttgtaagtgagaacatttgatatttggttttccattcctgagttacttcacttcaaataatggtctccaactccatccaggttgcggtgaattccattattgtgttcctttttatggctgaatagtattccatggtgtgtgtatatatacgtgtgtgtgtgtgtgtgtgtgtgtgtatatatatatatatatatatatacaccacattttctttacccactgcttggttgatgggcatttaagctgcttccatatttttgcaattgcaaattgtgcttctataaacatgcgtgtaccagtatattttgcatataatgacttcttttcccctgggtagatacccagtagtgggactgctggatcaaatgttagttctacttttagttctttaaggaatctatactgttttctggtaggttatatctttaaataaggaaaagtatttacatttattctgtagggtgttgctatctgttttgaactgaagatatgttagtttagtagagtcctccatggctaccattaataggtaacacgtgaatttttaaagtgggcatgaattgcagatgtcttcttttttctaatatacagcctgaatcaatagtctctgatcattataatattcaacaagatacagaattccgcttaatttaatgtgattattcaaacacacttaatgagtttgctattacgtattttctcactcgggccctggttgaaatcagggaacttgagaatgcctaataggttcaacttcttcaaagagggcttttgcagcagaaataaggtcacatggttcattatgctaatggttagtatatgtcatttatattgtcatttatgtgccccaaggtctaaaaaagatgaggatatttgaggaggaaaatggagaaaataattttaatttaaaaccatggactgattataatggttacactatataagatctcacatgtggttttggttttagtttgttttgtttaattcagtctatttagaaaattctaaagggaatgggtcctggcctccttaacccaagtttgagaggctgtattagaaggtttcagaaagcagtcttgaaaatgttggccggtagcacaatattgtttaccctttccctcaataagtagcttctaattggggagtaggtatagcaaaggggaaataggtataatttctagggttcactaattgactttgactcccaatttgacctttcactaactgtatttcttcagttaaatggaaataaaaattatacctttctccaaaaaatgctgctaaacttaaactatgtaacaatacatgtaaaatgcagtgtcttacacatagtaagcactcaataaattttcactgttaccagattcttaacacgggagggcaacgtagtcattcactgccttttccattttcaagctgagagagaaataatagaaagagttttaaaaatggcattttgatgcctttcctgaatcttgttattaatgagtggtcaacaggagctttaaaaattactggtgatctgtagttttcttgcttttaaaatcttgcttttccttgtgcttctcttcggatatttggctgttattcattatttcatgctattaattgaaatcaaattctttttttttttagaaaatcatattgaggtctgagaatgtgtgatttatctctgacatattagttagccacaagaagaataagtcttcttggggctaaacaactctaactggcatttgatatctactgataattgtggtcatgatttataaataggcaaagaaatgttcaatacagtttgttggtttcttagcataagagtactttaatctggctagcactttggaattttggtgccttttaaaaattattagaattcaattgatccaaatggcccctctatagacttccccttaaattataaattttttgcatttgtagggacatttaatccttatatgtctaatttcatggaggcaatatcctgaagcaaaagtaaaggccaagaaagttttaaagctagtttttactctgccattttcattgttaaatatgaaatgtgttttttccaaaattaagtgaatttgaacgttgaaagggccaagtttggtctgaactatgaaatttgatggagtttctaaacattgcaagacaaattcttccaactctggtcacagttctggtatcacatgactggttgtttcctgcaaatagaaaccaacaccctggcttggacagtgtccagcatcctgcagtagtgagggaggtgatggacaacagtttaacttttggagattttctttcctttttaaaataaatgtcaaatttaactgccctttttccactgtagaaaagatggacaagaaaccctttattcatggaaatcttgacaaagaaggtagattgtgtatacattagttagggtaacgctggctgctataacgattagtgcccccaaattttaagtttagtgcagtaacacttaccattatgcatatttctgtctagttggtagaaccagccacctgtcttcttttctcttgtgactctcaatccctagggcttggtgctccctgatctaccaacagacagagatagagaagacagggagtgcacctctgtttgttcattgccttggttggacacttctgtttacatttcattggcagttattggtcacatggcccgcctaggtgcaaagaagggagagggtgcaaatttaatccttgagtggtgatcactccccccaactatggaaggaggagcaggaattgtaagggacacttagatgtctcttccattggggtcactggcgtgagtgtggaatctcaacactgtaatgtacattttcttcctctcaaagtaccttgggagcctccaatccagatcaggaattctagatgacttgatgacatgggagaatactacatgacatggaaggaattcacttattatttcagtttgatccttaagtttgaattccccaagaagcaagtccagaaacaacgatttgactgcaagtcgtttatttgtaaggtgatgctaggaaacactggtggaggtgtgggaaggtaagacagaaaagggaaggccaccaaataaacgttgcatgaccaagcacatcaccactgtgggtatctggagcttcactccactgggaaactctgagatccagtgtggaatacacacctcggagttatcccactcaaaaagtgaggggtgctgaggtatctaaacactcaggctatcaatttttgtttgaaaactgctcccaggggacattaataccgaaagcacttctggcatgttgagtagactccagtccccagagaaaggcttgcaaatgctgtcagctgaaagccaggcaggcgtgtactaaaatggtaacgtactggggatatgggcaagcttggcactactggcatctgctgtagtcctgggtagcacaggctgtatgaatgctgctgactgatgaatgagcaagctgtctttggtgttgttctttctgttgtacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcaggtagaggtgatggtggaagagaaaacaactgaaagccaggaggaaacagtggtaatgtcattaaaaaatgggcagatcagttcagaagagcctaaacaagaggaggagagggaacaaggttcagatgagatttcccatcatgaaaagatggaagaggaagacaaggaaagagctgaggcagagagggcaaggttggaagcagaagaaagagaaagaattaaagccgagcaagacaaaaagatagcagatgaacgagcaagaattgaagcagaagaaaaagcagctgcccaagaaagagaaaggagagaggcagaagagagggaaaggatgagggaggaagagaaaagggcagcagaggagaggcagaggataaaggaggaagagaaaagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacatgccatgcaagagacaaagataaaaggggaaaaggtagaacagaaaatagaagggaaatgggtaaatgaaaagaaagcacaagaagataaacttcagacagctgtcctaaagaaacaggtacagtaaacattttgcaccaaatgtgtgatgcctgtgacttgtgagaaatgtaatgcacatctgatttgggactgaggccacatgcatatagctcacatgcttgatcatttggcaagctgttcattttttcaggccatagcgatacacaagcatgcagcaattgattgatggctgaatattcaatcaaccaaatttactgggacagccagtaaatttggctgtccagaagacagagagaaattaattgctctgtgcttgattgttatgaatacccaaaaaaagaattaatccaaagatgataaatgtggtggtggtgtgttggcttctgattctgtgcttgcatctaaactcgttcttttaattatctttcctctatccataggtctgcatgaggcaagaggcccataactccttacctcactcatgggtttgacgttgaattaaaaaaatgataaaagctggggtgggaaagagacatgaagaataatggtcagacatttcatcttaagaaggcaaaaacaggctgggtacagtggctcacacctgtaatcccagcactttgggaggctgaggtgggtggatcacaaggtcaggagatcgagaccatcctggccaacatggtgaaaccccatctctactaaaaatacaaaattagctgggtgtaccggcacatgtctgtaatcccagctactcaggaggctgaggcaggagaatcacttgaacctgggaggcagaggttgcaatgagctgagattgtgccactgcactccactgggcaacagggagagactccatctcaacaacaaaaacaacaacaacaacaaaaaggcaaaaacaaacccctggaaattaactggtaataaagagggggaaaggaactggttggaaactttccttaaaaaaaaaagtcaaaaccctgatttgccaacatgtagacctcagcttaatgtagacttgcagaaagccattaatttagggtagtattgatttatatttgactggtaattaagagcatacatgctgcttctttattatctgggtgacacaaattcatgtggcctgaggaagggtggaaatagtaggggggaaatgtttgtaagctttgagaaagattttttttctgtctgcaagactgcattgaaagcactgtacctaatcaccaccacaccaccaccaccactcctaaaaaaagaaaaaaagagatgctttcacattcacctttccagagcaaattctctgtcactaagcctgcattgcactgaaggtatctttaactcctgcttctgtacaagaggctcatgaacacagctaaaattgagaccatgagcaaagtgcaccaaaccacacacgaggtttgtaaacacacgaggagtgccacatcatgctagatttcagtgagcgcaatggcaggcacacgagaagatgttggggtgggaagaaaatatcccaccttgctgtttagaaccactgtgctgtgagcgctgagacggcagaagagaagccatcccacgcagcacttgcaaggcgatccgagcaccctgtcactcttgtaaactagaaagggcttcttttacttgtgtgaccttaccattcttgaaaataaaaagggagaagagaagggaactaaagtgcaagctaaaagagaaaagctccaagaagacaagcctaccttcaaaaaagaagaggtaaatatgattgaaaagtaatgatcgtaaagcaacagaaaaagcagtcagtgttccaagatatctcaggtctgatgatctcaaaattgtaacctcatatccagtgtatttcaagccatgactcacagtccactgaatagtgagatcagcttagagtgtctcaaaattaattaaatgtatcagtcagcattttttaaaaaatgaaatggatagaagccatcagagggcattgtaggtagtaagtattgcattgtcaggtaaattgtctttttttctgtgggacgtcatcaaaaaggcttgaaaaacactgctggaatcaatttatcctgttttctattcttctgaatgctaattttttttccttgagccattctactttcatttcaatcatgaaatatttccaactggccttgattaatgctttaacttttcaaaggaaaaacacccacacacatctcagtagaaaatatggtgaactgaagatgatatttggttttcaaaagaaaagtttggccaaatgttctgcattgcatttctgaggcacacacaggagcgggtgccagggtatttgactgtaggtaagtgaacaaggagctatacagatagaatggcacggggtttgacagtaatcagaacaccacatcagaacacttgattgcacttcaactctcatgctgtgtttgccccaaataatcttaaaaattgtgactatatcgaataagttcacaatacttattaggatgtggtgaaactgaattatttgaagtaggaagacccgaagttcttcgcctatgagactggtgaagtgatttgtagccaacatgctccaacccatctattaagaaaactatggcatctattaagaaaattcaaaatcttaaacagagaaatccatatttagaaaacatggccagattaaatagggggtgggttattttcttaaatacgttttgtcaatttcacgtgaaaaatgaaaacccctagttcatgttacatattacatttctgttaagatgtatgttcctctgtttctaatagaagttgtggtggtttggaagtgaaaattgaatgtgagcacaggccatgtaaaggaaggagaaagtgtaaatgttaataacaggaaaactgaatttagctctcatgaggcagtcaaggaaatcattcattgaacatgttgggaaatacttttcatttggtgaccaaatacctacaaattcatttacaaaaaagaaaaatgaaagttacctcagaactaaactcagaaatatgtcccacatgggttcttgtaatgtttcttggtgaatgtctttatagaaagaagtgggcatgaaatgatgactcagtaattaaacacatgggggaagggaggctgtagaaaacactggattctatatttaaaatttcattcagttcactaatttgtttttactgaccaaagctttctatacctatgtagagtgtctgagaactagaagggcccatcagttgccactcggatgatccttttgtctcttttcagataaggccccagttcaacagcgtcctctgtgtcaatcagatactcccaggaatgagtgagccctgccgttttcccaagttgcccctcagcacattccagccagttccaaaacttttggcttgtttttgacacaaggccagataagctactcaaactggtttttttaaaaaaagaaaacaaccccaatctatattccttttttaatactgtgtacataacctgctgctcgaaagactaggttttcccctttccagctagttgtgttgtttctttatgtagacagctttaaatcatgtttacatgattcagccattttaaacaacctcttcctatttttttttcctttttgtacaaaaaaaaaaaaaagaagaagaaagaaagcaactaactaaaacctttcctttcaaggatttatgcagcataggatagggcaaccacaagtaaacacaaacatcacgtgagccttcttaaagaaaacatttccagaaatcactccaatgtcttaaaaaacacacaaaataaaacctttctccactgcagtttaactgtggcaatgagttgcagacgatcaccaacactgaaacttaatttagcttttttctctcctctccaatcataaaaagtctctttttggttcttcatgcaggagctattttctttcttttctggcctctaacaggaaaacagagtttctagccgagctgctcctgaggtattaaaagtgatgttcgtgtcatgcggatcaatcctgcccaaacattagtgtgcatgcaaatcacctggcagtcttattaaatgcagaatctgattccatgaggtccatgttgtccgtggaccaaacttgcagtagtagcgaggagtctagaagacgtccatgttatagaaattgaacccaggaaaggatttggggcttatgaagctaacaaaagcacgtaaaacccagcctgagaaacagtagctacacccagctcttgttgctattctggaaccaaataatgcaaaatatgctcgagacacatctcagttcttgcttgcttgactttctgagtgtctctctggcacaagggcctgtcatttgaattcccatcccccacctcatccccatgtattattccactggatatcccaaatatctagagtttcaaaacccaaatgatcccatttggccagagccttttttatgagtatgctaatgttatctgtgtatgaagcacacaaactttttcaggatacccggctatctattaatccttcagcacggacgttctccatggtaacagtctgacctataagatctaatgcctttcccagggggctcagaatcccatgagtttgggttaaatctgccataacatctaaaaaaaaatgtaaaggctctacggaattactttatttattcatttcccagaaagagaaaataattttcagttgaactcaaatcgtcattattacattgacaaggtttctaaggttttccaaaaagaatataagcctgccatccactatagcctttgccaataaaggcagagcttgaaaaaaggggggattttttttctgttagacatgtatcatcttacaaatctattttaaacacttttgggaccagtaaatcagatataatacatttggggagaatggaaatttttctgactgcaacataggataaatgagttaaagggaatgtctccatgcgtagtgctccacagaccgtgagctcctactcggaatttatttcatggttatccctaaaatgggtttccctcacatttggagccacagatgcttcttaactagaacataaactccagtccatggtttctggggctaagtctaacaacaataggccaaaatgagaatatattttgtttcctccttcctgtccagtgaatactgatatattcttgggcaaggacagccatcagggagccacagtgaagctgtcattcaggctatgagcttgctccttttttctgtagcctctcatgacccatgaggacccaagagggaaatgacaggatgaaaaattcggaaggaatcatctggtccaaccgcattttttcacgtacttgggaccagcatcccagagcagtcaagtgatttgtccaagtaacacaactagtttgttgtcagcactggagccaaaagtcaggtttcctgatttacagacaaagctcttgcagagaatggcaaagtacagcccccattttcagtgtgtccgagggacatcctaggtatataccccatggtgaaagattgaagtcttaactaattagggcagcatagaagtgaatccctagtaattaatcagataatacccaaagaagacaatcaaatgacttaaaacttatcaataaagagcaaaaaactgtgctctgctttgtaaaacatgcactttaggccaggtgcagtggctcacacctgtaatcccagcactttgggaggccgaggtgggcagatcacttgaggtcaggagtttgagaccagcctggccaacaaggtgaaacccattctctactaaaaaatacaaaaattatctgggtgtggtgttgcatgcctgtaatcccagctactcaggatgctaaggcgggagaatcccttgaacccgggaggtggaagctgcagtgagctgagatcgcaccactgcactccagcctgggcaacagagcaagactctgtctcttaaaaaaaaaaatgcactttaggagtaaatcttcacagagtatctgaagaataggtgagaagaggtgagtgatcaggtcaggatagaacctcctaggccacaacacctaaagtcctgagttcttatggcctacctttcctctggatttctttagaatgctcatggtttgtaactgtcttgaaaagaaccatcgtgaatgcacctcacctgttttcacactcatcttttaagaatggatgagatgatataagtgaagtgatttgaattcctttaccccctcccccacaaaaagctatgtaaattcagtatacttttaaataatctgtctcacttactgaaagaaacacaaaacgcacaaaatatgaaagctaacacctgccctccatatatcatcttcctatgtctcccaccacaaccacaaaactacttccagagaactaaatttttattgacaatggaaatcaaggtaaaccctggaatttttcctattccattctaactttaatggtttagatgactacagacatgttctcacagaccccacatatctttggatcctcctactaaaggtagggttagtaaatgtcccatccttgggacataatttactcagttgattaaaatactggtcttcgccagagttggtttggcagatctagctaaactgataggtttccttttctttctttcccatttgtgtctctctcacagattctctcaccatccaggaagaaacctgtctaagcaacgtggtcattcttccatcaaagccatcctaataattgctcttcccagtgggaactgcaaacagctacttttacatgaagttcccagaacttagtggtttccaaacaatagtactaccactgctcttgaaaataaaaacctcagtgagatcagggatgatcttaccttcttaaaattgtggtaaaggtgtttgttcacaggctaaaggaccatagctcattctctaagaatttcacctgattccaactctaccacatctgagtggtttctttctgagttttctgccttcctaacaattttgggtcttacttgatgataccaaccaaaacctaataagatttttcttgttctgtttcttcctgatatgtactgttggttagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcaggtaagaagtagcaactagttaatagaaactgtgttcacatgcaaagaaaaaaaaaaaaaagtcagtcttcccatcctgtgcttccagacagaaacgtgctaagcaggcagcatgcttttgttgtgaggtcattagccattgtcttagagatactcagtcagcaggtccagttcttatatcactaacagaagaccagcagtcatcgctcagacagggcttagtctgcttttcccattattttgaaaggcagatcatgcttggcatccatgtttttgttcactgaccttttgtgagattagtgtattagaaaacattataactgggattcatgtcattcaatgattctctatatggtctgaccaccttcctaagagacctttctcagtaccattttcaagaatgcattttctaaaggttgtaaataaatattgcataagactaagattgttttgtggcgaaatacttgggaaacactggattaagctaaattcctcagatttctttaccacatgactttgagagcccttcatgttcattttcattggaagtctctaagagggagtgagaggtatggacctactgctctattttatacagtttggaaaaactctcttgtatagcttgagctttcccctcaacataatcccttaccccatcaaactgaaaatctgggcaactgattatcagacagacgagaccagtatattcaggtaaatcctcatttctaaatacagtcgaatcctgagagctctctaccaattttgtagaagaacttgaggtgcagacactgggctggctacgtgattcctgtgctccttccccacaaaacactctctccaaccactggggccaaattccaacctctgttttgtcactggttgctgtgccagatgtgccggagaggagtcttgggtccctgcaatgtggatttccccgggcttgttccttggctgcaggcttgcctagtgaccctgtttttctgaacacttcaaataagaaagtcatcaagcaggtttgagggagaaatctgacatgctcctcacaccaaagcctttgtaatattcaaaagcaggcggagctactagggatggatatttcagtctcatccaagaggctaagatggataaatacggttgccccaaaacaatttttttgtacgtaaatttaagcagaaacctattcatatttatccaaaggagaacctaaagctcacagaagaaaaggtgtacataaaagatctaaataaaatgatgaaggtgtaagaaaggtagaatctatagatattacttgggattgccaagagaatagatgtgaaaattaagtttattgaacattcatagaaaatctacaaagcgagttgattcaggttggtaagttgagtctaaaacttgctgaagtgtctgtagtttaatgttttaaagccctagaatagtgttaggttcatgaaaagtgttcaatgaatattacctaatattactattttttaatagtttaaaagatgtcttgtaaacataaggttcttttaaggtataagttttttgttaagagaaataacgtttaagaaaatctgtcagtagaaaaaagtctgtttaacaattagcaaacttgccaacaagcttcaaagctcaaattaataattaacatgcctattgtgtagaaatccaaaaagctgggtaattcgaagaaaggaatagtcacaagagatggtgacaagttaagtgctaagaacacttacgtgtgactctggccttaatttttctattttgggcaggaaaaaaaaatacaggaacaagctgctaccatattatttatttttgtttagccaccaacgtatgtgagttttagtttcaattagaagttcacgctgattgaagtagagaagtatagttttgctccatatacatataaaatgaggagagaggaagagagtatccgcctagcctctatttaggtaagtttagtacctaccagcttcactgaaaacaagctgtgttcttaatggtcaaaggcctgatactcatcttgacttacacctaaggaagccaaggacgggggtagggtggtgggggtggggtgcggggagaaagaactttatggaacgatttccacattaagtggcaccctaatgctgaggtcatgcacataggcagaggtggtgtgaacaaaacttttgctcctgttttgagcatagctgcttatgtgtgatttaattactgttccctttgatatctgcattttcttgtaactcgttttctctaaaacatgacataaaaatctcaattcaatgagcaagatatagcgatgcaaattataccaagggttttatagaaagtgcaaaatggttttttgattttttatttttgaaggtagaaattaaaagattttttccgattatagaaaaaaatactcattataaaaacgctcagaaaatagaagaataaaaataagcacccaccacccaaagataactagcagtaacactttttccagatatttatctatgtatataatattcaagataaatgcacacacgtgtgtatatttatatgtagtatatacgtgtgtgagtatacttataattttacattgattcttgcactgtgcataagaatgtgtcatagcttgctttctatgccaataaatataagcctataattaatgatattagattctactggatggatgtattaggacttatttagccagtccctaatgacggacattttgattgtccaaaatgaagactgagtgacacctagtggaatccatagatgtttctataggcatgtgttttgccggtccagttcctgtacagtaatatgatgaacacaaagagagagcaaactcatttttggaaggaaagaccctaaattgactgagagaggagtcacaggcctgtgaacctagaagaccctgaaagagcctttgacagcaaggttttgagggaccctttaaccttgtttgagttcaaaataaaagtttacctgtaactggcatgagcctagaccaatagttctaaattttttaacctaagcccttagtaagaaataaattttacataatgacccagtacacacctgtatatatttttataactgaaacaagtgtgtcaagaaatggtactttgttttgctctatgcagtgcactctgatattttctgttttttttttttttaaatgttgattacaatctactaaattgattttctggtctgcagcttgaaaattattgttctggaggacacaggatattcagaactacttcagtgtttaaaaagcatgatatataatatacatatatatattataaaatcaatattgcacagtgtatttcttgagcccatttcttgttttattcttcctcttgtttcacagctagaaacactgtaccattctttacatgtagtaaatgatgttagggtgtgataattcctttgttccttagacaaaagtgtcaggaataggatatctacgttgacatctagttaagaatgaccttactacttgctaataagtatttaaatggcaaagctgtatctctgtctcttaaagactacttataacaagggcttcaagcctaaattaagccactaaattctgcttagtgaagtcccaggcaaatccaacttaggtgaactctgtgttagtgaaaactctgcattctactgaagttctactttgagtatcgacatgttttaaaattatcagtgttctaactgtatcatacagtaaatttattaaagaaactcaggggtcacagtaggtgctaatgatatgtcttcatctttttatagttgtgtaaaatactaaaaataccagttccaaaataaaattttaccataaggactcttgggatagcattctgtctgaagtcttaatatgttcccaattctgcaatgaaatccctgtgtatcctccttaatcacaaaagaaaattcaacataatttcaattttagttcttacttacataaaaacgtacccatttcttcctgttttataagctgttctacctgatgaagcttctgcttcatctcaggcacggaaggtagctagacctagactgtagaaactctagagacagaggtaggaaacgcttctctcagactctatcctgaaggtttgaggtaagaggtggagagatggaataacatgttctatttcagtttattcattgtttcataacaaaacgtatttaatttcaggtataattatagttacaagaagagtacaactaatagataagcattagaatctgatcatggctcgactgctttctagcttccaaaagtttgagtatattattctctgtcttacctgtggtttccttgtttgtaagatggggataataaacctaacctgacatcttcccagttattgtgactgttaaatgaagtagtggatatgaaaagggtttagagagcataaagaatgacatgtaagtaataaccttaaccacatcataccaagctaatttcataattttaagtctgtataaggagtattccagttgtattggggtcaaagagcatagaaaattcacaaattgaagccataggttaatgcagtcattaaggactttcctggagcagctctgtaagaatagacataaatcactgtgtttagctcttaatcaagaggcaatgggtaatttcgtctgccagagatcagctgctagagtcaagctcaaggcacagttgtggacagatggatttacttcaatgcctacccttagttacagccactttttcccattcccagcgcctgaacctttctgtcttccctcctgatccattactccaggcagacccaagttaaccagtaacttacgggaaaggactagtaaggccactacaagacttttgaactcattcacaagtaaccttttggactacatgcctccctttctaataacaactaatatttatactgtagatgatatagaaattatagtatatcagtatgatatcagtatgatatcatactgatataatacataagcccatgcaacccactgaggtaaatagaataaatagtatttacccatttttccatgttgtagcatgtatcttcttaaaaattgtggtaaaaacaaacatcacctaaaatttaccatcttaagcatttttaaaagtacagttaagtagtgtgaggcatattcatattgttgtgcaacagatctccaaaactcttttcatcttgcaagactgaaagactacacccattaaacagcaactctttatttcctgctaccgcccaccctctgcctctggtaactacagttctatttctgtctctatgaatttgactactttagatccctcatataagtggaatcacacaatatttgtatgatttccgtgattggcttatttcacttagcatagtatcttcaaggtttatccatgttgtaacaggtaacaagatctccttccttttttttttttttctctttttttcttacagacagagtctcgctttgttgcccaggctggagtgcagtggcacaatctcggctcactgcaacccctgcctcctgggctcaagcaattctcctgcctcagcctccagagtagctgggaccacaggcacacgccgccacgcccggctaatttttttttttttgtattttagtagagacagggtttcactgtgttgcccaggctgtcttaaactcctgagctcaggcaatccgcccgcctcggcctcccaaagtgctaggattacaggcgtgagccactgcacccggcctctccttcctttttaaggctgaataatattccatggtatggctagaccaccttttatttatccattcctgctatgatggacacttgggttgcgtccatctcttggtccttgtaaataatgctgctatgaacacgggtatacaaatgtctcttcaagaccttgctttccattcttttagaagtgtatcagaagtgggattgctggatcacgtggtagttctcttgttgattttttgaggaacctccatactgtttccatagcagctgcacaactttacaatcccattttacagtgcatatttgtcccattttacagctgaggaaacgaagcacaagtggaagagcagaggctcctggactctgtgattccgggcagaccccttccccagcctaccccctgggctaatgagaggcagtgggtatttagtcggggatgcagaagccgcagaccgacctccccttcctccagggagactacaggcaaaagcatgtaaacccctttccattgccccccaaccacagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggtaaggcgggcgctagcccactgagaacgttgcccgggaaaattccctagtgccgtgcggctgttcttttgagcatgggctctcaaaaatatttttttaagaataataaacttaccatgtgctaggtactgttttataacttgtagatgtattaatttgtccactgcttctaagaactcgctgacctaggtactaatccccattttacagatgagaaaactgaggcacagagaggttttgtttttgtttttgtttttgtttgtaactttcccaaggtctcccttgagtctgcctgacatgcaggaggagccccatcattaaaaccctttactgcctctcaaaaaggaaaagttagaaagctgaaaaggatgaaaggtctgcaaattagttaccagaatgaagttatggttttctaatagttggagagtttttatagagaagatttttttaaatctttttttttttttaatgagcaagtaagtacattagaatataaagaggcagggacagtatctgcgttgttcattactgtatacccaggaccccataccgtgcctgacatgcaggaagagccccatcattataaacagatggatttgtttcatcttttaagacagagctaaaaacagcagatagagttacaaggaggaacattttggctcagcatatgaaataatgtttaaccaactacaacttacagtactacagtttacaaagtgcattctttcatttcatcctgaggtacatcgttctcattttatgggcaaagaaaccaggaatcaaatagtttgagtgacttatttgaagattcttgactaataaatggtagaatcagtaaggagaccccgcttttccaactcagagcccagagcttttgagatagcgatctcccatcattcaaaatatgaagaaaaaaaaagactttcaatggcattttgacaaggatcctatgcaaaattttcctgaactgtatggaaaatttggatacattattttgaggtctcttttaactccaactttcaatgagccaatgacctttggttgggaagtatgggaagtaatcaggatgatagagtttgggggttaaacacaccccaggcttttttttttttattgtttttttagacatagtcttgctctgtcacccaggctggagtgcaggaatgcagtggtgcaatctcggaacacacccagtcttctatcctaactctgtcactaacaagctggggccttgggaaaactggactactctgtgtcttcttttccttatctgtgaaataatatctactttgcaggattcttccaataatttaatagatcattgtgctcccagtgcctggcacattctaggcactcaaaaattagtaggtatcattattgccatcattgttattatgattattattcagaggaggagagtatcaggaaaggctgaagagaaatcacgaagtcttagaactggattggacctaggagattatttgggctaaactaccaaacacaggatccttctgtgacatcctctgacagatgaacatctagtctctgcttgagaacatgcagtgataatgatctcacagcttaagaactaccaaagactgcattaaatctctcagaaaatcaagttgtgcaacttgatcagagccctgatagagaagacagagtattctagactaggaatgaagacacagaggggttaatgagacagtctgtaaacatttgcaattgcactaccatggttcaacgtctagagcatttcaggtttgtcaaaccatctaaaattatatattcacttgaagcggggagcaaccataaaatcacctcttgtaccatctggcaaatatagtaccacagatttagatagcttttcacataagttattcatttgtcttcacaactctcctaggatgtaggtagaaggaatattcatatcccttttacatatacagaagtgtgaggtcattgttaatgacccacaggatggtggtgattatgtatcatcctatgggaaatcatcataatgagtgttagtctaagccaggggtgtccaatcttttggcttccctgggtcacattggaagaagaattgccttgggccacacataaaatacactaacactaatgatcgctgatgagccaaaaaaaaaaaaaatcacaaaaaggtctcataatgttttaagaaagtttacgaatttgtgttaggctacattcaaagccatcctgggcatgatgtggcccctgggccatgggttggacaagtttggtgtaagcattttacatgtgctatctcactgagccctcacgaaagccctaaaaaatgagtactattgttatccctgttttacagatgaagaaactgagccacagagcagataaataacatggccaaggtcaggcagttggaaagtagcagcaccagaatgcaaatgcaggcagctcgactccagctctcaggctaaacctctggtgaccacctagaaggggagtgtccagcctgcggcctgagtctgctgcctctccaactgtgctctctctcctacagcactcttccctttggctgtgaagctggtactgatgcctcgttatttgttctttctctcttaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaaggtatttttttccccagaaaacttctattagaatatgatagagactggattttagccccttgtttagttattgattatacagggcctttgttcatttatctttttgctatccttccaagttaatctgttcaggctgctataacaaaatactttagactggggccaggcacggtggctcatgcctgtaatcccagcactttgggaggcagatgtgggcagatcacctgaggtcaggagttcgagaccagcctggccaccgtggtgaaaccccatctctaccaaaaattcaaaaactagccggacgtggtggcacacacctgtaataatctcagctacttgggaggcttaggcaggagaatcacttgaacccaggaggcagaggttgcagtgagctaagataatgccactgcactctagcctgggcaacagagcaagattccatctcaaaatttatcactcacagttttggaggctggaaagtcaaagatcaaggtgccagcagatgtggtgtctagtgagggcctattcctcataggtggcaccttctccctgtgtccttacatggtggaaggagaaagggagaaaacaggcttccttaggcctcttttataagggcactagtcccattcacaagggcctcaccctcatcacctagttaccacccaaaggtctcacctcttaataccaacacatcaaggactcagtttcaacatataaatgttggaccatagcacctcctttcagctgtttcacagcttctctttgtttacaacatatggaaaggagggacagtagtgaaatttttatctgttgtttattagatgctttggcatacattaaaatgacattcggtgattatctctcaattttactgatccacattctccatgtgcctcattcctttgagcaactgagaatagagacatctaaaatttataaaataggaaagtatattttaaaagtttaagctgcttttcatgctagctgttcattttttctttgtcatgattaaaagccagctggaaatggtacaggtgcaaattttaaagcaattattatgggaggaggtgaaatgtgacttggaaagggtccttttccaggatggctttggtcctatgacagccttcatggagcacagctcctatttgatgtaaaacagagtgctgccaagagaacagaaaaggagcaggaatcagctgagtcagggagatgatagaatagttgagatgtagggaaaacacagtggactcaagaaagtagcatccttgatttataatcagtccaccattattgccagtggcagtttctttgagaattaacatcattgagcatctagcacagtgccttacatcatattgaagatacttaataaaaatttgttaaatgatgaataaaggaatgaatcttcagagattgggacttttaacatttcattttccatcaacctagctaggttataaagcatcaacaatggacaaagccatgagagaattatacccaggtctggccgggcacagtggctcacacctgtgatcccagcattttgggaggccgaggtggatggatcacctgaggtcaggagttctagaccttcctggccaatctggtgaaaccccatccctactaaaaatacaaaaattagccaggtgtgatggcgcacacctgtaatcccaggtatttgggaggctgaggcaggagaaccacttgaacttgggaggcagaggttacagtgagccgagatcgtgccactgcactccagcctgtgtgacagaatgagaccctatcccaaaaaaaagaaaaaaagaatcatagcgaggtctggatggttaattatgtacatatgtgtacggttatatcaagtggcacaccaaaatgaccaaaaactgcttacattttacagttattacttgttccacatgaaaatcagaattttttaatccccaaataacttcccttagtctttttttttttttttgagatagagtctcgctgtgttgcccaggctggagtgcagtggcaccatcttggctcactgcaacttccgcctcccaggttcaagcgattcttctgcctcagcctctcgagtagctgggactacaggtgcacgccaccatgcccagctaatttttgtatttttagtagagacagggtttcaccatattggccaggctggtctcgaactcctcacctcatgatccgcccaccttggtctcccaaagtgctgggattacacgcatgagccaccatgcccggctcacttagtctttatgatggtctaggtcccagtcatatttctgatacctcccaaataaattatttgtacttgaacccttgtctcaaggtctgcttcagggaaaatttaaactaagccacagagggattatacatttaatatctgattatttatgaaatacttaatgcatgctatgtcctatgagggaaagaacaaagcaaggtggctgccctgatggctctaatgactgcctcaaagaaacaattcaagaattacaaaagtgagcagagcaaaatgagtagagaaaggccttgtggagtaggcaagctttatttataaactctgaaatttgaattttatgtaattttattgtgcttttctaatgtcatgaaatattattcttcttttgatttttttttaaccgtttaacagtgtgaaaaccattctcaaggccaggtgcggtggctcacacctgtaatgccagcacgttgggaggctgaggcaggtgtatcacctgaggtcaggagtttgaaaccaacctggccaacatggtgaaacctcgtctctactaaaaatacaaaaattagccaggcaaagtggcaggtgcctgtaatccctactcaggagcctgagacaggagaatcacttgaacctgggaggcagaggttagctgggcgcagtggcgcatgcctgtaatcccagctacttgagaggctgaggcagaagaactgcttgaacctgggaggcagcaacaaaagcaaaactccgtctcaaaaaaaaaaaaagaaaagaaaaagaaaaccatgttctctctttctaccttctttaaaatcccacccaagccttccttgaacagtcttggtaacatgaagaaaatagtagtcatctagacttccaaattctactgtggttttttttttttgtttttttttttcaggagaaactacaacctaccctaccctcctctaattatttcttctctaccaaatttctcaacgtacctatttctctggtctttccctcagccagatgctggcttcccatttcatctagtacccccaggaagccatttatctactccctctgatggagaggcatttgtctgcaattgattaaagtagatgtataaaaaaggtctaggttattttaaatttctatgtaagagagacacatattcaggggcagacagtctatgcttccctccatgtatgtgccttgaagaacttgctgtgactctgattttcaagctcaatttcatattctacaatgtaattgggatagctattgatacccttggccctgcaacttttataagtggtcacaagttagcattgtagaataccaatgggaggaaaaatatttgctatttgacatcaaaatactaccaactactgtatttttaaaaaatatctcatgatttctattccttgtttgggaaagtctgtacctagtttttcatcattaaattatgttagcagtgactgattttcatatgcaataaagaatagattttaagtaaattaaattcaaagattttttaatttctattgcctttattggttggggcagggtgtggagtaacgagagcaccaattttctaaaacgaatggtgtgcttttattccaagttttatcgagacaatactgccacctcttggtcttcagaagaaccaatttcccttgttaaattccttaaacagaacatttaatatacaaattcagtacaaattgtttagagccactaagttaggatattttctagcaggagtgcatcagtaaacggacagtgcatcctgacaaaatgtgcgaaatgcaatgatgaagtcaggctatgttagctatgatagaagcaaaaggaggagtaggaatctgagaatctcggtgatttgaataaatgccatggccaaggttagaaagatgatccctgagtcataaagatgctgcaggtgggacaaagaacagttctcacctccgctatccccttctgcagtgcctctatcctcccaccacactgaatttttctttatccccagtctcaccacgctgcgtgccttgtggctctccaaatctttgtacatgtgcttgctttgccagaaatgccctttcctggctaagccatgcacttccttcctcactttcataaactcatttctgaaaccatgtaaaccagaaactactaatctcagctcaaatatcaacactactgaaaagccttctccacctcccccagatagttacttcttatacacacagcatttttttctttaatattgtacctactgttaatttttaaatattttattttatatactttactagtcttccctactaaattctgtgttccttaaagaataagaccttgtcagtcaggcacagtggttcacacctgtaatcccagcactttgggagtccaaggtgggcgaatcatgaggtcaagagatcgaggccatcctggccaacatggtgaaatcccatctctactgaaaatacaaaaattagctgggcatggtggcgcgcatctgtagtcccagctactcgacgctgaggcagaagaatcacttgaacccgggaggtggagattgcagtgagccgagattccaccactgcactccatcctggcaacagagtgagactctgtctcaaaaaagaaaaagaaaaagaccttgtctatcttagcttgcttaggttgccataacaaaataccatagactggatggattaaacaatagaaatgtatttctcacagtcctggaggctggaagtccaaaatcaaggtgcaagcagattcagtttctggtgagagccctcttcatggcttgcagatggctgccttcttactgtgtcttcacatggaggaaagagagcaagtgagctctctagtgtgtcttcctgtagggataacaatcctgtaggatcagggttccaccgctctgatctcatttaaccttaattacttccttagaggccccatttccaagtacaatcacattgggggttagggcctcaacacatgcattttagggggacacagttcgatcaatagcactattttatttattagtattcaattttatatagaaggtactgagtatattatttattggctaattgtttggctgacaggctggcagggataaaaataggatagatggatggatagatggatggatggatggacggacggacggatgggtaatatttattaaaagtgccagtgcattgcatagttctaaactgtttcaccttactcacctgggaattttttctacagaaatatacttctaagtttataattaaaatcagaaaaataagagttactttacagatgttttatatatcccataaagtcagcactacttatagtacttttttgcatagttttttaagtaagagtttgcttttgtctttgtaggaaatcatcagaaagaatgaaatgctcttactagtatctataaaactgttattcaactgatattagagaggaagcatgttttcaaaaaaaaaaaactctgtggtatttattaattgctcatgaatcccagaccagtctgggtcagaaagaacccctcacatcttggagaattgtgtgtatcccctcaaaattcatatgttgaaatcctaatctgcaatatgatggtattaggaggtgggatctttggaagacaattaggtcatgagggtggaggcccccttaatgggattagtgcccttgtaagaagagacacagaaccttatttgctccctctctattctgcactatatgaggacacagcaggaaggtggccatctgcaaaccatgaagagaggtctcaccagaccccaaccatgctggcaacctaatcttagacttcccagtctccggaactgtgagaaatgtttgttgttttaaggcacccagtctatggtaatttctcacattaaccaagactcactgagacaaggggccactcaaacatactagcctagggcaactaaaatccagtagatttcttgactgtcctgaacagggaagaaaatggaacttttcagcgtgcatgtgctttggcacatgcagtcataagcaaagaaggtatttgctcatggtattgataggtgatgggtggtagaggatatttctagcctggagttgggtgtggcatggattcaacaaatatttgcttattgctaacatctaaatttaagtgttacagtttcagtaaaatataatgtttgatttagcagcttcagttgtagcaaaaaagttcctagctttaaaaaaaaaagaactcatcaaagactactaactgctgattttttctatgtccaaccctgtttctctgggctcatttcctcatttcacacttgggctaagaggggcttcatgggaagcctcagccattacagatgagctgtgccccatcctcattctacctgtatcccgccttttacgttccaaggctaattaagttcagcaataggcttgatcattgacccttgtcaagttaggaaatcaggttaagcaataagggactagttcacatttcctagttattcaatcctgttacataccaaatacatagttaaaacattatgggaaaattttgttactcgaatagcatggtatgtctctagtaaatacatcctaaagggtaacagtgtgtgtttttgaaaaaattatttgtttgttgttgttgcattttgtttgtttgttttgagacagatgctcactctgtcacccaggctggagtgcagtggcacaatcttggctcactgcaatctctccctcccaggttcaagcaattctcccacctcagccttccaagtagctggggctacaggcgcgtgtcaccacacccagctactttttgtattttttagtagagatagggtttcaccatgttggccaggctggtcttgaactcctgacctcaagtgatttgcctgcctcggcctctcaaagtgctaggattataggtgtgagcctcagcgctcagccaattatgttagtcttaaactttaattattttgccactgatttatattgttttagaggcatttttattccatttctgtctggtctttattttgccttgaaaacttgatttttttttttttacacgttttctctatcctgtatcaatcctaccttcattcccccaaatctcactatcaaataccttatatgtagttttgctttctagcagagctacgcacagtaactcaaatacccttatatgctcttcggtgtgtttaacaggttcagggatgatattggcctgggctgagaaacactgtttataagcttgaaatattaattgggtttattttcttttgtaattcctagatagaagagcgagcagaatttttgaataagtctgtgcagaaaaggtaaatatgcttgatggttcaattgagctaatcagctagcatatgtatgagaagattctctctcatatttttatatgtatgtgtttacttttttagcagtggtgtcaaatcgacccatcaagcagcaatagtctccaagattgacagcagactggagcagtataccagtgcaattgaggtgagaattgtcctcagcgttatggtcctgctgaacagaaatagattctgactacatagaagagcataaaaacacttaggacaataatcaagtccaatagccccaggagtgttagaatttttttttttttttttttttgagacggagtctcactctgttgcccaggctggagtgcaatggcaatctcagctcactgcaacgtctgcctcctggggtcaagcaattctgcctcaacctcccgagtagctgggattacaggggcccaccaccacacttggctaatttttgtatttttagtagagacggagtttcaccctgttggccaggcaggtctcgaattcctgacctcaagtgatccacccgccttggcctcccaaagccgaatgtgagccaccacacctggcccccaatagtgtcagaatattaatgatgctttattacactttgaaattctaagttctaagaaatacaataataaagataaattttaggagagttttaaataaattattttctactttcagcgtgaatattgtttaatgaaaaggtttttttgtaacgaatgggtttactggtatttaaatatatatatatatatatatatatatatatatatatatttaactatatatatatttaagtcttctttcaagtattctgtcaaatctgggtttaaatgtcacttcctcagagtagccttctttgcacccccaaactaagtactgccccccaattgtgtgccatgctttatggcacatcattatttttcatagcacttagcacaatgtgaaataaatacttgtataactagttactatctttcctttctattaaaatataagcccactgcagctgactgtcttgttttttgtttgtttttttgttttttatttttatttttatttttgagatggagtttcgctcttgttgcccaagctagagtgcaatggtgcaatctcggctcactgcaacctctgcattccaggttcaagcgattctcctgcctcagcctcccaaccgtcttgttttgagcacgactgtatccccagagcctagcaaagtgcccttcatacagtaggcatttaagaagtattgttgaggccaagtgtggtgactcatgcctgtcgtcacagcacttcaggaggccgaggcaggaggatcccttgagcccaggaatttgaaaccagcctgggcaacatagggactatgcctggctaattttttcatttttttctctacaaaatagagagaggcctatggttccagctactcgggaagctgaagtgggaggatcacttgagccctggaggtcgtggctgtagtgagccttgattgtgccactgcactccagcctgggtgacagagcaagaccctgtctcaaaaaaaaacaaaaaagtatctgttgaagaaacgaagtagaatatcaatttcacaacaaatggtgtcccaacaaaaagcatatttcatttttgaaagatcctctgatctagctgtgatggtttattttgagggacatatgtcatcagcatacagttttacaacagaaattatcactctcatttttggtggaggtgtttacacaatgaatttttaagatgataatgttgaggaagacaaactcactataattttatgagaacaaacttcccagcaccaatcctaaaaataactcacaaatttcagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggtgagcatctgatttttgtctcttaagtgtagaggggcatatttttttgcatgtcgattttgatttaggaatcacactagtaaataataaaagcagtgaagaaggtgcaatttgtactttgttttgcaatgaccacaaaagcaagctcagagagaatgtgtttgtgaggttgcatgaggtactaagcccgggccatcttactccaaataaagtgcctgggctgaaatgtccacccttggagttggagtggggtgagttaccagggaaagaaaaccagataacatattctgtaaatatcaagtgttaaggtttatggttatgtgaaatcatacttaatgatattttgaatttgctttgaaaattccttcccaggtaaagtttacttcattctttaatattttggatgattgcccctttgtaggaaactgctggcttgaaggtaggggtttctagccgcatcaatgaatggctaactaaaaccccagatggaaacaagtcacctgctcccaaaccttctgtaagtacctttaggtttttctgagtttctttgatctcccagcttctaccagcagaagaaaacaagcagttggtctgtttacctaggaatggcagtgcccctgttctttgctttccctgatgaatagcaaacaggaaagtgttcagatttacaacagttctaagaagctgcatctcagttactcagagggtaaaatggaaccaaataatcacctctacaccctaactgagaggaggaatcagctagaatactgaggcagttcaaatttagatcctttactcgtctatttgtttagcttctattctataaattctggatagaaatttgaaaatgaaaggtcacatcattttggctacttctttgtcaagagcacccctaaacttattcccaaaagaatatgtatgttgcctattgggaacccatatgttccaatttgcctcatttttataacttggcacaaaaatgcagttattgggtagctgttgaaataattggtctaattgtgttgtcagcacctcctgaggaaagtcataaaactggaaactagaaaaactggttatgaatgatgtttttgagaatctaaaattttcttaatttattaagtgcagctatcttactaaaaagtacatttcttttcacctttttgttgaatgtatacgacaattgcttgcatttgtcattataataagaaaacgtatcaagctccccactgtatattgctgagctttccctgttaagtttgcttttatagctttgttggtgcccaagggagctgagagtccactgtcataatcctacattctagaggaagaagaaaaagtttccaatcctaggcctctgtgcatttaattgcatccattggctccatgccatttaattgcatttgttggctccatatataatctccaaagtcattaaattttgtcactttccaatttaaaaaggaagaaatggaaatgttcacaaatccttcttgggcacaactccttgaaccgtttaattaatctacaccccgagattctttgcataaaggctcacaggaggtatacactaatgtcaacccaatttacaattggaaaatctttatacattgaaaaaagcaacttttcctccccctctcaataggtacaagaatgcgggtttataaaaggacacagttgaggcaagagaccggacccaaaagttatgtgctctttagtgcctcaagttttccaagcatctctggtaacataaggagtagaaattattttcaaaaacaaaataatcactggttccagaccagtgattattaaccctttttgaattatgaacccctttaaaacctaatgaaatttaaggaccctctcccccaaaatatacatataaaaaaacaaggcagtctatggacctactgagtaactctcaagatagtaagtaaggagagaaagatctatgtttccctctttgataagtatgaaatatttggaggagatgctaatttttgcacgtttatgatatttgcaatctttcatttttgtagcagattatactcaaaaatttgatccagaacttggcccctattcttttatcagcactttaacttgtaaactgaaaagtttaccatcatctgtatgacatcctaatgaggttaaaaagataaaatgcagttatgattatgataggtataactgtatccaggtttccacagcaaaaacaaaacaaaacatacaccatgttctggggttattgacagcctcctaaaaaaaaaaaaaaaaaaaaaaaggcattgcagagaaattacaaaatcattgcctgctttacctactaattagtatgtgacttgctagatcaccccctagagggtgaagaaaaggaaagaagaacatggcagttagtatagattttagtgagatccttcttcccattagattttgtagactagtgtggcttcctgaatgagaaccagatggaagaaagttctatgaaatcaatgttgtaaatacaccagattgctactgggatgtcccttgctatttgtgggtagaatttataggatttcagtgtaactttgtaactgcaattcaattctgagtatgtctgtttgagctggtttgtctattctttgtgtctaaactaatgttacacagaaattaaaaagctaatttgtctttctttttgtttaaaaaaaaacaaccaacaatgtctttctcagctgaccttctgttcctcactctttggtctctggttgattggaaacctgcttctcctgccttcatttctccctcttcttccggagtgggtctttctctaaaatgtagtctggtcaggtaattccatttatatttcccctttgatttaaaatgccaacttataactcagatgttcatattttcttaaaaggactctttaaactctttaagtgatcttgaaagattcatcggcaggatttatgggaagtgcaatccattttcttaggtagaagaacgtgcatgagaaggaaaaatatttgtctcatatgaatcaaataaacaaagcgataatagctgctttccagagcttccctcagcatgttcctaattatagtttccaaaattttaaaacagtcttccagacagtttggcagcttccacctacgctggcaaatgtagtggaattctacaaaaataatctgatttgttgcttaatggctccaagttaaataggtgtaactctctaatagaatatcaggaattcatgccacagaggaaatccagaaactcagtaaagtttaggcaaatctgaaatgcttcacaggtatcatttaactgtgcattttcagtgttacaatctcaatactatctatcagaaatatgtccatttagatcagtgtccacgggtaaatgcaattgctgttagctttgccttcctcctgagaaaagggtttgccaagataagcattactatttcagtaaaacacatttattttctacaaactaccttttgccaagtactaatataagcaaatgctggaagaaaagtaaattgaaacagaaatttggatccttatccaaatgaaattaattaggaggtagtaaataaagactctaagctgtataactgttatcgatcatattttagtgtttccatcccaagatttccacatgttcttacacatgtcatcaactgtcaacttctcgcatgggttcaatttgtgatgaatgtttatatttgctaggttctactgatccacttctgaattacccacttgcccctcgggagacacataatgattttagggtgaggaaaatgctgctagaaaagggactttgtggctgggcgcggtggctcacgcctgtaatcccagcactttgagaggctgaggcgggcagattatgaggtcaggagatcgagaccatcctggctaacatggtgaaaccccatctctactaaaaatacaaaaattagctgagcgtggtggcttgtgcctgtaatctcagctacttgggaggctgaggcaggagaatcgcttgaacccgggagtcggaggttgcagtgagccgagattgcgccactgcactccagcctgggcgacagagcaagactgtctcacaacagaaaaagaagaaagaaaagtgactttgtttgggctgcccggcaacggatcccaagatagtgattccagagcaagttgtttacgtggaggtgaagaaaaccctacaggggctgaggttgggagaagaaggcagtcctcacagaaggtgttattaagcaagtccccacatggactgttaaactttcatcccatggaggaaatcctggaagccaccaaagaacacatacttcagagttacccaagctgaggcgagagtgagcctgaaaataatattgcaccaacattcaccagtcagccattgaggactgctcctggggatgttataataactctctcaactttccagcctgcccctgggcaggcaaatcaggcatctgtacccagagaaagtccctaggcagagaagcgctgtgtgggcagttggcagtcaggctggtgtgcactaaagtagtaagggctggggggaaagaggtgagtacaaattgagttcatctgtgaggcaggaaatgcttatcaaaccccaaattaatcatttttaaataacccatgatctattgacttgtaagagtgcagaaatttaaaatgaggctacattattttaaacatgctcctgtttcacttttactgatcaataaacagtaagtccttaggaaagggcaaggaccccgaggctatagttccagcccattctcatatcataagacatgtcacggtctatataaaatcaaacaacagctaaccccatctctactacacatacaaaaaaattagccaggcatggtggcacacgcctgtaatcccagctactcgagaggctgagacaggagaatcacttgaaatcagtagatggaggtcgcagtgagccaagatcacgccactacactccagcttgggctacagagtgagactctgtctcaaaaaaaataaaaaaataaaaaaatcaaacaacagctgatggtcctttcaattccatttcagatcactggggtaaagtgtattaaacaacaaactgattcaaataaacaatagatgtggccatttatttagagctggctagaaaatataaatggccacctatcgatgtttttctgcttcctttttatcaggacttgagaccaggagacgtatccagcaagcggaacctctgggaaaagcaatctgtggataaggtcacttcccccactaaggtaatctattgggaagactagtatttcagaggtttgttttcctgatgtatggtgtagtataatgtcctggagtcagatgagaaatatcactgacctacagatctttgcctgcacacccatcagtgtctaaaagaccagtacataacacagtgaaatgaaaagcgcattgcaagtttgtcagtcatacaacataaacggcccaaatccatggaatggttctcagtaggacattctcaatacaccacagtggtaggaacattggcagcagaaggccgtatgggataccatggtctacgtttccttacaaggtcccagcttagtgccacagtcatttaaaaatcacttggggaaaacatctgtctccctgagtgtttccaaaactgctttctggaaccattttagattacattgccactgccagcagcctaagactcagggttgctatggccaaaaaaaaaaaaaaaaatattcaaaagtaaggcaaccatttaccaccctgtgaaaatgaatgattaagaatgattgggttcctcttacttttagtcttctggtcaaaggatatggtcattcttcagaaaggaggctctgaagaacatctaaatgatgcttacactgcaaatgggaccctttgtggtacaatgagctcattcaactcccaactgtagcctttccccatttcaagtaatagacctcgtgttctccttcaataaaaagaaaattaaaaagggagaaactggagaccaacaataagcaaggttagaacaggctgcttatgggttgatttaaacagaagcacttcgtaagcaaactcaggactaaagagcacatcaacggcaactagagaatcactacaattcactgcagtgagagaattaccttccctttcccactttctcatgctcttagttctggtgcagctacctaaacatattaccccaccttcactattagctacgtattgcgcttttattccattaaaatccactagcctttctaagtcattgctaaacatatgaaaagtacctgctggtaattatcacattgctaactactagcgctacaagtgagcaccccactatatgccagacactattctaccttcttaccctccattatttcatttgatcctccagtcaccatgtgaggtaagtagtttatcattctcattttgcagctgagaaaaatgaggcattgagagatgaagtaactttcccaaagtcacacagtgaataagtagcatagcctgcattgatactccagcacctgatccgagcctgcatttttaaccattatacatggtactttcttttaggatgcatattcaggagaaaatgtatagttattcaattccttgtataattttctctcggtggcaggggagaaaagaactttctttgttattttttaaacaaagaatgagcttgttgacctaagcttttatgacctctctagcctatgctattagcgcattgcaggtttgtcagccatgcaatgtaaatagcccaaacccatggaatggttcccaggaagacattctccacacaccactgtgggaggaacattgacagcagaaggctctcctctcagacctctgagaggtatctgacttctcagaatggcagtcccagtgtttatataggttcctgtctgaaaagcagatgtcagctggccatagaccatcatcaccagtataacggagtctctctggataacattcctcctagccagagctctggaaagtggaacaaagatgatgtggaatggtcagactcagagaacaccactcacatacaaacatgaatggtactccctggagttatgtagcaccagggcagtacaaggtaggagggtgacagtgtgagttttcatgtgccactaacttctttctacagtagtaataatataaccaccagaccgagaactgagtttatgaggtagcagattaggtacctcttttgctccaaactgtcaaactcatttcttgttactcagtcattccttagaaatgaatacaatgaacacccttgaaaattggaattcacaacactttaagatttcttaatagcttggcaaaaatttttagcaactagctgagggggagagaatggtgtaagaataggactataggtcagataagtctcgtggggtaggggtgtaagaataggagggagaaaatagagattgctagattaaaaatgggagaaaactaaagataaacatcctccttcaccatcatacattgatgtggccctcactgagctattcagtcgcatgtgcctgttctggaatacacactgtagatttttggctcttacagtggggcttaaaaatgaaaaaaacaaagcaacttacttgactctaaatgctataagcaaggccaaaagttaagacaggaaaagagaacatcaaggagaaagacaggaagagggaagtgaaaaaaatcagcagaaggaaggctaaaataaaataagatccagccaggcgcagtggctcacacctgtaattccaacactttgggaggccgaggcaggcagatcactggaggtcaggagtttgagatcagcctggccaacatatagggaaaccccgtctctaccaaaaatacaaaaattagccgggcgtggtggtgtatgcccgtaatccccagctactcaggaggctgagatgggagaatcacttgaatctgggaggcagaggttgcagtgagctgagatcacaccactgcactccagcctgggtgacagagcaagattccatctcaaaaaaataaaaagtaaaataaaagatcatatttgaatggaatgccgataataatcctccctttcataaatatttattcctgccatactattattcatttttcttctgactataaaaaccatctgcctgaaacactgcaggctgtcagtttcacactacaggctgtcaatttcaagttctcttctcttggcaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatattttatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccatgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaatgtctttttctcacttatttttatgtacaatattgatagtgagaggtatgtctattataataaagattatggcacagt

SEQ ID NO: 35931 - DNA, 191300 bp, Homo sapiens; identical to SEQ ID NO: 35930

SEQ ID NO: 35932 - DNA, 191300 bp, Homo sapiens; identical to SEQ ID NO: 35930

SEQ ID NO: 35933 - DNA, 3878 bp, Homo sapiens
ggcgctatctcgcagcccccgaccagctcggcctgctgtcgggcatctctgctgtcctccggctgtagggctacctgcctccctcccggggggtgcactgcgagtccgactctagtgggggcagcgcctagcggactcccaaacccgctcaggtcctgccggcctcaccggcaccgcccaccctccagccggccgcggctctgcgcttgcgcgccggcagcacacagtgttaggggcgcgccctctgctctggacatgcgcgccgtcgcgagcgtctctgggaccggaagtgcgggcgagcgcgggtccccgggtctgacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtggtgaggacagggcccggggaggcggggacccgagggccctgggctcgcgccggcggccccatgcgcggtccccatcgagggccggggccgctccagctgctcgcgcccctccggctgctcgcgcccttccgctcctgccctctggaagcactgagggtatcaggcccaggcttagggctcgggtccggcgtcccgatgcaggactccgggtttaggtctcccagacccgcgcgatcgaccccgggtgcggaggttgtggcctcgggtcggcgtctgaggacccgctgacgctccggtgcccctccgtcctctctcacagcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcggggtgagcggcagagcagggcgtatggggcgagcagtggtggctaaggccggggagctctgctcagaggctcccttcgtgtctgcagggctctgccagtggcctggcttgaacggacgatgcggtcagtagggctggaggtctacacgcagagtttctcccggaaactgcccttcccagatgagacccacgagcgctatgtactgggggagtggggtgtgcctgggcccagaaagcaccttggagggaggggtctgggctgggtatcaccttgcgggggtgtcatggggccaggaagctcagtgggagggaaatccctggtgggcactggagggctaggaaagttgtggggggcccttcagccccctaccacaaagttacactgaggctccccccaccgatgctgcatacagatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccggggtgagtctcagggctgctggccgtggaggggtttggtcagtgccccagaccctgctgatcctgcttctggcctccagggcagatttattgggccaaagatatcgtcttcctggtaacagaacatgaccttctgggcactgaggcttggcttgaagcctaccacgatgtcaatgtcactggtaggttctcttgtcctgcctgccctggtccccctctcagggtcactgtcctcaccacgtcctccattagcactcattcacttgctcctacaggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagggggcctgttgtgcacgcttcagggcaaggtggggctgcctgcctgcctgagggctgaagggcacagggtctgtgggaggggctgtctcatcctgtcctgcacctctaaagctgcagcccgaggactggacatcattggatggaccgctgcagggcctgcagacactgctgctcatggttctgcggcaggcctccggccgcccccacggctcccatggcctcttcctgcgctaccgtgtggaggccctaaccctgcgtggcatcaatagcttccgccagtacaagtatgacctggtggcagtgggcaagtaagtagtctctggtcccccctttccatgcccaggatggggtctagctggagcggagtgggggatggcctggtggctctggccagccgtgaacctgccccacacctgacagggctttggagggcatgttccgcaagctcaaccacctcctggagcgcctgcaccagtccttcttcctctacttgctccccggcctctcccgcttcgtctccatcggcctctacatgcccgctgtcggcttcttgctcctggtccttggtctcaagatatcctctgccccttgccatctacctgtgaccagcctccagtctcctcaactctaggctggggagagtcttccatcctgatggggggtggggtacgggggtgagccctgggtccccctctgggcagatcccgttacacctcttgttggggtccttgattgggctacgctctggaactgtggatgcagctgcatgaggctggaatgggccttgaggagcccgggggtgcccctggccccagtgtaccccttcccccatcacaggtgatggcacccccttctgttgttggaatgggcttctggggtctgactggtgtttagtgttgcaacttagcctcagctggtgggatggtggtggtctttggggatcccctggccccagggtccatctccaagagcctgtgtgccctgcagggtgtggggctggcctcgctcgtggcacctctgctgatctcacaggccatgggactggccctctatgtcctgccagtgctgggccaacacgttgccacccagcacttcccagtggcagaggctgaggctgtggtgctgacactgctggcgatttatgcagctggcctggccctgccccacaatacccaccggtaagaggctgggctggttgttgggggcaggggtagaggtcccctggacatgcagacagcttgtgggttgcctctgagtcctttgtcttacagggtggtaagcacacaggccccagacaggggctggatggcactgaagctggtagccctgatctacctagcactgcagctgggctgcatcgccctcaccaacttctcactgggcttcctgctggccaccaccatggtgcccactgctgcgcttgccaagcctcatgggccccggtatgtatggatcagccccacttcccccaatgcctgtgccctcatcacagaccgcaccctcattcagtagccctttcccccaacctggtgcccatgcccccaccatggagcctaccttgatgttgcttctccacccaggaccctctatgctgccctgctggtgctgaccagcccggcagccacgctccttggcagcctgttcctgtggcgggagctgcaggaggcgccactgtcactggccgagggctggcagctcttcctggcagcgctagcccagggtgtgctggagcaccacacctacggcgccctgctcttcccactgctgtccctgggcctctacccctgctggctgcttttctggaatgtgctcttctggaagtgagatctgcctgtccgggctgggacagagactccccaaggaccccattctgcctccttctggggaaataaatgagtgtctgtttcagcagc

SEQ ID NO: 35934 - DNA, 11133 bp, Homo sapiens
ccctgcgtctctgcccgccccgtggcgcccgagtgcactgaagatggcggctgctgtaggacggttgctccgagcgtcggtgagtggctgtcggctggggacaggcgtggagacactggtggctccgggaacgtgcttctcagacaggaccccgcgcttctgggcatgagggccattcgcccttcttggagggtttccgcgggtaacggacccagaggcctccctccgggaaggttccatgcgcctgcgcagaaccgcccttccccactccatcctcgcggtctcttccccgagtccctcctctttcggcgtccccggtccccaggcccatctccacttaaggtcctggccctgattctgccaccgaccctgtgatcttgggcaagcgccttcgcctttctcagactgtgtacttaagatggaaagaatgatgcctacatcaaggcgttgctgtgaacagccccttaaatactggataaaaacgcgcaaagtgctaaaaaactcacaaaggctttccctcccaatcccactcccgcgtgtttctgctgctgtttcctgcttaactgtgggcaatgcgtcgtgctcttttggtacacggctttctctggtggggttcaacacagcccctttcgttctcctgagtcattttgaacattaaagttgagcaaaccggcagagtgcggtggctcacgcctgtaatcctagcactttgggaggccgaggcgggcagatcacttgagcccaggagtttgagaccagcctggacaataatagtgagaccttgtctctaaaaaaaaaaatagccgggcatggtggtcagtgctcctggggaggctaaggtgggaggatcacttgagcccaggaggtcgagactgcagcgagccgagatcgcgccactgcactctagcctgggtaaaagagcgagactctgtttcaaaaaaaaaaaaaaaaagttgagtaaacatgtcccttgagcctttaacagactcccagaggctgaatttggctcttcttgtttacttgtcgctggtgctggaggggccttgtttttctaaggaaaaccttgaaatggtagaacatactcagcagatagtgctgggaaaagcctgcacaagtcccctggcttctgaaccctgtgttgctttaagcgcatggagtttctgattttttttttttttttttttgagacggagttgtcgcccaggttagagtgcaatggcgcgatctcggctctgcaacctctgcctcccgggttcaagcaattctcctgcctcagcctcccaagcagctggaattacaggtgcccgccaccgccgcctggctaagttttgtgtttttagtagagatggagtttcaccatcttggccaggctggtctcgaactcctgacctggtgatcaacccgtcttggcctcccaaagtgctgggattacaggtgtgagcaaccgcgcccagccggtctttgtgttcttatagttcctctccaccttccagtctcctaggagaaggaagcagaagggagtgttaagaacatgcagatccaatccatgctcttagagtttggggtttgctatttggttcacaggaacagggacagctgaaaccaccgttggcacgatgccctttcagccttcagtcaccagtccaggaaaactttctaataaaaagtttctctttccaggttgcccgacatgtgagtgccattccttggggcatttctgccactgcagccctcaggcctgctgcatgtggaagaacgagcttgacaaatttattgtgttctggttccagtcaagcaaaattattcagcaccagtaagtgttatgtcatgtcttggctggagccaggtaaaggaaaaatgaaccatcgtctctggacaggggctctgaaccctggccaaacgttagagtcacctgggagctttcaggaacacagcactgcccccgtcccaccccagacaagttagtctgtggggtgagaccaggatgtgccgggtgattctaacgtgcagccagggttgagaatcactgaggcaaactgcccttgtcacatttccatgttggttgtcagagtttctaatccactgtgttgaggagggtgttactgggagctcagatgccttctgagtctagtgtgtctgaagagctgtgagtggtgggcagcctgtgggggacctgagagggcagctgctctaagattcaaacctgtgtaatggccccagctggccacttaggaaccagacctgtctaatggtatctgtaatctgagcgaaatttagctgtttcttgagatttacactcccttctctaggatatgggctttgctaagatcagcctcagataatgagtggtatttgaaaataccttgtctagatttgactagcctttgaaaaagcccgtatttaatatgtaatggtttgtggggatatactttagtaaagcctttgtttgtgggcaaaatgttctaagagctttcgcaattttactaccctggagcttcaaaatatttctagtagtgatgtgataccacaggcttaaaactttactccactggtttcgaatcctcatccccagcagcgcctcctgtttctgttcatggcggtgtcaggcattttgacattggaactactctgtcgctcattcctgggtagaagcaagtccttttcagttttgacacatctcttgcatccattcctttctgttctttctgccccatacctcccctcaatacgtctaagatcactgaaatcgaggctgggcacagtggctcacacctgtaatcccagcactttgagaggccaaggcaggcgaattacttgaggtcaggagttcaagaccatcctggccaacctggtgaaatcccgtctctactaaaaatacttaaaaaaaataagccgggtgtggtggtgtgctactggaatcccagctacttgggaggctgaggcaggagaattgcttgaacctgggaggcggaggttgcagtgagccgagaccatgccactacactccagcctaggtgacagagcgaaactctgtctcaaaaaaaaaaaaatcactgaaaccacctcctaacatgtctcccccttcctcctgctcctctttccctcctgccggactaatcttcctaaaaacccccatctcagccaggcactgtggctcacgcctgtaatcccagcactttgggaggccgaggctggcagatcacgaggtcaggagatggagaccatcctggctaacacggtgaaaccccatctctactaaaaatacaaaaaattagccgggcggggtggcgggcgcctgtggtcccagctactcgggaggctgaggccggagaatggcgtgaacccaggaggcagagcttgcagtgagctgagattgtgccactgcactccagcctgggcgaacagagcgagactccgcccttgactctgttatctttcctgctaagaagacccagcagcctagtatttaaggactgttgcaacatggccttcaaccattcctgcctgctgcctgctcttcactccgtacccttagacactctctgttctcattagactgccacacgctgctccacacacatgtcctgtcttccttcctgctgtttcctacatgccatctgccccatcccatctagacttgacaaaatctgaaccatatttaaaatccatctctagtctcatgtcttccttaattctatccctactttgtcttcctctttttagtttctgtagcagttggaattgaatttgtgcacaatctaaaactatagaaggagaaattacagttggccctctgtatctggattctgcatctgtggttggttgaatcgaaaatattgggagggaaaaatggatggttgtgtctatactgaacacaaagtctttttttcttgtcattccctaaacaatacagcttaacgactatttacgtagcatttacgtcgtattaggtattatgagtaatctagagatgatttaagtatactggagggtgtgtgtggattatatgcaaatcaccactttatgtaagagacttgagcatctgtagatttcgatatcctagaaccaatccccccacaggtggcaaaggatgactgtgcctaagatgtacagttgaaccgaatgttttgatttatactaagcactttatactactaattaattatgagaagtttaaataaaatcataggtgcttgacatagcaaatgatgaactccatatgagtgtgggttttttttcaggttcctcatgccatgcacctgctgtcacccagcatgcaccctattttaagggtacagccgttgtcaatggagagttcaaagacctaagccttgatgactttaaggggaaatatttggtgcttttcttctatcctttggatttgtaagtgtaatttctatgatgctttcgtgtcattctgagagcaagcacatatcctgttcccacactgaattgtctatccctagatacccttgtgaaaggaaggattctttctgaccctttatcactgatggccttgttgattacagctgggatctgtagcttgtttacaagtgataaacttcgggggtggggtaggacagctttctttatagtacacctctgtgctctggagcactgcttccctaagccagtctatgaaaaagttttcactggtctggggaaaaatgagaaaagtaggcataataaaatgatttttttcaaaaagcaactttattgaactgtaatttttttttcttaaaatatgtgttccctttccccattttttgatacaattcctaaaaataaaaaggtgaggggaggtagtagtacttttgccagcacaacactatagtccagtgaggatggtaaaccattttgccttttttacccttagcaagttgaactagttgttagaccactaattgttaaaatccttgtttttaaatgctctaatgagaatttctatcctttttttccagcacctttgtgtgtcctacagaaattgttgcttttagtgacaaagctaacgaatttcacgacgtgaactgtgaagttgtcgcagtctcagtggattcccactttagccatcttgcctggataaatacaccaagaaaggtatggcattgtacccctagcttttgctcttataaacttgcttggaagaatctaaatttctagctatgctgctggactatcaagatcaaattacgcaagggttgggtttttttttttttttttttttgagacggagcttcactcttgttgcccaggctggagtgcaatggcacaatctcagctcactgcaacctccgccacctgggttcaagcgattctcctacctcagcttcccgagtagctgggattacaggcatgtgtcaccacccctggctaattttgtatttttagtagagacggggtgtctccatgttggtcacgctggtctcgaactcctgacctcaggtgatccgcccaccttggcctcccaaagtgccggaattacaggcatgagccaccacacctggcctactcaaggtattttttttattattactcttccatgtctatgtttgagaaaattagcctttaaaagaatgctttaagaattagaaaaagcagccgggcgtgatggctcacgcctgtaatcccagcactttgagaggccgagacaggtggatcacaaagtcaggagatcgagaccatcctggctaacacggtgaaaccccatctctactaaaaataaaaaaaattagccaagtgtggtggtgggcgcctgtagtcccagctactcgggaggctgaggcaggagaatcgcttgaacccaggaggcggtggttgccatgagccaagatcgcaccactgcactccagcctgggcgacagagcgagactccatctcaaaataaataaataaataaataaaataataaagaattagaaaaagcatctgtagtcccagctactcaggagactggggtaggatgattgcatgagcccaggagtttgaggctgctgtgagctgtgattgcatcactgcattccagcctggtgacagcgagactctgtgtcttaaaaaaaaaattggaaaaggtctatagtattagccgggtgtaaatcttccttctgctcctttctagctgtgacctggaacaagttacttaggtttttcttgcctcagtttcctcattttgatagtgtcttctccagggtggtttcgaggaggcagtaggttaatagagtaagcagtgcttggcccgttgttgaattactgttacctatcgccgttactgttggtctcaaacattgtggtacgtggtcaagaatgttgtgaggccacacattctaacagtcatgtttgcattttgattagaatggtggtttgggccacatgaacatcgcactcttgtcagacttaactaagcagatttcccgagactacggtgtgctgttagaaggttctggtcttgcactaaggtaagatcctgtttctgatgaacttaagattatttttcatgtttagtatcattctgcttcttaggggatttatgtagaccttggtaaagcatttttaaaaccagaagatcctggctgggcatggtggctcatgcctgtaatcgtagcactttgggaggccaaggcgggaagatcacttgagttcagaagttcaagaccagcctgggcaacatagtgagacctcatccctattatattaaaaagaattaaaatttataataatcaatccttaattttagtctttaataaacactgatgaaatgcctcctgcaagggttggcggtctctcagaaatgctgagacatgcatgtcccctccaccaccttgggtctctttctgaagaaggctggctgcgtcttgaggccacactgctccatactccctaactatgtgggagccacttccatggggacacacacctgacattgaagccatcagactctgcagaaggggggactagcagggtaagaggtagtctcttggaatggtgaccatcttcagccctggaaccaaacaatccttggtttgagtttttcttttttttaactcagctacttaatagctgtgtgactttgggcaactgatttgatttaaccttgttgagccccagttttcccataactaaaatgaggtggtacgtcacaggtgggtgtgaggattaaatagtgacacagctagagtttttagcatagttactggcagcagttgttaggatttctgccccagaacatcatttctatctgtattcagtcccttattaaacctttattcctttgagtgtgaaaagctttcagtcctcagcagccccacattcaaacataaccttcctgggagggatgagaacttgggtcttagaattggcatcttgaagtctgctgagaataggagtgaaggagggatagggcagaacttgacctccaggaaggaagagaggggatccccctttgatgtgctgtgcctcacagttttgctgggggctggtcagcttaaagccagctcacctggccgggcgcggtggctcaggcctgtaatgccagcactttgggaggccgaggcaggtggatcacgaggtcaagagatcgagaccatcctggtcaacatggtgaaaccccgtctctactaaaaatacaaaaaattagctgggcgtggtggtgggcgcctgtagtcccagctactcgggaggctgaggcaggagaatggcgtgaacctgggaggtggagcttgcagtgagctgagatcgcaccactgcactccagcctgggcgacagagcaagactctgtctcaaaagcaaacaaacaaacaaacaaacaaagccagctcacctgcctgtcttgtaggtgacctctggcctgctctttcttgggttacaccttgggttttagcgctgagtggcatcttagagtttgggcctttttttcctctctttttttttttttcttttcttttcgagacggtgtcttgctttatcgcccaggctggagtgcagtggcgtgatctcggctcactgcaacctccacctcccgggttcaagcagttctcctgcctcagcctcccgagtagctgggattacaggcacacgccaccacgcccggccaatttttgtattcttagtagagatggggtttcatcgtgttggccaggctggtctcaaaactcttgacttcgtgatctgcctgcctcggcctctcaaaagtgctgggattacaggcatgagccaccgcacctggcagaccatttttttttttttaaactttaaagagattatcaaacgaatgcctaggtctttcagaattgtcaatggccagagaaagggtactggctatttttctcctacggtccctttccctatgagaactcactaattttgcagttacctctgtacccgttttaatattgagattaacaagagagagaagctgagtctggcttataagataaagacttttgggagtctatgggccctgctctgtcccagctctgcctcaccttctattggtggacttcagctggctgcaccctctgggaacagtttcacctcaaaccccaggctcccagtgcctgacccagggagggagaagcatcttttatcctgagttttctctaacctgccttttccatgagtgattgatacctgaaatttccacatccttttaagacagactgttaaaacctgtaggttaaataaccggacacagtgacacacacctatagtcacgctacttgggagtctgaggtgggaggatcagttgagccagaagttcgaggctgcagcctgctgtgatcacacctgagaagagcactgcactccagcgtgggcaatacagtgagaccctatatttaaaccaaacaaccaaaaaaacttctaggctaaacatatctgcatctgtcacagtaacaccaacacagaagataaacacagaccactgtggtagcgtggttcatctcattacatgctgctacatgattaaaagtgatgggcatggttttctgttttgcatagacttagagcctgtacattctttctatgaagatttttcccgtgggatttccccccatttacccaataattcattcataataaacagttgttgaacctagataaaatacacctctgtctcttcccatttgcctataagtttcttgccaagatgtgatacagcagctcaaagaatgcttgccaagtcactaatagtctttgctctctctagttcagtgactttccgatactgtgtaacattcagggcactatgtgaacttgtaagtgtgaccatactgcatgttttatggtgacctggtccagtactgcctttgttaaagcatctgtcatcagtaagagatgataagttttttgcacaacagtgaaaaccccacctttaagcatatgattacgcttaataaatattttattaaaaggagaattaaagacctaaaagggaagaagttagactgttctagttctggtactgttgaggcactgatgaggataaatgatcatgcagaggtctcttcataattgaccccaatggagtcatcaagcatttgagcgtcaacgatctcccagtgggccgaagcgtggaagaaaccctccgcttggtgaaggcgttccagtatgtagaaacacatggagaagtctgcccagcgaactggacaccggattctcctacggtaggtttttttccccaaaagcagtgaggtccatgttctctcagcctcgagagctattgacctgaaatatccacaaaagggagcccactcttgaagcaagcgtgcagatgatatgcaaatgggtgaagctgctgtggggtagagggggtggggtggggagccaggaaccaattatcagagacaggcaggcctttttttttttttttgagacggagtcttgctctcgcccaggctggagtgcagtggcgctctctcagctcactgcaagctccgcctcctgggttcacgccattgtcctgcctcagcctcctgagtagctgggactacagggcgcccaccaccacggctaattttttgaattttagtagagacggggtttcaccgtgttagccaggatggtctggatctcctgacctcgtgatccacccgccttggcctcccaaagtgctgggattaccggcgtgagccaccgtgcccggcctagagacaggcaggccttaatgaaactttcatctttatgttttaaaggaaatctttaaaagtttaaagaactttaggttaaaaattgggagattgccactcacttttgggactattattatggtaaagtcacagttacctaattaagcttttgtattttcagatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccaccagt

SEQ ID NO: 35935 - DNA, 15220 bp, Homo sapiens
gatgcaggctgggtgtggagggtgcgagtaggctggagtacaccagggagttcccagcaggccactaggagccacccaggatgcccggcaacctcatgagtcagacaagcagggctgtgtctatctggaagtttccagccaagctaggtaaaacacatggacacaggtaactatgctgtaaagcaaaatccccaagtcctacaatcgtgtcccagtggtgtccctgggccaccactttccagaagcaaagttattttctcaccccgttgttaagcacacagaatagagaaggtacggccgcaatccacccaagtgcccactgattagataggaacccccgaggtgaggctggaagctggggccaggagctccactcttcccaggagtcagagaagtgagttcatttgctggctttttagttcctaataagtccctggggcttttcgggatgcttaagccaagggcgtggggccgagagcgacactaggataacactaggcaaggctgagcaacccaggctaccaacagcacggacttgaaccgggtcgcatgccggagcggacgggatgaggtgcaccgcagaactggggactcctggtgccgggacgcggcgggctggggcgccccactctcggggcaagtctgcaatgcccggtgcccacaaaaaggacacatccatctttgtcaccccgaggcctggcacggcctgacggcccaggctcggtaaaagtcgggcggagagagtggaagcgcagagaaacccggggagggcgcttaagaacgggccagggcgcccggctgggctgccctgcctctcgggcgccggccaggcgtcccggccgccccaccacgccgtcggagcgcgccgaagctcagcccggggcgggcgggccaggagagggcccggggcccctgccgccgcggcgccccctcctgcgcacccggagggagaggccgcgcgcgcccgcccgctctttctgcgcgcggccctccccgctgcccccgccctcgcgccctgtttggagggagccaccctgacgtcggagccgctcccccgcgccgcgcgcccgcccggggccgcagacagcgcgcagcgcagcccagccgagcgtcgcggggccgccccccgccctgccggccgcctcgccgagcctcctggggcgcccgggcccgcgacccccgcacccagctccgcaggaccggcgggcgcgcgcggtaagtcccgcccgggtcggcacgcgggcgcccggcttccagaggcttcggccgcgggggcagtgccgcgcccccagcccggagctgcgtcccccggcgcgtccggcggccgcgggcaccgggtggaggcgccgccgccgagctcaggagccctgggggacctggcgggcgcctccggacgccggcgctggggacgtgggcgcggcacggggtggccggggggcaccgccgcgtccggagcccgtccccagactcgccccagggttccgtttctggatcggagtttccgcggccgggggagagagggagcgagggagggagatgcgtggccgggcgggccgggctcgcatgtcccccggccgtgcccgggcctcgccgcgccgcgcctctcggctctggacgtttccgcctcccgcggccccctctgcttcggtccccacgtccgtgtgtctgtctctccgtcgctccgtttccgccgctcactttcccctggtctgcccgtctctttccgttccccgcctgcctccgtgttcggctgcccgcgtttgtgtctctgcctctggcttttctctccctctctctgtctctgcgctgccctctgtgggggtctcgccctgtgtctgcgcctctccctgatcccccgccctccgatccagacaatcccccagtgtcggaggctcgccttcccccagcggggttcacgaatagtttcctagaccgggtgcggcaaaccctccccctgcctcccgccggccccgaggcctggcccgggtcatctccctggaattgagtctggggcagggagagccagcctttccgggggctcagttttcttaagaattccacccccgcgaggccggctggacgacaggccctgctgcgggccacctgcccggcccgctcccagggcggggcgattctgatcgtttacaagcggcggcaaagggggcagccgcctgccttggcgtggccggaggttggcgggcatcaagggagaaagccacacttccaggctttcggaggccctcgctccccaagctggacgccaccagcctgtaactaggggcaccccaggaaaacagaggtcagggctggaggccaaagaccgggcgctggcggggaagcaatttgtcaacaaggagcccctcaccctttgttactgcggaatggggcctccctagactcccccagatgctggggctgcttgggcgtggtttgccttgagttggggccaaagaaaaggcgaggctgcagcgtttcctcggtgacccctacccctctccacccacccctgcaagctggacctctctcccgggcctgtgttttggaggggtggacaggggagtaggtgttctgcatcggccagggatatcgcctcattattttaaagtgaaatttcaggctgagtttagctgcttccccccacccacaacctcaagggtcggaggctgccggagcgggcagggttgttggtgaggtctgcagtggaacttctgctgagcagatgtgcagcctggccctgcagcagctcattagcatggatttgttttggagactgtttttcgtttgcgggcaggagggtctgcggtaaggagggccgtggcctgggtttgggggctggcacagaggtggtcagggctggaagatgcaggcaggcctgggtggcacggggtcggccctgtgtgtccgccctctggacagttgactcatgctctccccagtgctgaaggaaggaaggaaaagccaccctgccgtgagactggggtcgtggaatcacagcggccttaagcagtatgctggagccaggctcctccctgggggatctgctgaaatggacgttcccaggccaggctgcccattttacagatgcaaacgtgaagctgaggggggaagcaaatggtcagtggctcgagctataaccattagactctcctgactccaggcacacagaaagccaatgtatgagctttggccagaactcatcctcaaaccccagagtgagcccaggaaacccggttgggctgaccagagccggggcctgacctgggtgagcagggagccccaagcctgacactgccttgccccttcacagagcaacaatttcagttgcaccattcaaggaagtccctgtgctcatttcaagacctggagcgatcgccccgcccttgccaagccccaagcctagggctgcagcccagccaccctccacaccctctgcacccagcagcatgctcagcctggcagtggggcacagcctgttttcttgaagttggattctggaggaggctggtgtctccacgaccctgtcttagagtctgagtgggatcttcctctcagttcccaccttagatagggaatcatgttgggtggcccttgacaatttctaaaatccattcccagctgtcatcccacttgctggagtttcacctcaaggttttccctaaatccagtttcactggggcagatgcagctcagactgaaatagcctcaggacctgccgaggatcctgtgggagcgaggggcagaagggagcaggcagaggccagggaggataagaggcccaagctagcacttaaagtgacatggactgaggaattaactatgatgggcgatctctccagagatttccatgtattcttcagtttaattgtcacagctgtcctgtgagctggatattagcactgtccccactttgcagatgaggaaactgaggtacagaaaggttagaatggggccaagtgatcctagtgctttgggaggctgaagtgggagttcaagaccagcctggtcaacaaagggagaccttgtctcttcaaaaaatacaaaaaaattagctgggcatggtggtgtatgcctgtaccaccagctattctggaggctgaggtgggaggatcacttgagccccagagtttgaggctgatgtgagctatgattgtgccaccgcgctccagcctgggtaacagagtgagatcctgttacaaataaaaacataaagataaaaagagaaagattagaatggctgagctaagatttgaaccccagtctgtcataattgtggagaatggaggaggagagccagaccctgcccttagtgagtgtggggggagaggaaaggtgggagaggcaggggagggggagcatctggtttgaaagccaccagccacaaacgctgcgtgctcgttgtgcatgcggactgtggtgtcacctgaatgctgagcccacaggtagaatcgtccgtctccatcagctggggccaagtgtggggaggttccccgaggaggttctggaagcaggaggtgaagatggggagggagagccctgccctttccaccgaggatttgtcagccctgccctccacggctctgcaccgagtggttgctggaaccggtaacaggaaaggcctggtgtgtgtgtgtgtgcgtgtgtgtgtgtgtgtgcgtgtgcgcgcgtgtgtgtgcgtgcttgtgcggatgtacattttcttgtgcatatataggcatgcttatatatgcgtctgtgtgttctgcgttcatagggggcacaggtggtttggggtatgcctgcttttgtgtgtgtgtgggtctggggtgagtggatacactctaccttgaaaatcctggtatatctggccttgagtgaccttgaatattcagacttaacccagaagaggaattggggaggatggttcacttgttataccaaagctaatccactctacaaagggtttcacggtgggcgggagtcaggaagaagtaagtgttccttgaaatctaggccactcctgtgtatttagggtgcatttaggatgcctttccaggtaccggaatccaggcagtgggctggggggcctcagtggcagcgttgttaatcgaagcccctttcctgggggctgggaggccgttgctcctggcctggctgggcctcagagtcccgtggggagcacattcaggtgcccaggccgtgcctcatacctggcggggtcacacgaggagggccgggccccggcgtctcagttttggcaggcatctcaggaaagaggtgtcacaggcctgaccccggagctggccttcctgggggaccctctggaccaagactttcaggaaagcaaccagggcagggctgctgtgtttgttccctgccctcttccccggagtgggagctacgggtgggtcacttccttgacctgtgcctcagtttccacggtgccaaaatgggtctgctgttgtcacctcctggggaatttcctttctgtgtgggcggcagctcagaatgtaccaggcattggcagagggccgctgaggaagtggagggcttggatttgggagtggcgggtgggtggggttgggaagacactcacctgtgccaaggacacctcctttaaagcctcacggcgcccccatgagggaggatcgtgtcacacatacctttaccagggctccaagagccagggtcagccatggccacaagacggttggctagggagtcaggaatgggatttgaactctggtctgtggagcccccaagcttccagtccaggcagtggctgaacgctagggtgttaacaggaatgagaggcgcagtcggctggggcagtggtgggagctccaggcctcatcctgactccagattccatcgtttcttgcttctttctcttcggtgaaccttttgacctgcaagggtagctgggggttaacctgctaccctccaggttcaaatcccggttctcctgtttactaacagtgtaagcccaagcagatttcttggcctctctgtgcctcagtttcttcatctaaaaatgggggaaagaataggatcaggcagttatcataggacagaataaattaatatccagtcacacaccacacaatgatgaaccacgtacacaatggtgctgccataaaattattattattattattattattattttgagatgaagtctcgctctgtcccccaggctggagtgcagtggtgcaatcttggctcactgcaacctctgcctcccgggttcaagtgattctcctgcctcagcctcctgagtagctgggactacaggcatgtgccaccacacccggctagtttttgtatttttagtagagacggggtttcgccatgttggccaggctggtctcgaactcctgacctcaagtgatctgccacctcgatctcccaaaatgctgggattacaggcgtgagccactgcgcctggcctcccatagaattataatactgtatttttactacaccttttctttctttcatgattgtgtagtggcatgatcctggctcactgcagcctcaacctcccaggaccgagtgatcctctcacctcagcctcccaagtagctgggaccacaggcatgcaccaccacacctggctagtttttaaatttttgtagagatgggatcgtcttatgttgcccaggctggtcttgaattcctgagctcaagcaattctctcaccttggcctcccaaagtgctgggattacaggtgtgagccaccatgcttagcctactttacgttttcttttcttttcttttctttgagacagagtctcgctttgtcgcccaggctggagtgcagtggcgtgatctcggctcactgcaagctccgcctcccgggttcacgccattctcctgcctcagcctccgtgtgtgttacagtgacctacagtatttagtacagtcacatgtggtccagatttgtagcctaggagcaatgggctatgccatatagcctaggtttgtaatagcctagactattcaggtttgagttcactctatcacctaatggcacatttctcagagtgcatccccatggctaactgacgcatgactatagttgcgctcttatatttagttcagaattcagaacctctgcttccctcctgagagccatctctgactgtgccaactcaaaacaactgccccctatttacccacatccctggacctcccctcaggggagtgtctgagtgggcatagggtctgtgcccccagctccctgccctcacccttgcctttctccccaccctcctagaagtgagtgagtgtggaactgcagggccctgaacggcccagggcagggcattgctttgcctgacttgctgggggccttgggacagccccttgcagagcagggagacttggctgggagatctccaactttccttcccgccctcgcttttggggagtcccatgacttgctgtgtgaccttcagggcgggaggaagggttgagaatctgggtgaggctctcaaggctcaggaaggaaagtacgatcgctgcttaaaaaaaaaaaatagattagttgctgcttgaaaaaacaaaaaagcgtaaaccaacaaaaaagcataaaccaacaaaaaaagaaaacctgctagccaagagcccaccccaccggtgggggcagcctgggctcttcggggctgggcaggagggtgggcggaggcaggtgtgtctggatgacagccgtgtgtgggagagacttcatctggcatcctcgctgcctcctgttccagcccagccttggctctgatgctggcccagcctttcccatgatcccctggggggaagagagctgaccttagtgggtgcctcctaggtgctgagtaccttcatttactcctcccaattcttctccagggaaggtgcaatgcttcccatgttagggttgagaaaggcagtttctgaggagtgaacttatttctggagtcacacagctcctaaggggaggggctgcagttcaaacactggggactccagggtccacgcttccagggggagcccggggaaaatgctggagctccacgctgctggcccggggaggccgaggccccagcgcctgcggagagcctgctagggcctggtgggttgggttatagcacccctctgtggacacagctggccctgtgataacctcagctgtgcactggaaagggtggaaggtaaggagggggccttctgcctcagttcgtctcatttctcctaacctctgtcccagcctgacgctgataaccagttcctgatctctgggcctgcaacctcttccaaaaagtcaccattaccccatttcccagtaagcctccattagcctcaaccccagtctcaacactcggcttcagcctagttgtgacccacagcctcggttgtgacctctcctaattccaactccaagtgctcaccccagcctccctccctccctctgtccctccctccctgcctccctccctcttttctttcctgtcctttttttccctttcctttttgacaggttcttgctctgtcacccagtctggagtgcagggacgcaatcatggctcactgcagccccaagcctggtctcaagccatcctcccgcctcagcttcccacatagctggactacaggtgcacatcacaatgcataatgtgataataaaaaatgtgttatcacagtgtgataataaaaaaatattttattttattttattttattttgagaccaagtctcactttgcttcccaggctagtcttggactcctgagttcaagtggtcctcccgctttggcctcccaaagtgctagaattacaggtgtgagccaccatgcctggcccaggctacttgcattacaaccccagtctcaattccaaatccacatcactttctgccccagtcacctccctggccccctgtgacctgttgttcctgaggaagcaagatggggtcagatataggaggacaagagtccctggacctctcctaagggtctagggggccagtccagcccagggagccctggccttaaatggacctccaggacccttcaggtgtgctgtgggcagacctgactcaggagtgaggaagccgcctgcatgccaggcttgttgaaaaattcactgggttgccagttagggaggaatccattctattttgttaggatgtggttgtactggaaacatgggctttgtcagcaagaccggaaatgcgtgggtgagggcctggatcgtgacaggaactcatttgggaggcggcgggggggcagcctgtccgacctcacttccagctgcccttcctccccagtgggctgggagtggggcttatcccggcattggggtcccctgagatggagacctgcaggagaggggcaggagctgggggaacttgctggatggggagcggagtgcttggaggggttcacagccctgcaggagccccactcagccagcccacctctagacccgtgctccccagacactttataaagtacttggctctgggctgggtgcagtggctcacacctgtaatcccagcaccttgggaggccgaggtgggcagatcacttgaggtcaggagtttgagaccagcctggccaacctggtgaaaccccatctctactaaaaatacaaaaatcagccaggtgtggtggcgaatgcctgtaattccagctattctggaggctgaggcaggagaatcacttgaacccgggaggcggaggttgcagtgagccaagatcatgccatgacactccagcctgggcgacagagtgagactctgtctcaaaaaaatagataagtaaggccgggcgcagtggctcacacctgtaatcccagcactttgggaggctgaggcgggcggatcacgaggtcaggagatcgagaccatcctggctaacacggtgaaaccccgtctctactgaaaatacaaaaaattagtggggcatggtggtgggcgcctgcagtcccagctacacgggaggctgaggcaggagaaggcgtgaacccaggaggcggagcttgcagtgagcagagatcgtgccactgcactccagcctgggcaacagagcgagactccgtctcaaaaaaaaaaaaaaaaaaaaagtacctggctttgccatctccatggcccatggtaggattgtcctaaatgggatgcccagtcccaagccacctgactcctggtgctgggcttctgtggggccactgggaccaggacttgtcccctcttcctcctgatttagcctcatccaggcccctctagggactgtcccaaggtaaagaatccctgactgagcgcatagctgcctaggaagcctgatcaaaacgcagactcctacccaccctagaacttttactccacaagttcctagggaattctgatcaaatttcaggtttgggaaccactggcctggctcactgcactcattttacaggtggtggggaaacaggtctgagtgtcccggtcacccagcacacgtggacccatgccctttctcggctgtgccgtcctccgagggtttgggggcctccttgaagaaggcactgccctcatctctgaagcctccctctcccgtgctttttgcactggggggcatgggtgaaacttacctggggcgagtctcctgaaagcggaatcctttgacacagactgccctgcagcgccaccttttggcagatcctggtattgttttagtatctcactccatcctatagcaggggaatttgcaaatggccaagtgcttagctttgattggctcccgcttgactcacgtgttagaatggggctggggacagtgatctgtgtagagcccttgtggattcgagtttctggtgaggcatcttagagaacaatactgtctggttcagggtcagtttttttgcctgaggtctggccagccaaggtggcccaggaattcactgcaggccaggtgcggtggctcacgcctgtaatcccagcactttggaatgctgaagcaggaagatcgcttgagccccaggagtttgagaccagcctgggcaacacggcgaaacctggtctttacagaaattagccaggtgtggtggcggacgcctgtagtcccagcaactcgggaggctgaggtgggaggatcacctgagcccagggaagtcgaggcttcagtgagccgtgatcatgccactgcactccagcgtgggtgaccgagtgagatcttttctcaaaaaacaaaaccaaaaagaaatcacagcaacgtgaaggttaaggctaacttttcaaacatcagaatcctgacaatggttgcagtagctttcaaggagacatggtgtgtggccagcccctccagggctgtgtggacagctttttgtgtattttcctgggtgactcacagcatcaaagggagaaaggaggtagtaattgttcagcacttgacatgtgcttgaacacttcgtaatcgcaatcctgtgccaggcagtggcaccatctcccctttttagatgaagaaaccgaggcaccgagataaaaagtaacttgctcaaggcaatttaggaagttgtaaaaccaaccaacacatatggaatgtgtattatctgctaggctcatttaatatctcatctgaccttccagatacccatctgatgtaggtaccactcccagctccaattgtgagattcagaggggagaaataacttgtccaaagttgcacttggttagtaagtgggagagctggggttgcgccaaggagtcggatgccagagtccatgctgtaacaccactacccggccccctgcaccttgctgtgcctcacctggcacctgtgctccgttctagggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacaggtgggacccaaggggtgggtggggggatgcggacaggggtccaaggagggaggaagaggaccagggctgcccatccctgcctccccaacagtgacacaggcatggtgacctctcctcccacagggcgtgcctaggacagtgcttcagctacagcgtccccaacaccttcccacagtccacagagtccctggttcactgtgactcctgcatgccagcccagtccatgtgggagattgtgagtactgcctgcctgccccacccagtctcggcccggagcctgccccagccttggcctttctccccaggctcctgtattccagcagatggccacagggccttagaaaggccccactgtgtgcagggtgaagggcttgtgctggggatacaaatgtgggcctccccacaggatggctcagaagtctgacaccaacttgtacaggacagggatgttcccgaagttccattctgatgtctctcatgggctgaagtcctttcaggggcttcctgttgttataggatgagaccaaaatctttgccctgtcccgagaacctggcatggcctggctcagtggcctttccagcctcctcctgcttcctgccttccttagtagcttgacgcttaacacagccaccttctttcagtgcctcgcacctgctccgttcgcttctaccccagggcccttgcacctgttcttttccctgcttggaacaccacctctgtcccctttctctagttcacttctattcattcttctgcccttggcccaagcagcgtttcctcagggcccctttccaggccccctgactggggcacaccctggtaccgttggctctcagagcacagtatgcctccgcttcaagcacctttcacacctgcagtcttccacctgcatccgggtgattttgacagatctgtttcccccactagactctgatttccttgaaggaaatgtgtctttgtgtccccagagctggcacagggtaggcgctctgtggaagggaggaaggaagagaggaagggagggagaaggaaaaaaggtacttagatgggtgatgataggggcagagtaggaggtagatggggttcctgcagggtgagcctcagctgggctgggctttggggtggggctcttttgaggaagtgaagtctgagctcagacccaaaggcgcagtttagggcatgtggtagtcggcggggataggggggtgggtggggggaaccttccaggcaaagggaacagcatgtgcggagtccctgaggcagagcccaagcacaggattggtaagagtggtgcagggtcaggggtaggggggccagccagctggtggcacctgaaggtcctgggtggccttagtgaggggtcagggtttgtctccaagtgcagggggatcgcggcggtgggggcgattttagcaggggcaggccacactggtggctgctggtggggaatgggtgggaaggtggcaggactggatgtgaggagacagctctggtggcttgtgcaggggttcaatttccccctccccatgggaccccagagctaactgggcatcacaggtgggctctgggattcttgatcccatgaggaagtattaccctaggggctgccttgcctgccccagacctttgggaacatgcctctgcttctctcttgccctctgcaggtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagcccgaggacccccctggggccccccacacagaggaagagggggctgaggactgaggcccccccaactcttcctcccctctcatccccctgtggaatgttgggtctcactctctggggaagtcaggggagaagctgaagcccccctttggcactggatggacttggcttcagactcggacttgaatgctgcccggttgccatggagatctgaaggggcggggttagagccaagctgcacaatttaatatattcaagagtggggggaggaagcagaggtcttcagggctctttttttggggggggtggtctcttcctgtctggcttctagagatgtgcctgtgggagggggaggaagttggctgagccattgagtgctgggggaggccatccaagatggcatgaatcgggctaaggtccctgggggtgcagatggtactgctgaggtcccgggcttagtgtgagcatcttgccagcctcaggcttgagggagggctgggctagaaagaccactggcagaaacaggaggctccggcccacaggtttccccaaggcctctcaccccacttcccatctccagggaagcgtcgccccagtggcactgaagtggccctccctcagcggaggggtttgggagtcaggcctgggcaggaccctgctgactcgtggcgcgggagctgggagccaggctctccgggcctttctctggcttccttggcttgcctggtgggggaaggggaggaggggaagaaggaaagggaagagtcttccaaggccagaaggagggggacaaccccccaagaccatccctgaagacgagcatccccctcctctccctgttagaaatgttagtgccccgcactgtgccccaagttctaggccccccagaaagctgccagagccggccgccttctcccctctcccagggatgctctttgtaaatatcggatgggtgtgggagtgaggggttacctccctcgccccaaggttccagaggccctaggcgggatgggctcgctgaacctcgaggaactccaggacgaggaggacatgggacttgcgtggacagtcagggttcacttgggctctctctagctccccaattctgcctgcctcctccctcccagctgcactttaaccctagaaggtggggacctggggggagggacagggcaggcgggcccatgaagaaagcccctcgttgcccagcactgtctgcgtctgctcttctgtgcccagggtggctgccagcccactgcctcctgcctggggtggcctggccctcctggctgttgcgacgcgggcttctggagcttgtcaccattggacagtctccctgatggaccctcagtcttctcatgaataaattccttcaacgcc

SEQ ID NO: 35936 - DNA, 78969 bp, Homo sapiens
atctcgagatagccgcagctctcgcgatctttctggagccgcacctccacgcggagtccgagcgcgtgtgctgagaccccagggtcgggagggcggagactgggagggagggagaagcccctttggcctgccttacggaagcctgcgagggagggtggtgtccactgcccagttccgtgtcccgatgcccagcgccagcgccagccgcaagagtcaggagaagccgcgggagatcatggacgcggcggaagtgggtttcctcctttcctgggcctgggaggacagacccctgggccgggctgcgccgagggagggaggagggggagtggggccctacaggtccttgtcggcacgttctccgcaggctgcgggcgtggggtccgggcgcctagagcccttgccccagcagtggggccagaccctctccggaccgcgtttcttgcgggggtcacctgggagtttggcctactagaagcgtgtccccggggtggggaggacgggaagaaccagccgccccggaagtaggagcgcggcgtcacacttgagtctctctgggttaggcacgtcctgcacgtaatgcacaatccctgggaaaattttaataagcactagtaatcgatatgtactcagccctcgtgttcctaatgctttagcaagtaatgacagtacttagcaaaaccatctgccaatatgtttaatgaccatttcccatgtgacagctttaaagaacacatgtcatttttatttactttctccctctcagtgacccggtaaggtaggtaataggagttaccgagaatgcatttgaggtgaagtgaccccaaatcacgtggataattcataacacccagtgatccttcggtgcttttcagaaatcaaagtttgaaaccatcctacaagttatgtgtgctgtagtactgttaagccttaatttccgtctggctccctaatttttctataaggagttctgagtttgtggtaagcaacatgagaagtaaggtcatcttagaatactaaatgaggaagagtcactgaaatattaatagtactaattatgaatgcaacttttttgtccttcacacaatttaatctccttctgttgccctcaggcttcattgtgtgactgtatctctctactctggccagggttatctttttctttaaattgttcagtaagcgccttaaacatgtctggttttattttggtgtaaacacaaaatccagcaccctcctgctctaaaggagaggattccaacaggtagctgtaaagtgacagaaacttaattgtttcatacagatcttaagttaccttgtaaaaactagggcaattatttttgtgtactcttaatctgcttaattacataaactatcagtgtacccttacagatagtataggtctagatacaaggtagacattgtggcagagttatgccattttatagctagaagaatcttagatcattttagaggtaaagtaagattgaaataaaggccacttatctatttaataagtatattttgttaacagattggaccctaggtcttctgtttcctgttcctaactctaatctgtaacaagaaatttgatattattatattgtcagtgtcaaactcctgtaacctggtatcctgaatctggtttttagaaacaggaagctggtgaattttttgatgatgttttacaaaaggaaagttgtagttagcttatacccagcatctccagtttctaaaaactgtggacatctggtgctcagaaagcttacccaaaacgttggttctctttgaacatttcttcctgtaataggaagttaataaaactgtggtacttcatcctactcccttcacagaggaaatttatgtccctgctttgaagtagtttcatctttttgaagaaggtagttaagatgtgttgtacatatgtgtaaattttatctgagaatgttattaagtatggtaaatccatctaggagtggtgatcttcaaaacaaactaaccagaaacagtacttttctgttttctgtagagtacatatgtaaatgaatgagagatttccacattatgaaactactgactttctgaattaataaaatgatcctgaaagttaaattcatttttatattctattattagtatttatgtgtttactgtgctcttagtgtttacataaaaagtcacgatgcaaaaaactttttttgtaggattatgctaaagagagatatggaatatcttcaatgatacaatcacaagaaaaaccaggttagtagctatgtgacagtaaataaagcttttttgctttctaattccaggaaagctctaaatgaaattttaagtaaggttggcataaatctgaaggtataattctgaaaagcttaaatgacattaataatccaagtagatgtcataaccctgtgtaaacattgtcagtttagggttccaactctagaaaaggaaaaaaaatgttattaggtattgtaggttaaatggtatgttttaaatggtagattatattttttaaatattcctaaattattaggtaagattcaaccgttgtctaggagataggagagtggctaataactgccttcatcacatgtagcctttttgcatgctttaataaagctacctcttttacttcccccaacccccacaactttacttctctgactgtttttagctattatttattcctattttgcttgactcttcccaaacatttatattttcacttattctctacagcatccttgaaaactaaggaaccaaagttgaaagataagaaacttgacttacacagagtctgccagacttgggattagaaccaaaggccatctgaccctagagtccatgggtccttccatcttacatcttctctggcttctttggcagtactatgatttgagttttaaagcctccacccccactccattttgtttactcgtagctttagtgtctgggaatgaaatgaattattcttagaccccagtctatcttttcttataaccgctcttttttgttagtgtatgttggcatctttatatttcttttttttttttttgggagacagaggctcgctctgtcgcccaggctggagtgcagtggcatgatctcggctcacttcaacttccgcctcccaagttcctacaattctcctgcctcagcctcctgagcagctgggactacaggcgcacaccgccacgcctcactttttttttgtattttagtagagatggggtttcactgtgttgcccaggctgatctcgaactcctgaactcaaggcaatccacccacctcggcctcccaaagtgctaggattacaggtgtgagccaccgcacccggccttatatttctttgaaattgacctgactcatgttgtttctctcagacctgtagattttttatttataaatgtttgcctttcttttacttctattctatatatgtaatttcaacagatttgtcttacttaactatttgacagtaatttttcttttggtagacacttcaaattacgtctctcactctttggtgcagtaattgtagacgtttacattcttgcccattggaagcactgcttccagtttagagggctgcctatgaatattatgctttggaaataaaacacctctaggttaattttattgttatatttgatttgccacatgatcacaaaatcacttttctttcccaggcttgttgggaaagaatacaataaaagaccaaaattcagagactgagttgggaggatcacttgagcccaggaatttgaaactagcctgggaaacatagtgagaccccatctctacagaaagtaaaaaaattagctaggcgtggtggcatacaccttttatcccagctactcaggaggctgatgggaggatcacttgagcctgtgaggtcaaggctgcggtgagccacgatcacaccactggacttcagcctgggcaacagagtgagaccctgtcaaaaaaaaaaaaaagccaaaatttctgaaaatcatttccaaaacataaagatgaaataaagtaattgagtacaggttgagtatcccttagccaaaatgcttgagaccacaaaagtgttttggactttatttttttggactttggaatatttgcattatatttaccacttgagcatccctaatctgaaaatccaaaatcctccgatgagcatctcctttgaccatcatgtcagcactcaaaaagttttggatttgggagcattccgggttttcgggttaggaatgctcaacctatgtaaaatagactatgagcaatagagtataggggatgatattcctctgccagggcaagcaggaggagacacttgagactttgttttcaggttaggtgtctttctcaactgtacttccttgagctgtaacacaaagaagctcactggagtttaggtctttaacataggcccaaagcagccattaacataattgctgttgttcttttgctggcaaatccacagacagttgcgttcttccacttagagagaaagataacctatgtatgtaaaattcggcctttggttttacctctgcaaaaatgccaattctttgctcaaggtggtttcctttctcatctgcttccatttctctgcattaatcactctgatgcccatgactcttaaaagtgcagttttcaaactgaaatcctactaccttggttgttactggttagccagtcatagtgatgtgagtatggcatgggcttcgggtatgttcgggtgtattaaaggttgagaacccctatgctagttaattgccatgccacaagaaagaagagccattaccctttttcttctccaaagtgctagtaaaattatcctaattatcgcatatctcttagacttctgcttttctgttttgtgtggttttgagttgtgattgcttggttagccattgctttttcagtcttggcattttcaaatctgccttttaaaatcttctgctgatgtgtctgtcttttctctttcacgctttcttttgcctgagtttacacagcagacttggaagttggcttaactcataaagtctgttggcagtgttttgcagaaatcctcttgtgatgccagtggctttaaaattcctctttcattctctttgcttttggctatgagaaccgtgttatttattctcctgtaaatcagattctctctgcagctgcatcttttcttcaataggcaaattataaatacatttagaaaaattcggtaagacatacagtatttataatttgactttatgtctcaaaaggtattctcgatattgtaatgtcatgtctattgctatgtttaatttaactaatacttaaatgtttttctctaatcaaatgattgcatttagaagagtagcaaaaatgattgttgaatgttgcgttgtatacacatctttacataacagttgttttgtagctgttttcctgtttaggaactctagatgaatgtagtattttgtttagtattaggagcataatagttggggctcacttacagccaaaaggctcgatagggaaatgtatgagatgacatcaagcatgattggatcttggggctcaggaagcatctacaggcctttctctctccagcttttggctctgtttcctttaggatattggcctccttctcgaatcctgcaaacatagcaggaaaggtgaaagctgcagccctgggcctgcaccatgtcagcgcagcaatcccaggaaagagagcttcattcccagcatctgtatatttagtcccagagaaagacttgcattagctcagttagagtcactgcatcctggggaataggatactgcgactgttcagacttggtagagactagctgacttaggtactgtggcaggcaggcaaaagttccatgtcctaggcaggataggctgtgtttggccttacaagtcattgaagtgttcagatttgcattttgaaactgtctgacttcaaaggagactgaattagaaggggacacagggattgcagttaggaagctattgctgtagttcaggtgggagacaatagcttggtttagtatggcggcagtgaagatggtagagaaatagacggattttaaaaatatgtttagaaagcacagttcacaaaacttgaggcaaattgcacatggaacatgatagagaagacagtgttgtcaaagattgagaattattcaggatggttccaagtacttatgctagctgtcaaaaataattatgatctctttgtaaattctgaatttaaaaattattttactatataaaaatcgtttactgttattacagatcgagttttggttcgggttagagacttgacaatacaaaaagctgatgaagttgtttgggtacgtgcaagagttcatacaagcagagctaaaggtaggattggtttcattattaaagctctttcggtaaggactccgaattttttgtcttacatattcctcacagaccaaagtaaatctttaaaaacaaaacaaaaacatgtaacttttctttcttaaaagtcactgtaaagtattaacccatggttaatcaattttagattcctgtaaaacatccttacaaataatttgaccctaaagactgatgaaatctaagacttcaagctacttttctagcatcgctctaaagtttaattattttcagctggagaaggagtagctaaaaaaaaaaaaaaattgaaaaaaaagagtaaactttaattatttaagtgaagagtgtttttgagaaacttcccgtttgttaatatttttatatttgtaattatctagatgaggagagaagtgaacaaaagataagactgggcaattcaatacagtaaccactgaccacatgcagctatttacatttaaattcagtaattccgtcacactagctgtatttcaagagcttaatgaccacatgtggctaacggctcccattttggacagacagcacaaatacagaatattctcatcatagaaagttctttcagacagtgctaaaaatttagcctcaacaacagagaagaaacgttaggatcatttagacagaccctgttcttatagaaaattggcctactgtagtgttcagaattgtctaaaaatatcaattgacacactagtttataactttatacttttcatactttttcacatttgatcatccctgcaagtttgtgaagtaggcagaacaagcattcctattccactttataaatgaggaaacacgttcagaatgaagctacttgcccaaagtctcatagtaattggtggagtataaacagaagctagaagctttctaagacatctccgtctctttagcagagttctttgcttctgtagtatttaatatgtcccatgataatagcattttttaattgtgttttataatatttttattgtagaattaatacatgcccattattttaaaaattctactttgcttctatagtatttaatatgtcccatgatatatagcatttctttccttttttctttttttctttttttttttttttttttttttgagacagagtcttgctctgtcacccaggctggagtgctgtgttgcgatctcggctcactgcaatctctgcctccagggttcaagtgattctcctgtctcagcctcccaagtagctgggattacaggcatgcgccaccatgcctggcaaagttttgcatttttagtagagacagagtttcaccatgttggccaggctggtcttgaactcccgacctcaggtgatcctctcgccttggcctcccaaagtgctgggattacaggcataagtcactgcacccagccgatagagcatttcttaattgtgttttataatttttttattgtagaattaatacatgcccattatttttaaaattccagcactttatacatacatttcactcttagggccaccattgttaagagtttgtctattctttcagtatcctcccctgatgaatactgacagactttgagaagagtactggtggagttttaaattttcaaataatgttgatttgccttcctgaaaggttgggccatttattctgccaatagtcagtcacattgtattataatccttcatttactcgtctctctcccgttatactgagagcctttgttctgtccaaatggggcactttttcctaaacatagtaatttagcaaattaaaagatagaatgcatgctacaagtaagcctgaaccaagaatatttcccttcacacccatccctttattttacgactgccatgtctgtttcttcttaacagttaaaactcatgagtgatacttcccagtggttatgaataagaccttttcagtgagacagatgtgtgtttgaatcctggatttgtgcttacaatctgtttactctacgcaaattgcataacctttccaatcctcagtgtcttctcttaaaacaagtatatattaatacctagcttataagatgttatgtagtaatatttataaagtatttagctctatgcttggtgcagtgtaagccttcgataattgagtcatgttaatgagcatgacagttacttacttgccttccatcgtagttttttgtgggtcttatttcctgttgtcagctcttggaaggtgctactgcttattttcttgctttgtttggtacacaacacataataagaaccctaccgaataatagatgaataaaacaggtgttttatacacatataatagagcattgtcttctgggtcttgttcttgctgtccagtagctcactctaattgagatcagcatgtaagtatgaagcatcacgtaagtgaaaaaatatacaggttgagtatcccttatccagaatgcttgggactggaagtgttttggattttggattttttttttttttttttttggaatatttgcattactggctgagcatcccaaatctgaaatccaaaatgctccaatgagcatgttttttgagagtcatgtcggcactcaaaaagtttttggattttgaaacattgcacattttcggatttgagaatgttcttcctgtaccatctgctagtgtttttttttccatttgtgacaaattattttagtctcttaattgatagtgcctcctgcctcaaaacatgaaacaaattgcaaggtgtaaggactttattgatgatatgagctaatcatggtgggtggatagggagaatttatgagtgtcaatgttatgaacagactgaacggtttaaaactttcttaagagtttttaattgaggaatttcatagcactttttattagtatattaactgttattctatctcaaaaaaataaattatttatgggtattggggaattttggaggggctaaatgctaattgcactattttaaaactcaaacagcacaaaaactaaagaataaagcagaaagtgtaattcacttgttctgctcccaagagaataaaaacactgtgaaagtttgaaatgatagaaattgctttaaacaaaaattgatactttttcttttacaaaagtgagttcatatgctgtatcagtgttttatgtagctctacatgatcatttacaatatttttaatttgcaaaattgaaaaatttattctagattataaaagtaataaccattttttgttaaatactcaagcattatagaattaaatcaggtataaagtggaaaactgactgtaatccttctttacagatttgtgggtttttttggttggtttgtttgaggtggagtcttgccctgtcactcaggctggagtgcagtgaggcaatctcagctcattgcaacctctgcctcctgggttgaagcaattctcgtgcctcagcctcccaagtagctgggattacaggtacctgccaccacatccagctaatttttgtatttctagtagagatgagggcttttttttttttttttttgagtcagggtcttgccctgtcacacaggctggagtgcagtggtgtggtctcggttcactgcagcctccttagctaggactacaggcatgcgccaccatgcccagctgatttttgtatttttagtagagacaagggtctcaccatgttggccagggtggtctcaaactcctgacctcaggtgatctgcctacctcgacctcccaaagtgctgggattacaggcttcagccactgtacccagcctcagatttgtttttatgaggaagttgagggtcaatgtgagtgtatatgtgtgtttgagctaaaatttttataatactctgtattattttataacttgcacttttctttatcttttggatatcttttcatgtctgtgcgtataggttttttttgtttgtttgttttttgagacagagtctcgctctgtcgcccaggctggagtgcagtggcacagtctccgctcactgcaaactccgcctcccaggttcacatcattctcctgcctcagcctcccaagtagctgggactacagacacctgccaccacgcccggctaatttttttgtatttttagtagagacggggtttcactatgttagccagaatggtctcgatctcctgaccttgtgatccacccacctcagcctcccaaagtgctgggattacaggcgtgagccactatgcccggccgcatcattgttttttaatggtttcatagtatttcatagtatggctatatttttttacatatattttatttttctcatttgtataaagttcagatttatccattgttgctttaatttgtgtttcagtcattggttagattaaacttcttttcctgatatgttaactattttgaacttcttttatatattgtttgttcttgccctgttcctattttattaaaaaagaacaaataattttctccaagtctgtttgcatttcagttttttgaggcgaagagaggcattacaaatgatgatcattatgtccttttctttcaaatgtttgtatctcatttcttgtttctctttgcaatactagtaggttctctagtacttcagggattcacacaatgaagaatttttgaaagagcagaaattccagttctaaatgaatgattttgagtttaaggttctacataaaatgtcattagaaaataaatggcaaagttttaaaaagtagattaaaagtagtttcccagccaagttttctgtttgtcaggaggagatgttgaattttatcagacctttttctagcatttcttcccttcaaaatataattgtgttatgtgatgtatatgtagagaggttcattatactattcactctgcttttgtgtttgttggaaattttctgtgtaataaaataaattttaacgtagttgatcctcattattcgtggactgcatattcgcaaattcacctactggctaaaatgtatttataaccccagaacacttgcagcacttttgtggtcattctcagtcatgccagacctgtacatgtgcagagtggcagagtatttgcgtcatccagtacacacattcccaattaaagtcaaacacagtaatgttctgccttcttgtttcagctctcatactgtaaataagcgtccctttcacagtctctttaatgccacatttatgccttttaaaaaaggacttttaaaaacttttgtgtgggtacatagtaggtgtatatatttttggggtacataataggtgtatatatttatgaggtacttgaaatattttgaaacaggcatgcagtgtgtaataatcacatcatagaagattgggtatgcatcccctcaagcatttattctttgtgttacatacaatccagttatattcttttaattatttttattttttaaattttatttattttttgagacaagtatggcccaggctggcgtgcagccgtgtgatctcaactcactgcacctgtggctcctaggctcaagccatcctcccacagcctcctgagtagctgggactacaggcacatgtcaccacgcccagctaatttttattttttattttttcattttttttgtaaagatggggttttgccatgttgcccaggctggtctgaaactcatgagctcaagctatctatccacctcagcctcccaaagtgcttggattacaggtgtgagccaccacgacacccagtcattcttttagttatttttaaatgtacaattattattggctgtagtccccctgttctgctatcaaatactaggtcttactcattctttttttttttggtacccattaattttcccagggccccccaccttcaacccctattacccttcccagcctctgttaactatctttctattctctatatccatgagttcaattgttttgattttaagatcccacaagtaagtgagaatatgcgatgtttgtctttctgtgcctggcttatttcacttaaaatgacctccagttccatctatgttgttgcagatgataggatctcattcttttttatggctggatagtactccattgtgtatatgtagcacattttctttatccattcatctgttgatggatacttaggttgcttccaaatattggctgttgtgaatgctgctgcagtaaacatgagagtgcagatatctcttcgatacactgatttcctttcttttgggtatatacccaacagtgggattgctggatcatgtggtaactctatttttagttttttgaggaacctccaaactgttctacatagtgattgtactaatttacattcccaccagcagtgtaccagggttccccttcctccacatcctcaccagcatttgttatttgactttttgatataagcctttttaactgaaaggagatgatacctcattgtagttttgatttgcattcctctgaagatcagtgatgatgagcactttttcatatgcctttttgccatttgtatgtcttcttttgagaaatgtctatttaaatcttttgcccattttaaaattgtattagatttttttcctgtagagttgcttgagctccttatgtattctggttagtaattcctcgtcagatgggtagtttgtaaatactttgtcccattctgtgggttgtctcttcactttgttgattgttacctttactgtgcagaagctttttaacttgatgtgatcccatttgtccatttctacttcagttgcctgtgcttgtggagtattactcaagaaatttttgcccagaccagtgtcctagagggtttccccaatgttttcttgtagtattatagttcaaagtcttagatttaagtcttcaattcattgtgattgatttttatataaggtaagagatgggatcaagttttagtcttttgcatatggatatccagttttcccagcaccgtttattgaaaagactattttcccccatgtatgttattggcacctttgtcaaaaatgagtttactgtagatgtgtggatctgcttctggattctctcttctgttccactggtctgtgtgtctgtttttatgccagtaccaagttgtttttggttactatagctccgtagtataatttgaaggtaagtagtgtgattcctccagttttattatttttgctcagcatagctttggctattctaggtcttttgtgatttcatgtaaattttaggatttttttttctatttctgtggagaatgtcattggcattttgatagggattgcactgaatatgtagattactttgagtagtatttaacaatattgattcttcccatccatgaacatggaatatctttccattttttgtgtttcctcttcaatttctttcaatagtgttctatagtttttagagatctttcacttctttggttaattcctaggtgtttaattttatttgtggttattgtatgtgggattacttttttttatttctttttcacattgttcactattggcatatagaaaaatgctactgacatttatatgttgattttgtatccttcaactttactgattactgaatttatccgttctgataggttttgctggagtctttaggtttttccaaatataagatcatagcatccacaaaaaaggataattttacttcttcctttccaatttggatgccctttatttttttctcttatctgattgctctagctaagatttctagtcctatgttgaataacagtggtgaaaatgagcatccttgtcgtgttccagatctaagagaaaaggatttcagtttttcctcattcagtacaatactagctgtgtgtctgtcgtatatggcttttattatgttaaggtatgttccttctatgcccagtttttggggggtttttatcatgaagggatttgaactttatcagctgcttttttagcatcagttggaaatgatcatatcgcttttgtccttcatcctgttgatacaatgtattacattgattgatttgtatattttgaacctccttgcatccctgagataaatcccacttggtcacgatgaatgatctttttaccgtattgttgaatttggtttgctagtattttgttgaggatttttgcatcagtatttatcagagatagtggtctgtagttttctttttctgatctatctttggttttggtgccagggtaatactggcctcttagaatgagtttggaagtattttctcttcctctgttttttggaacagtttgagtaggattggtgtgagtcctttaaatgtttagtagaattcagcagtaaagccatcaggtcctgggcttttctttattgggagactttttattacggctttaatcttgttgtttgttactggtctgctcagattttggatttcttcatggttcaatcttggtaggttgtatgtgtctagaaatgtccatttcttctagattttccaacttattggcatatattgcttatagtagccactaatcttttgaatttctatggtatcagttgtaatgtctcctttttcatctctaattttatttatttaggtcttttctcttttttccttagtctggctaaaagcttgtcatttttgtttatcttttcaaaaaaccaactttttgtttcattgatcttttatattgtttcctttatttcaaattcatttatttctgctctgatctttattagttcttctgattttgggttcagtttatacttttctagttctttaagatgcattgttaggttatttgaagttctttttttaggtagatacttataattttcctcttagtacagctttcactgtatcccatatgttttggcatgttgtttccattatcatttgtttcaagaaattttttgatttccttaatttcttcattgacccactggtcatcccagagcatattgtttaatttccatgtgtttatatagtttccagaatttctcattattgatttgtagtgttattctgttgtggtccaagaagatgcttaatgggctcttttttttttttttttttttttttgagacagggtctcactatgttgcccaggctagagtacagtggttattcacaggtatgattgcagcgcactgcagcctccaactcttggcctcatacaatcctcctgcctcaccctcccaagtagctgcgactgtagttatgcaccactgtgcccagcttgcttttgccttttaaaatggccccaagtatggttctcaaatgtttctaaagttcggaagcacaagaagactgtgctgttcccttaagaagaaaatacctgtgtttagatatgctttgtttaggcatgagttacagtgcccttggccatgagttaagtgttaatggctcaccaatatatattaaggtatctttaaacagaaacacacacaaaagaaggttatgtattaatcagttggcaaaaatattgtgaccataagcgtgaagaaacctaaccctaaacttccctcaggagcaatgattcagtatgccctaattcagtattgtggcagctttacagagcataacttctataaataacaagaatcaactttatgtaattgcagtgagtgacaataatgtattttataacattgaaccatttttagattctttgaataaactcaatttggcaaaggtgcgggtggcttttttttttttagtatagtgcttgtttaacttactttttgtggaattttgcatttataatctggtcttcatcatttttaactggaaaattctattctaagttataatacttaatgtaagttactcaaataatacattaatacttgcacacgaatctttaaaagaatacagaaataatgatactcccttttttcttctatactacctatcctctgccccaaccttttctattcattcttttttttattattcattcttaatttgttctgtgtctttccaaatctttataatgcacgtatgtgcacatacacacccacacacacagtttgttttattttggatgtgtgtatgtttaatatgtcttgttatactttacatattatttttcaactttttaaaataattaacagtgtttcttggaaacccttccatgataactagttacagatctacacgaggtagtatttctccaagatgggtgtatagaaatgaaattgctgggttaaagggcatgcatatgcatttttaaaatttctaatactagatcatcctcccaagaggttgtattcaaatatattcccacaggtatgtcacagtaccactttctccacatccttgctgccatggtttcgttatttttcccatgctatattgaaacttaatcctggtcaggcacggtggctcacatgtgtaatcccagcaccttcaggggcttaggcagggtggatcacttgaatccaggagttcaagaccagcctggccaacatggtaaaaccccatctctactaaaaatacaaaaaatagccgggcatcatggcacacgcctgtaatcccagctacctgggagtctgaggcatgagaatcacttgaacccaggaggcggaggttgcagtgagctgagatcgcaccactacactccagcctgggtgacagagtgagactctgtctcaaaaaaaaaaaaaaaaaaaaagctgaatccccagtgtggcattgttgaaaggtgaggcctttaagaggtgattgggtcatgagggctctacccccttgaatggattatcacaggagtggcattagtgactttataaggagacctaaactagcacactcagcttttcaccttgatgccctctgccaccttagggctctgcagagtccccaccagcaagaaggcacttacaagttgtgtcccttcaactttggacttcccagcctccagaactttaaaaaaataagtttgtttccatataaattacccaatttcagatactctgttacaagcaacagaaaacgtactgagacacttgtcagcagtgattgtcagtgttttttatttctgccaatgtagattatctttatttattttttgaaacagagtcttgctctgttgcccaggctggagtgcagtgatatgatctcaactcactgcaacctccacctgccgggttcaagtgattctcctgccttagcctcccaagtagctggctgggactacaggcatgcaccaccatatccagctaatttttatatttttagtagagtcggggtttcaccattttggccaggctagtctcaaactcctgacctcaggtgatctgcccaccttggcctcccaaagtgctgggattacagatgtgagccactgcccccggccgtagattgtgtttaagaataaaatcttgtgctctgaatttgcaaaaaccctgattgctagtaccctcttcttcctatatcttatgtacgaaaaatcatatcaataaatatgacttacttgggatcgtttgtgtgctttaaccccaggagtaatatattaaagctgggcttcaagaaacaactcatggtggcagtttctagtagagcaaagccctgagaaactgtgaataaggaaatggaagtgtcaaaatcctagtgtcaaaagtatgacatttagaatcctataatgcaaaaataagagtctcttcgtataaaaaaacaaaacaagaaaagcctgtatattttttccttaagggcagtgtttcagacattttttaaaatgaaaatcagatttcttatggtaggtttatatataacatccctaaagtgaagtgttttaaataggagcaaggagaaatttcttaccttaatgatatgcttaaaattagtttctttcaagcgtgaaacatatgagcataagtctgcatattgaaagagtaattggaatgtctgtcattcctttcaaattttatacgtaccatgtggaaggcactggcacaaaataattatttcagcactattcttcctaaaaacttacttacacttccaaaataacttcaacttaaatctatgcaggaacatttcaggggaagcaataagtggaaaatacttcagaacgttgagatctttgttgttttaatccctaattgattaatacaaatcatgaaggaaaatattaaggttggatattaggaagttaaggtacattatctaaataatgaatccagggggcttagcaagctaaaagtcagcaggaagagatgaaaacataggattgcctcacatctttgatactctggttctcccatgaaggcctatttcattgctgagccatcaccataatggagctgagaagaaactttttgtcctaactacctaccatgtttgttcttcagctcagaaataaagacttcacgataaaaaatttctgactttacatttttctaaaacactacatccatataaacttaagaaataaactgcttcttctgaaaacttaatcaaaatgcagcacaaagttttaagtgttaagaatttaaatttaaaatatcaaaagatagaccaggcttgtaatctcaacactttgggaggctgaggcaggtggatcacttgaagtcaggagttcgagaccagcctgaccaacatggtgaaactccatctctactaaaaaaatacaaaaattagttaggcatgggattacacgcttgtaatcccagctactcgagagactgaggcaggagaatcacttgaacccaggaggcagaggttgcagtcatcgtgccattactctccagcctggacaacagagcaagactctgtctcaacaaaacaaaacaaaacaaaaacaaataaaatatcaaaagatagttcattcagctgttttgaacactgactttgttttctataaactgtcttttgtgttggaaagttccaagaagaaagattaataatatttagcagttgattaatctgccctctaaagttcatataccagcttttcaagtgagaactttttactaaactgaggaattatatatttgcttcttaaaatagaaagtaatttatgggtatggtaaaaataaaaattccagtagtagaaaaagatatggaaatagaggtctcacgattctcctccatctcaccacagtctcttccctgcaaaatagccactgttctttcttgtgtgttcttgcagaaaaaaaaaaaaaaatacatttacagacagacaaaatatacatacagacatgaccatattttttgttttttaaatttgcacaaaaaggatcatgtacacactgctcctgtttatctctcagcatgtggaaggtagtgccttgtaaaacatggaactaagctaatcatgcagtaaggtgtgtcaccaaccagagccaaagaaagaacaattttgtttcctaatacatgacaagagcttggtctcaaaagtgcttcatagagaagtagtctgagtggacagttctatttaccagggagccagtactgatggtttgtttgtttgtttgagtcctttaaaaatcattttaagtggaccatcaaggttcttgtattttaaagtgctttgaacgtagaaagcttgaggaccatagcattagtcacaagtagttctgtttcaatttccttaacatatattctaaaaaatgtatttattgagtcaaagataacgtttttaagccttttaatgcttattgccaaattgttctccagaagcattacacaaatttaccctgccttcagcaagttataaaggaacggttttacgattttaattctcccaagcattgagtaataattcgattttatattttgtattttttaaatctttgctcatttgagaggtaaataatctgtcgttgtttgcttcaacttgcattacttgcattaccagtaacatttttttccttatacggtatttacttactatggtttttttcttgttccttcagattatctgttttggtctattgcctgtttatctattgggatctcagtgttcttttctcataaatctttaagatccttatgtattaaaaagattaatttatataggttatatgctgttcagcacttattttttctcagtgttattgttcctttgatttattttgtatatagatgttctttcattcttaaacttagaaagttttcccttcctccgtgatatagtttaatattcagttccattttttactctgtattcgttggggtgtttgtttaaatttcgtaatgtcctgaattctgtttagaattaggatctcctttatctaatacggtctattatcaattttttcttatgttctattgatctggttatttttgtactggcacacttttacatactatataggtttttgtaaaacaatatgctcatagactgttctcactacttcattcccttcctcccccatctgttgcctttttttaataagaaaaattttttagaattaaatctaataagcacagtaaacatttaaagggtatagtgaacattcttcacttctttttttttttttttttttttttgaggtggagtcttgctctgttacccaggctggagtgcagtgacacgatctcagctcattgcaacctccgcctgctgggttcaagcaattctcctgcctcaacctcccaagtagttggtattacaggcacctgccaccacgcccggctaatatttgcatttttagtagagatggggtttcaccacgttggccaacctagtctcgaactcctgacctcaagtgatccgcccacctcggcctcccagagtgctgggattacaggcgtgagccaacatgactggccttcacttcacttataaccgttgattttctttcttttctctagcaggcatgcaaatcttaggaggtacatttgctcctatgtttagctgtctaaaacttcccgggttctacttactgcttgtgtttaattttgaacttggccaaaatttcctttcagcccttacctttcttctgtacctacctgtgagtgtatagttctcttaaaaaatttttattctgattagaaaagtagtgcatatttattgtagaaagttcagaaaatacagaaaaatacagggacagaacaatttcctataatttcaccattcattggtagccacattttggtggtttttttccccatatgatcaatcttaatatacttcttacacaaacaaaattgggattacacgttacatatggttttatcactttttcctcatgtaagagtctatcatgattttctaacaaatacttacgttcgtgttcccagcgccctgcatactttttgtatatagtcatccagctgtgaaaaaggaatgataattaatcatcaaataagtagtcagtggtagtggtgttactaataatagtcattaaggccaggcgcagtggctcacgcctgtaatcccggcactttgggaggccaaggcgggtggatcacctggggtcacgagttcgagaccagcctgaccaatatggtgaagcccccgtctctactacaaatacaaaaattagccaggtgtggtggtaggcacttgtagtcccagctactcaggaggctgagacaggagaattgcttgaacccagaaggtggaggttgcagtgagccgagattatgccattgcattccagcctgggcaacagagcgagatgccatctcaaaaaaaaaaaaagaagtcattaataggccaggcgcgatggctcacacctgtaatcccagcactttgggaggctgaggtgggtggatcacctgaggtcaggagttcgagaccagcctggccaacatggtgaaaccccatctctgctaaaaatacaaaaattagctaggcctggtggcacgtgcctgtaatcccagctacacaagaggctgaggcaggagaatcgcttgaacccggggggcggaggttgcagtgagctgaggtagcgccattggactccagcctgggcaacaagagcaaaactccatctcaaaaaaaaaaaaaagtcattaatagttaacattaattgggctccgtctcaactttaaacatattataaaatccttatgattatgaaagaaaacctcatgactcttaccgtctccattttccagatgaagaactgagatataaagtggtttaataattttcccacaggccccttcataggaagtgataggatatgataccaggccttttgatttcaaagcttttacttttttttctaccagacacactaattgttaccccctagtgccgacccatagacttatcctgtgctcaccctttgtaagtcctttagagttctccattctttctccagggtctttgtgtagcactgaaattatcactggacagctttgtgaggcagctaggttggtgctgcttctgtctggactattagagtagctaatacactctgactacattatggcttagcctagcactgtcgtgtgcacattaccttccatttcacagtaacatacttttctaagtggggtaacgtggctgtggtttcagtagtagttcctaggaaaatgttatttttattcatctgcaagtttctctgtggtaataacctttgtccttccaatattttaaaactcctttgaatttgtttcctgtattaatacaacttcgttttttaggattttactttgtgactggatcatcctccaaagcaaaagggaaaattaagagtgttttttagtggttaaaaacctgccaatcatatatgactctaaagtcaatagattatgtctgtgttgacactttgtttgcaacctgtcttttttaacttgtgattgctatctgatttgcatttcaaaatactgtatgttgaaagtagtaactgtaagtctgcttgcatttttgctttcctttttctttcttcttttggttaaggcccattctaaatgtaaaatataatgctcagtttaaaaaacaaaatcttgtgatgttttacaaaacaatctgatgtgtaaagtggtcttggagagattaacccattttttatgaagaagtaatttcccagaatttgatcagagacttaagaaggatctgctttggaggaaaaagggatgtcacaaggatacataataacgaaatatattatgaataatgtttttcagaaggttaagaataaggagtaacagttctttatcaaagaagaaggaataaagaggcccaggatatgtaaaaataaaactggttatagggcttgaagaaaatgatctttaatagacaatataagttatttggagtaaaaaaaaatgcgagactcataaaatatgaaggactaggaaggtgataaaggaaaaatgaagaacgtagaacatgaaaggcactagcctgtcaatttaaatgctctttaaaatgtactttggtaggaagaaactctgtagatggaccaccccatagtgtttgtgtccttgtttttaagcactgtgttagcacttttgtggttgcagtattgaaacttccatagtagtacagtgcctttgcatgtggaatatactaactattgaatgaatgttgaaagtgatctcaagttacttgaaatttgtttaataaatcaatgcaatgacaaaataattttcttgatttagaagtttttttgaaattggtgatttgcctgtgttcttataacaagttgaaagcatttcttgttactcatcataggaacttgagtttctttaagggttgtcagttgagtgtgagtattttgtctgtggaagccaaatggatagtatacacatgcatgcgtgcctgatgagtatagtaaattttggcccacttttaaagtagagagcattttccttctttgtaaaacctgaagttgcgtgtccttaatacatttgtgttctttctgtctttttcagggaaacagtgcttcttagtcctacgtcagcagcagtttaatgtccaggctcttgtggcggtgggagaccatgcaagcaagcagatggttaaatttgctgccaagtaagtaagcaattatatcctgttgtcagaataaacaatggtgggaaccaagactcccaggggtttggaccattttcatacattaacatcaatgcttcgtttgtttaaaaatgtagttatttaaattgtcagttcagtgttgctgaatacattaaacttacaaaagagaaaatatggagcacaggcttgaaattcatttggaactgctgaagcagcactctctacagacaagtcacatttactttcaagtagagtaacaaaaagcctggcagcctcaacatagcagagcaactttattttgttgtgtttgttgagcttcatttcctccctccttccctccctcccccagtttgagatttgcatgttgagcaacaagttttctaaccaaaaaataaaagtatataaaataaaagaatgtagtttggcaaatgattgcctccagaaggaagtaaaacaaatgttttacaacttttagctttgacaccaaaagggtttaggagaaaaaaggtaaaacttgctttttcctcctgtaaaagtctgggctgtctggctcagagttcccgtagaagcagcacattgttttgttcagcttgcaggaggcagatatagagatagaagtgtggttgtgtgtgcagtggctctaaggtgatgagagctgttttacttggtagtggtgatgtggctaattttgtttcatgttttttttcaatttcatcagaattttatttccatgataatgatctcagaaaacatgagaaaatggatggtctttgtgttttaagtaataaagtaatttcatagtgtgtaagtgttttttaaaagaaagaattcaatcagagtaaatgatatattttttctattgatttttttaaatgtttgctttttagatgcatgctttctaagaatgagttaatacagatggaattatgaattttagaattggaaagaaacttaaaaattatctaattcaatatcgtaatttagctttcagccctccctgaccctctagcacaatgttatacatataaaggatgctcagcagctggttttggtttagatatttatcaaattacgtcatagtaatacctgcactcggatttaagaacttaagtgccatgaattgtatcgattcattgatgagatcagtagtattttaatactactaatacagtagccccacctctccctatctcccagtgctgcccagagatgaccacttttcttctacgtgtgtcttctggtaattaggtttgcttgtttcgtctcctggttagagtgtgtgcttgtggggtgcatttgtcttccaaccttttaaggttagtgtgtatcctatgaagtcaaacataaatgagcttggtccctagaaattttatctgcacagagaaccttctataaaagaaaaaaagatggtcctggaaaccgcagacatagatgctaaattctattaaatatactgaaaaatactggaaaaaagtcaacctcaaatcaacaaacaacttttgtataataatttggttttgaaaactaatacatgaagccgacagttacatagagaatatatttttccattaaactgcattataacctcggcgttacattcctaaagcttccagtggaaaagccttttgaaaatcccagttacccataatattcagtgagaggcattctactgacaagtggacggttaatccatgtgatgtgtttagaagcagacacgttaaagtactccgcaaataagttattcctattattttggatcttctcagaaactcctgggacttgactaaataacagcgattgactatatcagatgtcaaccatagcttaatagctaaaagagctactttcaaatggtctcccaaacagaacttagttcactaatgccctcataaaattaaagaacatctttttatcattattttattaaaggctttcatccaaatgggatgatatacgggcgatctttttttttttttttttttttttttttttttttttttttttgagacggagtttcactcttgttgcccaggctggagtgcaatggcgtggtctccgctcatcgcaacctcctacccggttcaagcaattctcctgcctcagcctccccagtagctgggattacaggcatatgccaccaccatgcccagctacttttgtatttttagtagagacgaggtttctccatgttggtcaggctggtcttgaactcccaacctcaggtgatccgcccgcctcagctgttcaaagtgctgggattacaggcatgagccaccgcagccggccatgggtgatctttcttttagacaagggaagaatataggtaatttagcctagattttttaattcctgaagtggaactccataaggatctagatgcagttcaggcttaactaaattgtgacttgatttttttttttttaagcaaaggacatgcagctatttttagtccctttaaaaaatggactttatataaagtagcaatgtgtaggaaaaggttgagctgttccaaattataaaccttgtcactggttatatgtaagtgaatggagccaattttatacaataggttcaacatgtggtacatagataactattattaaacttttggcactagcatgttaaggaatcgagcctgaataattaccagtaggtgggttaatggcttttgctatcttgcgaaaaaggaaaattcttatggctaagactcgttggcaaaaaatgatgagtttttaggttttgtagttggttaagataattttcttaggaacatgattttatgttccagatgggtcagtcagtttgtcctttctgtgtgatgtaacctatacttctaagatagttcagaaatcctgatccttcttggtaggagaagtctacttttagacttcggcaagaactttttagaacttttttagggaaaagatatatggggtttttctttgtcttttaaaatccttttcctaaaaattgttaactgtgttttagcgcataaaatgggtatgcgctaaaattgtgaaagcaaaaattaaggtagctttcatacatttatctttgaggtcacttgtttaggcagcagatcactagtagtataacagttggatgcaaggaaaaatgtttctatttctagttccagttaagttcagatacttgataattcatttgatacaaattttaactaacaatgccacattaactttcacataagtaagacagttttataaaatgattgactgatactttatttaaattgtcattcttagattactctttgcagaattttggttaattgtgaagctgaaatatcctgactctacctcaaagttaatgttttaggtaactgaacaggtattcttcccattactagtattgaagtcagaatacagaaacaaattaattatggaactggctctaaggctacaagctttatagagtaaaccaaatgtcagcaatttagttttagtgaaattaaaaattaatattacttattaatttgaattttgtttttatttaaaaatttatttctattttaaagttaagggctataagcataagcatttacagtagtttggtatttgtaggtctttaagtaacatgacagaacttatttaagtgattaatggggtttgctgacattttttattccactaaagagaacctatagagtagttttagaactgctggtctgtgccttgttgagtagtgcatacttctcaccacgcttattttggatcagctgggcatggtggctcatgcctgtaatcccagcaatttgggaggccaaaatgggccgttcacttgaacccagaagtttgagaccagcctggccaacatggcgaaaccccatctctaccaaaaaaattttttttaaattagtcggccgagcgtggtggctcatacctgtaatcccagtactttgggaggccgaggcgggcagatcacgaggtcaggagatcaagaccatcctggctaacacccgtctctactaaaaatacaaaaaattagccaggcatggtggcgggcacatgtagtcccagctactcgggaggctgaggcaggagaatcggttgaacccaggaggcgaaggttgcagtgagccaagattgtgccactgcactccagcctgggcgacagagcgagactccgtctcaaaaaaaaaaaaaattagtaggatatggctgcatgcacctgtagtcgcatctactctggaggctgaggtgggagaatcacctgagcccaggagatccaggctgcagtgagctgtgattgtgccaccgcagtccagcttgggcaacagagcaagactctggcttaaaaaataagttatcacaggccgggcgcggttggtcacacctgtaatcccagcactatggaaggccaaggtgggtgtatcatctgaggtcaggagttcaagaccaacctggccaacatggtgaaaccccgtctctactaaaaataaaaaaaaatagccaggtgtggtggtaggcgcctctaatcccagctactcgggaagctgaggcaggagaattgctggaatctgggggatggaggttgcagtgagccgagatcacaccattgcattccagactgggcgacagagtaggactccatctcaaaaaaaataaataaataagttatcatggtttaaagaatgatttaaatctttaatttttgcaaagcatcagtggacagatgggtgtaatagaggtagagagaacgcaaggatttagttccctactgactagtgacaaagagtccctcattgaccaaactctcctcagattcctttgaaagaactttctgctccggtaagcctcgacttttttacttcatgtttatgcctgcattgttcagttttagtaagaatcctgctgagttgctttaactataacccctgtcatcccccctcagtatctgatcacccgccatagctaattgggttccttctcctccaccatccctcaggtgatgtctgatcaccctcgcctgccttcaacaagaatcctgttaggtcattttagccagaatcttctgtttctcctgatggctcctcttagtaattttccatccactgactctatattcccatctttgggtctaagtttccacttgccaatcgtgtattcaaagttaagcctagttctatactcagatctcttttcccctattgcaataatcttgaataaaatttgtttttaccactttaagtattgtccatctctggttttccctgacacaaccatgtgacttcttacattgtttactgtttgcttatcttaactcattcttcaaagctaagatgctgattcaaacacttatttctacttgcgtgagaaatataaaagtctgaggtctagtgtggtactaattcactataattgaaagaagtgcttgacctataaatgaagcttatgcttaccttagaattgaaacatatggctgggcgtggtggctcacacttataatcccagcactttgggaagccaaagcaggcagatcacttgagcccagaagttcaaaaccagcctgggcaatatggtgaaacatcatctctaccaaaaaagtcagaataattagccaggcatggtggtgtgagcctgtagtccccagctacctgggaggcgaaggttgcagtgagctgagattgtgccacagcactccagcttgtgtgacagagcgagaccctgtctaaaaaaaaaaaaaaaaaaaaaaaaaaaaaaaagatttttattttcaaaaggtggtggttttattattttttgaagtacttacctaatttatttttgttcttttgatgctgttttaattagcaaatacgtggtttcttgtgtttgggcattttgtacttctttgcctcagtgaattgtacatttaatttataacattgaagcattttatgttggtgcattatttgaagaactggtgtgtgacaactttatggcatgcctcttttctaactaatcttttttcaccccccttgcaaagatttaaaaattactcatttgaatgtgggtggttatgtagatctgtaagtatatttatcattgagtatatagtaagatttaacacattatttctgacaaccagaaagctaaaaaatgtatcggttttgctgaaaatctttaatagtcaagtttctgtgttaaaaattttagtagtttttgttgatataaggatatataaatacgcaaatggaaaaacttaatgtacatagtgtctctttcaccattattgacttttttttttttttttggtggtggtaataaatggaaatagtttagaaaaatatgagccgatgactacccaaaaataaaatttggtcatcccccagtctctaccaactgccaagtttatccctactgttaacaagacaatcagaatacatcaatatataggatttctgttatattttaggcctttattgagactatctagtataatgaaatacttcaaggtgcttaaatctgtggtacctagaatgatgagaaataaaaggtaacactattagtgtaaaggttatgctgcccatcttctgtcatcttgggtttattgatagattatgtgaataatgatgggctactcttcctcgacctctgtagcaggtgtcatgtattttttagatgaaaggtcatggaaaacccatcccctaccacataccagactcgttgcatgtgaaatattatttttaatatttaagaagcttaatctgaaattaaaactcagtatagtaactacacttgctttattttgccacctttccagtgtctagcatggatttttatgcttatttggatgcctcttctctgttagtccctgtaccagacccaaaagttacagtacagtggtcaccagcatcttccccagttgatgtacaggggaaataacaggttcccttataataactgactcttattctatactaagcgtggagccacaaagtgccagatttttttctcacttgatccacacaacagccccatgaggtgtaaatactgtttttgtctttttttgttttggggcggagaggaggttggttctgttctctctctcttttttttttttttttttttggttttgtttttttggttttgtttttgttttcaggtgaggaaatcgagatgtgaaatattaagtgtcttgactaaggtctcttagattctggattcacactctagtctctgtgtcatcctgcctctctgaaatagtgtgtaatggtgttagatcaaaaccctccacattatagctccatttagaatacagtttgttagctagacactgctcccaaggtattacgagtcaaaactaaagggaaaaaagtttagtttaaaaaatagaactgggccaggcgtggtgactcatgcctgtaatcccagcactttaggacactgaggtaggaggatcacttgagcccaagagttcaagaccaacctggtcaacatggcaaaaccctgtcgctacaaaaaaaaaaattaaataaataaataaaaattaaaaataaataaaaagtggatctgattataaagtaataaaaaatatttttatgtttgagtgataaattcctgctaaaaattccaaaggaggaatttatttttaaccattagtaacactaatgagtttgtctcttccactataaagcagtagctgccttctaaggaatcaccctattgttaaaaagcatgctctaaaaataagggggagggacagggagttggaacctagagagtttcatgttttcagtgacagttattcttcctgaataatctcaataagaaaaattttgatagttaaaaacatgaaacctaacaccactagaggcaaatctaataatcaattgcatctacttttgcttaggctttgggcttttttttcttatcagcactgccattaacacaacacaatacgttttgcacctttgtatcactctcttgagaagtaaggcacaaagtcactcaaaaaagcagctgtgtggtgtatgccactgatgttgaaaataaaaccacagactcagaatttaaaataagaatttatcttttactaagattgtggatgcaggaaagaatagaaaggatttggctggataactaatactgttccttaacacatctaattgcaggcgctttgttagacacttgtaccaactaaagtcctttcctagaattgctccatcaacagcaagggagaagagatcttggaacatttaggtatgggtgtccttttagattagctttttgtagagtgtgctaatgtactgtcagttctgctatgtgacatacgcattcctaaaactaaccgtcctatgcaaaattgtgcaataaaaaccacagtgtttatggagaaaatgagattaatggcataacactcaaaaacttgatgtggagaaagggaaacccctcatacactattggtgggaatgtaaattagtatagcctctatggaaaacggtatggcggctcatgagaaattaaaaatagaactaccatatgatccagtaatcccattatggggtaattattcaaaggaaatgaaatgattatgtcaaagagagatacatatttgcactccaatatttattgcagcaccattcaccatagccaagatatggattcaacctaagtttccttcaacagatgaatggataaagtgtgggatatatacactctggaatactattcagccataaaaagtgaaatcttgtcatttgtggcaacatagatgaacctgcagagcattatgttgagtggaataagctggacacagagaaatactggatgatctcatgtgctaaagatgttgatcacatagatgtagagagaatagttggtggggggcagagggggatgagggagagattggtcagtctgttcaaaattacagataggaagaagagtaagttctggtgttctcttgcacagtagggtaactatggttaacaatattgcatatttcaaaacagctggaagagagaatttgggaagttctcaccacaaggaagtgataaatgtttgaggtgatagatatgccaaatgctctgatttgatttttacacgatgtgtacatatatggagacatcacactgtacctcataaatatgtacaattatgtgtcaatttaaaaaaaaaaacttcattaatggcatactttttgaaaagatgagacggagtctcactcttgttgccaaggctggagtgcagtggtgcaatctcggcttactgcaacctctgcctcccaggttcaagcgattctcctgcgtcagcctcctgggtagctgggtaaattacaggcgcccaccaccacgcccagctaatttttgtatttttagtagagacagggtttcatcatgttggccagcctggtcttgaactcctcacctcaggtgatccacccgcctcagcctcccaaagtgcagggactacaggcatgagccaccaagcccggccagtaacctaacttcttaaaggtaacagttttatactcgttgaatggttaagaaatacataaatactacaataaatatagcattttaccttgaaaaaaatgtgcagtttgcttgtggaagtgggtatcaaaagaaaggcagtttgtaagttattttgaagtgatggaaggaacagtgtctgaaatcagagggaaagttgtaacaccagatgtggatgggtatggctcataacatgagttacaagtagatgtttaaggtgtgtgcattttgtatattcctgcatggccgagtgcacccaagtgttgttgtctgcattgaccgagtgttctcactgatgaaatctggcataggcaaaagcaaaattctcattatactcaaattgttccctaatgtgtcaacgatgttgaaacaaattcacattttcaaaacaagctttatagcaaaactgtactcttgaaagtgacaacagggtttgctagtgaatggataaaacatgaatcttatctgtttgcttacaacttatgtgtgggggtaaggaaaataatgaattagaaaattactggtttgagaaactaagtggaagtgacaccattaatctggaataaattgccaacatggactgagagtacacatgacccactctttggaactgagatgggctcatcttcccatatggcacttggccaaatatagagtagacaccaaagaggagtgaagctagcccctttagcaaagaagaaggcaagtccattgggcaggcagccagtagtgtttcctaagcttaactatatcgagttaattgaagagaagttccaggcttttgagtttagaaaaagcccaacaggttgttttacccaataatcctctgattataatttccaccaatctgcctcccccaggctgcctcattttccgttggacctcatcaagacttctagtctttttatccatctccacattctctcccagtcttttcagcctcttcctgacctcatgtggccccatgctccattcctgaaactacgctctgcacctttatccactgttccccgcccctttgtttctcttgccccacaaacaccctacaaactcccctgtcccaaagactcctgattccatcatctaacaccaggctagagtatcctgtgtgttcatggcatgacaactgattcctattcctcagctgggcccactagtgtatattctactttataatgaaaatagaggtttatgggctgtgcctgtgttttcgttgtttcactgacctcttcaggatctcattcctctttatctcttagtttctaagtataattggaaaggcaaaatttggaaagcactgagttccattgcttagtattctaccacccttctgttattattaaaaacagtacatcaccaacatctaaaccaattctagtgagttctgttgcttaaataaaacaaaaatctttacttagaaacttgaggatcaatgaagcatgagataattcagaagaatatttagttagtaacacattctctttgggaagctagcagctcagttagtgaacgagctaactattctgccagaatctggtttggaaaatagtatggagagaaatatgtctgtgaggaaaaggccatttctaatctccatttaattttaattctgtcttagatcagttgttatatataaaatgcttggagctagaggagtgccttaggactatttgtttattttcaagatgtttcgtttccattttgaatgttactgcccaaagagactggacattaaagcatgtgaactcatacacaacaaagtgggagaaacaatggtgtttatatgttaattccatgaagccctatatttaactctattccctctggccatataccaggtggaaaaaagcaaggactgtgctattaaaaatatcaaatcagatagttccagctggggtttcttaatcatttaaaaggcaaaatatgaggtcacttttaatatcttaagtagataacgatcttagcatttactttagatattaaatctgaagtgcttatcttttgccttactggctagacaatactactagcagtttctagctttggagtattttccttaaaagaaacattggaatttaatacggagccaactattttgcctcaaattgtctgtcttaggaatatccaattcatcaatagagtaatctaaaaagttgattcactaattggatttaagtgccacaggactcttcacacattattttaatcaatttgttggaaagatcaattttctcatggatgaatgcatataaaaatgaagcaattgaatgagttacataggaaggttggcacatctaattccctagaggttctaggaacaggttcttaattatatatctgaaatggtttgaggtttttaaatgaaatttgtctagaagcaggaagatgcaatacccatctatccaggcctgtatttctggatccccatcttatctaatatttaatagttgatcctgaagttgagatattatccctttattcttttaaaaaaaatttttttgtatgtgtgccattttaaagtaattaacagagtagtttgtgttagttttggttaagtgttataaagccagtttttttttaaaggaagtcctggaggcctttttgtattgactgttagagaggacagtgagtgtaaacacaagtttttaaagtttaaagttacagtgcccactataaaggactacaattaatgtgaaaagtagttttaaagttaaaatttatatatcgctgtttgtgcttatataatacttcccactctccccaaacatagaggtattctgattctgaaaataagccttttttagtaccattatgtgtatacatatatattttattttatttttctttatattagtcattgtggttaaatgatttattggtagctgatgagtcacaagtatgtttctcattctctaatgagtcacctagctacctacaagtttgtttattttctttcctttctagatctttcacctaaaataggtgttttactagttggtaggttaaaatttcagtttgctacattaactttttttttttttttggagacgggagacggagtctcgctttgtcacctaggctggaatgcagtggcacaatcttgactctctgcagcctctgcctcccaggttaaagcgattctctacctcagcctcccgagtatctaggactacaggcacacgctaccacgcccagctaaattttttttgtgtacttttagtggagacggggtttcaccatgttggccaggctgctctcaaactcctgacctcaagtgatccacccgccctggcctcccaaagtgctgagattacaggcatgagccactgtacccagcctacattaactattagatctggaaaataccaaaataatactcagaagaagtctcattgatttttacaaacttgtatttagcacgtgctctggtccaggtactctgctgggcttgagtatgcaaagatttatgtgtgtcatatatatcttaggagaagcttaattttgggagagggcaagggagataaacaactgcatgcagaggcagggtatacaggtgctgtgataggagtgtatattgtctgtagttgaggcccaaagagaggtgtgcatgtggataccccttgagcatccatatggataagttggtgaatgtaggcaaggccattatactgttgtgtattgcaactccttgaacagttgcacctacattttatacctctttgttggaacagggtatttatctgttagaggaaaaacagcttctattttcagtcctgtccactgcaacatctgtattgaaaatttggataatgctaaaggtgtgctaagaaaaaaaacgggtctaaaatctgctgtcagaaattttcagatcgtttgtgggattaattctcctgggctaaatataactttgtataaaacaatatgaaattattatttaaagattttgctgaatttctactaaggttggcaacaacagcaaaacatcaagatacatcagtgttactggggaaggtagtatgattcctggacatttgggaaactattactaaagggcctattattttcagttgttgttgtttttttgtttttttttttttcacagaaactataaagcaatctagcagctcatgagcttctaagaatgaaaatgtattatttcatagtgagctgatgatgcattctgagatatttaaatttagttctaatttgtcagtctgtaacagaactgtctagtgcaataatcattaaatgatcttattagctatgtgatggtagtctaattacttaaccttgtagagtctcagttttctcatctgtaaaatgttgataatacctaccgtgtaggcctttgtgaagcgcaaatgagatagtgtctacctaaagcacttcacacagaacctggaacataaaagggaattgctaaagaaataatagaaataatactttagggatttagttgttaaatctcttttcttttttctcttttttctttctttcttttttttttttttctgagatggagtctcgttctgtcacccaggcaggagtgcagtggcacgatctctgctcactgtaacctctgtctcctgggttcaagcaattcttctgcctcagcctccagagtagctggggctacagggccacgccaccacacccagctaatttttttgtatttttagtagagactgggtttcaccatgttggccacgctggtcttaaactcctgacctcaggtcatccacccaccccgacctcccagaagtgctgggattacaggcatgagccaccgtgcctgggctaaaatcactttcatttgagctataaaaataaaagtgtgtttgccaggcatggtggctcacgcctgtaatcccaccactttgggaagcagaggcaggtggatcacttgagcccaggagttcgagaccatcctgggcaacatgatgaaaccctgtctctacataaaatacagaaattagccgggcgtggtggtgcctgcctgtagtcccagctactcaggagtctgaagtgggagggtcacttgaacctaggagatgagtttgcagtgagttgatcccagtgattcttctctatatgctcaggaggactcgtcagagtcaaaacctgatactgggacccagcagcaagagataaactgctttttcccccgatttatgtctccatttatttgcaagatggtgacctctttgactggagttgtgtgctgttaaatattttttcacgtgtctcctatacagaaattataccttcacccttgattttcagatcatctacggtagccatttctcagggtttatgattcttgttctctaccccagtgctctccaaagtgtgatatgctcaagattacccattgagggaaagaaaataattcaacttccttcattccgcctaccctttcttccctgcttttttcttttatctaaaaggatgagaatgaatttgagtttttccaatagttaatttatacataaacactggacccataacttggattgcttctcagaaggttacatatcacctatagcatgtgaggtttctgaaggaagattgtgggattccagtaatgaaaagaagctagcagtggtaccctcattctcctctctcctcccttctttcttcccctcccctcctttcctctcctgtagatattatgccatcttcatatacaatgtcagttaaaaccatataatcagactctttctacagtcagtagaattttattcttctactgcagtaatgtacgcaagtattcctgtctctcttgttttgactctattttatatatacacacataaaaccctcggatagtctgaccctttttcacaaatggaacctttttgattttaatgttttttcttctgaattcactcatgtctacagtaagacaaaaatggatgtagatacagatgtagctgtatagagataatagggctaaattgtccaaaatcatggaatagttttactaatgtctaaataggttatgatttttaacagctgcatataataaggggaaatactgagattggaagggttaaaaaaaattaactgttctctatgtctgattaatcctgccttctttcccgttgattcagtagaacaatttgtaattgcagaaatttataatagctttggccctagcttaagaaatagtttgtggtttcagaagttaatttgtaagttgtttcgtcctggaaacaatgttctaagtggtagttgttttctagactagctgatctaatattttagcactcagtactacgaaattaaagtactaaaggtagatatagttccatgtttcaggtcctgggttaaaagagtcatctggtacttttgaatgagaaagaagagggaatttttttttgctttaattggacctacagccagccctgggcagagtatctttgactacattccaccttctttctagaaggatactagcatgacgctcagtccttaaaagcagatgtgtttgggccgggcgcgatggctcatgcctgtaatcccagcagtttgggaggccaagacgggtggatcacctgaggtcaggagttcaagaccaccctggccaacatggtgaaaccctgtctctgctaaacatacaaaaattagccaggcatggtggcacatgcctgtaatcccagctactcaggaggctgagacaggagaatcacttgaacccgggaggcggaggttgcaatgagtcaagatggagccactgcactccagcctaggtgacagagacaagaccctgtctcaaaaaaaaaaaagtagatgtgtttgacttgagttggcctgaagaagactgtctgataatggaaggtgcagagggccagcaaatgccttctaataggagtcaaagtttgtgagacgaggggaccaaggggtcagggatatagaagaaaggtagcagagtggacctctacttgggacaggtcaggttgcttgatgaagcagtacattgatcgatacagaggagaaaaccttccttgtgaagatgtgtgagataagcaatagaattctcaccaggcctgaatatacactcagttatcacatttactggtaggtggcagtcaaattgaagatagattcagttcagtgacactagattgcaagtattagaaaactttgtaacagtccactggagcctcttgatcccttcaagcctcagaagagccttatcttagttcaccaactacttcttttgccataataaattctgagtttcttcagtagtcaagattttagctaggtattaggtgatagccccagtgcaggagacttacgagagtacaagagatatgcatgctgttgattttttttttttaagttagttggtaacagacataaagatttctaggcagtgtagccaagtgacataaacaattttctttcttaactactcttcacctattatcctcattttgatcctttttcattgaaatggattctggtgttctcttgtttaaagtaagtactgtctggtttctggaatgtctaattgcaccacaactactaaagacccaaatcctcatcagaatgaatagaatttttccatgaaaattaaatcttatccttttcatcaactatattgtgatatactttgtcagtacaagaatatacacaaaagtaaaactggtacattttgtatgggaatcaccattttggagtatacattttcttccttggttatgtactagtgattaaaaaaataatcattgtgtttaataagctactttataaattttgtattttagaatttcagtgtctggtgttcagaattcaagttattataaaaataagctgtccaggagatgcatttattttacactcatcatatattaaacttcatataggcacccttttaaatgggagtacacaatccaataatcataaatctgatgacggagtatactcagaagctaaaggtagtgaggatttaattgcaaaacagcacgctaatgtcctcttattaccttaaaatcttttcagttgaccgtcttctattatttaattccatcacataccagtaattgcatttattgaagccagtatttctcattataggaaatgctgatcttagtgattctcaaaaatagggagggaaatgttctttaataaataattaaaagactttttactacttttcccaattcggtactggttttattaccttttatgtccagagtattttataagtggtaactaaattatggcatctaaaaaatcatctcttcaaggaatctcacaaggtatgctacgtaatagcttattctaagtaggttaaatagactggctttatctcaagtggcttactgtattaaaaaagagtttaacatattcagctttactgctgaaacaccagaggagttctgacacctctgatgagatgattcaagttgggaattttttctcttgacagcatcaacaaagagagcattgtggatgtagaaggtgttgtgagaaaagtgaatcagaaaattggaagctgtacacagcaagacgttgagttacatgttcagaaggtaagttttttcaaaatataaaatcgcatatagaaatagatttgggttctaatagttttcatgtcaaatttatatgttcttactaattaatgtaaaatactgaggtttataaattagttactgaatcaattagcttttgttatataacaaatcaccccagtacttagtgacttgaaacaacaaacatttatttgcttacaattctgtgatgcacccaactgagatggctcatctgctccatgcaacattggctgggctcactgataaatctggcacatctctttctgtggcttcctctcatccagcaggctagcccagatatgttgatattcaggtaccaggagggttcccaaaggcaagagtgcgaaaccctaagaacagacacttttcaagcttctacttgtgtcacatctgctaaatattccactcgtcaaagtcacacagcaaaacttagatttaaggggtagagaaatagattctagcccttgatgggaggaaaagcaacatgattgcaggggaatatacatgcaggagcaagaggaagtattgcagccatttttgcaaacagtctaccacagccacatagggaaaaatacaaaacacatctgaaaaactactcaccaatataagtgaataataatggacctatcttgctataagttttttgatgatgtacttttattttattttatttttcagtttccatttttacttttcctttatttttatactttaagttctaggatacatgtgcacaacgtgcaggtttgctacatatgtatacatgcgccatgttggtgtgctgcacccattaactcgtcatttacattaggtatatctcctgatgctgtccctcccccctccccccaccccactacaggccctgatgtgtgatgttccccttcctgtgtccaagtgatctcattgttcaattcccacctatgagtgagaacatgcggtgtttggttttctgcccttgtgatagtttgctgagaatgatggtttccagcttcatccacgtccctacaaaggacatgaactcatccttttttatggctgcatagtattccatggtgtatatgtgccacattttcttaatccagtctatcattgatggacatttgggttggtatcaagtttttgctattgcgaatagtgccgcaataaacgtacgtgtgcatgtgtctttatagcagcatgatttataatcctttgggtatatacccagtaatgggatggctgggtcaaatggtatttctagttctagatccctgaggaatcaccacactgacttccacaatggttgaactcgtttacagtcccaccaacagtgtaaaagtgttcctatttctccacatcctctccagcacctgttgtttcctgactttttaatgatcgccattctaactggtgtgagatggtatctcattggttttgatttgcatttctctgatggccagtgatgatgagcattttttcatgtgtcttttggctgcataaatgtcttcttttgagaagtgtctgttcatatcctttgcccactttttgatggggttgtttttttcttgtaaatttgttggagttcattgtagattctgaatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaattcttgtataaggtgtaaggaagggatccagtttcagctttctacatatggctagccagttttcccagcaccatttattaaatagggaatcctttccccattgcttgtttttctcaggtttgtcaaatatgagatagttgtagatatgcggtgttatttctgagggctctgttctgttccattgatctatatctgttttggtaccagtaccatgctgttttggttactgtagccttgtagtatagtttgaagtcaggtagcgtggtgcctccagttttgttcttttggcttaggattgtcttcgcaatgcaggctcttttttggttccatatgaactttaaagtagttttttccaattctgtgaagaaagtccttggtagcttgatggggatggcattgaatctataaattaccttgggcagtatggccattttcacaatattgattcttcctatccatgtgcatgcaatgttcttccatttgtttgtgtcctcttttattttgttgagcagtggtttgtagttctccttgaagaggtccttcacatcccttgtaagttggattcctaggtattttattctctttgaagcaattgtgaatgggagttcactcatgatttggctctctgtttgtttgttattggtgtataggaaggcttgtgatttttgtacattgattttgtatcctgagactttgctgaagttgcgtatcagcttaaggaggttttggcctgagacgatggggttttctaaatatacaatcatgtcatctgcaaacagggacaatttgacttgctcttttcctaattgaataccctttattcctttctcgtgcctgattgccctggccagaacttccaacactgtgttgaataggagtggtgagagaggacatacctgtcttgtgccagttttcaaagggaatacttccagtttttgaccattcagtatgatattggctgtgggtttgtcatagatagctcttattattttgagatacgtctcatctatacctagtttattaagagtttttagcatgaagggctgttgaattttgtcaaaggccttctctgcatctattgagataatcatgtggtttttgtctttggttctgtttatatgctggattacgtttattgatttgcatatgttaaaccagccttacatcccagggataaagccagcttaatggtagtggataagctttttgatgtgctgctggatttgttttgccagtattttattgaggatttttgcatcgatgttcatcagggatattggtctaaaattctcttttttttgttatgtctctgccaggctttggtatcaggatgatgctgacctcataaaatgagttagggaggattccctctttttctgttgattggaatagtttcagaaggaatggtaccagctcctctttgtatctctggtagaattcagttgtgaatccgtctggtcctggactttttttggttggtaggctattgattattgcctcaatttcagagcctgttattggtctattgagggattcagcttcttcctggtttagtcttgggagggtgtatgtgtccaggaatttatccatttcttctagactttctagtttatttgcatagaggtgtttatagtattctctgatggtagtttgtatttctgtgggatcggtggtgatatcccctttatcattttttattgcatctatttgattcttctctcttttcttctttattagtcttgctagcggtctgtcagttttgttgatcttttcaaaaaaccagctcctggattcattgattttttgaagggtttttgtgtctctgtctccttcaattctgctctgatcttagttattcttgccttctgctagcttttgaatgtgtttgctcttgcttctctagttcttttaattgtgatgttagggtgtcaattttagatctttcttgctttctcttgtgggcatttagtgctataaatttccctctacacactgctttaaatgtgtcccagagattctggtatgttgtgtctttgttctcattgatttcaaagaacatctttatttccgccttcatttcattatgtactcagtagtcattcaggagcaggttgttcagtttccatgtagttgagtagttttgagtgagtttcttaatcctgagttctagtttgattgcagtgtggtctgagagacagtttgttataatttctgttcttttacatttgctgaggagtgttttgcttccagctatgtggtcaattttggaataagtgcaatgtggtgctgagaagaatgtatattctgttgatttggggtggagagttctgcagatgtctattaggtccgcttggtgcagagctgagttcaattcctggatatccttgttatctttctgtctcattgatctgcctaatgttgacagtggggtgttaaagtctcccattattattgtgaggaagtctaagtctctgtaggtctctaaggacttgctttatgaatctgggtgctcctgtattgggtgcatatatatttaggatagttagctcttcttgttgaattgatccctttaccattatttaatggccttctttgtctcttttgatctttgttggcttaaagtctgttttatcagagactagggttgcaacccctgttttttttggttttccatttgcttggtagatcttcctccatccctttattttgagccaatgtgtgtctctgcatgtgagatgggtctgctgaatacagcacactgatgggtcttgactctttatccaatttgccagtctgtgtcttttaattggagcaattagcccatttacatttaaggttaatattgttatgtgtgaatttgatcctgtcatgacgttagctggttattttgcttgttagttgatgcagaaaagctgaaaattctaaaaatcagagtgcctcttatcctccaaaggaacgcagctcctcgccagcaacgcaacaaagctggacagagaatgactttgacaaattgagagaagaaggcttcagacggtagataataaacttctctgagctaaaggaggatgtttgaatacatcgcaaagaagctaaaaaccttgaaaaaaagattagatgaatggctaactagaataaacagcatagagaagaacttaaatgacctgatggagctgaaaaccatggcacaggaactacgtgatgcatgcacaagcttcagtagccaatttgatcaagtggaagaaagagtatctgtgattgaagatcaaatgaatgaaatgaagcaagaagagaagtttagagaaaaaagagtaaaaagaaacgaacaaagcctccaagaaacatgggactatgtgaaaagaccaaatctacgtctgattggtgtacctgaaagtgacagggagaatggaaccaagttggaaaacactcttcaggatattatccaggagaatttccccaacctagcaaggcaggccaacattcaaattcaggaaatacagagaacgccacaaagatactcgagaagagcaactccaagacacacaattgtcagattcaccaaagttgaaatgaaggaaaaaatgttaagggcagccagagagaaagctcgggttacccgcaaagggaagcccatcagactaacagctgatatctcggcagaaactttacaagccagaagagagtgggggccaatattcatcattcttaaagaaaagaaatttcaacccagagtttcatatccagccaaactaagcttcataagtgaaggagaaataaaatcctttacagacaagcaaatgctgagagattttgtcaccaccaggcctgccttataagagctcctgaaggaggcactaaacatggaaaggaacaaccagtaccagccactgcaaaaacatgccaaattgtaaagaccgtcgatgctaggaagaaactgcatcaactaacgatgatgtacttttaaagaatgattaattaactaattcttagtcttataataattacttttctgatattttttacaacatagagaagtcaaaataaatagtaccttattggtcttatattccaacagtagcttcctttttttttaaagaagacttatctctgatctgtttttttctcaggattaaaaactgaaagagctcattatcattgacttaaaataccataagtgtcacttgaggtcaggagttcaaaaccagcctgatcaacatggcgaaaccttgtttctactaaaaatacaaaaattagccaggcgtggtggcaggtgcatgcaatcccagctactcaggaggctgaggcaagagaattgcttgaacccaggagacagaggttgcagtgagccaagatcgcaccactgcactccaacctgcgtgactaagtgagaccccatctcaacaacaaaaaaaaaccataagtgaattcacacatatttagtactattgaaataaccctgccagtttgaacctacagtgctcagatttaggtctagattgtatctacaatatacatcactaaatttctcttaaggagtagtctttaagacagcatggcctcttcccgccctgatccgtgtgcacatgcatgaccatatgtaagagtcaggcagaccaacaggcagacagattcagagataggcctatatgtacttactgatttaagagtaacattgtatttagctggaatctgttttcttggaactcttcaagacttacaaaaccttgtaatttttactgacctaatttgacaaatgactttgttgtctttgtgtaagtctcatcttgaaacaaccccaccaggaagtttgtaacctagtaaagacaaactgaccaaagagtaagaataaagataaatgaataaacccatttatgttgaccaagaaagataactcccacatcttccaagtaacacatctttttcagtacttgaataaagaaaatttggccagatgtggtggctcacacctgcaatcccagtgctttgggaggccagggtgggaggatcacttgaccccaggagttggaggttacagtgagctgtgatcacaccactgcgctctagcctgggtgacagagcaagaccctgtctcaaaactaaaaaaaaaaagtgtatgtgtgtgtatatatatatttctgtttttttactagaagcaaatgtagttttaagatattcttattgtctagatgtgtgcaatgcaacattaataaatattagtaataaattttaagccagaagagcttacagaatttgccataataaaaataaagtatttcacaaagcatgaagtattacctactaagtagaatcttatataagtagtgactttgctttatcacttatttatttattcagccagcagttactgttgataggtgctttgtgccaagcactatgtgaagactctggggtcagagtactcatggtctagtaaagaggatgatgaattcccactagttataaaagtagaagtagcagctcttcagctctccagtttggattggagatgaagtttctgttaacttgtcaaagggaatcctagaatttgggtttagggagtggtgacaaatagttctattttataataaggaatactagagtatcctacactatttcttggagtatctaagctgaatgccaatattgatctgccaactagaagagtataattccctttcctgaagtaactaaataaggtatttttcccgtttgtgctttagcaggttttccagacatagtttgggttaactaatatgataaaatggtttttaaaggtagccagaaaaacaaaaagcaaaaaactctagttcagtctttatgacccagttgctttttatcactaaaatgtgaaattagtgtgagtgaatattgatggaatttttatttatttatttatttattttttcgagacagagtctcgctgtgtcacccaggctggagtgcagcggcgggatctcggctcattgcaacctccacctcccaggttcacgccattctcctgcctcagcctcccgagtagctgggattgtaggcacctgccaccacgccccactaattttttgtatttttttttagtagagatggggtttcactctgttagccaagatggtctcgatctcctgacctcgtgatccgcctgcctcggcctcccaaagtgctgggattacaggcgtgagccaccgcgcctggcctattgagggattttgacaacataaaggaacatcctctagggcatttcctaaccaggagactggcaggaaatgagatgtttgtaacatgtttaatgagagagagcaatgaaggggtacttgaaaggagaaagaatgagaaaagaagtgcagcagagctggactgaatttggtcctagtggtggcagtggcagtggcgctggccaaatgctgttaaaaataacaagatggccgggcgtggtggctcatgcctgtaatcccagaactttgggaggccattgcaggcagatcacgaggtcacgagtttgagaccagcctggccaacatagcgaaatgctgtctctacgaaaaatacaaaaattagctggtgtggcacgtgcctgtagtcccagctactcaggaggctgaggtgggagaatcgcttgaacccgggagacagaggttgcagtgagccaagaccacaccattgcactccagcctgggtgacagagtgggactccgtctcaaaaaaaaaaaaaaaaatgatagcaagtcatatgttaattgctccttcacatgagtaaagtgttttcacatttattattctgtttgattcttatagcaggctttattttaattgaagctctgagattaagtgatttccctaacaatagcttttttgtgtttatgtttgtttttgtttctgtttttgtttttttgagacagggtctcactgtcacccaggctggagtgcagtggtgcgatcttggctcactgcaacctctgcctcccaggttcaagtgatccttgtgcctcagccacccaagtagctgggattttaggcacgtgccaccatgcctggctaatttttgtgttttttgtagagacggggtttcaccatgttgcttagcctggtctcgaactcctgggttcaagtgattaacccaccacagcctccctaagtgctgagattataggtgtcagccacagcaccaacccctaaccatagcttttttgacatagctagaccgtaagccagtgcctacaccccagtcattacttattacattggtaggcatcttaaaatttacaaataatttttatatatgttaccttatttgactgttctaacaaccatagaggtaggcaaaaaatattattatccccattttaaacaaatcatcaaggtgaaaaaacctgtatcatcttgtttgatttcagcaagtagtttcaattaaagatgtatgcaaacattgcttcatgcttaagtcaactgtagattgttttttaagaaaaagatgcagattttgtgtgctttctactatttttggtaatctctcacttacagatttatgtgatcagtttggctgaaccccgtctgcccctgcagctggatgatgctgttcggcctgaggcagaaggagaagaggtaaaaattatacttatgaaatattatgcttccgctgtatatttagtttgcaaaacattgaaaacctgatgtactaagggtgtctgtgaattgattttgagctccattgttatttaaacttactcttaaaatcagcaattctcaaaccttttggtatcgagttgccttttacattattaaaaataattaagaaccctacaagcttttgtttttattggtatatatatcaatatttacagtattgggaattaaaacatttttaaatatttattactttattaaaaattatatatacattgcatacatgtttgcatatgtagtattatgtaaataatgaagctaataacattttatgaaaaaattacagttgtccaaagcaaaaaataattattgttaagagtgacattgtatttagcagtccattgccttaaccactcagctccctcatccttcggatgacattctgtttatataaccacaattctttgtgatttctggcttaatagacaactagattctcatattgcctctgcattcattctattgtgataatacacatcatagaatctttagcagactgctcagtatactcatgaagagtgaaaaacaaaaagtattattatgaaaaagtaagtttgacttcatcaacttctggaaagtctcagggaccttcactgctccccagaccacattttcagaaccactactctatgtcagcttttatctgttccttcaaccttgggctagcaggttaaatccaggaatcaatgaagaagtgggtggttaatttttcttatatcccaataatgaggcaaggctttgaggggtggaggagggaaagaaccattaatatctgttcattctttgtcttctttccatctctcttttaacgctaacttctctctggccgcactttgtgtttctaccattatctgattttcgggcataatattaacgtacacacatcctactcaattaaaagtaaacatggcttctaaaagtattttttgtgctcttcaaaatattagtaaaatttatttttttcttttctttttttttttttttaggaaggaagagctactgttaaccaggatacaagattagacaacagagtcattgatcttagggtatgcctcatttatttattaagtgaagcaattatgccgcattagagaggggcagggataccatacctgtctcaggcttataaagctaaatggtatttgcctgactgtaagtatgataatacaggaaacaatttccttttctgactgacccttcccctaaaaagaattgcaggcaacaggagcggttaaatactagttaacaggatattgactttctttgttttaaaatgacaaatgaatttgaagccagtaaatgatcttgcttccaggtgatatcttttttagacaagttattcagcaagtagaaacataacctttaatatcactacaaagttatgaaaaaaattacatgcacatttgagatcaaccaggtggagatgagtaattaatgcttcaatcctttgaatttgattggagcaccaaattaaaaatatagaagcagttggctctggtggtttatgcagtagtctcatgggtcttctgtttccctttctggtttggttgcaagtgaaagagagtttagtggtttcatcattgttgtagtaaaaccattgcatctttcttaatattttgaccacatcttccttttttacttaaatattctactcaagctcaaattttttgtcaccttaagagttcttcttggctattctaccatcatgtgagtctacccttattatatactcatgttattcctaattatttgctttttgtcttctaccttttccattttaatttgtatatgaaaagcaagcagtaatccaaagtcctcttgatactacctagaaacctcaggtttttcatgtatgttggccacaggagtgagacatcattctttatttatttgcccttgctagttgttcacacaagttattattggtttgtgcctctagaatttgacctgaggagtttttgggttttgggttgtattgttttgtttaaattcattgccaccattgaaaaatgggttttcacattaaaatctggatggcacttcttaaaaagaggagaatctggaacatgagctagcatgctagataggacatatacaggattcttacactgtcttttgctttgccctgcaccacccagcaaatatcattcatttcattcattcatgttatttggcccttgcaagcgttcacatgcttaactcttactttgactttacattttgggagatgttgtgtacattagtaactttaagtttttaagcaccttcgtttccttctaaactactgtcttggtttggtgcagtgtctcacacctgtaatcccaacactttgggagcctgaggtgggaagaatgcttgagcacacgagtttaaaaccagcctgggcaacatggcaagacccctgtctccttaaaaaatttaaaaattagccaagtatgatggcatgcatctgtggtcccagctactcaggaggctgaagcaggaggattgcttgagcccaggaggttgagtctgcagtgagctatgtttgtaccactgcactccagtctgggcaacagagcaagatcctgtctcaacaaataaaaaataaactactatctaatttagtccccaactagctctttcatagactctcagcaaagtcaagggctaaagaatttggaaataaaaggcaaaattgccattcttcttctataatacaaacgttctaagatatatcctccgtcaggttctagtgtagcctgacttttttctcgtatatgaatggttttctctctgaactttacaggcaggtgccctgattaaaaatacttcaccttccagcccccaagaaggttaaagcaattttcattcctagaaaagtgaattaaaatgtctttggcacccttttcatacatagcactcacataactcatattccagattggcacggcaaattagcttcatcctcataggttagcaggttgttaggagggttttctcagaatctattcaggagagttccctttagatcagaattgtcccctttatttcacctcactcttaggtacaggtgaaggttgtcctaggagtaaatgttagtcttccctcttgagaatcattgtttaagtacttttcccaaatacaaatggattcgttggttcaaaattagtctatttcttttatttctttatctagaccccctgtactatagctagtctacaaaatatttattatgttcgtattacaggtttcttatactgtggaatatgtattggtcatcttcaaagaacacatcattttgttggggagataagactagtagtgtgaggtctccttaatagggatgccctcccttgggttgccaggtaagcatagaaactgagccatctttaaaggtgaatcatcagctcttttttgccacttggtttcacatgccaaggggatagacaattcaggactcatgggcatcctaacccttgagaccccatggcattcctaaagttctctttgtttgctaatacaccacattatcctcaatgctacctctgaaatcacactatcaaatagcccctactatgtaattctgtaactttttttcctgaatgtttaggtctattttggcatgcagggattaagaaaatagctatctgagcatatattttatagttcactaatgaaccctactttgaccctgtgggttaatgaatgaaaagtatctgctattatggtgtggtttcatcttatcaattacatatttttgttttgaaatttgtcacctttgtcttcaccattcttttctcttggacagactgttagccccttaactcatgtacttgccttgacttaagttaccagtctgtccaagagaaaagaattacattcatggcaaatgcccccagtcaggcacaacataccatatacataatattcttgatgagcttaaagtagccacacagcactcagggcagcctccactaactgattggaaataagcctatttgccatatctccctgaaactttctattaacaaagccacaaaacgcttaaacaaagaaaaattagataatatcaatagcccatcttctaacacattgcctagctcattactttcaatacatattttccaaactaaaaattaaaatctcaactctttaagagaagtttcgtaattttgtagtataagagattatcctggcaatatagttttaatgccaatatattgaaacttacatgacatttcagtggttttgcagtgttttcccaagtatggtacctttaccactgaaggtacacagtgatttctgggtgttaaacagatgaacattttttattttaatagctatacaatataaccagcaaataaaatccatgttttcatggatattattgcttagagttagttaagttttaaaatgtgatttaaaggaaaatattaagtactagtacaagagatacccagtatgacagaaatgatagtagaaggcaaaagacaagtttaagaaatgctggtttgtgtcagcagtgggcagaaaattggggactcggggctgccatgagaatgataggtgtttgatcaccacagctataggagttctttgaaagtagatctggacattttgaaatagtcaaggggaggtgtcctcagggatgtcataactgttgacctcaagaccaatgcatcagttagaaaaacattttaaggatgctcagcactgctatgtatcacagggtccctccataggacatacatacttgatctgctagcgtttttgtcatacgttagaatgaatgaatatgtgttggaatgtcttgacacagttaacctgaacacatacagctggaatccccctgttgcagttgttattatatgtaatataatagcaattgcagacagcttggattctttctcacagatattccttttgttcaattagaaattctacataattctggccgagcacagtggatcacttgaggtcaggaattcaagaccagcctggccaacatggtgaaaccccgtctttacttaaaatacaaaaattagccaggcgtggtggcgggcacctgtaatcccagctactcgggaggcagaggttgcagtgatccaagatcacgccattgcactctagcctgggcgacaagaaagaaattccatctcaaaaaaaaaaaaaaaggaaaaagaaattctgcgtaaatctggccaggcatggtggctcatgcctgtaatcccagcactttgggaggctgaggcgggtggatcacttgaggtcaggagttcaagaccagcctggccaacatggcgaaaccccgtctctactaaaaatacaaaaaaaattagccaggcttggtggcatgtgcctgtagtcccagctactcaggaggctgaaatcacaccactgcactccagcctgggcaacagagtcctccatctcaaaaaacaaaaaaaaaaagttctacataaatctgattttttaaaataatagttccctttggaattaaatcaggtatcattttagaaatgtctttcccactgccttttctactatctctcctgacccctagtccagcttcacagtagtatctctgtaacctgataaaccataaatgaacaggaattctctacagccattaaaagcaaaagatatagtgggtatcttaactaagatgataacttaaataggtatttttaaaagctacaagtctaatacaacatggaagtaatttgttgtgaggattgtaaggcgctaagtactattaaagattgctgtataaagtttgggtttgtttgaatttttgtctcctatcgaaattctttctctcaacacccttacttctctccatgtacctgcctctcttctccacaaaagatataattttgctttttagtgctatgaggacctcagggaaaggaattctataaatgcagaatattgtttttccctttatttcagatctttcacataatacagaatagcagtgttttaattttaataaccatacttttgggaagtttgctatagaatttaaaagtactattttaatataaggaatgtcaagcttttttagaactaaagttcaaggactgggtttttcgttttgcttttctaaaattaatttttttaagtgtagaaaaattagttttctgctttctgtttagtttatcttctacctcatgccctctgtaatcgccgttatcatctaacacctagcccagtactaggaggcatataataaatatttgtttaatgagtgaggaggaagtattattttttttacatattatggaatcattaaaatatttgtctgacccaaaacaatttttagatttaaacattaaggaaactaatattattagtatggtttataacttaaatgataaagaaggcctttttcctgttcatttaggtatcttaaggtaagggtaagtatagtaatgataaattaaatatataaggtatttgtacattccttgtcagttgaaaataaggttgttatatatttgcattgaaattaacatatgttgcattcattttatgtactatagtttagaagcatttaatttgagatagatttaatatataattaccctattaaacatacttttcttttgttatatacattctgtaatcttactgataagttggatcattgttgatttttaccttaaccgtcaaattcttacacacgtgtagaagtcagttgtagtaatcaatatgtaatggggaaacagttttaaaatgagtctataaaaaaccgattttgtttctctttagatgtgttctacgcaagagtgtcttgttttgatcaggagaagaaaaaataccattaccatttcttattttaactatattgtgttgttctctcatgtaatgataatgctttttgaaggaggaagaaatgtagaaagacaacccagcagtaggtacaaaaagtttctcagactctgatgcagtctgcttagtactcttcctctgctaaattaactgactaacctgggcctgaggacattattttcctctgagcaaagtcagagagtttacaggatactaatcttacccgtttgtcttgttccaaccagcagagatagctagtctgaattcgctcgcacaatgtgattgtttgcagtaatgggtattcttgctagtaagatacataatcaaaatagttgaagatgtattttgaaatatttgtttttctttcttgttatttacttttaaagaacatcttatatttagtaattcctttttgtttaattcttttcccatctacccctgtgattggtggttttcaaattaaaccatttaaaagctagaatcttctagaaaatattctccagtatgtaaatcctaggtggaaattaggatgtattagaattgtcatgtgaataactgttcactgtctaatcaagtaggtgccgtcttcctattagcaagtgccttgaagaaactaatgagaaaaaaatcatttttcttatatatgacagatccgttttccccataaatgttacacattaacatagttgtttgtacaatcaggaagtgaagaagtacagttttttaaaaacataatggtgaaatttctattcatattaaataatctatgacaaccagttcataagtttaatttccatttagcaagatgttgaagtgagtttaggccaggcgtcgtggctcacacctgtaatcccagcactttgggaggccgtgatgagcagatcgcctggggtcaggggttcaagaccagcctggccaacatggtgaaacccggtctctactaaaaatacaaaaattagctgggcatggtgacgggcacctataatcctagctactcaggaagctgaggcaggagaatcacttgaacccaggaggtggaggttgcagtgagccaggtttagttgaactagctaagaggcaagcggcaataaaatgtattcagtgaccctcttatagaatatattctaagtgaaatacatctctgtacatttgtcagtaacagtgaaacagctttttgctaaataggtcactaggcttttgaaagcagaagattatgccatttgttttgattggatgaaccagacgtttcactaaaccacataatgtgaaaaaaatgcaagtctttttctatagtttaaatgtagacatcttgaaaatgagtaagtaatctaataaattataaagacctttgaaatggttttattgttttatgagaaactattgatttgtaactttgaatgtaagttataaaataatgttacttaaatatgaccagtttacatgaatgtttttatctgatctgcagaaattcaagattatttaaatatcattctttagagtgaaagaaatgtaatcattccattaacagtgttttcacagggtactactgtgtaaatgcagaaggggtgagccctttgatatgggagaagtaattgaaattctcgtaatgagactaagaagacaccttcttcacctaactcagttattcacagctaacttagtggtttgaggtcacatgttttactaaacacctacctagtcataggatagctattttttaaaaatataataagccaggacctaaagataagaagtcacttcttttgaccagagaagtggacaaaagttagtctaaagtagagataattacctctagagctttctggtcaccatcacaactgattgaggctaaaagtaaataggaggaccagagaaactgagaaagaaaggagggaaagagagagaatagaaagaacaggcaactgtgctgcacagttggagcgctactattgttttatgtaccacattggaaatcagtgtcatgggatgcctaccccttttattgtatttttttctttttaatttcttaatctaattgaacaaatacacaagtatctgcaattgtattgttgtaatggttaaaataaaaatacatggtttttattcatttattgtcaaataccaaaatcttacttagaacattagtatgctgcacaaacattgctatgtctcactttatgggttggttgcctttaaaaaaaacagaccattcacaagtaagttgtttcactaattgttaagaaacatttttcttttatggaattcctacaaattaaaacatctgctcactaaggatttccggtgaaattcctttatatgatcatatatagtcattgtattccagcatgcctttttgccttgtatttattcgtgtcctttcgtcttctctccaattattagaatttaaaaatgttgaaagcaagaattgttaggtttccacagtgcctagcccacagagttagtgcttagtaattaagtacgttgatttaattagattttattactgtcttctagacatcaactagtcaggcagtcttccgtctccagtctggcatctgccatctcttccgagaaactttaattaacaaaggttttgtggaaatccaaactcctaaaattatttcaggtatgcttcaaaatatttctcttaatttttaaaaataaatttgctctccccagagttgctttatattaataaaatttttaacttgagaatcccaagtgtccattaaggtttattgccatgagactactattttgaagaccatcttatatagcaacaatcatatatcaccaaccttaataagtacattttcttattccaggagtccttttgtgataatgattgtaatgtgaggcagtaacacacaaagcaagattcttgttacagaacttacaccaggaactactttcattatatagatttcttttgaaattagtattgcagttttgttttgtataaactgcattgtaaaatcagtaaatactaatgatgggaaaatttccttaattcttgttgcccaggctggagtgcagtgttgtgaattcggctcaccgaacctccacctcccaggttcaagcgattctcctgcctcagcctcccgagtagctgggattacaagcatgcaccaccacgccgagccaattttgtatgtttagtagatacagggtttctccatgttggtcaggctggtctcgaactcccaacctgaggtaatccatctgcctcggcctgccagagtgctgggattacagatgtgagccaccacgcctggctaattcttattcttgtatgagaatcttgtcttaatcattttaccctttttagatttgtttaacactagaaagtgtgttacaaatggcattttgttacaaattcacaattgaacattgcattcttaataattagaaaaatgattattccaggctgggcgcagtggctcatgcctgtaatcccaggagtttgggaagccgaggtgggtggatcacgaggtcaggagttcgagaccagcctggccaaaatgatgaaaccccgtctgtactaaaaatacaaaaactagccgggcgcggtggttgacgcctgtagtcccagctacttgggaggctgaggcaggagaatcgcttgaacctgggaggcggaggttgcagtgagccgagatcgtgccacggcattctagcctgggtgacagagcaagactccatctcaaaaaaagaaaagaagaatgattattccagctcctggggaaatttttttaaaagaggaaaaatgatgaagaatatattttttcattttaaaaaaaaaattttaacaactccaaaggggctttaatagttttgaaattgatgcagaaagggagcatatatatccacagaagtgaaataaaagcatagccaaagaagtaaatctggtttaaatataaactatttagaatcacatagaagatgatgtatatagactgtgatttagccacaattcttcattttccagtttttgttaaagtgagttacctgagtataaactttttaactagaggtttgcattgataagtttacaattgattataataatataaatataaatgtttacctttcagctgccagtgaaggaggagccaatgtttttactgtgtcatattttaaaaataatgcatacctggctcagtccccacagctatataagcaaatgtgcatttgtgctgattttgagaaggttttctctattggaccaggtaagattttggcagttatgttttatccaagttaattaattatacagcagttataattttagaaacattttacttatataatgtacagacactttgaaagcttaaattattttatctgctgactacacaaatgctagactttgagttagagataatatatttgggtagacattttcttaaaagtaatagtaataataatatggtcaatagtactttaaacagttgagcatcattccatgtgaatacaattataaacatatgtattcttacagaggaatgctgaagaaaatttttatcttgagaatatgtcattttaaaaatgcgtttcttgaaaatatacaccatctgaaatatacctaagtatatattttaatatacctcagtgcagttagaacagaattagctcccatttggactcttttcagctccctatcagcactgaagagcaggtagttgcagtggtcaaagaaatatatgtttttgtcctttataatttcttactcctgtaagtttacagtgtacctctgtctaatttgctatcaattttattccagagctgttctgtttcactattttgtttgtattgtccttactattggtaatgtgctgatgtccattagaaactactaacaaatatgttatatttaataaattatattaatatggtttttaagaaatgtttgctaaaagtcaagcacaggcacataatcatgtggcaaattcttttttgaagctaattgtaagtgaaaagccagcgttactttatttaacacttaccaagttattttatatatgttttttgataccttaataaaaattaaatacttgctaatagagaaactggcaagatcattaagggtcttaattttctgaatttattaactagttatttgttgaacacctgctgcttatataaccttgtgctaggtaccatgtacataaaagaagaaccagccagcacttctcaaatgttaatatgcacacagattacctggagatcttgttaaaatacagattctgatcagtaaatctggggagaggtctgagattctgcagttctcacaagtcctgggtattgttgatgctgctcatttccagatcatgctttgagtgataagggaatcaatattgtgcctgctcccaagactaagacatacatacatatcacagtcatagggaataatcaaataattttcacaatgaatgatcagattgtcctataccatcagcaaatgggtgttaattatgtagtataaatagtaactgtaaaaagagagaaaatggagtttgctagagtcaccataaaagaaaattcaaactgagatgtactttaaggacaaagtaggatatatagacaacagagatggagttctagacaggaagcagagtaagtaaagagcaagaactacacaagaaaacaaaaataagacaagttagtattaagaagtgagaaatataggttaggattaacttacgaaagcataaaggttttagggtttttttggtcattttatgtcttactacagtagtcatttgggaaccattgtaagtttctgagcaaggatgtattataggaatattagtgatgtgaaagatgagtcgaactagagtcaaaaagactggacaggaggaaaaggcactgaggatattaaggctggactggatattagctggactgagctaatggctcttaatatcctcagtgccttttcctcctgtccagtcttcctgactctagctcgactcatctttcacatcacaaatattcctataaatgactactgtagtcaaatggaatacgtatgttactttattggtagagtttcacttagtttgagtcaggttttaataaaattgagaagaactcactatcttggtcataattgaatatatttttaaatattgagaagacacctcaggatcttgcattcccccagggttctcatgaacctctcttattaatttacatttggtacggcttttattgcacgaccgtaggagtttataatgaacttgctgtccaagataatgctcaaacagatggttcatcagaggtccttccagccctgtaatatgaaaataataccactggaatccaactaaataaaagtttgtatttaaatccctatttatccaaaattgaaatcagtgtttgctctctatttcttttattaacttcacagtattcagagcggaagactctaatacccatagacatctaactgagtttgttggtttggacattgaaatggcttttaattaccattaccacgaagttatggaagaaattgctgacaccatggtacaaatattcaaaggacttcaagaaaggtaaaaagtattttatgcacctagatggacttaatttcaaatgtttgggccctttaaaaaaaaaattcttcaatttaaacatacaaacttaagtttctatgaacatatatataaagatttaccagttagatgatccatttaattggttggaaaaatctacactcagaatactgcttctggatccaaatcatttgggggctcaactaattaacctctattgtgctagtaaatttaccacattgtgaacagtccaactgtattttgttgttgtttttgtttcctttatactgacatcccgaatgtctcaagaaatacagcatgtgtttcttttaacagtttatttgggaaacagtatgagggtagtgtgtaagaggttggattcagcaacatccagatagcctgagttcaaatcccagctctgctccttctctgtgtgggccttgtgcaggttatttaattctgtgcctcagtttcctcagccattaagtggaaatagcattattacccacctcagaggcaaaaagttccttcagtcaactgaatctgtcgacatgtaaattaagcctggtcaaatatggttaattcttaaatcaatttatatttacattaagtgctcagtaaagattagaaactagtagactgaacggatatttaaatctatttggatctgatgaattaacatttatagaaatattagatgtgttctagatgttcagaaaattgaatcatgtagaatgtgcacttcacctacaccctctaaactggcaaagagctcttccctttacaggtcattgaaagttgtttatttatgatgatgtttaacatagagaaaataggaaaagaaaatagaaccgagtcaagttgattaagaaagtctctatttttccctctttctgtatttgtgactatatttcaagtattaggtaagctataatagtctaagctagcattttaataagtgacagaagatcatatttaaaatttttatttgaagaccagcaattcaactattccttgttgatgtatttgatatgtttcattggtattttaaaagagttcaaaaatacgaattttatttactgcattgcagggctaatgagtatgtttaagaatgtagaaattggcctggcaaggtggctcacgcctgtaatcccagcactttgggaggctgaggcaggcggatcacttgaggtcagaagttcaagaccgacccggccaacttagcaaaaccccatctctactaaaaatacaaaaattagctgggcatggtggcacgctcctgtaatcccagctacttgggaggctgaggcaggggaatcacttgaacctaggaggcggaggttgcagtgagctggatcacgccactgcactccagcctgggcaacagagcaagactctgtctcaaagaaaaaatagaatgtagaaatcaatcactgatcttaagaatactgtagcataagtgccagtatttccaggcattctctgcagctttgtacctttgatagctagttaattgcagacagcctttttctttttatatctttgttctctaaaacattttgatgcagtttattttaatcagttttcaatggttcatggaacaactgataacattttccttataagacaaaatatactttagaactacaatgaaggagcacacacagcttttctcattttctgttcgcatttataatccaagaaagtttcagaaactcattttttaaaaatactgatagcttctccattaaataatagagtttgacatttccactttgatttttataacaacagaccaagcatgaatttgagtccttgggattaatcaaatctctacttacaaattagactcaaacgccattactgctgaactttttcagtagagttaaggtggcaatttgaaaataaaaaccttctttgtatgttcttcaagtcatttaggaattttaagttttggtgtcagggcttgtttattgggttatctgacctgtgtcatgttcctctcgtgtttatcattagtatttacctctcatagaaaaatacatatacaaatgtatttgtattctattgtatgtatatgtattgtatatatatccaaatatatatgtgtataaaatacatatataaatgtattttaaagtattgatagtcatatttttgtactaccattgatagacatgatgaatgggagttgatatataaagcaaagaaaagctatttaaaaatcatttgggagctgggctcagtggctcatgcctgtaatcccagcactttgggaggctgaggtgggcagatcaggagatcaggagtttgagaccagactggccagcatggtgaaaccccatctctactaaaagtacaaaaaattagccaggcatggtggcacacgcttgtagtcccagctacttgggaggctgaggcaggagaattgcttgaacccagcaggcagaggttgcagagagccgagacagctccactgcactccagcctgggcaacagagcaagactccgtctaaaaaaataaaaaacaaatttaaaaaaatcaattatggggtctttttaacccttcttacatcaagattttaataaatcaatggctaagctttattattcccacgaaagcctgtaagaccaatcaagaaatgatagtgttttaatttcgagaatataaattctaggccgggcatggtgcacatctgtaatcctaacactttgggaggccgagacgggcagattgcttgagcctaggagttcaagaccagcctgggcaacatggtgaaatcccatctctgcaaaaagtaacaaaaaattagccggtcatagtggcacatacctgtagtcccagctactcaggaggcttcaggtgggaggatcgattaagcccagaaggccgaggttgtggtgagccaagattgcaccactgcgctccagcctgagcaacagagtgggaccctgtctcagaaattaaaaaaaataaaaatagaatgtaaattctaggtaaagaattctatatataaaatacaaacatacttttttctgtatatagaatataaacatacttttttcaagtctgttaattatggaaaaatttcaaacacatacaaaaggatgtgcaatagtctaatgagcccccatgaactcatcaaccagtttcagtccttgtcaacctgtggccaattgtgtttacccatttccctcattcactattattttgaagcaaatcccagccatcatttaatacataaatactccagcaaaaatagacatttttttctttttctttttcttttttttgagacgagtcttgctctgtcgcccaggctggagggcaatggccgatcttggctcgctgcagccttcacctctcaggcccaaacaattctcctgcctcagcctcccgaccacacccaaataatttttgtagttttagtagagatggggtttcaccatgttggccagactggtcttaaactcccgacctcaagtgatcctcctcccaaagtgctgggattacaggtgtgagccactgcacccggtcaaaaatagaccttttaaatctcaataaaatatcatcttccatagcagaaattcagctcagtgcagtaaacattgtcctgtaccttctatatatatagggtaggcattgtactatagagattatcaaaatgggaaagaaactggcactcccctgaacatacagtgtaatactgatgggggaagataagacaaatactcattaatttggtcttcctcagtgataacaagaattgttaaaggattaaaaagtcagatttttgtaatgcttcataaaatgggcattttatatttctaaccatattaactgatatgaattataaagaaaatttttaatcctttgatgttactgtggttacaaaaacgagattgaaaaatggtgttaaatattttaagtatttaaatttcattctttaataatttgataatgcttttcctggtgtatatactgattcaaagattgatttttgtatattgccacagtgacctcttgtgggggaaacatttatctcatacattttattaactaaatcattctgcaaataggtttcagactgaaattcaaacagtgaataaacagttcccatgtgagccattcaaatttttggagccaactctaagactagaatattgtgaagcattggctatgcttagggaagctggagtcgaaatgggagatgaagacgatctgaggtttgtctttgtggctttttttttactttaagttccaggatccatgtgcagaacgtgcaggtttgttacataggtatacatgtgccatggtggtttgctgcacctattgacccgtcctccaagttgtctttgtgatttttaaaaccttggtaatttggtttaagataagaaaaaatgaaaatattaataaatgatttttttcacctgatacacttacattttattaactttggtatacagtatgatgctcttttatataatgtgtgatctgaaataaaagtgtttactatagtttgcctaagttttcataattttgtttataaacaccattttccattattttcccctcatgtttgtaactctttaaagagtatagagagttttgcctgtgattttatcttctaatatgttacttctctttccagattagtggtattagagaaggtagacagcagtctaaatccatccccacacaggatcggggtataaactgttaacatccaaaagttataaaagtcaatattgtttatatagtgtcatacatactatattatatatagtatttagtatagtattatctaaatttagatcatacgacttataattttgaaacaaattatgtagtttaataaagattgaggctgggcatggtggctcatgcctgtaatcccagtactttgagaagccaaggtaggaggatcatatgagccaggatttcgggaccagcctggacaacacagagagatgctgtctgtacaaaaaaatttaaaatttagctgaacatggtggcacacacctgtagtcccaactactccagaggctgaggcaattggatcacttgtgcccaggagtatcaaggctgtagtaacccatgatcatgccactgtactccagcctgggtgacagagtgaaagcctgtctgtaaaaaataaataaacaaaacatgtaaaggtaatttctatctacttatattttattcaagacttccttgaatgattcctttaaaccatcacaatacatgtgtatttaggagggaaaggaaatgattattgtcactttttagggtttctcaaaaaacaattcacccaaaaccctttatttttgtttaacaaaaaaaaatatatatatatggctttaaatattgcctacattgctagatgacattttaaggcaagatgaaaatcctataagcttaggtagtatttttttaagtattttagaaattgtttttacataagatagaagctgaagtagctacctcttggccatagaaatgtaacgtgtttatataaacacttttaaaaccttggataatactaatttttatttcataaaccattgataaagagtaccaaaaagggaagattatttcatggcaagactagcccatattagtatagcgaacttttattatgtgtaattgtaggaaattacttcatccatgatatttctgaatcaatgaattgctatattctgtttattgctttaattaaatatttgagcagcatctactaagcactgagtcactgtaccaaggtatactcataagtgattttcagtagtacttgccttttaagaaaagagcagaatagacaactgcgtgttctggccaaattttgtaatcccttgagaaactcaaatagaagaagttccttattaatgtttttaagttgccatttgatcttcaaacactgatttcacgtttctttttcagcacaccaaatgaaaagctgttgggtcatttggtaaaggaaaaggtaggactctttatatgctggatttctttttctaattctgaaatgtctcttgggactaaaaacaattgcagaggggtctgagcttcctagaatggtatgattctggaataaataaaaaccgaagaaggacaacattaaaaaaatttttttcttagaaaattgagaaatattcagacagcctgcctttctcccagatgatctgattaactcagtatttaatatttttacgaagttgttctgaggtgtctctaaaagtgatacctatgtcggattagttggaaatgacctccaagttatttgaaaattatttagaaatggtcttccctgtgtacccctgctgtctcatgagacttcaagatgaatgaggttcctctctccctcttatgtaatagctactttccaatctcattttctaaaaccaagactccaaagaggataaaagctaaacttagtatgatctttttaaaatttttaagataatgatataatgaaaaggaaaattagtccttgagctcctcctactggtggcagttgaaactgttagactagagaactgatatttctgaagtcatacaatattcagtttatacctttaaaatgctgtttcagcagagccagtttcagtttgtcagctattaacatcctcatctcaagttttatcaaaaatgttgaaagtcaaaaactgttggaatgtaattttttttttttttgagacggagtttcgctcttgttgcccaggctggagtgcaatggcactatcttggctgactacaacctccaccccctgggttcaagcgattctcctgcctcagcctcccgagtagctgggattacaggcgcccaccaccacacccaactaattttttgtgtttttagtagagatagggtttcaccatgtaggccaggctggtctcgaactcctgacctcaggtgattcacctaccttggcctcccaaagtgctgggattacaggcatgagccaccgcgccgggccctcaaatgtaatttatttatttttaattaaatctaggtcacatagtaagcattctctaaaaaaagtcataatttcaagttaatgtcatttatttctttcagttgtagcattcatttgaagaaaactaccaaaatctcatgtatatatctagataaaaatttaaattcttgggaagataatccatgtttttcaatgatggatattgtaaaatacatcaaatttcccaaaataattcatggacttaatatagtttctataacaatcaaaaggatttgagataatttttttcattataaaatgcatcagaatgactagatgaactagaataacaaagaaaaaagtaaaaatcaaagatgtttatcaaagtgtaatttagaatgggggagaaattagaaagggcttacatgttcaaaaaaaaaaaaaggaaaaaaatgaatatttaaaccgtaggcctggcactgtggctcatgcttgtaattctggcactttgggaggccaaggtaggaggatcatttgaggccaggagttcaagaccagcctgggcaaacatagcgagattccatctctacaaaaaattttaaaaattagccaggctcctgcttaagccatgatctcatcatgcactcgagcctaagcaacagagcaagaccccatctcttaaaaaaaaaaaatttaaaaactatggataataagtaatgcctaaaaattaggtattgcaagaatttatgacaccatggcaaaatgctgtaggataaaaatgttactgaaaaaagcaagatattcattgtatatacaatataattagagtaattacgaagaaccaaaatttttgtataaagttaattaccaaaatgttagccattttactttttaaaaatgtattttaattgcatttattctttttatagtatgatacagatttttatattcttgataaatatccattggctgtaagacctttctataccatgcctgacccaagaaatcccgtaagtaatttggttttaagtaacccattttgaggcagaagggaaattttattgtcactgtcagattgtataataggaataatggttttcattaataatttgcagttttgatagacatacgtattaccattgatgtctgtcaccactggtcaaaatgatattgtaaaatttgaatattctagaaaattagttttaaaaacctatgttaaaatcattttacttggtcatttttctgaagatttatgagagagaaagactatgtaaattataaatagtactactagatttgcatactttagtaaatcatcctgtcattgaccttaaactgggaattcacattgtatcctgggagttaataatctaaataatgtcttacggtcttttaccgtttttccattgcagtggtttctaaactttaccatgcatcagaatcacctggagggctttttaaaacaccagttgctgaggcagaatttctcattagttgctgtggaatgggagcctgataatttgcaggccccactccagaccaagtaaaaaatttctggtaatactgaagctactggtccaggaatcacactttgggaaccactggtttattgaaagacaggggattaaagtaaaaataataataatttaaagactcacacctgttaataacttggagttccaaaagtcaccccaaaataatatcattcttaaaaacatctcagatgataaagtgaaataaggatcagcactgcttcttaaaaattagatgtgatgctctgatttgttattggggggtgtgggaggagagcacagaatctgatataaacaaagaaaaagttattcagccctcagtagtttaattctactttagagaacaagattgcattgttaattgtaggaaaaaatgaacttgctcttcatgcagcagagatttttttccgtatatatgtaatagaaataggatggtagtcacttgaggactggtgttttttctcttgcagaaacagtccaactcttacgatatgttcatgagaggagaagaaatattgtcaggagctcaaagaatacatgatcctcaactgctaacagagagagctttacatcatggaattggtaaacaacttaaaataatttaggggagtgtatattctgaaaataatacattgtaaacatttaaaagacttctcagtctttttaaaaatctccattgaacagtaattgcttttgtgaccttttaagataaataagatgataaattatattttgttttgtgtctttttgcagatttggagaaaattaaggcttacattgattccttccgctttggagcccctcctcatgctggtggaggcattggtaatattctgttattgcttacaaataagttcataagttctaagtataatacaaatttgaattacaagaatttttaaaagtgaattacgacataagtgaaaatttgatttccaagaaacaaaataaacagctaacttgtgtgttataaaatattattgtcataaagttctagccattttttttctcttaagaatttagaagccaaatgtcttgtaagtggagtatcctgttttctctctgctgctgtgagttcattcgcattagcacaaattaaagctctaccttaaaatagctcaaagagctgctaagtgtttttattgagatgcagcacttgattcactttaagatcacttctacagtatatgtaagggactgctctgcaatttaaaatgagcaaatatttaactcatctttggatgtccatatcaaacactcttaaaaaattttttgaatgtatagtttcattgaagtttttatttgttgtttgttttggggttttttggaaaatacaaaatgtacttacaaaattttcaaattaaaattggtcgagagacagttttttcaacagatggtacagaaaaaactaatgtccatttgcagaagattgaaattagacccttacctaacatcatatacaaaaattaactcaaaatggatcaaaggcctaaatgtaaaacctacatataaatggccaataggtatatgaaaaaatgctcaacatcactaaacattagggaaatataaattaaaacctcaatgagataaccatctcacacctctggctgttagtaaaaaggtaatggataattgttggtaaggatgtggagaaaagggaatccttgtttgtaaatagttgatgggaatgtaaaattggtacagccattatgaaaaacaggatggagattcttctaaacattacaaagagaattaccatatgattcagaaattccatttctggtcttacataccaagggaaatgaaatcagcatgttgaagagatttgtgcactctgatgttcaatgcagcattatttacaatagccaagatatagaaatgaccttagtgtccatcagtggatgaatggataaagaaagtatagattgagtatcccttatccaaaatgcttgggaccagaagtgtgtctgattttggatttttttcatttgttatcatatttgcattgtgcttactggttgaacatgccaaatctagaaatctgaagtgctccaatgagcattttttggtttttttgtttatgtttttgagtatcatgttggcactcaaaaagtctcagattttggagcattttggattttcatattaggaatactcaaacctattttatctatacaatgaaataacactctgccttacaaaagaaggaaatcctgtcatttgtagcaatgtagatgaacatagaggacatcatgctaaacaaattagcacatcaggcacagaaagacaaatactgtgtgatctcacatatatatggtaccttttaaaagttgaacccatagacaaagagtagaatggttgttggaatggggagaagatggtcaaagggtataaagattgacttaggatgattaagttctggagatccattgttccacattgaaaattgctaaaagagtagattttaaatgttctttccacaaaaaatataggtatgcaagatgatagatatgttaattagcttgatttaatcatttcacagtgtatcagagtgtcacatcatacactgtaaatacatacaatttttgtcaattataactcaataaagctgggcaaaattttaaaaataaatagcaccagttaaggtcgttacatatggttttttattttttgtttttttaagttctgggatacatgtgcaggatgtgcaggtttgttacataggtaaacatgtgccatgggggcttgctgcatctgtcaacccatcacctaggtatgaagccctgcatgcattgctctttttcctaatgctgtcccccaccccaccctcccgacaggccccagtgtgtattgttcccctccctgtgtccatgtgttctcattgttcagctcccacttataagtgagaacatgtggtgtttggttttctgttcctgcattagtttgctgaggataatggcttccagcttcatccatgtccctgcaaaggacatgatctcactcctttttatggctgcatagtattccgtggtatatatgtactacgtttactttatccagtctatcattgatgggcatttgggttgatcccatgtctttgctattgtgaatagtgctgcaatgaacatacacgtgcatgtatctttattactcagaatccacaaggaacttaaacaaatttacaagaaaaaagcaaaacaaacaaccccattaaaaagtgggcaaaggacatgaacagacacttctcaaaagaagacatttatgagccaacaaatatatgaagaaaagctcaacatcactgatcattagagaaatgcaaatcaaaaccacaatgagataccatctcacgccagtcagaatggcaattgttaaaaagtcgagaaacaacagatgctgacaaggttgcagagaaataggaatgcttttacactgttggtgggaattttaaattaattcaaccattgtggaagacagtatggcgattcctcacagattgagaaccagaaataccatttgaccccgcagtcccattcctttggatataaacatgattttttttaagagttatagagatgaatggcagtgatgattgcacaatgctgtgagtgtatttggcactactaaactggacacttaaaaatggttcagatggtagattttttatgtattttaacgctgttttttaaattggaggaggaaaaagaatagtgcgtattcgcctccctacaggaaagcattgtttctagttttcagcttaacctttgcaaagataccttttcatatacgaaaagacacacacatttctttaaatatttttacacaaattgtagcatactattatatataaaccatttagtactttgcattttttacttaatgtatcatttttttaatatgagtccggatggagaagaaatactttaatgtatcttgtaacttgtttcctatcaatacctgaagagctttttcattctttttacatctctacatagaatcaattgaaaggagagaccataatcttgttaaccaccttccaaaaatcagtttcttctttacagtcaaaacacttagtataataatgtactccagagctttttatcgtagggtccaccatgttaaatgtctataaaattaacagtaaattttctcatacttctattattgcttaagcaagtttatggctctcatcctcattgcctggactgtataatcagagtgtggtatcatttgaaacgttcaagcttataaagtcttttgttttgtttttcttattgttacatcatagattttgttcattcgtatagatttttgtggttcacattttagactccataccactcaaggatatattacttagtccttttcatttatagcagcatctttatttctgaatcaatactcaaaacagttttaaataaacccaaaataataagagtcattttctttcctaacaaggaaaagtatttagtttaacgattacatttatgtttgtagttctaagtaagaccctgagagattttcaaaaaggaattaatgattatttttgtcttccccaggattggaacgagttactatgctgtttctgggattgcataatgttcgtcagacctccatgttccctcgtgatcccaaacgactcactccttaaattcacactttgccacttaactccagtgtggatgacagagcgagaccctgcctcaaaaaaaaaaaaaaaaaaagaaagccacacttattcttttcagtaacctgctagtgcacaggctgtactttaggtacttaaaatatgcactagaataaatttgcaaggccctaaaatatcactgttatttttggagtaattcagtataggttcgtttaaaagagatttttataacttcagacatgcatcagtaggaaataacttgagaaattcatatggttatgttacaaattcatattctgttactacagtaaacgttaagagttttaaacagttaagattgtacaatttttcttcttttctatattacaagggccccagtgttaatgtcttagattttcagtatttgaacttatttttttaaattctgtcattgagataagaataattcaggtagcatctgaaattttaatgaatgtataattggcatatcatggaaaattaaccagaaagtatcagttcttaaaagttatgcctagaaattatgtaaagctaaactactggttagaaagtattcagtgtaatattgtattaatttgttaaattctaaacttgaatttcaataaaattttaaagct

SEQ ID NO: 35937 - DNA, 12402 bp, Homo sapiens
gggccccgcggcccgccatataaacccgcgcgcccgccaggcgctgcggccgtcccgggccgtgactcctcctttcccccgccccgcctccgttcggagagccggcgggcgggcgcctctcggccaggtacgcggccggctgggataggggtcgcgggcgggctttggtcgcgcagcagccggtcctccccggaggtaggcgggcgcgggccctgttgggtctttgggacgcgggtcccgctggggccggggatgctgctcgctgtgagcgcgggtcccgtccgccgctggccccgggcgggcgcacgggggtctaaccttggggggcggcgctgccgcctggcccgggtgccggggttcgcgtcccgcggggccttcctcgctctttgtctcttctgagtgaacttgatgacccccttcttccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctggtgagtacccctcctggttcttctggaagtaaaaagggtgtcttttcggttgaaagtacttttcagcctataagaaacatgcatttgaaactggaactatccacagattgaaagtgtgcatctccagtcttgggatttagagaaatgaaggaggggtagagaggacctggcacccccgagggcgggttcgggccacagctctctgaagtttgaggaagcacagtgatggagatgaggcagggagataattggctgttcaagcaggtgctgtgccaagctgactgagggcccttccctcctggcgtccgggtacagccccagctgtcatcccgcgccagccgccccggattggccgcctggggaactggtgagcagcgggactgaaaggccattggtcgcggcagcaaacatgctaccctgctggataactgaaaacaaacccgtcacatgggttcaggaggcggttgccaggggagcaacttctcagcacttccttttgccgggtcgctgagtaaactgtggtctgaagccaaaccgcctacaccctgaactgttagagctctgtagattacgttcttaaggaaaagagtaacccccttacggcgtttagattttcgtacacccaagcagtagcatagatgctgtacaacgtaacactgagtcagtctgaactgtggacacggggactgctgggtgtgtgtactagactttcttggctatcattgaaccgcttttatagaaatgttgagttgatcttggctcagcagatcacttactgctcctgtagtcacacagcatttgtttatttaacgagcttgtcgggtgctttctgcaacctcaactctataagctgttgaaatgttaatccaaaagtgagcaccacaagcccctatccttaagcagcttagagtctggtggggaaaacaaaccagtatgtcagtgactccagtgcagtgcagggagcatcctgtttgctttgtggctgacgtttgtcagcttactgctgaccataggcttcagatgctttgctgtgttcattccttacagcaataccatgtgtagcttcatttatagatgtggcaactgaatcacaggtgaagtcacatccaagggtgcgcaggtagaaaggggccaagccatcgttggtaactgctcctgctgccttggtaggtgtgtctcctgcactgtggaaacacattgcctcagttgactcactgaaaacagcaagcagcagagaggtttgtagcagattaacagagggctccgtgttgaagaactaggacaggtgtctgtaattattaagtagtgggtagaatgttttcatatttgttctcggagggacgggatcctctttcgtttttcgaaacactttatgtggctgtactaattgaacattttttgagaactatatctagatttaaaattccatgtttcatatacatttggcagaatagtttctttcctttaaccaaaaacttgatcttagaaatgaaatagtttagccttcagtatttgtaattggatcctcaagggtttctaggaatatctggacaatttctcatactctcatattctacttttttttaaaccatcagccaagagcataagtaaaatttttcatagtatgttttttacctatttatttattaagctatagtgaagtaaagttaatttggggggtccatttttcagaactccaaaattagaacctgatgaagtataataaattgaaaacaacattttttatctgaatgtttgatgcaaactgtgtttcttgtttctcagttgaacctaaaaggtatatttctttcatactagactgaggtgaaacaattgcagggttctcaagagccctgggacacagtgacccttgtgtcccagcatccaaccccacgggccggcaccccactcccccctacagacattcattcctgccttcatctttgccattttacttctcttttggaatgccattccttcccacctgtccaaattccaagttcatgtctataaagaataactattccagaccacagtgatctctttctctgtgtcccagttacataatccttataattttacacatgagaaaacaaacatgcagagccacgtcccatcagagggcaagctgggatttgaggctgagttttctcttcttggtctggtgttctttccgcagcttgaggcttgaccatgcgggaaccagatggagaataagcgaagcctatgtggggctgtctcgccccgtacttgcccatgtgcatgtgtgcacagtaggtgctcagtgcctcgtacagaacatgctagaactcccgaaaatcaactccagggccactctaggagcatgtgacccagactgtcaaagtcacatcagcaaatatgtatctcatcacgtgcccagccccagtactgggtggtggcaggagtgtcagagctgtgatgtgacagggtgtggacagatgctaacctttttattgtaagatagaaatcacaccggatgaaaagacaaggtgaactacatagtcatttaagttctgtgtgctttaggcaaatgtggatattaaatataaggttacatattgctcatattaatatgaataatccctgcttgattccttcctgtgtttactgagatatgttcaactacactaaataatagtgatttttaaaaaacttttctaaacagtacaattttgtgggagtggtactcaaagagaacaagaatataaaatcactctgaagttatagctgataattttttctaggaaaaggactggtttgagtaatgtactgtgttactaatgaccacgttgaaattctggaacttgaatctgctgtattctaacattgtcaacttttttaaaacagctgttgttggcctactgtacccctgtatcgacagtcacctcggagaaccccacaaatttaagagagaatgggccagtgtcatgcgctgcatagcagtttttgttggcattaaccacgccagtgctgtatccttaattttctgtgctacgtccagagtatcttcttaggttatatattgaagcgttttgttttgttatatactcaaatgactccatgtcataatacagacatgatggtggtacctacccatttcagattactaaaaagagaaagaagaatggggctatcgatgacttcacagtaaaatatattgttttatggtcaaaataaatatatatttatttatatttttatatatattatatatatttttaaatatatatataatatacataataaatatatatttatataaatatatataagcactttatatatagctttcagcaagtttattcttatggttaagtttttgactcagtgatggcagggagatttcaggtgatcttaatgattactgtaacctgtatccaacaaatcctttctttagctcattacacagtttttatggacagtgaattatctgtggtacaataataaaatacccatgtttttaacccttgtggttttacgtttttttatcttaataagagtcagcaaacttttccttaacttttatatcaccagaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtaagtgtgtgttttcaaatattggctttggaaagcttacttaactttcattaaaacatccactaagcttagatattttcatattttatttgttttttatatagaatgatacagatttaggcatgaaattctcaaaaatgctgctatccataacttaatgtaacgcaaaggaaaaccaagtagtagcagttacaaccaaacaaatatgaacattcgtaacattggatggttgatatgcgttctgcatatccccactacagagaatctgtgatgtagaattgagccaggtgaaattgactgctaaggtacagtttcttttctcgctccaggtatacatccccagatttcctctatattcgttcttggctcccttgtatatttttctcaggaggcgtcacggtggggaacataggacgacagttagctatggtaagtgaaatgatcatattatcttctaaaacttgtgtctctttaccttgatagaatgactttacatgatacattcaaatttgcgttcatatattctggttcagacttgagtgacaactactgagaaaagcttatatttaaaaaaataggtaatgatacccaggtaattctttgctaaattataaaaattcataatatttgatctagaaaaggaactagagccctcgcactgcccctttgaattgcagatgtggtcagtgttctgaattcttgaaatttctgtagtaagcagtagagaaagtgactggtgtgtgagtgtcccctcctccttcaccatcggaagcagatctggatgacctcatgcagtgatactttgctccctgagcatcagtccaccagtgtttcttttcacaaaatcagagtggatgcagatgatgctggcctcttagtccacagtcaagcaaatcgagcctgaggctgcagagtctgtctcgggccagggcagggactaatgtgggcgggcaaggggacagcctggttcaggcaggcagcacctttctgtggggcaggtggccctgggcatggagaagtggtgatgagagcaccgctgcacgtggccgggtcaccatgtagacggactgtcctgcctgaacattgcatctgttctcagctgcaggagaaagcagtgctaccccgcagagcttctctcacagcccccctgagggagacggaaaggtagtgaactccaggatggctttagcagttctcattagttaaaaattgacatcttagcacttcaatttaaaaacatagaggtggacttttaaatgttattttgagttgactttggcaggctgaaagaaagtaaattaaaaaaaaaaacaaaaacctagagctgttgctctcggagataagctctgggaaaacttatcttagtacctcatgctatttttaaaacagtacatttatttttgccagctgatacccttctgtgaggagttgaatttgaagaccacttggctgtttcacaaaaccagaagtaattacaggtagaatttgcagtcttccactggttactgactctctgctgccaaatttctcatgatggagaagaaaggactttgcttgccttttttttttttttttttgagacagagctctggagtgcagtggtgccatcatagctcactgtaaccttgagctcccggactcaagcaatcctcccgcttcagcgtcccgagtagctgggattacaggcacatgccaccatacccggctaacttttttgctttttgtggagatgttatctccctgccttgtccaggccgggctcgaactcgtgggctcaagccatcctcccaccttggcctcccaaagcactgggattataggcgtgagcctggccttgctttttttaatattaaaaatctggtcggatggtcccacatggaaatagtatgttgttttcatgcattcgccatcatccccgttaatagtcttcaaaggagagctggcaactccatcattgctttcttgctgtgagatttttgtttcggtactctttgggagagaattcctaagaaggtttttagaataaaattgtcctcaaccagattgactaattacacattataactacaacttgaataacatttaaagagttggttatttctgtttgataggttggtgctgttatatgtcaaggctttttaaatcggttttaagaaataagcattattttggtggaggtagaaatttcacaacattcataagttctaaacatctagaaatggttggaggaaacattttcgttttgaagatagtttcattaagtaatccctgctgtgctcctttgcttacagaaaaaaatgttaaagataactcaaaataggatagttggtgtaattataattctccttacttcagctttctcttcatcctttttattctttaagcttgggggaaaatgtttggatgttctcgtatcttaaaactggaggagagaggctgggcgcggtggctcacgcctttaatcccagcactttgggaggctgaggcgggcggatcacgaggtcaggagatcgagaccatcctggctaacacagtgaaaccccgtctgtactaaaaatacaaaaaaaaaaaaaaaaaatagccaggcgtggtggtgggcacctgtagtcccagctgcttgggatgctgaggcaggagaatggcgtgaacccgggaggcagagcttgcaatgagccgagattgtgccactgcattccagcctgggtgacagagcaagactctgtctcaaaaaaaaaaaaaaaaactggagaagagagatcaccaccttaatccccttccctactgggctatcacatgaaactgacctctgaggttctaagcctaacccgcctaccactgtttttattcataaatacttaaatccttacctctggatcccaactgttactctttttttcacttcaaaatttgcaaactcatttctatccatcaaaccccggaaatggcccaggggcttcacagtgcagtcccctccctcctgctgcatccgttcctcaggctgtgccccaggttgcattcgtggtgcgtgttttctcccagggcagccttccccacattccactcttgtcatactgttgactcacaaaatggaagtggctgaatgttccagggatagtgtctaagagctattggtttaaggttgaaacctacaccaagtaaggctttgtgaagggagatgacgagagtgaagttgttgacagtctgaaggtgaagagattccgaggctcagttcagcaccgggaccagacccgcccagatccagggtaatttgaggtctgtgtttggtgctgatggttttgcccagtgcactccacaccctctccttcttagctgtctcagttctcttcagatgcctttgttctaacttatgcttccctcccttaagaagaaacatagttacttgcaagaataaccatgctcaaaagttacaagttggctttgcttcaagttatatggtctcctagctttttctatgtggtatttccccccacacatgccgttgtcctttgtgtccgaaaatacagcagaaacatttgttatcagcctgttacggtttttttgtttgctttttgtttgtttttatttttactttttttgagacggagtcttgctttgtcacccagactaaagtgcagtggcacaatcttggctcactgcatttgaaccgtctcccaggttcaaatgattatcctgcctcagcctcccaagtagctgggatcacaggcgcccaccaccgcacctggctaatttttctgtttttagtagagacggggtttcgccacgttggccaggctggtctcgaactcctgacctcaggtgatccacctgcctctgcctcccaaagtgctgggattacaggcatgagccaccgcgcccggcccagcctgtatgtttaaaagaaaatgagtctgtaaccatcatttatagaacttgtagttgttgctgtttgtagcttcaagtcctttctcaagagtaagctgcaaactgccaacagcaatcaagcctgtcctgctgccactgcccggccccactgggccacctggaggcagagtcccgcccacctcagtgtcagcttgggatttgatttgccgttcctgtttttgattgacccaattcagctgctaatgataataatactattattgttattgagggtttacatttgttgggctcttactgctgcacaggaggcattgtgctgagcgtttccattgttagccagtttagtcctcataacacaagtctttgaagtagaaactattattagcccatttttaaaaggggaaattgcagcttaggaagattaaacaacttggccaagtgggtggcagaggtcgacgtggcaccgtgcttctcattagcataccacactgccctttcaacacatagctcgcacctgccttcaccctggaagcaggtttacagcagcctgtgttggtgtctgggttgccatttacaatgtgccaccattaggcaacactgctggaagtccctgtgccacgtgtcagttccgcccgggctggctgtcgttcgtctctggcgtctttgccaggcctcactgtggcctctgtcgaccagggattctaaaagtccacttcccatttatttatcagcacattagtgaacagggagtcaaatgtgatgaccagttttctttccaggttgctgccaagagtttgctcttttgttttctcaccgcagtttgtatagaaccctcccagtgttcatatctaaaaattggcagtgctttcacatgatcaattcctaaaagcatgtatgtttcctagaaggtcttattgtgtgtgtccccagggtagtaactggcatacctgggtgactcaacccagactcatgactttcttacctgtctgttcagatgagaggctcttgctgttttctggatgagtaatctccgtcattgctgaaggtgaggagctcagctccttcctcttaaagtgagtggagggcaattaagtaacgtgggaagtcacgattctgagggaaaaaaattctgtatggaggtttctcttttgccctttagcagaagctccgtggcctcaggaaggtcatttaatctctctggctttgcttcttcatcagtgaaatactgttctccattaagaatttaccctgaggtgcctggtcatagtagtaactgtagtgtctacctctcagaagctctgtgagggtcagatgaggaagaacatgtagaaaggatttcccaactgtgaagctctgtgtgaattgagggcacacagagcttcagtattacaaagcatgacctatttccaatgtctgtttcaacaaactgctggtaaggtgggttataacacaggcatcagatactaataaaggtttgtggcagaaacctcccttctgataaaggttcaatcccttaaattgcagttagaactttcaggaacctatcataccctaagcatcaccatgctttgataaaattgggtgtttcctttatatagatattaatttagttaaactttcaccaatatcttacacttatataacaggctttatataagggcctcagcagcgtaatttcacctgaggcagagaattatcctaattttgcaggtgagagctgtggctcacggggccagagccatgaagacggtgcaggggagctgggagagctggcctcggtctccagttctctgcacatgtcccacctctcaatcttgttgcttcagtcaaagaaagtgtcaatctttcccatgttaggacctacttaattggtaattaaaatatttatacatttagtgctaattttctctttccttttttttttcctttctacacatagggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaacc

SEQ ID NO: 35938 - DNA, 12402 bp, Homo sapiens; identical to SEQ ID NO: 35937

SEQ ID NO: 35939 - DNA, 13385 bp, Homo sapiens
tggcagtgcgcctgcgccgcgtcggcgtgcggaacgccgcggtgtctcggcgcctctgcgcgcgggaagatggcggaacaggctaccaagtccgtgctgtttgtgtgtctgggtaagagggcgccgacttactcatgttctgacgtcctctggagagttggatcgggcttgtgcgctgtaggttgtgccgccggcctaggaaccatgagggggaggaggccagggactgggaggcctagggtgttctaggagtgtgccgcagcgcccctgttccccatccgccccgtgcacccgcccagcctgcccgctaaacctgggtcccctcgcgcctgccatatatccggggctcttggcatctgcagccacagcccctacaagccaaggtactttctttgcgactactagaatccctctcgttcccctccaatgggcccaggtaggcctggaggttgtcggactgatgtggtctcttaggggcctcctgagtcctatgacaacattgttttgtttgctagtttccttagcccatgcttagatagggatctgagttaaagggagatgaagttttacggtttcgggtttcttgattgtaaaagccaagcaaaggagacctggaggtccctatataactttggcccatgaaaaatgaaagtgtattttattaatggcttttcaggaactttccagcttaaattattttcactcctagaatttcaacacttagcttgccttacttcaaacataatttattttccgtttggtcttcagggatcttcctttggtgtagcactacaaggttatattcctcggtgcctccaccctgagaggaaggcctaaattgtcagtagtccggttacttaaaaccttctgtgagtttgcatttcctgcagtttctgtttatttttacagactcctcactttatctcctgtaccttttcctgctcacaccctcgggacactgccttccagaacctttcgttgttcggtagcacttcacatgcttactgagccttcatcgctgggtgcccattatgcattttgcctggaaagcctttttattttataaagtcaaacctaaatatttcctcctttgctttcccagatcatgagttgcttccttatcgacatcttttattacacaaattttactataatttgtgtaatatagtaaaagatgtaatacagaaaaggtgtgattccttatcgacatcttttattacacaaattttactataattatttgatagtctgttgaaatcccagctgagtttaattttgtcgatggcaataactgtggcttatttttcattttgttttcagctttaggacaatatatgataaacgctgactaggttttgtagaagttaacttctgtgaaagacgaattagaaggcttaccttgtttcacattggtagtgggcatcatttgatttttaagactcattgaaggctgaatgatgaaatcaataagtttattaaacagtagtttggttaaggatggttactaaataatattccattcccttgtatagttttggttggtattgtcgattatgctggcataatgcatcatggttgctgttaatggggaagtgtatccttgcatatacagtagtcccactttagctgtaggggatacattccaagactccccagtggatcccgaaactgtgggtagtaccaaacccaattgctgtcaattggaacatgtgtctgctcgtttcttacacccacaaatgtaataccgttgccaccttaactaagcatttaaaactgtggtcgcaacttttgcagtttgaggcaagacagcagacgatcaggaatttctttttccttgtttacattttcatggatagaagatttgttcgtactgtagatcttagtaacctcggtataagttttttttttctttccataagaagtcaaaaactttcacctttttacttaagggtagtgcttatggcttctctttgccgtatctgaattgctagcttcactactcttatgatttcgggccattattagtaaactaagggtgactcgaactcaggcactgtgatagcatcacaatggatctgataagctagagggcaataggtggatagacagcatggatatgctggacaaagacgtgtttcacttctggggcaggacggaatgggatggcatgagaatttatcctgctactcagaacagtgcacaatttaaaacttaggaattatttgtggaattcttcatttaatattttccaactgaagctgaccatggggtaaccatggaaagcaaaaccttggaaaagaggggactattgtatttcaatacaattcagtgattttttgttgttgttgagcatctactatatggcatgcattcctctaagtggtgtggtgaacacaacagacaaaaatcccagcctctctggagctcacgttctctcagtcaccagcaagtattaattgatgtgctcaatcggttgatgtgaagattaagaaaaatagagcagaaaaggggaatgggagtggagtgcagttttgagtgggatggtcagggaaggccccacctgatagatgacttttgagtaaagacttgaaggaggtgaggaagcaagcctaggatattttggagaagcatcctgaacccagaggaaagcaggtaaaagttttgaagggagaatactggccatggtcatgaaccgcagggaagctgcagtggctgggcctagtggccagatagtttttctcagtcaggattcctcatctatacctgaaaatttagcagataatttgagcgcctgttttctcagtgcttccattgtagatgtatagggagaagttaattccttatatacactggtcctttagggcaggagtctgcaaactctttgtttaaagaaccagattataattattttagattggcttcacatgacatacagaaagggtgtagcacaaagtagccatccatatgatgaacctggctgtgttctagtggatcttcatttgtggacatcagaattggatggaactctgtataattttcacatgtcacaaggtactctacttttagattttttccaactactcaacaatgtaaaaattattcttaccgctgtgggctgtacataaaggcagtggaccatgagccgattttcagacccctgttttaggtccagatcttgggaggccatgtgaagacttgggcttactctgaataaacattggagggttttgagcagaggtgggaagtgatcaaatttaagtttaaaaaagaagagtttcagctgttgttttgagatgaaactggaggtggagcatgcctttactggttgcattctgagggaatttgagcggtaaatggcattttacttggtagccatatagaggacagtaagagttgtatgcttttgaaatgtaaaaaactttgttcattcaaagcatttgtttggaccctattgagattgaagtgtagaaaagcatcagaggtttttcattggtgaagctaatgatggaaaataattgagctccttactacagcacaattatgaagggtgctttatgtttttgcaatagagacttattagtgaagatgatgcaggagccatgacccagccagcatggttggtggagatagcacatgctggtggagtcactttacttctgggctacacccatactgggtgctgggtctcttaccaggtatagcagacacagccccaccctcccagagcctatctgccttttatgagtctccatccttgaattgaagatgctgaagaagggtataaaatagtctgcctaatttggaaaagacaaacttgagactttacagattgaaacattttttaaaggcatttgaagatggaatgttctgtttttagaacttgtttgataggcgaaacctgaagtacatgcagtgtttcactgatgaccggggtgctccattttttcataacaaaatttggtggcatcaactttcgaaatcaacagggcaagctactgctagcctttaggacagttaataatgcaagttttcatattgttgtggggaaagtaagctgttattttacagttaaagataattatttgtaaacgtgtggggctagtctttattatatttttagatgctgagatactaggcatctgttgttctacagatccaaaataataattgtcttaatttggaatacaatgtttgctgttaaaaatattcccagggtatatggtgacaagtaaaagagttacacacccatgggaagcctttcaataattaaaatagtgctgatgacaatacctgtttagaaaactaaacaaaatttagaatgtcgaaaggaaaaacttcacaacacaaattagcatatagagggtattcaaggctaatttgttgtctttccctttatggtttgtaggtaagattttttactgctgtggaaactacagtctctgtgggaaaaaagtacgtaatatgcttaggtcttacaatgtagaaactgaaggctgtagtaaggcagtgagttggttttctgaactagggaattagctgtgttttacaacactagaagatcctcattgtatttgtttatcataaacagaagaccctaatagtgataaagagtaaactcttagttagtgctgcctattctcacagttcctctttttcgtatctgtttcctaaattcagctcctaatgtctggactcagtgtggtgctttggcattaaggagactggaaggcctcagagcagccccagaagcaaggtcgtagaaaccatcatttatcttccccagcgcagatcatagaaactagaactcctctcctgcaaagcaagccataaaacctagaaagatcactctctcccttttgccttctcttgaagacagcatttcagaggggccctgcctcattcctgggggaggaaatgctgtggccctgctgggtttccctcagtctgctaccattggatcatttccttttgtccagtgccatttctacacagctgtgcattggtcatctaagcatcaaaaccgtttccctgggtctttgggtcttcatttctgaaggctcttgttaacctgtcttttgttacaggagtatcttccatgacctttatgatgggtgaggaaagctgccacacctttccactctgacactgtcttgtatttgctccttcatacgagcctcttacaaggtctctccaattcagtcatgtgctcttctagtgtttccttagctgtgccggtaattttggtaacttgtaggaagggtctgtgttttaaacaactttctgtcttcaggttagggcacagtgcttggcacatagagttggcatacaaaatatgtttgttgaataagtcatattacccttttccataggactttctatttctcctcatagtggctacgcaaagttcaaatgttggcccagtgttttagggctcctgtataccagcccgtcagtttccagacactggctctctgtacctgaagcatcgcagcctcacctgcttagtgccacaatccctctgagttaaatgcctttcccttcctctgtccattaagatcctgatcatccttttaatatcatctctaatctttcttttttctggtaagaaattttcttatatcttgtttttgctttgtagcatcgttctttttctgtgctgctgtagtgtattgtttatcagcattcattttcccacttttattataataaatataataaataaagtggagatagagttcagctgaatggccagtgattcaacccattgtgtctccctccgaaaaccccaataaaacctcagagcactatggctctgaggagcttcctgggttggcagtgctctttgaatattgtctcatgttgatgacaggagagtaaggtgtcccagaggacagtggagctacctgttagggaacctcccagaatgtgccctataggtcacttgctttggctgttttgtttgtttgtttgtttttgtttttgttgctgttactataatgaaattgtaatggtaagtgttctgctttcctgagtttggggagtaattctagggaattatcaaacctgagggagccctggggaacctggatttctcacttgctggtctaaagtaaggatggccctgatgtcgacatcgtggtctggagagtggtgtccctgaccttgggctgctaatgcctggatctgtatccctgggctcagggctttgcatgtgatcgctcagtaaatgttggtgttgaatcgctgtttatgcttaaatgcatgtttgtgtgtttgtgtattgttttgtgaaacagtagtcatccttatgtgtgatatacttgaaaatacatacagttgacccttcagccacaggggtttgaactttgaaggatttattcgaggaatttttttaatcaagcacagatggaaaataccgtgttgtctgaatgagaaacccatctgtatggagggctgacttttcctatacttgggctccacattctcaggggccaactataggacctgagtatgcacgttttggtatactgggtaggggtgggagggtgtcctgaaccagctcctgagtctactgagggacagaccactgtattttatttttattctgttgtatttcattttaaaataagctggttgcaacccacttcattttcgtgattcactcctggatcattagtagcaactctttaaacaataatttttgttgaaattgtttttctgatatctttgtcatctgtacttggagtacttggctggttggtgtcaaatcactgaacttgagcctgataggctgttctccagcagggtctaccctcactggttggacaaaggcgtcaaaggatagtgttggcctttgtttttcctgagggatagcacagcccccgtgtgtcaggtgtgtaaagaaggggagctggcatgtgcccttccatccaacctaaccctgtttccccacccctccctttttttaaaggtaacatttgtcgatcacccattgcagaagcagttttcaggaaacttgtaaccgatcaaaacatctcagagaatgtaagtaccattcattatcttaaagaggccaacctgaactcctctgggcaggaaattgcaaaaaaaaaaaaaaaattccatgtttcttcccctgcagtggagggtagacagcgcggcaacttccgggtatgagatagggaacccccctgactaccgagggcagagctgcatgaagaggcacggcattcccatgagccacgttgcccggcaggtaccgtccttggacttgaagttgtgtgttttgtgtttcagtgggtcattgacagcggtgctgtttctgactggaacgtgggccggtccccagacccaagagctgtgagctgcctaagaaatcatggcattcacacagcccataaagcaagacaggtagacaagctcttgttcaatttctaatatatagagtccagtaacttgagaagtagcgaaaggattaaccagacttgtatattaatgaatgtgtttatttagggtgagcttaaccagctatggtgtgtccattttgtttcacttctggttgcacggtgttgaaagacttgcctgactttggaatttacttattaaaatgcacataaaagctaggtaatttataatgagagagcctgactgtgagctggggctgagcggtgctctgtcttctgttccttcctgcataatttttattaaacatttaggccatagtaatcatcctgctgatattgcaagtttgttgctagaatgaggttatataatatatacaaaaacattttttcaactgtaaagtgccttagtaatatagggtaataccagcaacattatggatatataattatagtctattgggccacacttaagtttggagtctaataaagtcacaatcaaattctgcaatttcaattgaagataaccttgtctttatattatgaattagaagctaaagttgatttttctaagagttctttatttaaatgaagtactctgggactgaccttttcggaaatggaatcttcattggtcaggtgattcaacatttttatacaatttatccatcctcatctcttcaggatttgcataccttgccagtttctactggccattgttgaaaatacatttatttggagaagtccaaagccaaggggctcatggggctgtgaagtccttcttgctgcatcgtcctgtggtagaaggtggaggagtcaagagagtgccccagagtgagtgagagcgagaactagaaaaacgggaagagggaaacagaggagagagagagagaggacccatcagtgtcaggagcccactcccaagatagtggcattaataaagatcctgcgtctcactattgttgcattggggatgaagtttccaacaaaggaactttgggggacacatccaaaccataacataggatttaaataattttacagagttcaagagttctgctactgaaccgtttgagatccctgttctgaggtctcatcactttccagttttagcaggaagagaagtggcaagtggcaggagtctgcagattggggcctgcacctttttttgaggcaccttttttatgaacagtgtttgttggaacacagccagactcactcattcacctgtagttcgcggctgcttttgtgctagagcagcacagccagagcggcctggtggccacaaagcccgactgtctctgcagcactggttttttatatggcgtttctagttgtttttagtagtaggggtgatttgccacaagctgtttcatttatagctgcaagtggaaatcctttattgtgcatttgttacataagttatagctgtttctttctcaattattgtaacatctaaaaattatgtaacagttactaagtctttttttatgaaaaatttacaattagtccagaatttaaaacaagtttagtattaaatcctagggaatttctcacataactaatttggagaaataatataatactgttcaggcatggtggctcacacttataatcctaataacactttgggaggctcaacattgcttgagcctaggaggtcaagaccagcctgagcaacatagtgagacccatctctaccaaaaaaattttaaaaattagctgggtgctatgacatatgcctgtagtcccagctgtttgggaggctgaggtaggaggttggcttgaactcaagaagttgaggctgcagtgagctatgatcacaccactgtaccccagtgttggtgacagagtgagaccttttctctaaaaacaaaaagaaaaaattcagtattgtacttattctcaattttgaaataagtcaatgtcatgggagtgttgacgaaatacagtcttttctagctactggaagtgcatactaaaagccaaagtttctcattttttagaagaacaggtatacactttccacctttgttccgcagtacgtatgtttatgtttcttattctgccattatttatagtagtcgaaattcacaaaataatcttttcatttgtattttaagtaggtgtgtttatagattatatcagaaaacaatcataagctttcaggttacaatcagtagaaatactgagtggcattctcttctgtgtgaggtttaaattatggatagtcaatcaaaataaaggaggactgtcagttatcactcctgtgtttctttcttagtgaccacctctgaccacccaacttaatacttttactcctccctgccccaaagctgtatgtatctcctctctgctttatttcctccagggcatctgtgcctcctgtgtgttgcctgcccccatgtggaagggcagctccatgggacgcggctctgtccacttagcttggtgtttgttactggggcccaggatgttcagtgcttgtggaatgaaaaatagagtagaataatgaaggggattaaatatgtgacattttagtatgttgactgtattatacactgctactaaggaattgaagccgatgtataaacattgtgtctacacattatactattttatgattattgtatggaactttataatacaaaatttctttgcagtacaattttgagaaataggttaactctattttaacttaaaagtaccctaaaaattatttaattgtttattagtgagtaacaggctcaaatacagcagttttttttttcttttagtattgctttgcatcctctaggcttgaatggtataaacactgtgttttgacttcttattcaattttagattaccaaagaagattttgccacatttgattatatactatgtatggatgaaagcaatctgaggtaatcctgtttttgaagaatatttctgttcaactctcagttcagcagtgggccaagtaatttgttgtccagatttactttttctattttaaaggttttaatagtcagtgatggtcaccatatgtagaattattttatttagaacagcaaaaaacttagtaatctagaattgtctcttaggtatttacaaggaaatacaccttagaaaagggaaagtctagttgttaatagcatgatttaattggaaaactagcttggctgttatagttttgtatcaagcatattgttctgcatgagaacgattttgatatttttgctgtaatgattcctgggcagggcagtgttttattgattctcaggtcaaagctctgcaaccataggttcctattattatcccatcttgtaaaagaaggaagtgagaaacggtaatgttaggttatgtccccgagttcacacagctagcatgtggtggatgtcatgggatttaagcctaggctcagtgaggaagggccctgctgtatgcacccctgcctcagtcaccaccctcctgacctgccccagtcccatgttcaaggcgtcatcgggaacggatcataatttaatgtcactccaggattctgacttgcatcactacttattcataaatatctcatgtttttgatgaagataaactatttgtgcttttaattacttttgtacaaatgaacagatagggatgcaccagtttcaattattttttattaattaggaccttcattaaaatgcatgtattttttaatttttatttttcagtccttattctgttctcattgtttttgctgacaccatagcccataggcatcgtaaaaacacctttttaggagaccccatttgctttgactggcactgagcaccgtgtttctttgcgtgtggggcaagtggagttcctgcagcctcacatttgcacgtgctgttcctctgcctggaagctcctccttgcttcttgggtcattcggctcctatttgcccctcgtgggtcagcttaaattcatttcttgatagaggtattctgctgccctgtcattaggccagattgtgcattagacttaggcctgcctgcagttctcattcctgcacctaatcctgagctgtaaaacttcgtgcatgggagctcttggctgttccgttcccacataaagcacgtacctgactcatcaactcatctgtcgcaggtgctcagtcgaaatttgttaaataaatggaggcgcttagttaagtttgcctttttcttttgtagcaatgtgaaagctaagggtggaagtctagagtgaagctgagttttcagcttgggcagaggcttaaggaataaaagatggaagagtaattaaggagtgggtcgtgctgtgggaagtgctgtgtcaagacacctgaggatggaattggtagccctctgttttgggactggttcagatggtgttttgggttcctttctatgacctttatctctgaaacttgattgtcttaaaatgtattttgtgggagaaaatataattattgtatattttgtgtaacagaatcagtgagaataagctgctgtcgcaaactgtcttgcctagagagagggcagtggcatacagctgcagaaggggccacacgggcctgctgagtgttccgtttcatttcaaattaggtcattctgtcttgattttgatatggatgtttcagaacaccctagcagatgtccctgtttaacttgaaaccatagatcagaaaactaagttcatatttcaattttacagagatttgaatagaaaaagtaatcaagttaaaacctgcaaagctaaaattgaactacttgggagctatgatccacaaaaacaacttattattgaagatccctattatgtaagtacagttcacgttttagggctaatatgaagacccaacacatttgtatcctgccatattaaataacagatgagattgtgttaaggatgtttttgttatgcaggttttgccattttcttctttttcctgtccatttaggggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagacagcttatggggtattttaagcattcttagactagttgaacatctcactttgccccagttacaaaaatagtagaacaagcaacataaaacaatgaaggaaaacctcacttgaaggcccaggtcaacatctaagcctgttgagacttagataatcgagtctacctcttcagtaggtttgtgtggatggcctggagggcaggtgccctctgctccccagtgctacctctctcttccctagggccttttgtggattgacagtagtcccctccgtaggagctcacagtctagattagaagtgttttaatttctacacacccatagtgcacacttgtatattgaaaagatagggaagagagaaacatttatggaatcagtcgttggcaccttcaatacttcatgatttttgtcgagtttacttcatgaggaggtcagcccattggctcccatctgaaccactttgcctctgaaacttaattacatccagaaagaaggacacttgtatgctagtctatggtcagttgaggaatatgactgtttttatatgcacatgtaacccaaatgtccaatataaattggcttattttttaaaataattttaaaagttgggaaaagtgttattatttggcatgcttaaatattgaataagtattcttcatcagcatttaataaatgtataggcagatgtaaggtaatttctgtgtattttgagataatgtcaaaatcatgaatatttcaaaataaactggggagttataaaaatacaactagagatat

SEQ ID NO: 35940 - DNA, 2702 bp, Homo sapiens
ataaaggggtggcccgtagaagattccagcaccctcccctaactccaggccagactctaaaggggagatctggatggcatctacttcgtatgactattgcagagtgcccatggaagacggggataagcgctgtaagcttctgctggggataggaattctggtgctcctgatcatcgtgattctgggggtgcccttgattatcttcaccatcaaggccaacagcgaggcctgccgggacggccttcgggcagtgatggagtgtcgcaatgtcacccatctcctgcaacaagagctgaccgaggcccagaagggctttcaggatgtggaggcccaggccgccacctgcaaccacactgtggtaagctcctcaactcctttggatggcctagtactaggcggtgggagggacaagaatctctccccagaaatctgacccagggtgggtctccagggagatgcaggggaggtcctgaaactgctcctgggcccccacatcaagggacctaggttcccctaccagggtttgtgggcccctaacccagtccagggcactggtgtaggggcagggtgttaaaactctccagatcccccaaatcggggacctcagtatccccctgggacttaggtgaatttataaattctttccagggcactggtgtcgggggccttgaaactcctcgtgggcaccagtcctgggggagtagaaatccctattcagggttgaagggggacctcaccagaccctgaaaaagggggcttttgaaattttcacttcatccctaagaaactgaaatattcacctgggtcctgatatgggggatcttgaaactctcgctgggcatgtcacttgggcggggaaatcccactgcattctggatttggtagggccctctaacttttcttgggccattgctcaggcaatctggaaatgtccactaaactttggttatcgatagcctccaagtttccacgtggggtggcctcaaaactcccattttgaggacccacatgcttatgggtggccctgggagagtgtgtggttgtggctgttctttaaggttggagaccatggtgcagagagggttggaagaaaacctgaaaggggtttgcatttaagcccctctgtccccaggacctagggaggaggcccaggtcccaggggcagcagccaaactccccaggccaaaaccccagattctaactcttcttagatggccctaatggcttccctggatgcagagaaggcccaaggacaaaagaaagtggaggagcttgagggtgagaaagggagaagggagagggccggggaggggtgagtcaggtatggaagagggggtgggggcagggagaccagggctggaggttggggtaagggggaggttctgtcccagagtggagcagggccccagcatggccacatgctgacccgccccctgtttctgtcctcccaccctaccaggagagatcactacattaaaccataagcttcaggacgcgtctgcagaggtggagcgactgaggtcagagatagccttcccccgctaccctccacctgccacattcctctcacccccacatccctagcccaagacccaggatctcctttgctcccaaaatccccattgccccaagggataaagtttgagtcccacaaaaggataacttagcccctagggtcacagagccatgggtggccgctgtccattccctccccggtgacttggattggggcggtgcggggggaactcccgggggcggtgggcttacagggagggcggcaggagccaggacgagcagatgcctgatttgccatctgtaccgcagaagagaaaaccaggtcttaagcgtgagaatcgcggacaagaagtactaccccagctcccaggactccagctccgctgcggcgccccagctgctgattgtgctgctgggcctcagcgctctgctgcagtgagatcccaggaagctggtcagtgaggagggggcggccccgggagggagaagaaagctggggaagcggggcggggaagcagaggctccgaagtctagagagagaggctgcaggggaagggactgggcgcagaggtgaggggccttggggaaggagggagaatccagtgagaaggatgccctggatcggggacgggctgatagctgtatggggcggggctatcaatgggggcgggtctatcgatggaggggaggggcttatggatgggtggggcgggtctagcgatgggggcggggcttggggccgggcttggagcggggccagtgtctgctgcctccagtctgccctgagtccctcttctggtcctttaggcacatcttggaaggtccgtcctgctcggcttttcgcttgaacattcccttgatctcatcagttctgagcgggtcatggggcaacacggttagcggggagagcacggggtagccggagaagggcctctggagcaggtctggaggggccatggggaagtcctgggtgtggggacacagtcgggttgacccagggctgtctccctccagagcctccctccggacaatgagtcccccctcttgtctcccaccctgagattgggcatggggtgcggtgtggggggcatgtgctgcctgttgttatgggttttttttgcggggggggttgcttttttctggggtctttgagctccaaaaaataaacacttcctttgagggagagc

SEQ ID NO: 35941 - DNA, 55142 bp, Homo sapiens
cctcgcggggttgcggcgagcccggcccgcgaacgtcacgtccctgcgcgctccctgcactctcccgagctgcgctaggcgggcgccacggctgcccggcgaaggaaaccgaaaccgagtccgggcccgtccctccgcggccccatccgcccggtgcacccggggccgcgctcgccaggccgcggagcccagagctgcgcgcacgaaccgtgcgccgggagggcgtgggcgtggcgccgaagggtcccgggtcttcgacgcctctgcggcggctcctccctccttgcagttggatccctggcgggtgcggcccggcccggcccgtgagcggcgcacagaatgggccgatgctgcttctacacggcggggacgttgtccctgctcctgctggtgaccagcgtcacgctgctggtggcccgggtcttccagaaggctgtagaccagagtatcgagaaggtgaggcggggcgggctgtgtgtgtgttgtggagtcgtccagctcaccctcccatccctgctgctacatcttgtatgggaaagaccagcactcaggcagaccctccgcgctagagctcttcttgcgtccctgtcttccagggcttggtaggcgagggttaaagaaggatgaggaaggatggagccgactctgttccctttacagtgataagtaaggctatggatcctgacttttaaaaaggccttcggttgtgttctgtcgtttgcatctctccccactccttccgtctacaccccaatctcaggtgggcccaaacttgtttccttcccacttcatgaagaaacagaactgaatgaaagacaccgcagaagaggcaggttatgttgtctgcttgctgtagcctttgaagtggtgtgcgcctggggatgagacgtgggtgtgcggtctattgtgttcttgccctcttgggctgggcaggggcagttggtagctgggccagtcctttaggctgggtgacaattcatccatcagtctttgctgaacgctgacttagtggctttgtatcttgtaccaacagtctgtgttgctttgtctcaccatgaattcttgtttttctcaaacggccataattttcaggcacagatgcatttagataccctacaagaatctgaacttgtctcttcctctagatgattgggctggagagccagtcctttaagaagacttcatcttttgatttcactggtcatttcatctgccctttcccccacatccaccaagctgtgtcaaaagaggaacaaaagagaattactgggatcattttttccttaaaaaagaaaaataatcactggagcagcagcctttcttgttagcatccataactgcacgcttcatttctcccactggtctgcacttgctgcggccagataaaaaagcccaggcctagtctactttgaatcactgcactctccagtcagtaaagctattttattccaggtggcaatggatatcttcctttaactgagtttccaaaagtaattaagtgagtacctgaaatctggcagttaaaggcagtttttcaaaaagcaccatggcaaagcataatgtaatttttaaagttcacattgccaagggaagacaaggcccactgtctgagcgtctcgagggtcagtttcctttgagcaatcatgttcaaggaaaaaagaaactgaatcctttctccactcctgtccatgtccaaatccatggtgagctgtgtttgaggatgtaaactcttgctttgggtgactagagtaaagcaatccaattatagtaaatatgtgagttttcttatatggccttgaaaggctgtttcaaggagccctataggatgagtgatcttccccgtggttcccatatagccagcccttagattctctgtgtgtctccatttctctgggtgagggggtggctgtaaggcaacttggctggggcctgagtttgtgttgatatttccaagtgtttttctccatgaggaatggactctgttctgataagtaatagtacagggaagtggactttcagagctgctcaatcccagctaaggaggactgcacggtgtattgtatgaaactaaaggacagggctagtttcagtgggcaggtgtggaaatactgttgtcattagaggtaagtcacacatcgctattctgctttttcctggattacctgtagggtggtaggtagcatgggacagtgggaaagattgaggatgttacactcctgggcatgaaacctagcttccactatgtcccagctcggtgaccgtgggctgtttaatcttacttgattcatgttttccccatctgtaaatagggataataaggactaacgatcacatctgctttgtcaaataattcttataaccttaaggtgtgatctttctgggatatagttagtgcttaataggtgatagcaactttatttttattagaagccacacaaagaaaatacgtgagatttggagtcagattccatatgttcaaatcctatccttgccagtataagctttatgacttacgtcaaataacttacttggtcctcaatttcattgcttgtaaaactggggatatgagctgttagctaacttgggcacagtgatgcatttaccatgaaactcgcaaagttaagctttgggtctctcacttgcacagacccttgcgaagccctgtacctcattctatatcccaaattttcttttttcttaagaaggacccttcaaattgtataagcttcaggacccacaaaacctggatttgtctctgcatgtgtattattgtaggaccaagtataaagcacttagcatagtatcaggcacagaataggtaatcaatatgtggcagtcatctttattgccactagtattactatgggagaattcattcataacttgattctaatgtagttataatataatctactctgatatttccagttctttgttttttcatttgaagattgtctatgccccgacttgtctatgtcaaaaagggaagagggaaaagggatgaaattcaaatgagtaggtgtgggaagcttagtaagagaattcctatccaaaaagttgtctcaaatgataattgtccttgaaccctgcagtgaccagaggtaactgaagagagacttttaattttggccagtgaatatcgtggaaggaaccaagacaattttgtttcatttttggcctcagtggtgactgcctcgtattgggcaaggcctgtaattgtttctgcttcaattttctcatttgcaagagaggcataatagtacttctctttttcccacaccctcttcctaggggatattgtgagcattaataaggcatttccttacaagcgtttgggccttcatgaagagagagctttgcagagacccagcagttccttttcctcccttaggcctggaaaggcaggagtttacgttacatttcatctggtatcccagtgaactgccttgacacctagcacagtgcctgagatacatattaaatgcctcttcactcgcctgtgatcattttaatagaaagaagagtgtcctgagaatcagcagaactgaatcaaacattttttttctgtccctaaggatttcttggactaagctgaacaagcacagtggcaagttatttaatccctcaaatcctaaggatcctcattttgaaaataggaacaataaggataagaatacttaactcagagttgtcacaagaatgaaataatatgatatctataaagcacccagcacaatgcctcgcacaatgcctgaacgttaacagttgttatgtctttagctatatttgtcatctgtgaattgaaacttattatacaagctatggttcctcttagctccaaacttctgagatcccatgacctttaagagcagctatgcagttcagaatattaagtttgcgctcctaatctctgcagacgtgctggcaggttgactgtctcccagtaatagggatgcagaactggccacagtcagggctggccaacaagggatgggatggcaagggaaccagtgggagactgtttacacctttgacttcctcttcacaggtcaaggcaggactgtagcattaggtctcagagatgcaatgaacaggacaaatacacttccccttcatctggacctgaggctctgggcaagtcagtaccagctggtttcttttgggagccatagaaactctggagctgttctaccgattcctcaagaagtaaaatataggccaggcgtggtggctcacgcctgttatcctaacactttgggaggctgaatcgggtggatcacaaggtcgggagttcgagaccagcctggccaatatggtgaaaccctgtctctactaaaaatacagaaattagctaggcatggtggcaggtgcctgtagtcccagctactcgggaggctgaggcaggagaatcgcttgaatccgggaggcggaggttgcagtgagccaagatggctcccttgaactccagcctgggcgacagagcaagactctgtctcaaaaaaaataaaaataaaaataaaaaaagaagtaaaatgtaatcactgataaccagattgctttgattggtgactatgggatcttgttttttaaagtcaaatcagcaaaacatctttattgatgtgtatgtaaaggcattcagctatatatcattttaaaaggctccttcttgcatatctacctcatctcctgagttgcctctattcaaagaagacttatcttagtctgagatttttcttgatcagaaaaaaacctgtaaagatatcttaaatctgttatcttacggtcaaggaaattgaggctcttggaatagaagtgacttatctaaagtcaaatggagagggaaggagagagcgtgccagctagccttctgatcctgaacccacttttcccatctcaaggatgaccatacatcccatttgcctggaatagtcctacatggtttctgtgtacctgttgtgctggtgtaatcactaacaccccctttcctccaaaagatttctgctttggacaataaattctatggccatccctcacctctcatgctacattgtccttacagaccacaatgtatcccgcttcttggctctcttaaggagttgaggcctactcaaactagctctggcaagagaggattcttttttttgtttctgtaaatctggaaggggaagctcatagaaatcaaagggcaagaaccacggcacagtaaggcctcctgagaggacaaccgaaagtggaaagtcagcaggaagcaggcacactctgcctcccactttttcctctgctttctccaccaacaggcttcctctgtttactcagcctggctctgtactcatccgggcttgctcagccccgcctcagtgtgactttccagctgttgacctctcatagacatgcttcatctcctagtttctcttttccaagtttataacggagcaatgtgattggctcagcacaggaagaaactatagcactgtaaacggaggcagtgtcgttaatttccttgcaagattctctaactcctaagcaaaattatccaaattctttcctggcttttagaaacacgatcttgtgatatcaaaatcatattaagtttattttagtgtcttactaattcatgttgactatgagtgcattccttattaatgattaagacaatatagtaggctaacagttgtcagcatagcccctagactctaggagatgcatctaaatcacttacaaagatttagaaaataccagaccccatcccagacttgctgaatcagactcattaggaacagaactcaggttaaagtgcttatcataaaatccattactggaggcaggttgctgtgggatcgtaatctgcaattttgggaatatgcatttttaaaaaaggtgtttatatttgtatagtgattattttagaccatgtcttcattccttaagatggtaattctgactgaggagattactacttataattactattaatctgcaagtttacattaaaggaaatattatttggtgaggaggggaagattcctgcctgtggaaactactttgctttattgttaaataaatccaagatttcattctgtcaggccacagcagaggggccatctgttctgccagacatttgcttatttcccaggaagaatcaggaggtggaattataagctcattgatgaaaacataggatgttggccaagttactagacattcctggccatatcatcaagatatgcactatctatacactatacactaaggaagggaccatttttaatccaagctggtaactggaaaaaacaaccaaggaaaaataaagaccactttaggtgtttgctttctatatctaaatgcacttttgggtacatgctttggcagtcattctttcatttgacaaatatttactgagtgtgtaccatttgcaaggcagtgtgctaagagctatggatataacactaaacaagaggcagtctctacccttgcagattttataatccaatttaaactcctgggcccctcatattcttaaaaattattgaggaccccaaagaacttatgtttccatacctattgatagttacaatattagaaattgaaactgatatgtatttttgagaaatgtttaaaacagaagactacacaagcacatattccaatatgacatcattatatatcacgtaacctctggaagactccactctacactcagagaaataatagaattaaaaacgcaaatgataccttagtattaaaatagttttgaccttgtgggcgcctcctaagaaggtcttcgggctccccaggggtcctgagatcacactttgagaactgttgatctagttttcatttaattatttttttagaatatttttaaaaatacataatatccctgttttatattcctgtaaggccagtttggaagctatcttgttaatgttttcaaacaaccaggattttgcttggtgtgtctttgatttactgtgtccttttggctttcctgtgagtccagtgttaaaaataggagtttgggccatcagtaattccagttccacaatctcttgtctttccccgagtgctgatcaaagtagacaagagcattcatatctccataattgaattactcagtaattcccttctggcctcagccctgcggggattttcaacccatatgacgtaatttggtattttaatctagtatgaaagctctctttgaaggtagatgtcctgtcgtatttagttttgtgtcttttcttactgccaaatgcaatgtcttattcaaaatagatggtcagtaagtgttacttggatgaatagagaaaataatttctttggaaatgattttgtttgcattttgttgtttagtctcacattttgcctcactctgtaggccagtggtcacatgtttgtctcatgaatgatttatacctttaaaatctggaaacttcacgtattggtccagatttccagcttctcttgaaacatgtggatgttctttggtactcgtcataccaagttctgtgtggtagctgtctcggcagaaaagaggctgacccttagaagagacctgccttccctgtttcccactgtcttagtccattcaggctgctgtcacaaaatagcatagactgggtggcttataaacaacagaaatttatttcttacagttctggaggctaggaagtccaagatcaaggccccggcagatttggggtatggtgagggtccactgcctcatagattatggtcttctcactctaacctcacatggcaaatgagctctctggggtaccttttatgagaactaatcccattcgagagggttctacgctcgtgacctaatcacctccaaaggccccacctcctaatctcaccaccttgggggtaaggatatcaacaaaggagttttgaggggacataaacattcagaccacagcacccaccgtcctttgcgcccttattggctcccaaggcccagtgaaggtatccgttgttgtgcatgtgctgttgtgtttcttagagtagagaaatgtttctctatatctgacactccttaccaaaagaaggaaaatgaaagatagcttgagaggatcatgtgtttaacagaaatgggggagggcatgtttctctgtagaaatgaatattgctgctggggtttgacatgcaaacaaatgtacaaacccatggcctgtgtcactcatttgccctagccatctggccccttcagcatctgaattttacacactttccagagacagtgtgaggcagagtgccattgttacactaatgtaatcactcatcacaagtcccattttttaaaattcattttttaattgacaagtcaaaattgtacatatttagggcatgcaacatgatgttttgagagagatatacatatagatatacatagtgaaatggctaaatcaagctgtttaacatacaccttacctcaattacttatctttgttttgtggtaagaacacaaaatctaatctcagcatttttcaaatatacaatattttggggttttattttattttatttttgtttttgtttttgtttttgttttgagatagggcttctctctgtcacccaggctggagtacagtgccactaccatggctcactgcagccttgacctcctgggttcaagccatcctcctgccttaaactctaaagttgctggaactacaggtgtgcaccatgccaggctaatttttaaatatttttttgtagagatggggtcttgctgtgttgcccaggctggtctcaaattcctgagcttaagcaatcctcccacctttgcctcctaaagtgctgggattacaggcgtgagccactgtgcctggcccaatatattgttatccactgtgatcaccatgatgtacattagatctcttgaatttgtttatatcaaactgaaattttgtgtcctttgactaacatctcaccagtcctcccagcgcccacaattcccattttaaggatattttcttttaacactgtacttctgataatcaacagtagtggaagaggagacatagaaataggtaggtaatgaaaatattacttatttcaattttgagagatataatcacaaccaaacaggttgcaaaataatgagactggctgtgcaagttacacacagaatgtgggccttgtttccgtggccttatttcttatttattcacatctgaaactcctctttctcacccgcctccccactccccatatatgtatatatatattcccctcccgctcccaattttcacctggttctatgtttaagtttctatcggtagctgctttttttccctttaggtcatcagttctcaaacttggctgtacatttgtaatcacctagaaactttcaaaaataagttagtgggtattttgtagcaggaggttttttgggattgtcattccaccatattgtcctgtatgtaatttataaacaaagtacagttcacccatgagctacatttgaatctgaactatcagagctcattagttaaaattatgacagttgcaaaatgaaaatgagttaagcaacagtgacataaataaatgaatgccaatacatttttactgagttaaaataaggtcagggaataagagtagaatgttaatggcagtttctttcttttatgtaaacagtggaaattacttaaattactgcatgagtctgggttgggtttgcttcgtttcagggagcaattttaaaaaacaaagcaaatcaattggtgttttgccatttgatgagttttattaatctggagtccagtatacaattaggccaatataccatccatacacaattagggcaagttctccaagttggtctgcattatctctggatgaatttagactgtgcagatggcaacatggatgcttaagttgtgtttaattatgaagtagcactttactgaccttaaagaacaaccagtagtgctctcgaatcccgaaactttccttaaaggtattactgattcccgtgaaagcctaatggattccctgagtgcttatttttatcacttggaagtggcttacatcaggacagctggtttcaccactctcatggtgttgccttcccaaaagattgctgttaggctgacttgggttgtggctgtattaagtcatgtcagtgttcagcagtcaagctaatccagcctgcatctgttccttcatctgcaggtcaggtgtcagcctggccagcgactccatgttcactacacacagctcagagaggttgttctcagttctgtctctgaccagccttctgtgtacccaaatggaagcttatgctggttgaagattcttttacttttgttttaaaacagtctcacttcatacatggtaaaaactgttatgcttctccagtaattcaagaaatgcaagttcaaacaagaagatgctattttgccactactgaggaagcaaagatttctgaaaaccttaaacaccaatattgggatggatatgctgaaatggttgctcatacactgctttctggagcaacttgttgatatttaaaggctgatgagttcatgaaaactttttgtctctagacccaataatcccaatctaggagtctattctaagaaattattcactgatttgggccaggtgtggtgcctcatgcctgtagtcccagcactttgggaggccgaggtaggtggatcacttgaggccaggagttagagaccagcctggcccacatggttaaaccccatctctactaaaaatacaaaaagtagctgggtgtagtggtgtgcacctgtaatcccagctactccagtggctgaggcatgacagtcaaaagttgcagtgagccaagattgcaccactgcattccagcctgagtgacaaaagcaagactctgtctcaaaaaaagaaaacaaaattattcactaatttggacaaatatattcaagaacatttacttcagcatgaaagcaacacaaatgtcctatagtaaaagaatgattaaataaactgatttagtatatttttttaaatatactaatacagtggattagtatacagacattaaaataacagtttcaaaacctatttaataacaaggataatcgtttataaaagatgagtcaaaaaatgatacaatacatatgatctcaattttgtttaaaatacacatatatatgactagaccagagggaaataaacccatatgttaacagcgatagtgtggattacaggggatttaaattttgttccttttactttcttcattgtccaaattttctgtgacaaatataatggaatgggtagggaatggatggagtagcatttacctgatttaaagtaacaacaggctgggcacggtggctcacacctgtaatctcaacactttgggaggctgaggtgggcagatcacctgagatcaggagttcaagatcagcctgactaacatggtgaagccctttctctactaaaaatacaaaattagccaggtgtggtcatgtgtgcctgtaatcccagctactcgagaggctgaggcaggagaatcgcttgaacccgggaggcggaggttgtggtgagccgagtcatgccactgcactccagcctgggcaacagaatgagactccctctcaaaaaataaataagtaactgaataaataaaaaataaagtaacaacaatcagtagcatcatttgtgaatagaaattggaggcaacacatgactttttctgcacatttgtagtaatgttatctgctactttaaacatctcttctaatatgaatatagaaatttctgtagattgataatttatcataatatctaggtatttttcccttagataaatgtgatgttttattgcttacaagtctagtttgttccttgttatatcaaggagtttttagaattcaccaataaaatgagaaggtaggagatcttgtctaccattatatctccaatacctagaacagtggcttagcacaaaggaattgctaagttaatatttgtggaaagaatgaaagagtttcatcagttttaaggttgtgaaaatcctatgctatacttgctatgaaaaaggatgttataaaaaattcattaaaaccaaaattgctaaagacagatctaacagacttagaactaatgtttgtgtgcctttggcatattaattatgcataaaaatagaccctgctaattccaaactagtcttaaccatttatgaaaggaggccaaaatgtctccttgaaaaataatatttgcagctaagaaagttactgtctcttcttgattctgcagtactgaaattcagactttttatttattcagatcacctttcttacatattatttagaatatgcggcattttgccacattgaagattttaccaagaagaactgggtaaacagcagaagatgaatgcctggcacagcgttgtgctctacgctgcggtatcatctgtttcttcattaattatttattgtgtcccttctgtgccagaaaccatgttatgtgctggggatccatgaaaaagatacagttcttagtatcagacccaatctgacactaaagactaatgaacacattttccttataaaacttgtgaagtttcatgaaagcagagagaaaacacatagttcagaggggccttctgagagatggcacttctgaattgagccctgaagcccaagtagaagtgaaccaggtgataagggccctgcagagacttctgggtgaagggcggtgagtgactcaggccaaggcactggctgagaacttgtgtggtgggtgctaggtaacagtagatggttgcgtgttactggtgcataaagtgcctaccaggaaaagacagcgacaggtgacgcagttgcatcagatcacaacaggtcaaggactgtggactttatcctttgagcaggggtggagtatctgttcccttaggcacttttgacaggcttctctgaagcctgagatggatgaagcatttgaaaggaaaaaggctggagagagggagaccagttaggagcctacatacagtattgtcacagtccaagccaatgatgaaatgtgccttggggtagaaatggggaagaggaggaggtgaaatcagcaggacttagtgatcaactaggggagaaaatcatgagtccattttggtcatgttgtcttggagcagcctgtgagatgtttagatgggggaattttatcacagatccatgctactggaaggatctaaataatttcaggcataagctgtttgttaggctgaattactgagtcttgcacataatttttcactccctgttacatgcatgttggttttgtgtccttagctaaatttcttcttacagacagggcctatgcctgtttgcagggcatagtccgggcacatagaaagctctcagtaggtacatattgggtgattaactgaaaagtatgttttttagtccaattattaatttagctgttgacactgtgaattcaccatagaacttgataattttccagtattttgttttagtggtagtgccacagtattgtgcgtggaaaaattcattatgttcgtcttggttaaaactaataagcaacagttatattgtgactccacagtgccactcttaatatccagagtcacactgtaaaactgatttaaggccttatgttgctttttcatttagtgtaactaagaagactcagctgattacaaggtttgtctggtggctgtcatcaccacagcagaaccctcggtgaggaagatcagttgttcccaagccatggctttctgttcagactggcaaagggcgcctttgagggggacactagctcgttgtatctggcggaatgaataacttcctgtgccagacagtccgcggtcttgaggctgaggttattatttgttagtttctcaggccttcctttgccgagcaagctcctgggagtgcacacttgaatgccctgaggatcagaaatagaaggggcagaaattaaaagtttaagtcaaaacagagccctctctgggccatcttgtggcaggaggttgaggtgctttctttggacccattagcatactggggctgcgcggctgcctggaaactctagagttgaactctccctttttcggttcctcacctgtgggctccttactaggagctgacagtgacctcacgcagctgccctagtttcctttcctccagatggcacgggtaacactcgaggaaaccctgagagttcagagtccaacttatggcttctccatagtttcactgtccctctgggctagagttgccaaataaaataaaatacaggacaaccagttaaatttgaatttcagataacaaataacattttagtatgagtctgtctcgtgtgatatttcggttcagtccgatgtatcagttgttaatgtcctgccatatttatctctctgatgcactttttcttgaattatttgaagtaagttgtagatatcacacactttgttcctaaatccttcagcatgcatctcctatgaataaaaacatttttgatgtagcccatgcaatatttgggacataattatattataaaattatttgttgtttatctgaaatacaaatttaactgggtatcccaggttttatttgctaaatctggcaactctaccctcagggtgccatggggtggcagctgctggatgggtgagtaaatctgcactcctggacttggtcagatttgatttcatttactggctttgtgacttgggacagccagtgccaccatttctttgtctgcaaaatggggatttttattttgtagtgtcagtgtaaaactcagagataaggtacattataaagcccctagcatagcacctgactttagcagactcacagtagattgcagctggcgtggcagtaatggtaactgaatagtaactgccattctctgagctgaaagtgagaaaataaaaataaagacacactgttttagaaatgttagcagctgtatttacaacttccctctgttctctcattccccatctctcttcctacttagtgcattcgcatgagcacacacacacacacacacacacacacacacactcactcactctccagcacgtgatctactctgggattgacagagggtttcctgacaaacatccaacttgtaaggtggaggaaaagagacatatgaaagcagcaggaaaagccaccactcttgagggcaagatttgaagggagtaaaaggggctatgaggatttgtctgagtgctggtgactcaactaagaagtggccaggcagagaagggctgtgggggtggagggagacagaggagaagccccagctgtaacatggtctgggttggttatgactctggcatgctgccaaggacagtttttattgttcttgtttttcatttgctttgtttcattaagaagtcaaatgtactaaatgtttatttctatcctgaaagttggaggaacaagttcaagtcacactgtttacgcatgtcagaacagccaggtttacccttctttctggtaaccccttctttctggaaacccttccacttgtctttggatttatggttgcctaaaagctggatgccagcccagcaagataaaccagggaggttagccatctgttcatttatgtttgctgattctttcagggttcctaattctgaggtgattttcttcacatgaacaaataaatgagatctcaagtcctttctcactggaaacttcacacactatgatgcttgtcaggaaaaattaggcaggaatacagagtgctcactcaactgtcctgacagtaataggaagagaagtgcggtggagtcgagagtgggggcggctgctcctgggcctttgcagcagagcagaccgcagctgaggcagcatcaggctcgcctttgttttgctagaacagaggaaagccaagatgaagtgagttctctttgtgtccattccttctccttgccttagggtctatccataacatgctacagaatctgagtttcttagattttcacttaaaaaaaaagataagggaacatttttttttctgcttacagaagtaatttatttctggtgtaaaaatccaaacaaaagcaacagtgagtggaagactcctcctaatccggacctgaattataactgatacaaattctcgacactcaaagttcacattttggtttgtttatttgcagtctgtgcttttatattatttttgtatttcagccgtttttacagtaaaaatacaaggcttttctccattaacagatagaggactgttgggaataccaggtgttaggtttctgttaacctcaggcgctgtatttatcaggcctctactgccacggtgagtaacaagtaactccccagtctcgttgcttataacaataatatgtgggtgtgcagccagctcagctggctcagtggaacgaggctggactccaggcttctggtccgctttaggactagtctacacatctccgttttagaacctaggctgaaggatcagcagctacctgtggcctgctcttctcttttccaagggtggcaacttcaaggtggcagatagaaacttgccatgcatcttaaggccttagctccaaattgatacattgccattccacccacatcctgttggtcaaatctagtcacttggcctagcctgaagtcagtgaggcagggagaatacttcacccttaggggagtcatggtgtattaatttgctagggcttcccgaatgaatacaacagactgggtggcttaagcaacagaaatttgtctcatagttctggatgctagaagtctgagatcaaggtattggcagagttggtttcttctgaggcctgtcttcttggcttgtagagggctgtcagttctgcgtgttttcacgtggccttccctctgtgcttgtctgtgtcccagtttcctcctccagttaggacaccggtcctattagcagggcctaccctcatgacctcatttaaccttcatcagctctttaaagaccccgactccaaatacaggcacattgtgaggtattgggggttaggacttcagcttaggaatttagagtatggggggcattattcatcctgtaacacagaacaggggtggaaagtgcaggagggattgtgtgcagagtgcagtctccattgtcagctaacctcagtgaggctaggcctcctggtttttgaaacggggataggcagttccattttagggtttttggggatccaataagaaaatacatttaaagcccctggtggtggaggcggtagggatggatgtggtttgacttgaaaaaggaccaaaactggccttcttgggcccttccccttgttattctctcatctgggcaaactgggagtgtatggtgcttttcagaattgcttaacttctacagaagatacaccatccatggaatcttcaaaaataacaaagccagcaggccctttaggcactcaatctgtgccctaggttttggaaacactatgcttcatgcttctgcccaagtgctgtctttagtacccttcctttacaattattaattaattaactagttaatttattttgagacagagtcttgctctgtaacccaggctggagtgcagtggcacgatcttggctcactgcaacctccacctcccaggttcaagcaagtctactgcctcagcctcccgactagccaggattacaggcacgcaccaccacacctggctgatttttgtatttttagtagagacggggtttcaccatgttgaccaagcacgaactcttgacctcaagtgatctgcccgccttggcctcccagagtgttgggccactgggcccggcccctttacaaatatttatcgaaggccttctctgacttattagaactgtgggctctattggtgtaagatatggccctgttctcaggagactgcagttgaatgcctgtgaaatgattaaaatagtgatctaggaggtcagaatagggggcgtcccttcctctgcttcttgggtttaaagccaactattgccttacatttttgtaaatctccttttggttttttcctagaaaattgtgttaaggaatggtactgaggcatttgactcctgggagaagccccctctgcctgtgtatactcagttctatttcttcaatgtcaccaatccagaggagatcctcagaggggagacccctcgggtggaagaagtggggccatacacctacaggtaagtcttgaccacctcctgtcttgaaagaaatacagagtgaccccaatatggcctgagtccttgcctcttcccaggagcaaggctccagggctgtgtgggagcacactttctgatttcattgtctgaaacgctgctgatgttttgtatgtgtgtgtgaaacctcagcagagaatggctttgtagactgggccaagtctcagcgtgttgtgttttgaagtgcagcggtttcctcctgagttggcagactgtgattattaaaccatgaagggttactccttaccctgacccttttaaggttgccccttgatattcttattttattttattttatttttttaagagacaaggtctggctttgttgcccaggctggagtgcagtagagcagtcatagctcactgccacctccaactcctgggctcaagtgatcctcctgcctcaacctccctagtagctgggattgcaagtgttcaccaccacacccagataattttttttgtagagatgaggtcttgctatattgcccaggctggtcttgaactcctgggctcaggtgattctcccgcctcagcctcccacagtgttgggattacaggcgtgagcaccaccatgcctggctactgcttgatattcttaagtgacttttagggcctccctccatttccattccccacataactagttttaaagcagttccagaatttacttttgtctgagacagatctttctgtttcttacccgctccttttctccacctatcctgcgtataagcaataagcaagtagcagaggctgttagagtctttgctggtgaccaccaattccaaacactggggaatcaggatccctttaatcatttttaaacgattagtagagggagacgcttgaatcagagcattttctctgttgcaatgttccccttttccctattacaatacctcctccctctcccatacaataatctttccaataaagtctctccttaccaggttagaaaacaaattaatagaggaagcagacaacaagatctttctttttcaaaactgctgaatgataaaaatgcctgacaattctgttgtaatcgattgctcaataaattattgctgactgattcatgtgctatgaatcagtactattctcagtggtgggaattcagagataaaaatcctagttcctgccttgggtgctcatgctctgactctggagtcagatgacccattttgattcccgcctctgcaacttactagttctctgtgcttccatttccttatctataaaatggggataaaaataggacctcctccacatggtttttacaaagattgagtcaatgagtcatgtataaagtgcttagactagtgcctagcacataattagtgatacttaagtgtttgctcttactattagttggattaggctatttttgcattgctatgaagaaatacctgagactgggtaatttataaagaaaagaggtttaattggctcatggttctgcaggctgtacacacatggcacactggctctgctcggcttctggggaagcctcaaggagcttttactcatggcagaaggcaaagcaggagcaggcacgttacatggtgaaagcaggagcaaggggtgaggaggtgccacacttttacaacaacaagatctcgtgagaagtcacccactgttgtgaggacagcaccaaaccttgagggatcctcccctatgacccaaacagctcccacctggccctacctccaacactgaagattacagttcaacatgagatttggaggggacatccaaactatatcattccacccctggcctccaaatttcatgtccttctcacatgttaaaatataatcatcccttctcaatagtcccccaaagtcttaactcattccagcattaactcaaaagtcctaagtcccaggtctcatctagaaatgaattccttctacctataagcctgtaaaatcaaacaagttatttcctttcaagatacaatgggtgtatcagcattgggcaaacattcccatttgagaagggagaaattggccataagaaaggggctacaggccccaagcaagtctgaaacccaacagggcagttattaaatcataaagctccaaaatcatcttctttgactccgtgtctcacatccagagcacactggtgcaaggggtgggctcccaaggccttaggcagctccgcctcagtagcttttttatgctgagattgcaagctgatggtggctctaccattctggtgtctcaaggacggtggccttcttcccacagctccactaggcagtgcctcagtggggactctttgtggagccttcagctccgcatttcccctcctcactgccctagtagagtttctcttgagggctctgcccttggagcaggcttctgctggggcacttaggctttctcatacatcatctgaaatctaggtggaggatgccaagcttccttcactcttgcactctgtgttcctgcaggcttaacatcacatggaagctgccaaagcttatggcttgcaccctccagaggagtggcctgaactgtacctgagcccctttgagccatgtctggagctggagtggctgggatgtgggaaacagcacagggaagtagtgcccctggcctggtccctgaaaccactcagtcctcttaggtctcagggcctgtgatggaaggggctgtctcagagatctctgaaatgttttcaaggccttttacccattgtcttgactctcagcacttggcttctttttagttatgcaaatcgttttagcaatggttgctctacagcctgcttgaatttatctccccacaaaaatattttgttttgttttgtttttgagacagggtctctgttgccaggctagagtgcggtggcatgatcatggctcactgcagccttgacctcctgggctcaagggttccccctgcctcagcctcccaagtatctaggactacaggcaagtgccaccatgcctggctaatttttaactttttttttttttgagacagagtctccctatgttgcccagactgcggaaatgcttttctttctctgccacatggccaggttgcaaattttccaaacctctatgttctgcttcccttttaaaaataaggtccaactttaagtcatttttttactcccacatctgagtgtaggctgttagaagcagccaggcgacatcttgaatgctttgctgcctagaaatctctgccagatatcctaaatcatcactctcaagttcaaacttccacagatccctggggtgtgaacacaatgcagccaagatctttgctaaggcataacacatgtgaactttgctccagtcccaataagttcctcatttccatctgagaccttttcagcctgaacttcactgtccatgtcactgtcagcaatttggtcacgatcatttaatcagtctttaagacattgcaaactttccctcatcttcttgtcttcttctgagccctccaaactcttcccttctctgcccattacccagtttcaaagctgcttccacattttccagctatctttatagcaatatttgactctcagtaccaattttctaaattaggttgttcttacattgctataaagaaataaccttcctgggcatggtggctcatacctgtaatcctagcactttgggaggccaaggtgggtggatcacttgaggtcaggagtttgggaccagtctggctaacacagcaaaaccccacctctactaaacatacaaagattagcctggcatggtggtgcccacctgtattcccagctagtcaggaggctaaggcaggagaattgcttgaacctgggaggcagaggttgcagtgagccgagaacatgccactatactccagcctgggtgacagagcaaggccctgtctcaaaaaaaaagaagaaagaaagaaagacagggagggagggagggagggaggggagagagagagaaagagagagaagaaagaaaagaaagagggagagacctgagactgggtaatttacttaaaaaagaggtttaattggcctatagttccacaggttctacaggaagcatgatgctggcatctgcttggcttctggggaggcctcaggaaacttataatcatggtggaagtaagagagggggagcaggcatgtcacatggccagagcaggagcaagagaggggagaggtgccacactttacaacagccagatctcgtgagaactcactatctcgaggacagcactaagccatgaggaatccttcccatgacccaaacacctaccaggccccacctacaacattggggatcatatttcaacatgagattttgaggggacaccaaaactatattattggtcttcgtagattaattgttttagtctgtacaagtcaatatgtagaattataaagatgaaccctgttgctatatgaagaaatctaagaaaatacttgggtcctcattttaaaaagccattttgtatgtgttctatgcctgatgaaacactgtgtactgggtagagaaagtttgtattttaagctctcccactggcaataattagaagttgaaccaggatcagtatctaagtgtcccattgtttgttgttgttgttatttttaaatgaaattccttaagatgtgatggagactctgcaaactatccaaaatagtgtcattccaacatgttagcaatatttagaattattaatgagatactttacaatctttttttatactgtctttgaaatcctgtgtgcattttacacttatagaacatttcatttcagactagccacattttgaatgtgcaatagccacatgtgtctagtggctaccctattagacagcataattccaaccatactcccatgattttttgtttgtttgtttgtttgtttgtttgtttttgagacagagtctcattctgtctcccaggctggagtgcagtggcgcgatcttggctcactgcaacctttgtctcccaggttcaagtgattcttctgcctcagcctcccccgtagctgggattacaggcacggccaccacgcctggctaattttttgtatttttagtagagacaaggtttcaccatgttgaccaggctggtctcgaactcctggtctcaagtgatccacccgccttggcctcccaaagtgctgggactacaggcgtgagccaccatgcttggccactcccatgatttataagctccccagacacactgccttgccagtattcatgctgttgcttcagtcaagaatgaattcctcagcgctacctctcttgaccttcacatcttacttagtgcaaatgctgtctcctcctgagacttgcctgacttcggatactctccctgttacatcttatttaaaatgtcaagtagactgggcacggtggctcacacctataatcccagcattttggggggttgaggtgggcagatcacttgagcttaggagttcgagactaggctgggcaacatagcaaaactccgtctttaacaaaaatacaaaaaattagccaggcgtggtggcatgtgcctgtggccccagctacgtgggaggctgaggtgggagcatcgcttgaacctgggaggtggaggttgcagtgagctgagattgcaccactgcactccagcctgggtaacagggtaagacccccatctcaaaaaaaaaaaaaaaagtgtcaagtataccactttatagcacttgtaaagtggtatgttgatgtggtttggttgtgtccccaccagccaaatctcagcttgaattgtagtttccataatccccacatgtcatgggagggacccaggggggtaatttaatcacgggggcagctaccctcatgctgttctcttgatactgagttagttctcacgagatctgatggttttataagggactttttaaaaaacccttttggttgggtgtggtggctgatgcctatattcccagtgctttgggaagtcaaggtaggcagatcacttgaggtcaggagtttaagaccaatgtggccaacataatgaaaccctgtctctactaaaaatacaaaaagaaaaaaaaattagctgggtgtggtggcacacaccggctaaggcaggagaatcacttgaaccccggaggcagaggttgcagtgagctgagatcacgccaccgaatgccagcctgggcgaccgagcaagactttgtctcaaacaacaacaacaacaacaacaacagacaaacaaaaacccttttgctgggcacttctccttgctgctgccacgtgaaaaaggacgtgtttgtgtccccttctgccatgactgtaagtttcctgaggcctccccagccatgctgagctgtgagtcaattaaacctctttcctttataaatgactcagtctcaggtatgtccttattagcagcatgagaacagactaataaatatgtgcatccattatgacagtgactaattgcattttaataattggcttaggtatctgtctttcttcccaatgtactggaagctccatggggtgcagtgaccaagtcctttggtctctgactgtctactatttaatgaatatttgtggaatatgtaaattaaacatcttcaactgtggtttaaattcataggacacatggaaaaactaacactataggacacaattattaaaaagtatttaaaagtaatgacaaaaaacgcagttactttgcacccacctaatagccggaaccataggacttagttcaggaaacccaaatataggttcaagaaaggggaatcaggccctgaaaatgaatggctttgttaggaatatgcatatgtgcagtgcaggctgctaagagctccttacagggctgagtgggtcgtgagatctgggatttgtagaaaaacatggctttttagggagctgtccaaaccttctatggggcctgttagtctctacatgtgccttttgcggtcattcactggatttgatttctgtcacttgtggctttatgatgctattgtttaggctggataagacagaacattccagaagcttctgctccagtgttttctcccaactgagtcagctgactccatcaattgtatgccagggggcctggggcaaaggaaggggagggcatgtagcccctttcgccagttagtacagattggtgtggtggtgggaaacctctgagatggggaagggccaagcaagactgtggagggcctaactcatctgacacaggatttacagtggcacatttcccaaacctttcacatactggggagttcagaatagtaatgtttttggaaaaagatgatgggcattccaaatgttgataacagccagtcagtctggtttaaggaatgaagtgtattatttacatttttgtaaagctgcagattgagcagccctggaatgggtctgtgaatacaaggctcattggcctcatgatccttttgctcagggacatatttgtataaaatttgtatcaaagttgtggtatcccatggcttctgcagcctttttgaggtttattttttatcttgtcagatacctttttctattttgcctaccatttaacatttcaagaattaaaaaagaaaacaatttgtctaagggcacttccaattaatttgcgtatttctaagaagtatttactaaatttacagtatcccgtgaaatatcttattttggggtttcttagttttgctgtttggattattcatttctattttaggcttgtattatttaaaaagatgtaagggctagatcttaagttattttattattcattgataacaagtaatactggattttcaaatataatcaacatatataatatatacagcattatctttaagagtgtagactatattttatattataaaaattacacatatatatgtgttccatatatataatcactaaagatcaacttgaaaatgcagtaaagttttgaacaaaaactactaatccatggcttcactgtctcaaaaataaccaatgctaactaacattttagtggatatcttcttggccatttttccatggatgagttttagatggttatcatactatgtacatatgcatgtacatatacaaaatatacatattttttattcacctaatgttatagcataggatttttcaatgttatattttggtcttcatacaaatgaattttaatgatgattatatttaatagagtaaatgtattactacacttaactgttcctttcctgaacatgtagatccgttttcattttctcctctggttacctcgtgggttgaatgttctcctcatgtttgccagccagttgtgtttccacacttttagttcttgtcctttgtccatttgcttatctgggttctggagtgttcatggcactctgtgaaccttttatgtttcatttggggcaactgcttttccattgtttaccttgtcaatttttaaaatgtgttgtagtcaagtctattctttttcaacatttctatcaggtctgagctttaaaagtcttactcccttcaatggtttgatgttcaagtcgattttcttatagttctgtttttccacatttaatttcttcaggatctaagtgtcttccttgcaatttagcaaaggcaggaattttgtttatactgtctaattctgtcctattaaccctttagttctttaaccgtgtctgagccaagctgtataagaaatttttttaacataaagagacaacaaaaaatttaggaacaccgtgatcattgtttccattattataggagaatgctttctccttttttctaaacttgcctcgcttttctctgatagtgtttttagattggtagctaaaactgtatttgttttgccaaaatagaaacagattttgaaaaaaaaaatccttaaactgctcagaagtaaaaaaaaatagaaaaagatctctcacaccatcttatcatgcacaaaaggttgtgaccaggtatgtgtgagttttaaatgcacgtggtacattaggtgaattgcctacgtgagcctatgggtcactgcctggggacagggagaccagggagatatttccatcttaaggagtgaaactgtttcttgcacactgtcaacaagcgggtgagtcttctcccgaccctgctcttaccacttcttctcagtatcctgctttgtatctacaggttgctgccttcagttacctgagcgggcagcgtactcaaagttaagggtagaggctcctcagcctgtgcctttggctggctccccttgctttccctcttctctgtggtcaccctaggacttcagtactcctttcacgttgatgtgttcatcaccccagcctcgcctggatctgtgatggtcttttaaagcgtgtcctcctcctccaggaccacagctttctcactccccacatgggaatgctttcatgcttgctgcccaccttcgccccaccgctgcctctgttggaacacccccttcaccctcccacctgcagaagcccactctttccagaatcaagcaaaagtgtcttttgcaggagtccccttccagttgccatccctccctcctctgtatgcccacagtgcgtttactgtgaaggaggtggcctctgaaggcagtctcccatgctctactgtggattcttggaggaccagaaccaggacttaatgtcacaccatctcaagagcttagcacaagccgttgcacatggtatcagtagctaatccctcctaagcagcaggtgtgccaggtagtgttgtaactggatttatgtggatttcattctcacaacaaccctacaaggtgagtacgttattacctccattttacagatgaggaaactgaggcacagaagcagtgagtaagatgaaaccagggttgaatgttaaccctaccagccagatctcagtctagtttgtatccagtgtatgcccaatcacttcttaatagtaattctcaacagaggattaggtgaatgaaggaaccaatatgactgaaagataacgatactatgatagtattatacgcatccaatttatcaaacacctctgaggaattagatataccgatgttaattttccacctaattaaaattattccttttgatttccactccttatctcagtctattgtttctaaaattatttctaaaaccaaccatgaattttcctgcctgattaaatagttcatggagcataactgaaccttgtcttaatgacaaggaccgtcatagtaatgcacaaatgttatactatagtctgagattcattagcatctactaaataccagggaccatgccgggcacttttaagtatagttccttgattaattgcctaggctgaaaatttgatttgttttttgttgttgtttttgttttgttttttcaaactcttctttgtatttctgaaagttcatttggtcttctttgatcttgtaggacagtaactgatcaatatgcccctctctgcaggcaccagccttggcttacacaaaagtttggctttgaaatttcctctcctcctccatattccaataaattactgtgaattaacctctgtgtaaaatcaaggaataccctgaatgagaggtgaggtcaccaggattctaaacctggccctgacactttcgattggtcctgaatccacatatccttatctataaaaaggtggagttaatgatttctaagtgaagggtctttggttataagcaaaataaactacctctggctaatttaagtaaaacgggaatctatttgaaggctataaagtaggttaacagaatcaaggaaagcagcttggaagacaaaagcaggatgcagggcagctttaaagatccaggtcacgagagtgtattgatcatcacatcatgtgtctgccactgggaggaatcctgtcttttactgagttttcttgtttttaaattaaaattttttttttttttggtagagacaaagtcttgctctgttgctcatgctggaatgcagtggcatgatcatagctcactgtaacgtcaaactcctgggctcaagccatcctcccaccttagcctcccaagtagctgacactacaggtacatgtcaccacgcctggttcttttactgtgttttctatcttgaggcactgtgctcaggattcagaggccagaggaaaggaattggttgagctcaggtcccatagcaaccttgactgatggtcttacacagctgtacaatacaagagaggaaagcaaatcagggctattaccagcagaaagcggaatggttgtctaacaaatgaaaagtccactgcaaacactgaacttcaagctgtgtaagtggtttaacacggaagtgtctatcaaatttttaaatatattctttgtaaactggaagggcatgtaatttatcattagatttggctttggttagaggcatttgttagaggcattagctggtttcatcctacaggcgtttcttaggtacctgttaggagaggttgtctcatacagagagaggagcaccttgtgctaatgagaaagacttgggatcaagttctcactcttctgcctgtgctctgtgtccccagctgtgaagtggggcaatactacatgctgtatttgtactacatacttgtaaggattaaataaaataaaataatgtgggttaaactctttgaagagctatgcaagggtcagctatttataggattagtgggcatagcttggtgcttagtgtgatatgatgtgtgatatgtgtatatgtgataggaagtatgcttccttctatacacttgacagagtataggatatagacatgtgatatgatgaaatatatatttagtcttcctccatttcctggcatacagctcctaagatccttggaatcgcttaagtgataagtgtctttttgtatgctagtgaattgactgatgactggcagcctctatggctcctggatgggagctggtcctgaaagaagaggacaggattagagggttgggactttcagccccaccccccaacctcccaggaggggagaggggctgaaagttgggttgatcacaaatggccagtgatttaatcaatcatgcctatgtaatgtagcttccataaaaaaccaaaaggactgaatttggagagtttccagagaaccaaacatggggaggttcctggagagtagcgagcctgcagagggcatggaagttctgagctccttcccctacaccttgcccagtgcatctcttcatctgtatactttgtaatatcctttataataaaatgtaagtgtttccctgagtactctgggctgttctagcaaattaattgagcccaagcacagggggatgggaaccccaatttatagccattagttcagaagcacaggtaaaacagcctggggcttttgattggcataggaggtggaaggcagtctcaacctgtagaatctgatgctatgtccaagtagaaagtatcagaattgaattgaattggaggacactgcagaattattggtgcagagaaaacgccacacacttcttggtgaccagaagtctcagaagtcttagaagtcttctgtgtaagttgttacagtatgagagcacagaaaaaaatggtttgttttttctactggagaagatacaaagactcatctatttgtatgcatctatatgaatgcatttattttctcatctgtttttattttaaagtctagaagggatttaagaggtataaagagatacaatatacagacagtccttgacttatgatggttcaacttgaatgatgttttgacttcgcgattgtgtgaaagtgatgtatttggcatgcccctccaatgacgatagagttacatccagataaacccattgtaaattggaaagatactaagttgttgaatcaaaaacaaactttcaacttacgatgttttcaacttatgatgggtttactgggacataactccatcatcaccgaggcgcatttttacgtaccagtttcagccttcagcttgcttgcagtctacctgaggctacatgataatttcacaatctaaatgatgtcactcagaagtttctaattgaatgctaaagacatgtacggacatccacaggtgggtgagaaaaatccctgtgctgctatggttgggaaaggcctcagaggaggtgtgggtagcccagctggccaatgccttcctaacctgtgctcttaaattagctctgttcaatagaaatattacatgaaccacatgtgtaatttaagattttaagattttctagtagccacattttttaaaaagtagaaggaagcaggtaaaattaattttgataatatattttaattttacccattataactgaaatagcatcatttcaatatataatcaatataaaaaaaggttggcactgtttttgaaattctgtatatattttacacttacagcaaatctcaattccagttagccacagtttaagtactcagtagtcacatgtgactagtggctaccatgtcagacataataaccctagctggtttaggaagaaggaaagataagcaaagggaaagaaacaaaagtcactggaatttattgaacacctactatgtaccaggcagggctagggctagggctagtgtgaggcatttgatgaacaaaagatcagattctgtttttatttaaaattttgttcatcataaatttttggcataaattttggttttaataaatagtgcattaaactatttatcttgattactacttgtttaggcacctcttacatcactcacactgactctaggcccagccctggcaccaggcgctttctaagaactttctaatgcttcatttgggggctctaacttgaaccaaactgtgctgtatatcagaaacagagaccgggtgtggtagctcatgcctgtaatgccagcattttggaaggtcgaggcaggaggatcacttgagtccaggagttcaagaccagcctgggtagcatagtaagacctcatctctacaaaaaaataaaacaattagctgggtgtggtggcatgcttctgtacttctagctacttgggaggctgaggtgggaggattgtttgagcccaggaggctgaggctgcagtgagctgtagtcatgccactgcactccagcctgggcaacagagcgagaccctatctcaaaaaaagaaacaggagtgaactcctgtaatttactaagccttgggcattattttttaaaataaaatttcaatttaattcaatgtagaaacaagaagacattggtaaacaaattgaaattcaaactaaatctgtgaaccaaactgaaaattttgaaaatacttcaggaccaaaccataacccaggagagagttcatcggctttgattcccggtcaaggtgaccctcaactattgcacctccctaatcagggaagaaaagaaggaaaacaaagtttttgagaagactctatcctaggcctcgtttccttcccacattatagcttcgatctccagctttttaaggcttagtagctgcagtctctatataatgttatattgggaatgttatattgaaaatataacttggatgctgaaagaaaggaaaagtcttgcttattaaagtggtgtctattttcaaataaaacccttttctttcttttagggaactcagaaacaaagcaaatattcaatttggagataatggaacaacaatatctgctgttagcaacaaggcctatgtttttgaacgagaccaatctgttggagaccctaaaattgacttaattagaacattaaatattcctgtattggtaagtaggcattttaataccattaagttggattttggaagaaaggaaaaagctaagttaatgctctttatgattttacatttaggagccattaagttatgttgaaatatacatatataaaaagaaaaatacttcttttcttttctttaaagtacatcttggacttttttctaagatgtatcaaataaggtcttttcaaatgatgacaaaattcagattttaggatttgttttcataatttcttcctgggtgttcaggattagcaattgtgcaaataaatatgcccctaggattttttggtagctaataattttaaaaatgtttatttgccccttgttttcattcagaaattctagcaatgaaatttgtataccatttcttacttcagatttttatgttggattttatactctcaaaattcataaattgacaccagaaatcaatagactggcagcctactgtgatttcagtgggctctgtttataatggtaattctacctaataacgacacctattctacatctattctatactgagacccatgagactttctttttttttaaattaaattaatttatttattattaattttttttgagacagggtcttgctctgtcgcccaggctggagtgcagtcagtggctccatcacagctcactgaagcttctacctcctgggctccagggatcctcctgtgtcggccagggactccaggcgtgaaccactgttcctgggctggcccagtaaacattctaattcacctacaccaacccctgccgactctcccaccctaacccctaggtgaccgctccatatgcagctggacactgatgatggacccaggacctagacagtatgaggtccctgccacctagtcccaggggtgtaggtcgggtttataatgagcctctggccctgcttaggcggaaggtagcgccaccttgtggccaaagatgcccacatgtttacaagagcttttccccttttgtggtgtctggataactcagagcctgcaaatggtctctttgtaaatattacacttacaaaatgcagtactgggaaaggacagagaagaggctttgtcttccatatgcagccagaaaggagctcactgcctgatttttcagctatttaatctcaacctttacatttatatttccaaccccctttgctatggggtagtaggagagagtggatggaggtgctttggaggggatgctgctgtcttaatatacctctgctccgcagactgtcatagagtggtcccaggtgcacttcctcagggagatcatcgaggccatgttgaaagcctatcagcagaagctctttgtgactcacacagttgacgaattgctctggggctacaaagatgaaatcttgtcccttatccatgttttcaggcccgatatctctccctattttggcctattctatgaggtaagtagatttttcttttcagaacctctttttttagctgacagtgggttggggcaccccaagccagattaactttgagtttcttctagaaattgcctagagttaagttatcttatagagtgtgtgaaaaatggagtgttttttggaaagaaaaaaaacttgaggccgggtgcggtggctaatgcctgtaattccaggactttgggagaccgaggtgggtggatcatttgaggttaagactttgagaccagcctggccaacatggcaaaactctatctctactaaaaatacaaaaattagccagctgtggtgatgtacacctgtaatctcacctactcaggagactgaggcaggtaagttgcatgaacccaggaggcagaggttgcagtgagctgaaattacaccactgtactccagccagggtgacagagcaagactctgtctaaaaaagccaaaaaaaaaacaaaaacaaaaacaaaaacaaaaaccctggagtgcagtggatagttgggaagttggtaaaagataaaataaccccaggaagaggattagattaggggtgtgctctgggattgtgatgggtctcctcagctttaaatttgtagctgttttctggctctgcctgttcaagagtcttaccctcttcatgtaatcctgtagcattccagtttttatggcaaacagcaataattgtgtccctgggccttcaaggttatataaaacgtagaaattgttaaaatagaattgtgagcaagttttaaaaaattatatgtgtgagagacaggagtcctaaaagtagggcctcaccaactctgaatgcatcattcgggagaagcagaccaggcaggagttccctagagggtcctgtctcagaggaatacagcttcacaggaccagaggaagcacagatttcctgtcaagccctgactgaacctcccttctagaaataatttcaggagagcctcctactgagagatattatgcaaaggttccctcgaggcccttttgttcccagtggcttcaatccatcagccaagtagatcttgttgctaatatctcactgtttctcagataatttgcattatataactcactttttttgtttttacatcattgaattcaccagactgatagccacactatcttatgtggttgtgaggatttcatgagatgattcatgcaaaaattttagaacagagccaggaatattatactcaacaattgttcactcctattattatagaggagctactacctgtgctatttctgagaaatcatagctacatgcccaaataaagaattttaggaatgtagtgtctgtatgtgcccttaagaagtataacttggagagaatatacaattgaagaaaccttaattgaaaatagggctatattaataccgtcttcttccagtgtagctattctggtataattggtcctggtcctggacttaggcttttaaatttgttattattgagaaataattcacttactataacatttaccattttaaaatgtacaattcagtagtccttagtatagtcacaaggttgtgcaaccattactgctaattccagaacattttcattatcccaaaaaagaaactgcatactctcttagcagtcactcctattcctgtcttactctcccaggccctggcaaccactaatctactttctggctctgtgaatttgcatattctggacatctcatataaatggagtcatataatatatgcccttctgtgtctgctttttaaatttagtgtaatgttgtcagggttcatccatgttgtagcatgtatcagtgttccattcctttttataactgaggaatattccgttgtgtagatataccacattttgcttatccatttatcagttgatggacatttgggttgtgttccttcttggctattattagaagtgctgctatgaatatttgttcatacaagcttttatatgaacattgggtatataccttgaagtggaattctcttgagtatatacataggtgtggaattttggagtcctatgaattctgtttaactttgttaagaactgacaaactgttttctgcagtgactgcaacatttttatattcctgctagcaatgtataaaggttccaatttctccacatcctcaccaacgcttactatttttcttttttttttttttaattgccctcctagtgggtgtgaagtggtatctcattgtggttttgatttgcatttccctaatgactaatgatgctgaacatgtttttatgtgctctctggccattagtatattttcttttcagaaatgtctcttcaaatcctttgcccattttaaaattgagctcctactttttaaaaccataaaataataatatggttaatatagtatttagcaaaatagtcactattttctggtcctggttcagtcttgtgtagcagttaggccctagtaggacagttagatgaagattaaattttttagttactgtatcagttagggttgccagagaaactgaatcaagagggtgtatatgtagagatgagaaagagggagagaaagaaatttatattatggaattggcttatgtgattatgggagctggtaagtctgaaatccatagagcaggccagcagctggaaactcaggtaaaagttgatgatgtggtcttgagtttgaaatctgtagggtgggctgcaacctggaaatccaggcagaatttcgatgttgcagtcttgaggagaattcctcctctaagaaacctctgtttttgcttgtaaggctttgaacagattggagggggcccagccactcattattgagggtaacctcccttaaagttaacggattgtagatattaatcacacctacaaaataccttcaccacaccatctgggctagtgtttgaccaaacaactgggcaccatagtctagccaagttgtcataaaattatcacagttactttaaatgatcatattcacatattttcagaaaaatgggactaatgatggagactatgtttttctaactggagaagacagttaccttaactttacaaaaattgtggaatggaatgggaaaacgtaagtcaaatgatttatcagtggaattattttttcagttttcatttaaactacatgtctacttctacattgcttaaaaatgtgtttagccttttttggatgaaaaatataaaaacatgtaaatagtcttgtaattattattctacaaatcaagatggtggtaaaacatcttacagattaaatattagtgatttgtagatttatcatggccaggcatgaattacaggccagtgaaaagtcccactcttgcttagtagtcattgagtgatgtgtagtagctacagcacaaatacttttcaaaccaccacatgttttgggctatttggccattgcctctatgaaagctgatttgggccagggacctactttttctcccccttgatctaattaaaactgttgtgtctgtgtatgaataagatactgtggatagacagctccagttaaatcttgcaaagtcctgaccatttaagagaatctaaactcaaatgtgatcatctttactctttcttgtgcttatcaattataggtcacttgactggtggataacagacaagtgcaatatgattaatggaacagatggagattcttttcacccactaataaccaaagatgaggtcctttatgtcttcccatctgacttttgcaggtaaaagctttaaagataagttctttttcaaaaataaggtctttcactgcaagaccaccaaaagcatgaggaatatatgcagacacacttattatgcatggatatttatgcataatcagtgataaatgctgatggcacatcgagacagtatagtgtactggttcacagcacagacttctgactgttggtttgaatcttggctctaccacttatagctgtgtgaccttgggcaaattacttaaccactctgtacctcactttccttatttgtaaaacaaagatagaaattgttaactatgttagaggttgttatgaggacaaatgagttagtattagtcaaatacttagcccagggcccatcacacagtaaccaatattaagtgttggctcttagttactatgatatgctctgtcaagcatcaactgacctggtctacttccagtcaataggtagtctctacatggaagccaaataaaagatactgttgtccatatttcagcagagtggtttcctcaggggaggcagagaaggaatggaatcaagagcattacgtagacaggttcagttatatccataatataatttttatttgtctaagtggcagatacaaaggtatttgttagagtattttatctctttctggtgcctaaaatttttcattaaaaaatgctgtaggggtggtttggtttgtgcagtgaaaccacctatgttattcacaaccttgcgagagatgtatcaacagctctggttcagagatgaaaaagtgaggcccagaaggctcttccggccagccttcaaaggaagggctgaaggctcagtggtgactgtgtacatcaaagtggttaggcactatgcagtgtaagcagtggtcatattacatgggactatgtttgaaatcagtaagaatgaaaggcagaattacgttgaactccatttaaataaatgactggggcaaaatatggaatctgatttttcttggagggggggattgagtatcaaagtgtgtattccaataaagtatctgtccaatgtgacacttttcaagtgcctaagaccctacgaggccacggccatcgctgcctgttctaccttagctttggctctgccgtgccctggcttccctggctttgccggtggcccgtccacactggcatatgtccatgcaggtctagagaggcctcttatttcttttttatgtgagtctccattctaaatgttatcatcttaattttgtaccacatattgttttttcttgtttggatgatatcaccgttgctacaataaacaccttccactacaattcatcttctgctttattacacgttgagttgacagaatgccttccaaacattcctttctacttaccctgtgagcttttggccatgttgtacctgagaactgttgctaacttgcggatttcgggcagattacactgaccagagtccacattcactttttattcttacatcctaacaggtcagtgtatattactttcagtgactatgagagtgtacagggactgcctgcctttcggtataaagttcctgcagaaatattagccaatacgtcagacaatgccggcttctgtatacctgagggaaactgcctgggctcaggagttctgaatgtcagcatctgcaagaatggtaagaactcagagaggggacatgataggggtgtcaagaatgcagaaggattggagttcaacaaagaatatgtagctgggcgtagtggcgcacacctacagtcccagctactaaggatgctgaggtgggatgatcacttgagcccaggagttctcaagtccatcctgggcaacatggcgagaccactgtctctaaaaaacaaaacaaacaaaaaagaatatattgtcagcccaatagaaagatcagtttctttcaagaacaatgtttcataacatggctattgaatggtaaaaaaaaatcatggcttttctgtgatgctttttatttctagaatgccatgttgtgtttttttttctggacagtggtttagaagtcttaacagtaataatagctcatgtttactaagcacctgatgtatgccagtcactgtcctaagtgctttacatatttacatgtagttaatgcatgcaaaacattaactgatttcatgttcaaaacaatgctaaggctgggcacggtggctcatgcttgtattcccagcactttgagaggccgagatgtgaggattgcttgaggccaggggttcaagatcagcctgggcaacatagcaagaccctgtctctacaaaaaaaaaaaaattaaaaaattagctgggtgtggcggcacacacctgtagttacagctgctcaggaggctgaggcagagagattgcttgaacccaggagttcgaggttgcactgtgctatgattgtgctgctgcactccagcctgggcaatagagtgattccgcacctccccaccaaaaaaaaaaaaaagctaaaagaaaaagtggacaactcagttttaagaaagtacgtatcatggcaaagattctcagtgattttgaagcagagttagttttaaaccctgacacaaatgtcccagtgtttcttaatgtcagagctactctgctcctttccatgaatgaggcagaattatcagtggcacaactgacaaaactattttcttcatcttgaagagtagttttaacagccacatgttgcagaattattcacaatgaacttactagatagtagacattcagcggcctgtttttataattggggaaactagggctcagagagggaacgtgattttgatgcgactcctccctctgagcagatccctggcggaactcagggtcttctcatatttgccctgtgattccctcttgggctgtaattcctctttaaaatttctctggagagctctctgtgtagtccctttctcctgaatagtaatgtgctcacttttgctcccttatctatctcattttaaaatctcctttcaggcctggcatggtggcgtgtgcctgtagacccagctactcaggaggctatggtggaagggtcgtttgagcccagtttgattctagcctgggcaacatagcgagactccatcttttaaaaaagaaaaaaaaaaaaagaataagatatcattttggaataagtctgaagtcagcagtatacctcctgatccttgtctgacagggcagtgacccccacacctggctttacatcagaattatctggagagttattaaaaatatattggtgaggcatggtggatcatgcctgtaatcctaacactttaggaggctgaagcaggaggctcacttgaggccaagaatttagacctgcatgggcaacagggagaccccatctgaacaaaaaatttaaaaattagctgggcatagtagcatacacctatagttccagatacccaggaggctgaggctggagcgtaggaattcaaggctgcagtgagctatgattgcaacactgcactccagcctgggcaacagagtgagacctggtctcaaaaaacaaaaaaattatatatatataaaaaattgtttatatatacgtatatcatatatatgtgtatatatacatatatatatacaactgacaaaagtatttttcatcttgaagactagttttaacagccacatgtatatatttatgtatgtatatgttaatatatttgttaatatatgagtatattaacaaattttatagttatatataaatatgcatatatttgcatatacttatatttgctatattttaatatatatgtatatagtatatatatataggtatacacacacacgtgcgcaagtgtgcacacacactcatggtgcacacacatgcatgtatgtcccagggtcccatgttggatataccagggccccagaatctacacttttaacaagtactccagctgatttccataaagatggcgtctaggtatttggggaccattgtgcaagggaacatggtaccctttacctggagataaagaccaagggtgaatgggaacaagttcctggttgtgatctcccccattgccttactggtaatagtcctgaaacagtgtccctgccccctcatctggtgtgcatctggctcaaagcaaaaatgtagatatattttctcttgctgtttttattaaattctgtttccttaagaagctgatgccagaatcaacagaagtattctactttacacatttaaacttcttgctacaatccttttcctcttccctcttaacgtattcccgaatttggactgaagtgaaactccccaggattatcctccagtgttttgaattctccagggaaacattttggatagcaggatgagtgttctggagtcaggcagattgggtttgagtcctattctatttgttggtaaattggccaaagtttattaaggagggttccagacatcagttttctcattaataaaatggaggtggttatagcttcttgaggttgtgtgagagttagaaataatatatataaaacactcaggacagtagcccctattaagccctcaacagatttaaaaaatacattttcaaggtcattataggtcacaaagaaggaagtcatgcctttgtggaactattcagcagtaaacagcaaaatgcatgtgcatgtgagagatgagggatgagttccttaagccatgggctggtgaatatgtaagcaaatttaaataacttgccgacaagctcctttctccaaaaatgtatttccctggcagcaattgttgggtccctctcttcttttcaatagccagatctagaataggtttcctttagtaacttgtttccctatttggttatatatatatatatatatatatatatttaaatttacataagcacttatttggttcttaaaatgaataggaaaggaaaaaccccagaatctttgtgatctggttagaggctgggtgtatagcacaaccaggctaactcttaaaaaattatgtaggccaggtgtggtggctcaagcctgtaatctcagcactttgggaggctgaggcgggcagatcacttgaggtaaggagttcaagaccagccttgccaacatggtgaaacgctgtctctactaaaaatacaaaaaaattatccgggtgtggtggtgcatgcctgtagtcccagctacttgggaggctgaggcaggagaattgcttgaacctgggaggcggaggctgcagtgagctgagattatgcctgtctttggtaaaaacaaaacaaaacaaaacaaaaaaccaccaaaaatttttttttaattttaaaaaggacaagaaataaaaagtcagtccacttactgatagagaattgtagttgaaactagtgctttgaggtacaacacccttcattcacttagtattctgccttcatagcctgatggctagctgtccctgggtaaattttgtaacttctatgaacctcactttcttcaaatgcaaagtgaggctaatagttctgactttactgggctgttgggagcattaaataaaataatgtgtatgaagcacttatactttaacttcagtaaatatttgttgaagaataaataatttagcctgaacttcaatatataatgtggaataaaaaattgggggtaaatgagatgtcagaaaatgaagtataaatcctgaactaggaggtaaaggatggtgttttagcctacccaagttaatttatatgtagcttttttgtttttctttaggaaccaggctgtggccaggaacttttatattcagctcagcttagattttaaaaacagcatcattcatttctgttttccttcaaatgcaggtgcacccatcattatgtctttcccacacttttaccaagcagatgagaggtttgtttctgccatagaaggcatgcacccaaatcaggaagaccatgagacatttgtggacattaatcctgtgagtacatacttcctcctggtaaaagagcatatgttttattctgtctatacattgttcaccagtttagtcctgagccttctttaaaaatatccttactttcatatacatattcaagtgggagaaattcagctcagtgctgatggaggcattgtctcatagccctgtaattagaaggctgaattttgtggattgaatagcagaaatacgagcaaacctgcctttaacaaaaagcaacagtgaaaactcagttattggaaactactgatgtacccatataacctggtcaatcttctgatgctagccttggacctcaacatatatttatttctccccttgggacacagatcgataaggttaaagatgtccctttgcttcctcactgccaggaatattttggttgaaatatgaatatgtatattaacctcagtcacttttggcaaacttctttctacaggttatttgagagtttattatattattaattgtaaaggtatcagatatacatagaggagacatacacacgtgtgtgtgtgtgtgtgtgtgtgtataatacacatttactcctgtattcatagacgagaaaaacaaaaaccatgctaaccatgtcttcatttttggaatttgaacattatggaccaataaaaaaaaaaaacaagaacattcttttagcacagtattttatgggtacttcacactcttagctgcatacattgcatttgtatctgagaaaccagtgatcttatgctctggtgaataaaatcgtgtgtggttttctcccttttctcttagccatcagctgatcagttcccttggatcagccaaactgttagcagtgcttgtcaccaagggacgaacacagtcttataaccttagtgcaaagatggagctgccctaaggatgacaagtgctgcagctgtgccccatggctacgctaggcgggccctatactaggatgccactctctggcagtgaccaccaccctcttcttagctctctggacaactgcctggaaatccagacctgacaggctatcttttaggcctccttcctgttggatcccttctaaggctgtgctattcagagtggcagcatcctgggagcttgttagaaatggccagtctactgaatcagagcctgcattttaacaggattcccaaggacctacattcatactcatgtttgagacacactggtctatcagccacctaatacaacccatggttctcattctgttctggggatcacttttacttgtttccactctgcctgtcacacatggtaatggtcaccttgtttatgaggactacacagaaatggtgctctattgaaaaagttgtttgcagtttaataaatcctaatgtttccttttcacttctctgatttgcagttgactggaataatcctaaaagcagccaagaggttccaaatcaacatttatgtcaaaaaattagatgactttgtgtaagttttgcttctttctatggaggggacagcagttttgctccattgcccgtctggtggggttgatgtcaggaggagtacagcctacttcatctaagcctgctcacccctgcccttcagggatggggcatgatcagcattttcatgggtgccttggtcttggaatttacttgttttatttaatcatacacttacagagtacttcccatggatcaggtattgttctcagcaccttatgtggattcacatataaccttgtattatccccattttacagatgaggaaacagaagcagagtgtttaggtaacttggctaagccttactatctagtcaacttttatccactccactaagcctttccctcatgcaccttgactctcttggtgtattagactgttcttgtgttgctataaagaaatacctggctgggtacagtggctcatgcctgtaatccagcactttgggaggccaaggtgggtggatcacaaggtcaggagatcaagaccatcctggccaacatggtgaaacctcgtctctactaaaaatacaaaaattagctgggcatggtggtgggtgcctataatcccagctattcgggaggctgaggcaagagaatcgcttgaaccagggagtcggaggtcacagtgagccaagatggtggcactgcactccagtctggcgacagagcaagactgtgtctcaggaaaaaaaaaaaaagcggggggggggagggagggagggaaaggaaaggaaatacctgagattggttaatttataaagagatttaattggcttacagttctgtaggctgtacaggaagcatggtgctggcatctgctcagtttctagggatgcctcagggagcttttgctcatggcagaaggagaagcaggaataaagcacgtcacatggggtgagcaggagcaagagagagaggaggggaggtgccacacacttttaaataacagatctcatgataactcactatcacaaggacagcaccaagcgaatggtgctaaaccattcatgagaaatccacccccatgatccagtcactgcctaccaagccccacctccaacactggggattacatttcaccctgagatttgggggaacaagtatccaaactatatcactcagagacttgagacagagtctcttcctcttcctctctctctattcccactgatcccacttggggccagccatagctctcatttgtatagttataatctcttgagtctagccttacttccccatgctgcagcttaatttggattccaaagtataatctcctgctcagacttttcaatgggaattttttagatatgagaaaattatgatataatgttgagtgaaataaacaggatgcaaaactatgcataatatatttatctataaaacttggcttgtttacctcattgaatttgccagatttaataccaggtgtcatggctctttctaagaagtaggtggtttacaagaatgcattttgtcatctgcatatctatttccgaggcagtataatttagtagttaagagctggaatcttagaagcaaagtggaattacatttgtggctccatcacttacttgtggtgatcctaggcctctctgagtcataattttctcatctgtaaacctgggacagtaatacctactgtaggtgactactctaggaattgaatgagataatatcccaaaaacacccagcacagagctggcacgtggtacatgctcagttggctcttgttgcaaagacagtacttcagtggcctagttacaaaacactctgaggagtgacagttttgttctgtcgactggagccttccctgatgactctaaggagactagtcatcattttaaggaatctgccttcagtatcttgtgttttgataaacgtacagcacatggaattgctagacagactggaatctaacttttggggtacatgtttgcaaagataactaagaaatcagcaaattctgggtaatttaagaaataagtgtactagaatcttcatataaatgtgtctgtccgggaaagtgtgccattgtgatgaggatgtttctgaaacaatctcatcctttgtctttgtagtgaaacgggagacattagaaccatggttttcccagtgatgtacctcaatgaggtaagtcctgagacggagggagccacgggtgttttcagactcagaaaaaatccattatgatgtctactgttgtagttacatgtaagttatgacagaagggcaaaagatttttaaaacctgttattcctcagaaaatttcacttaaatgttcacatgaatctgcctgtgtctgagagctgatttggagaaatgatggaaagaaattttccttctcaagaacactatttgggcaaaactcccttctggggagctgctcacgtaggaaacagaaacaggtaaaaggagccattggcagacattgttgaagcagggaaatagctcacactcagatagatgccagctagccctttgtctcccccttctttgaaaccatgctggtttaagacacctatgataaattcttttctgaatcacatatcacgtttactgtagttatatctcctcagtttctcctgcttccgcccagtttgagggaaaaaaaaaaaacgcaggtttttttcttcaataaattcttgattggcaaacttctcctttttattatttttgtgtttcctaaaaatacttgctgtttgtagaatattgaataacagagattagcaagaaaaagaaaaattaaaatcactattcacaaaatctgtgtcagcctgataatatttttattttattttactcaatgtgttgtacaattttttccaataacaactttaaaaggtaatctaatgttttacattttataaaacatgtgctctttataaaattcttagaaatttttttaaaaattgatttaaaaagtaaattactgataagtccctctctatcagaggcaggtgcagttcagatgtcaactcctgatattttctggtcttgatattacatagttgaaatcatacgatagatacaattttatatcttttttctccatttagcattatattggtattcacatttacaaacttttaagggtttgttattacaattctaagatgaggtttttatcgtttcataggaaaaattcaagcaatatttaccaatttataggatctctttgcaattgctcctgatcatccatgttcctgtttgtgggcaggggcatgaaagatctttttgaaaatgcagaagggcccttttctgccaacttctgttcagtagtggcatatttgaagtccctccacccccaacttctaatttgcttttttgtgaaagactagattaagtccaggtgtgtggagtggaaccttgtatttttgctgcctcctaggaagagcgtgattattctcttctctagaaaaataaaatattagacctggaagtctggaagtgacattggagactgttgccacaccacctttttaccgaggaggaaactctatccagttattggaaaaaatgtcttagaacccaatccactgactcggtccaatgaaaaaaaatgctttcttttcttttttttttttttttgagacaaggtctcactctcaccctctacagtggtgcgattttggctcactgcagcctcgacttcccgggctcaagtgatcctcccacctctgccttccaagtagctggaactacaggtgtgtgccaccatgcccggctaattttttttttttttcctgagatggagtcttgctctgttgcccaggctggagtgcagtggcccaatctcagctcacggcaacctctgcctcctgggttcaagcaattctcgtgcctcggcctcccaagtagctgggactacaggcgcccgccaccacccctggctaatttttgtatttttagcagagatgaggtttcaccatgttgaaactcatgacctcaagtgatctgcccatctcggcctcccaaagtgctgggattacagtcatgagccaccatgcccagccccagctaatttttgtattttttgtagagaggtggtttcaccacattgctcaggctggtctcaaacttttgagctcaagcaatccgcctgccttggcctcccaaagtgctgggattataggcgtgtgcaactatgccaggcctccagtgcaaattaagcctaaactaggccagaattgttgctcattatttctatggaattaagctcttcagatacctcactcattacactaggtggtaattcctctgctctgcatacactaagtgttattctagtacatttccttctatcagcagtctctggaattctagttagcccacaactttgctgagcactttctgtagagggctgtggtcctgattactatagatgtaaccaagaaagaaattatactttccacataccatttttgcagtgtttcatttatttattcatttaatcagccagcattaatcaagcacctactgtgtgctgggtgctatacccagtgtggaggtgactgaggttaagtcttgccttcagggacttcacagccattgcaagacaaacagttacaatgcagagtgcaaggacaatgatggaagtagagagtgagatggaaacttagggaggaggcctttgactaggcctgaggtagccagagaaaacttttggaaggaagtgatgctgagctggatttttaaggatgaattggaattatctgacataaaacaaaaggtgatactgtctcaatatttctgaatacattttacctcctttttccaatctattttaagagtaaaaaaaatgtcttcaggagaagacaagatattaatgaataaatgtcccttctgattactctgacttataaatggattttcagtatgtttggtttgctaacaggaggacattcccaaattgtattaaacaaaggaaagatatagcaaaaaacagttacacactggatgtttagtcatcaagaatactattttcttgcctctccagagtgttcacattgataaagagacggcgagtcgactgaagtctatgattaacactactttgatcatcaccaacataccctacatcatcatggcgctgggtgtgttctttggtttggtttttacctggcttgcatgcaaaggacagggatccatggatgaggtgagaactggctgaaggaacttcttccttactggataactttacctgaggaattcaactgtacttcactgaagggctgtcagctggcttattaggataaattctgggattttatgctgggcatagtgatttcgtgcttattttactgctggaccaaatgggaagcaaaggaagtgtgtcaaagaaggtggagggttagaaggtaccatctaatatttggggaatagaatctctttggatgtatcccctgggagttaactttatgtctttgaaaacaataacctgaaagaaaaggaagaatatataacagttacacatctgatctttggtgtcagactgcctgagttcaaatcccagttctgccacttaacagctatacgaccctagaaactgtgcttcagtttcttcatctgtaaaatgggataataaaagcctcccttatgagtttttcatgaggattagatgatatagtagacttaaaggacttggcccagtgttagcatatagtaagagctcaataaaggtttaagtattattaaatatgataaaacagctccaagattatagagcaagacagccagggtcctgcttggaaagaatccctgatgtatccgaagatacctatgatttaggtatcactgcataataaatgattggaacatgggtgtagttactttcctggaaggctaggataaagagttgggttcgcctttccaagtgaccagcagcccagccaggaacctgaatacctgcaatgagccttttctgtagaagcccttcttaaattttctgcagcttccttttttttacaacagtggccttttttcctccagtttcctcaactaagtgtccaaggcaaatgtgaagtagaaaataaatacgtgaaaccatctgagtaaaattagctgaatttccctgacttccatattcttccattatttctcttatcccctgccagtcactttagcctgaattagctgtgaggcaaactattttgccatttctatgtgtggatcttccagtgtgactttatgcagtcattgaaattgtcttaagcacaaatgaaacctcatggaaatgttaattactgctcctacaattaaccttcctcatatattcaacaagcaaggaattattgagaactaatacctctgagacactactccttagtaggtttcaaaccaggaaggaggcaagttgaatagagtctaagttttataatccagatcaacacagagaagggtactgctctggtattgagggtgggagtggtcagagaaggcctcctggaaaggttaggcctgctgaatcttcaagaacaagcagcagcccaagaggggaggtgagtgagatgagccaccttcctataggtctctcctccttccatgcccccactccccacccaaacttttcacactggggagaagtttctgacatgaacatctaacttgttttctctcttctgtgtttcagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagtaattttgttgttgttgggtgctggtagctccagaattttgtgaccactattgtgggtaaaatgtctctgcatcacttgttaatgctactggtctaacttcattcagtatgcttcattcaccgaactttgtgctcaaaatgcgtatataccattttatgttgtattcctccatttcacttgcaaaacagaagtaaataagagttcgggacccagggtaaaatggtagcttcatccaatatatcattcaaatgcatctgatttctaaaacatattacattttatgctgatcttcagttcataattcttccaggaaaactcagtcttccaactgcaataaaatactgggtagaatcaaatgggaaaggggttgggtggggcaatacccatgagttgatagtgataagctcctaaggatttttaacttgtacttttgtgaacgaagagaatgcataaataatgttggtgaggataaagtacagatatttcatgtagaattaattgctagttatgatgcttgtggatagttaactgttttttttttagtcaaaatgatcatgctacgaaaagatgcttctgagagaatgtaatgagtaactgatttttcttcctgagtcgcccttgccaaatatgttactgtattaattaatctaatattgagtgattatttgtaaaattatgaatatgggaaatccatctatctacagcctaagttacacataagtttcagaaagtctgattagactaaagagatatttcttctgggacagccgccttcttggtaattttgaagttctttttacaagttccttcctcagtttcagttctttccagtgttttgtagctcactgtcactcactgaatagagaaacgtgtgccctatacttcctgtgacaatcattttgctgacagaatgatggatgtttaaaatattgcacaaagtactttaaagaaaggtctgttaggaccagaagcagagacaccacttttcaaaggacttcttggtttcagcataacctaagacagggaattgggagccatcatatgtcacagtgttcagaattcaagcatatttaagggcattttctttgattctcaaagttcagcattcattttgaattgagaagcctatacatttagctgacaaagtgcttatagaatttcttaacaactgaaccattcaaaaggattttttttgtttaaaactggatttcaatgtaagcaaatgaagaaaaaaatatagatttcatttccatagcttcttatccctgtattgaggtaataaattgttttactgacaatttttcctttttctacactaaaacaatatgtgatatatttcccctcttgaagaggcaattcattaaactctcaaattttctatagaatcaagatagaacctttagatactccaactcaccaaaatgtaaaaaaactaacaaaaatatttggtcttcaataatgctaaatatctacatttttagaatttatcaacatttaactagataattgggcatgtcttaattatgcatgtacttatccatactaataaaattgacaatgctagtgcatacttattggtttagtcctattatcaggatataatcatctgtgaggaggatattttaaatactgtaaatgataacagttaatgatatacacatttagactgagttgcacactggcagggagaccaaaaacattacttccatacttgtgtcatgattcttttttttttgagagagtctcactctgtcgccaggctggagtacagtggcatgatctcggctcactgcaacctctgcctcccgggttcaagcaattctcctgcctcagccacccaagtagctgggactacaggtgcgtgccaccacgcccagctaaattttgtatttttagtggagacggggtttcaccatgttggccaggatggtctcaatctcctgaccctgcgatctgcccacctcagcctcccaaagtgctgggattacaggcgtaagccaccgggcctggcctgttttatgattcttaatagttacttggtttaaatcacatttgatactatccttctgaaaagtctgagacagatctacaaactacagtcaaaattatagattaagaggaatgaatgcacctatttggctttaagttgaagatgaattatttctcatgctcattttcttgcggcagttatcttagaaagacccccaaaggctttgtgattgtaagcactgtcatgatcacagaatgcaagcttctggtaccatgatcctcaacttagagaggaagaaaccaagacagagagcttaactcacttctctcagggaaaattaggagttgagcacaggacaggaaatgggctttgccacttttagctccaggcttttctaaccagacttgatttcctcatgttctagaaagatcactaatggtcaagtggaacaagcactacacgactaacccctattggggtttttaacttaagggaggctaatttttaatttaaactgctcgagatatgagttctgcaaaaggtggtccgcatccttggccctctggacattatcactaaattgcttgtgcctgttaacaagaatactgaccagaatgctcttcatgtagcttatacagttggttcacttcatgcggttcttgacatgtttatttctacccttaatgcaatgaaatgtttcattaataaaaaaccactttatat

SEQ ID NO: 35942 - DNA, 55142 bp, Homo sapiens; identical to SEQ ID NO: 35941

SEQ ID NO: 35943 - DNA, 4765 bp, Homo sapiens
cgcccctgacaccattcctcccttcccccctccaccggccgcgggcataaaaggcgccaggtgagggcctcgccgctcctcccgcgaatcgcagcttctgagaccagggttgctccgtccgtgctccgcctcgccatgacttcctacagctatcgccagtcgtcggccacgtcgtccttcggaggcctgggcggcggctccgtgcgttttgggccgggggtcgcctttcgcgcgcccagcattcacgggggctccggcggccgcggcgtatccgtgtcctccgcccgctttgtgtcctcgtcctcctcgggggcctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaaggtgggcggaggcccggccgcgggaagtgcagtgcacctgccgcggaaacccagccccgcgggccgggcgaggttccaggcggggcggcgggcaggagcccgttaggacgtgggaaggtccacaggtggggccgagtaaagggggacaggagacgtgcggggcaggacctcggggctggatgcagaggccggggtggtggaaaggggaggagaactgggcagggcagataagtgggtggggcctctggaggtggcgggggcaaggttggagccccgggacgaagaagggacgcgggtcagcgaggcctgaagagtgggaggagatgggacccggctgtagagtgcccagaggtctaggccaggggccgcgctgccgcaggaagatgcgagagtttggctttggtgatctggtccacccggggccagtcttgccccctctgccaccgcagcgtagggcctcctgcattccgtttctctggccggaagggtctagtgttcatccctctcaggctttggcctcctcccactctcccgccctggggcccattcgtttaggaagaatgggagagccggtcgtggcccctgggcggggtaaaggagggaggcttggtaaacctctgctggggaggacccagtacagtggcagctccttgtcggggaaagaacggatctgcgtcacacgctcttacaggggaaccctaaggggcctgaggggtagggcttggtctccacccagagggaaggagaaatttttcgagtcgtaaagaaatgtatcagaagccatggaacatttacagccgcacacgctgggtctcccaacaaacagatccccaaaatattttccagtgctgtactcgtggcatagacccagacccacagaccaggaggaagcgctagagatgtcaacagccaacaaaaacagtgctttacacacttgtaaaattgtgacctacaggggctgggcactgtggctcacgcctgtaaccccagcactttgggtggccaaggtgggaggattgcttgagccccaggagttcgagatcagcctggcaaacatggtaaaatcctgtctctactaaaaatacaaaaattagctgggcgtggtggtgcatgcctgtaatcccagctacctgggaggctgaggcaggagaattgctggaacccaagaggcggaggctgcagtgagccgagattgcgccattgcacttcagtctcggccacagagcgagagtccgtctcaaaaaaaaaaaaaaaaaaaaaaaaaaaggaattagcttggcatggtggcgtgtgccttgcagcgagctgtacgtgatcagtgccactgcactccagcctggggcaacacagcgagaccctgtatcaaaaaaaaaaaaaaattgcgacaataagtacattttactacgcacccttacgcattctttttctcacctctgtgtgtgtgtgtgcgtgcacatgcacacacacaaatgggtgacacaattctcaccatactaagagaaatcccctctgatattttgtagcctattctgttgcattaaaaaactacacaatcggccgggcgcggtggctcatgcctgtaatcccagcactttgggaggcggaggcgggcggatcacgaggtcaggagatccagaccatcctggctaacacggtgaaaccccgtctctactaaaaatacaaaaaaaaattagctgggcgtggtggagggcgcctgtagtcccagctactcaggaggctgaggcaggagaatggcgtgaacccgggaggcggggcttgcagtgagccgagatcgcgacgctgcactccagcctgggtgacagagcgagactctgtctcaaaaaaaccccaaaaaacaaaaccaaaaaacccccccaaaacacaaaactatacaatcaccacctggtgccttgactaatgagtgatgacctgctctttgaaaaacagaacacaattaccttattcaatgataagctggctgttgtgaatgcgcctcttaggtcagtaagacctcaggttggggtgaacttggatgaggcatcatcctaaactttagtttccacctctgtaagataggagtacccactgacctagcagtgaggttccagaagctataaaagatgagattcaaagtgcctggcacataattgatactcaacaaatgggattctcttccctgggggcaaaatatgcttcgcatagtggggggggcaggtatagacaaaatctaccccccatctggtttatagacccccttcaggccatttagagtttcattgcacacaggtctcagagatttcctccccaggcttgccttcctgccctcccccacccaagtccccctggctccagttttcttcctgccccagcttctgggcatggactgtttgcaaggcctcccagagagcgggccaatgggcggcagatgctggctagggctttggtctctagggtgccggggtatattcatttgctcccctctctcttctgggaagaaagtgagtgggcagtgcctgtgtgttgaactggtaccaacctctgcctctgccttccagattcttggtgccaccattgagaactccaggattgtcctgcagatcgacaatgcccgtctggctgcagatgacttccgaaccaagtgagtgtctctgtcctgggggctgcagaagccaggactggggtaggggttggggggtttagaatctgccctcacctagcctagatggcctgaagctaacccccctatggactcctgaactctggggaggtagggaagtcttcagagatgctgaggaagctctgcctggctgcaactatttcctttgaaaggtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggtgggtttgaagctgggcctttcttccatccttccctaacctcccagggctgaagactcttttattctgtattctctgaccgtggtaacacttggtgcaccctcaccatggccctgggtgtgggatcatggatcccagggttccaagaggaatcagtgatgacccagtctgtcccccagtgctagttactaggcctgcacctgaaaactaagcccctttagcctgaagggtggggaagtgacctgggccaggcccagtggggtctgggccctgacatgcccatctctgctgtatctttacaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccgggtaggtagagggaagcaggcaccctttgggggttaggaaggggagggctttgtgttccctacgcgaaggtctgactcaatgcttattccctcttcttcctctctctgcagactgaagaattgaaccgggaggtcgctggccacacggagcagctccagatgagcaggtccgaggttactgacctgcggcgcacccttcagggtcttgagattgagctgcagtcacagctgagcatggtatgtgtccccccaccgccgccgcttccctgtgcaattcacacttatacccttgcagcctagggcagcctggccggtggctgtgcccatgccctctccgggaaccaggctctgctgagtcacaaccccctctccctatcctcagaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaaggg

SEQ ID NO: 35944 - DNA, 114511 bp, Homo sapiens
cggagcgagcgagcgagagagcggcgcgggccgggccatggggtggcgggcggcgggcgcgctgctgctggcgctgctgctgcacgggcggctgctggcggtgagtgtgcggggcagaggggcggggggcgggggcggaggggctaggggcgccccggtcccgctcgccgcctcccgccaacttggctggggcgcccaaggctgcgcggcggggactctggcccgggacggcggcgcccgccggggaccccgggccggcgccaccctgcggcatggggctaatccaggggggccaccagtcaggacccttcgtggggctgggggcggggctggcccgtgtgggagcccgtgggtctctcggccacgttgccgagtgctggagtctcgctgggcatggtccggcctaccattcctggggaccaggaggggaaactttgagcagggtgggaacttggcaggacgagggaacccttctgcgccagcttggcagaacggccactcagtggtgatggggaccctatgagtctcgctgaaactttaccacaccgtctatcaccttggggagcttggacccaggtaggcacaagcaaaacttttgggacagaactgaagcttgtgtggaacacccacgggccttggagtcatacagccgaagagttgaatcaatccctgcctttcactgagtaactgtgtgacctggggcacgctagttaacctctctgaggccagccccacgtgggtcaagggaactcaaaatgcacggcctcaaaatgcatagctgcagggcgttgctggactgcgtggaatgagctgcaaagtgcgtggtgcggggatgcagtgcacccttgggggacccgagttccccagctttcctcttcccaggtctccaagaggcagggagaggcctgcccttgcagtctagtcccctactctgagcttaggtggaggaaaagggaattctacggtcaggaatcccgaggcttagaaggcacttggccagcagaggccctgaggacctgagtgaacttgaggaggactgggtggggtcggtgggcagggagctagtggcagatgtgggtgggggcacatctggggagccgagcctaccgtggggagccacagagccacccccactctctccgaggtgctcctaggcagtccccatacctgcctccctgttctctgagccaagagagggacttttctaaccaggctggtgtttacccaggaactgcctgcctggcctcaccttcctggcttcatcgcacctctaccctcctgagtcactcgtcaagcccccacccagacctggctcctcactgctcttgccccacccacccagcacttctcctcccccatccccactctgggcagcctcctctgtcgtcctcctgtttcagcctctcaccccaaaatattcagcagggccatccagtagctccctagtcttgacctgaacttgcactcctggcactgacttttacttttcccaacgcaccaacctagcacgtgggatgttttccgaggcccaacagtctttcctgaccttcccccagctctgcccccgatgaggggctcctccatgcccgggtgcggtaggatggcggtgggtggagttgtttgctgtgtgcatgaggaatttccacagacattcctggaccgtggcagatcatctcattcacttgttcattcaacagatcatcactgagcgacattccatggcagtcactgggagtacagaggttcattctttgggcagatatttgccatgcacctactgtgtgccagtgaaccagtgaacctcgtgtggtgctaggggctggggtgggttggaccagcaaggacaggccctgtctgtgccttcccagcactcacaggctggtgggcggtaatttagacaaataaacaggcagctccaatcctgtgggattagagagccttctcagcaacacatggagggtcgctgtcccaccccaggctgctggtggtgggctggaaagagcttggcccctgaagtctctttataaaattctttttaaaaagtttttcaggccaggcgcggtggctcatgcctgtaatcccagcactttgggaggccacggtgggcggatcacgaggtcaggagtttgagaccagcctggccaacatagtgaaaccccatctgtactgaaaatacaaaaattagacgggtgtggtggcgcatgcttgtaatcccaactactcgggaggctgaggcaggagaatcgcttgaacccaggaggcggaggttgcagtgagctgagaccacaccattgcactccagcctgggtgacagagtgagactccgcctcaaaacaaacaaacaataaaaagtttttcggggccaggcgcggtggcacacgccagtaatcccaggactttgggaggccgaggcgagcggatcatgaggtcaggagttcaagatcagcctggccagcatagtgaaaccctgtctctactaaaaatgcaaaaagttagccaggcatggtggcacgtacctgtagtcccagctactccggaggctgaggcaggagaatggcgttaacccgggaggcggagcttgcagtgagccgagatcgcgccactgcactccagcctgggcgacagagcaagactctgtctcaaaaaaaaaaaaagagggcatcacactttgttgcccaggctggtctcaaactcctggcctcaagcgatcctctcgcctcggtctcctaaagtgttgggatgacaggcataagccatcatgcctggcctgtctctgaagtcttacagacccaagtatgagtctctgggctgcggtttctggctgtgtgatctggggcgagttcctctctctgagccttagtttccaaatctgtacaatggggttgaggagtttgttgcaagtcaaaaatgagatcaattcctagcccaggctcccagcacaccttggaccctctttgcctgctacccttgctctcatctgcccttcagtttggtccggagccagtggcttatggggaagggttgggcacagcagcagggtgagatgggccttagggagctccaggcttccccgggacgggggacaggaccacaggaagctgatctgtgattaagtgtgggtgtaatttcagctgttgggaggtgaggaggcttgctggaggagggggctgggcctgggtgactcggcaggccttggcctgctgacccctttagggcggccctgcaggggacaggcgtcttgagggagcctcggtggtgattaaggtgttttccagggcctaggagggaagtcgctgagatacctgtttcctgcctcagctggatttcctcactggggaggctgccagctgaactgcaggagcctccccttcctggcggtccctcagccctcctccacgcagccagctgctctgtcacctgacactagcctacttgttccgtacctgcagccggcacaggatggggttttgagtgtgccctggacattcccggagggaaggagggcaggctgcaggtctgtctgcagggtagaagctggaaggggcagagatggaccacccccccatcccttaggcccatttccccctgtctggggagttgtggcccctgcctggcttggcccgggcctgctctcaggctgagcgcagacaagttaggatctgtgggtctgaagccctgcccgggagacggtggaaagaaggtggcaggaggtgactgggttcagggcccggaagacgggtgagcaaagtggaggggaaggagctcttggggtgccaggctggatgatgacacagtaatacgggtacttcagacttacccagtacccactgtctgctctgagtttctcagtgaatcctcccattcacctgtgtttcctgctcaccacctccctgcggtgctcagaattaggtcccagcccctgacttaatatagcctacgaggccctgcaacacccggcctcctgccacctgctcctctcaaactcctccagctataccagtctttgtttctttttcttttcttttttttttttttgagacagggtctcacactgtcacccaggctggagtgcagtggcacaatcacagctcaccgctgcctcaacctcccacgctcaggtgatcctcccacctcagccccctgagtagctgggactacagacaccctcctctacacctggctaatttttgtattttttatagagacagggttttgccatgttcccccaggcaggtctcgaactcctgggctcaaatgatccacccccttcggcctcccaaagtgctaggattataggcgtgagccactgcacccagccttttcttttctaatgaatataaaaatttaaaacaaatagagatgggatcttgttgtattgcccaggctggtcccaaactctttaactcaagctatcctcccacctcagccttctgaagtgctaggattataggcatgggccacctcgcctgaccaaggctttgtttcttgagcatgtgaaacacactcccaccttagggtctctgcgtctgctgttccttctgcctgggacatttgtccccgtaatatccatatgaccctctccctctttctggtccttaccactcttcccataatggctgtctccttaaactgctttatttttgttctcacaattgtctggcctgtatttgtctgtatttgtttatgtgtttatctgcttcctcctgctcagtttaagttctacgagagcaggacctcatttgtttttgttcactgctgtatgcttagcacctggcaggtagtaagtgcttagtgaatatctttgtcgaatgttttaagctgtagctactagcctgatccccattctctaagcagaggacattgaggcactgagaggttacgtaacttgcccagtgacttacatatccacacactcagagatgctgcaagccaagttttgaatccagacgaagctctcctaatcacgccacgtactgccccatgtgcttgtcgtgggcagtcagtagatattgctacaacttgtcacagatgttgattaagaactctggtcccaagtagtacaggggctacctcaggcaaggaatatcagggattggctcggggacagaagctcttaggttgggtatgcctcagtgtccgtggggtctcctagggacgcctgtgcctggaggggaagcctaggaactctagggtggtcatttttaggtttgttaattcattaatgttctcatcagatatttcctgggactctacaggcagttgaatttatccagggacttttaggcctgagtgggccaggctggccctgcccagtgtgggaggtcaggggcccctgcccctgccatgctgctagtgggggaaggggaagaacaccctcctggttgtcctgtgtggagcctgcgctgtttttttctggctgttccctgggggctcaaggtttagggtgagtctgcagagcttcaagggctgcctggccttggggtgagaggctcaggagggagggcaggagggcctgcccaggctatggaaagatctggagcaatgattcagaggccacttggaggccagaggtgtgggctctgcaccctcagactacttggggtatatgggaagggttcccagccctggcctgttgcccccctccccttcacccaatccagtcccagctatgaggggtcagactggaggaggaagtgaatatgacttggttccccggcagcttcccaagtatctgctgggcctacctctccctgtcccagggcctaccctggcctttttctcctctcgctcctgctcctgccaagaagagggaggctgcgccgagggtcccggccctgctggaatgttgcttccgcctgggccttggcctctttggccctgccaccccctcctgctcccggggccagctgccccagcacccagagctggctgactgaaacccagaagtatgtgtggaactcacttcgcggggagccgccggcctcactgcccagcctggtggcgtcagggctgtgtcaatagcagccttgagaggggtgtggctcgtggctgctggggtggccgggtcgggggtgctgtcatgaaagccctgagaacaaggtggctctttgaggcctgggaatgtgaggcctttgagtcttgctgcccccagaaccactctcccttcccttccatgatgctcatctgtgccaggcctgcaggaacctcagagcatccctggaggcatctgtggcatcctgagatagccttaggaccagctcctagctcctgaccagggcccattccctgagccatgaaggagggtgtcctgttgctctgggttttaggggagtatctggtgcgcaaagccttgcagagtgtgttgaatgaatgaatgaacaaatgatgtatgtgattaagcgttttttaaaattcatttcacaaatatctgtggagcatcttctatgtatctgactgtgttctagatcttttttttttttttgagatggagtcttgatctgttacccaggctagagtgcagtggtatgatctcgccgcactgcaatctctgccccccaggttcaagagattctcctgccttagcctcccaagtagctgggattacaggaacacgccaccacgtccagctaatttttgtatttttagtagagatggagttccaccatgttggccaggttggtcttgaactcctgacctcaagtgatccacccatcttggcctcccaaagcactgggattacaggcgtgagccactgcacccgccctgttctagatcttgaggttaccgcagagaataaaaatgtcagattccttcctctcatgtcacttgcgttatagctagtgcaggaagacagacaataaatgaaatacatcaggtggtgataagtgctcagaagaaaaaataaaacagggaagagggcagtgagtgatgaggcggggtaggtagggtggggtggtaggaaaagcctctgataagataaatttgaactgaaggagacctgaagtaagtgagcgggtgagcctcgcagatatcaatggaaagggcattccaggcagagggcacagctagtgcagaggcccagaggtgggagtgtccttggcatgtctgtggaaaagcaaggaggcccgtggggctggagcagcatcagtgagggggagcatggtggatgcagcaggcaggggggtggcagagggtgatcagcagagctttggccatgggaaggaccttggatttgcgtctgagtgaattgagaagtcactgaaggggcccggtgttccataggattgctttggctgctgtgtggagaggagcacggggagggtccagagcaaaggcaaggaggccgtgacccaggacagacgatgggagctcaagctaggaccacggaggtgggagatggttgaatccccagtacattttgaagatgggtcaccaggatttgctagtgggttggatgtggggcgggacagaaagagaagagtccgggatgcctccacagtctttggcttcagcatcccgaaggatggagctgccactacctgagatgggaaagttccaggaggagtgggcaggaggtggagtccagaattctcagaacagttaatttatttgtgtcttctcttacgatctcttgtttggacaataaaaattcctaaaaaaaaaaaaaaaaaaaccggcaggtgggccaggagtggtggctcacacctgtaatccccacactttgggagaccaaggtaggaggatcacttgagcccaggaggtggaggttgcagtgaaccatgatcttgccactgcgctccagcctgggtgatagaacgcgatcctgtctcttaaaaaaaaaaaagaaaaaagaatggcaagtgatggaggggacagcatgggtgggggttggactggctcacatgcctggcagtcatccccctacccatctccagccaggagctcccccgtccccacccaagctggggcctctgcattggcttatggtgtaggcggaggggatcttgctgagtgttcatttgtggagttgcagactctgccttagaactccacagccggagctcatggcttgtagatttattcttaccccctcatctagagtggaagctgcatgagggcagggacttggctttgttcattgctgtttgcctggtgctaggcagatagtaggtgaacacattaaaacttcaagtgaggctgggcacagtggctcacaacctgtaatcccagcactttgggaggccaaggcgggcggatcacctgaggttgggagttcgagaccagcctgaccaccatggagaaacctcgtctctactgaaaataataataataaaaaaatcagctaagcatggtggcacatgcctgtaatcccagctactcagggaggctgaggcaggagaatcacttgaacccgggaggcggaggttgtggtgagctgagatcgcgccattgcactccagcctgagcaacaagaacaaaactccatctcaaaaaaaaaaaatcaagtgaataaaggatgggcgcggtggctcacgcctgtaatcccagcactttgggaggctgaggtgagcagatacttgaggtcaggagttcgagaccagcctggccaagatggtgaaaccccgtctctactaaaaatacaaaaaagttagccgggtgtggtggtgcatgactgtagtctcagctactcaggaggctgaggtaggagaatcgcttgaacctgggaagcggaggttgcagtgagctgagatcatgccattgcactcaagcctgggcgtcattgcgagactctgtctcaaaactacaaacaaacaaacaaattcaagtgagcaaattaatggctttgaggaagccagcaggccaagaaggcccaggctccttgctgagattggaaaggggcgtgctctggcccctgcacttgggagctgcctgcccagccatgctctctgcagggccccagaagatgtgggacaagctgggatgtccactctgccctttttgacttgtctgtgtcctcattggtctcagagccacttccctgggcactgtggtcaagggaaagatgtgggctcaaaaggccctgccttcaagtcttggcccagccctgactggctctgtgaccttgggcaagttgctttacctctctgagcctcagtcaaatgtgaaatggggaggcctgcttcctggtggttatgaagtaaccaggtggatgcaccttgctcagtgcctggaatgtggcaggtatttgacaatccgtgattgcactaagtctcgttcctgctaaagacaaggccggtggaatatctgaggcagggttcccagggcacagccgggcacgccttctctatgacccaggtcctgtactgggcttgttgaatgaatggctgtgtaaggggattgtccattccctgggcctctttcgcagtctcagagctccgggtgtaactgcctctgatctgtcactgcccctccttcgcctaccgaggccgcagctgtaggacagagtccatccttccaccctgattgctccttcctggactgggagaaggaggggggcacaccccagggtgtggcctgggaaaggctggagtctttggacgccttgtccccttcccagatgtgtgcagttggtgggctctgagcaacaggaggtgtggccaggggctcccatgggtgcagaaaggatgttcgtgcatcctgagggtagtgacagtggggggggtgggggatgtcctgggaccccatcctagccctgtccccccctggcctacactggaggaggcaggaccttgcctggggagctctgggccaacctgcagttggtccttacttggtgggatgtggggctgctcgactctaaatctggctcccgtggcctcagagaaacagcaggactcaggagagagagacacacaggcctggggatctcaccccaccccaccctatgctttgggcttgggctgttgggtagagatgtgtcccccctccccatcaggcgggtcacacctaggtgttttgtaacatttggcctctttccccatctttctcccatcccagtcggtggggaaggggaggcctggctggggcctgagcctggggaggacttcagaggtggcctcgggtcactccacagatgcttctccacgggtggggctgggattcccagctgcctctggccccttcccagcccacctccgggtccctgccaccacctccccactccctgcgcctgcccatggctctctcccaggaagccggctccggcccccacctcctggtcctggcctccccctcctaactaaccccagctgactcaaccctctccttgtttggcgtttccaattttcaaatagttgggaactgggatcatgcctcttcttggatcccttactgggctggatggattgaaattctggcctgataaatcccagccctagtggcctctactctatcattttctttctctctttttttttttttttttttttttttttgagactgagtctcactctgtctcccagcctgaagtgtagtggtgcgatctcggctcactgcaacctctgcctctcggattcaatagcgattcttttgcctcagcctccctggtagcagggattatggattacaggcatgcactaccacgcctggctaatttttgtatttttagtagagacaggctttcaccaggttggccaggctggtctcaaacttctgacctcaggtgatccacatgcctcagcctcccaaagtgctgggattgcaggtgtgagccaccacgcccagcagcctctatcactttcacggctcttcaccctttcctgccttttgccttgctatgacccttaggccagaggaacagaaacccaggagtttcctggggacagaccagtctcttccctgtcctgggacctgcaggttctcctccccagtggcctcagtcacataggtcaccagtcaatgttccctgagtgctgacaccttctcattaaaactgccaccctctttagagccaggcctcccactgggctcttgccaggcattatcgcatataatactcacagcaatcttttgaagttggcattatatctccattttgcagggcaggaaactgaggcatcaggagggggagttgggggccagattctcacttgtaatcccagcactttgggaggcctaggagggcagattgcttgaggctaggagttcgagagcagcctggccaacatggtaaaaccccatctctactgaaaatacaaaaattagccgggcgtggtggctcatgcctgtagtgccagctgcttgggaggctaaggcaggagaattgcttcaacccgggaggcggaggctgcagtgagccaagactgtctcaaaaaaaaaaataaaaataaaaaaatagagggaatggctggcccttcatccatccagtacgtgccacacctgggaatggagcccaggttgtcagactcccaagtcatcattgttttcctcagtgggtcctgttgtgtccagacagaggaagtctgggagggctgtgtggagaaggtgggtccaggctggccttggcagagggttataggaggctgcatgtctgccacatgggctttgccagttcctgcttcacagactcgggtgtctttttaccctttggcttccatttcaacccagtgataatgttccccagagagatggatgtgaccttccctgtgactgagacccctgggaaccctgattcttctcagtcaggtcccaagctccctgtggggcctgcaggttttgccctgttgggagttcagtgagttttgctgagcggggcctgctctgagccagccctgtgtccccctcatactgggggcttgggtgaaatgcaaggcagagaagcacatggctcagctgcgagatgaaatctacatccaggtcccgcgttgtgttgtttcaacagccctgtgcagtggaagcttcaagaatccttccatccatccctctgtccactcatttgttcacatattcagctagtgctgcctgaggacctgctgtgcgcctgacatcgcgctcattgtttgatctgtgttatcaatccccctgtacatctggggttatgcctccatttcccagatgagaagtagctcagagagcagggaatagtcaggcgcagaggaaggtagaggctgccttcagcgtcaccagacctcctggaagaaattggaggcatggtccctactctccggatgccttggatcttgttggagaggcaggactcgtaagctataagtgcccaacacaactcaaagtccagacaatagcagagtgtcaggggaaggaaaagactgattgggcatgagttatctggaaagactttctagaggaaatggggcttaaagagcaagtctgatttggctggtagaggaggaaagcattgtggcaggggtccaggagttgtccccattgtccctggactcacattgtccacattgttgttgcatgtgcaagagcaggaagacactcgcttgctgccagagtcgttaaggttgggaaagaataagaggaagtccccaagatagctgaggtgacattcattgctggtcagaccagggaggcaagaggttaaggcctgggcctccacttggtcaccagtcagctaccatctctcctccccgggcctcagttttcctactcacaagatgggctcctttcttgtttgttggccgtcttccaagcagaagaaagggaccctgagttcttggagaaaactgctcactaccccccaaaagttggtggtgttccattctctggggcctgagggtggtaggcacctcaaggagcccaccatatcaccaatcccatgtcttccttcattgacgctattgattccttcccctgacactgttattttctggactttgagttgtgttgggcacttatagcttacgagtcctgcctctccaacaagatccaaggcatccggagagtagggaccatgcctccaatttcttccaggatgtctggtgacgctggaggcagcttccaccttcctctgcgcctggctattccctgctccatgagctacttctcatctgggaaatggaggcataaccccagctcccaagtgccaggctctgggctagggaagcagatgaaggagatggcccctgtgccctagaccttgaagcctgtcctgtcttcttgtgtagccccagaatctctcctgccgtgctctgtccatgtcagttcacctctgctcttgggtacctgctgctaagctgacatcaggggcattcattgtaaatgtctgtttagaaagtgtgactaggagtcacaagattcctaaactcttacgtgatcccaagccattgaacttctttgagcttaattttccccagaagcaaaatgggaccgttcattcattcggcaaacattctcggagtgacagcggtatgcgaggccttgtgttggatctaaacaccaccgtgggcttatggagcttgtggtctgataggggagagaggctgagtggtgggccagctggtaaaggagtagggagaaggaggctacattcaaggaagacactcgaggactatagcaggatttcagggccaccagacctctgggagatctcttgagtctttgtgacttggtctcagcactcatttgtgagtctgtttcccttgcagtgagcctgtgggaggagaggacctgggagccagctcccctgggtgagggcagggggagggcccacagcagcagagagaagggcaggccgattttatcgtgagtctcagatgagctcatggatgtgcaaaatagcgagggctatttatgttgagtctggttattttattttatttttttttttgagacggagtcttgctctgtcgcccaggctggggtgcaatggcatgatctcggctcactgcagcctccgcttcctggttcaagcgattctcctgcctcagcctcccgagtagctgggattacaggcgcccgccattatgcccagctaatttttgtatttttagtagagatggggtttcaccatgttagtcaggctggtctcgaacttctgacctcaggtgatccgcctcccttggcctcccaaagtgctgggattacaggtgtgagccaccgtgcccggctgagtctggttattttcatttaggagaaatggaagctgccaacagagcccaggtttggggttccctggcattgagtgggttaaatgaagggcgcagtcttggggtgcctgcttttcactttcctccctcttttttccctccccgccttctggggtcggggtgggggcgggatgggggaaacatcagctcaagcctggattcgacttgaggaaatgggaggaaagggttaattaagtcagtctggcttcccacctccctggtaggggtcgaggagggggtactgggatggctagggcaggaatgtgtgataagatcaaagctttcagccggcctgggccccacctctggtttcacctgagcaattgaagggaattctctagctgggaggactgtggcctcctaggcaggggggttttaggcagggccaccttcctccaagaggctccaccttacgttggcttcaggtgcttcctccttccccccacacctccacctcatctcccagaagacccaccttgtgccctgacaggtactagaagccccaggggccacctttacttcatacttcaagtggtggggggatgcaccctctctagcaacaggactctctcctgctccctccactgccctctcatagtttgggtttctaagcccaggacacttggttttagaaagaccaggaggaccctggctaaggagctgaaaggcttcagaccgcccagaaaagagcccagagccgccttgctgtggctgttagctcccgtccatcaattccgcaccgtttcattctgcaggttgcactttgggacagtgtcataggcaggaggcatagccctgaggcctatcctagcttcatcactgattgctgtgtgaccctgggcgggtgagttcgcctctctgagcctcctctgtcaggtgggaatggcaattcctacactgcagggttttggtgaagattagagatcatataaatagcctacagctggaatgggcagttgataaataacgggaactattattttgtgattttatctttcctccttcgagagagcccctggtacttggtcctagataaacctctgggtctcagttctattgtgtcgtccccctgcaaccccacctgccacctcacccccgctatgggaaggccctaagtcccagagtccatcctctcctccaacactcttttcttatgggatcttcataatgttgggaggggagcaaggtgggaaggagtgtgagtgcagggggccgaaggctctgtaaatgctctcagggaccttccctagggatagcaggttgagccttcctggacagctggtggtccaagctttccctctccactgccagaggcctcaccaggccagctgggcttaacagaagtggccccaggacacactcagtagggaggagcggatgctgggggtgccgcagcccgggcttctgcctgctttccacactggctctgcgctggttaatgattactctgagtgagcaggagagcagcagaggggaccctcccagccccttaaccactggttgcacccgaggtatgtcagtagtccggtgttccctgctttaatgtggcagcctgctctggggtatgcggggcagggaagcaggggcttggagtcacatattgacaggtagcttgtgcacctggggtcccggagacagtcttagggcccacagggtctaggtgcaatgtgaactctggtatagtaacaggccctgtggtttggtggcagctgtatgaacagatcctgcaataatacacaaggcaaggaagccgcttctagcacagaaaatcctgcactcctcctctcccaggctcagaccctgcacaggagtcctgatgattagggctttggggcagctgagcttggcttccaacccccaactctgccagttctgggctgtatgaccttgggcaagtcactttacctttctgagtggctgctttcttatctgaaagaagagaatgctaatccctactttgcaatggcagcgagccactgggagggaggtatttagttcacaattaatacctggggaatggcagcaattgttatattactgttatagtttttgttattaggagaaagggaaattgaatcttcgtcttgggtaaccagggtgacaatggccgttggggatgagctggaagatctgcccgggggaggaggcataggcagatcccagacacatgtttgaagagggcatgtaggaaagggctggaaggatgaagagaacaggggcttagcagagatctcagccacgctaggcccacctcagacctctcagcctggattcctccctgggctgggtcctgctgctggcgaagtccaggagtgggggaggagggagaactgttttattttgataacattagggcattttcccctactggcagctgctattttgagagccccggagagcaggggctatggttaaattaggtaatgttgctccaacaggaatgtgtgaagcaggcaggctgaggttgcagagagagtacggtcagttcactccatataacattaaactgcagcctggaaaagagcagcttggaccactttataaggcgatgtggggggaaccactggaagctgctgctagtggagtgaaagtgatggcccagcgcctctttttagggagcctgggcctctgcccggaggcctggctgacccagcaaggagccggtgactggcctgaggggcagagctggggtgtcttcagctccacgcctgtggctgctactcgaggcgggtggggtttagggtggggtgatgcatgagaagggtgacttggcagacttggccttgaatcctgcctctgcctctttctagccttctgtgcttgggcaaacccctcaacctcagtggacctcagtattagcagcagtggaaaaacagttccagccacgcacggtggctcacgcctgtaatcccagcactttgggaggccaaggctggcggatcactcgaggccaggagttcgagaccagcctggccaacatggtgaaacctcatctctgctaaaaatatgaaaattagctgggtgtggtggtgcatgcctgtaatcccagctacctgggaggctgaagcagtagaatcgcttgaacccgggaggcggcagttgcaatgagccaagattgtgccactgcactccagcctgggcaacagagcgagactctgtctcaaaaaagaaaaaacagttccagtcccttaggagaatttcttatagatcaaatcacaagaaacaaaggcatagctcacttttacggagggcctactgtgtgcagtaatccctttatgttcttataactccgaggatggtccaggcactagcagcccgggcctcaactgggagcttgtcagaaatgcagagtttcaggcccccttggacctactgactcagaatctgcacgccgacaagatctccaagtgactcatgtgctcgttaaagctggagaagggctgctttccgtctgctgtctcatttcatcctgaaaaccacccctggagagatgactgccatagaaactccatcaatgctcatactcttcccagattcttcccttcttccctttctttggtccaggtgggggttcagtgaagaatagggtgtcaaagcccctgacaggactgaagaaagttgagagtattacttgcttttgagactttttttttttttttttgagacagggtcttgctctgtcacccaggctggagtgcagtggcacaatcttggctcactgcaacctccgcctcctgagttcaagcgattctcctgcctcagcctcccaagtagctgggattacaggtgcacaccaccacacccagctaatttttgtatttttagtagagacggggtttcaccatgttggccaggctggtctcaaactcccgacctcaagtgatccgccagccttggttgctcaaagtgctgggattacaggcctgagccactgcgcccagcccctttgagacttaatcagactctcttgtttccattcacctgcaggctcggcacagctggacaaaggtcatttccccaaagtcattccatgctgcctgcctttggggaaagatgggggcaggaaagcggttctctactgacatggcctgtagggcgggcagcagcagccactgccctatagatcagaggagagggggaggagcccagtggggaggggaatcagagaggggtggccctggacttagttagggttctcccatctatcactggtacatctgggactgagacggtctaggagcaaatatttggagaacgctgactatgtgcccagccctggggaagtatcctcaatttcccctaattctgtagaccctttattattcagaaataaagctccacaactgttaatacaatttatttagtatgtagcatgtgccacacactatactgagcacttgagttgcattagctctttgatctatttaatttcaccatcacttccctcctctatagaatgagggtggtaataataataccgatcttgtggggctgttgggaagataactcaatgtttgtcaagtatatggcacatagtgttaaataaatatagtaagtacaaataatctcccaataaggcaggtactattattgtcccacccctccttttttttttttttattcccacagagtctcactttgttgcccatgctggagtgcagtggcgccatcttggctcactgcaacctctgccttccaggttcaagtgattctcctgcctcagcctcccaagaagctgggactacaggtgtgcgccaccacaccctgctaatttttgtatttttagtagagacagggttttactatgttggccaggctggtctcgaactcctgacctcaggtgatccgcctgcctcggcctcccaaagtgctgagattacagacgtgagcaactgcacacggcctgttgtcccattttacagaggtacacattgaagttcagtgcagggaagggtctggactcctctgctgggatcacaggaggctcgggaagagccataagaaattgagtcctcaaacttataagccaatattataattcagttcaacatagtaagtatttgtttattatcccctagctgctggacattaggaagtatctaaaggttgaatatatacatatgtttaaaagatgaaaaaaaaaaacttggtgtctgtccccaaggagctttggttccagcaggagagaagagacagtaactcaagtgattataattaagactgaatctctagtgttctgaggtagaaattaagtccacatatttgtagggagaaggatgtctttataggggttccaaaaagtctttagagtggaggtggtgattgagtgggccttgaaggatggatgaatagattagctcgaagggcatgggaacagcattccaagaagagggaaccacatgactaaaggcctagaggcaggcaaatgtgccctgtgttaccctgagtgggtgtcgtccagttcttaggagcctcagggggctgatgggtggagaagtccaagcccagcttttttgccattgaagattctcagtgttcttaaagacatggcttctcgaccaactgggactgttccatccccattctgccctgtcttttatttttatttatttatttatttatttatttatttatttatttatttatttacttttgagacagggtcttgctctgtcacccaggctggaatgcagtggcacgatcatggcccactgcagcctcgacctcctgggctcaagtgatcctcccatctcagcctcccgagtagctgggaccataagcacacaccaccacacttggctgatttttgtatttttcatagagacggggtctcgccatgttgctgagtctggtcccaaacttcttgggctcaagcaatccacctgtctcagcctcccgaagagctaggattacaggcatgtgccaccgcgcccagccattctgccctttcttagtgtgaaaaaatcaaagacctttgtaaacaggcggtcagaacttctggtcagcgtgtgataactggtgtagctgacagaattcaggccaaaagcagacagacttgatatcttgattaacgaggcagccttatcaccacacatgttcgatttccgttagccgtttccagccttgacaataaccatgggtggggagccctgtggcagagccaggcctggttccgattttgcctctgcagcctacagctgtgcagccttggcaaacctcagtttcctcctttgtaaaatggagatagctccatctccagccttggcctaaggatcaatgatggtataatctgcactgtctgatatggtaactgctagtcacacgtgactatttaatgcaaaatttaaaattaaataaagttttaaataaaaattcagtttcttttttttttttttgagatggagtctcgcactgtcgcctgggctggagtgcaatggcgcaatctcggctcactgcaacctctgcctcctgggttcacgcaattctcctgcctcagcctctggagtaacggggattacaggcacacaccaccacactggcaattttttttgtgttatttatttatttatttttattttttttaagacagagtctcgctctgttgcccaggccggagtgcagtgacacaatctcggttcaccgcgagctttgcctccaggattcatgccattctcctgcctcctcctcccgagtatctggcactacaggtgcacgccaccacgcctgactaattgtgtttttgtattactaatagagacagggtttcaccgtgttagccaggatggtctcgatctcctgacctcatgatccacccgcctcggtctcccaaagtgctgggattacaggcgtgagccaccgcacccaaccaaattttttgtatttttagtagagatggagtttcactatgttggccagactggtctccaactcctgacctcatgatctgcccgcctcagcctcccaaagtgctgggattacaggcgtgagtcaccgtgccaggcctttttttttttttcttcttcttcttttcttttttgagatggagtcttgctctgtcacccaggctggcatgcagtggtgtgatctcggcttactgcaacctctgcctcccaggttcaagcaattctccttcctcagcctcccgagtagctgggattacaggcacacaccaccacgcccagctaattttttttatttttagtagagatgtggttttaccatgttggccaggctggtctcgaactcctgacctcaggtgatccgcccacctcggcctcccaaagtgctgggattataggcgtgagccaccatgcccggcaaaaaattcagtttcttgatggtactagcctcatttgaagcgcttagtagctatcttattggatgagtgcaggcacgcaacatttccattgcaccagaaagttctgtcggaagcgctgtgtatgttaagtgctgggtattgctggaaggagttgctgtggtcattatccctggttccctgtcccatattggaaccgttccagctctcattggttcttcttgctgctcctctctctgctgggctcttcctgctttcttctcggcagcctctcactctccctttgcctgaccacacccataatgtgaaaaactccatgacttgccttcatccagctcctctgcccctgttattttcccacgtgctccctgcagcctgtctgcatatctgccctttcagctgctggcatctggaatctccatgtccgggctccgaaattcccactacccattcccagtgggagaaggggaggaggcctcccctggcagtccctagtccccagctcccagcagaggtgccggctgcctgggccccttagcggtgtagagatgatggtttgttgtgacgggggcaccctgcccgctctaacgcgcccgtatcagggcgccaagtgtgctgtttgcacttggctgggcctcacgatctggccgggtgcccgtgagggctggcccgctggcacccttggtaacaaaggtaacaaaggccaatcatggaccctccgcctggtcaggaacataaggagccggtcctgggctgggccctgggggtgagggacgtctgacacccagaaccagagtgcaggacagaggccgtggctgtggctgggctctgggtgctgagtgggacaaggcccaggcaggcataggcaggatgtgagcttttgggggtcaggcaggtggttgctctgggcagttcaggtgggcagggtctgcacctggcattcacacctgcccggggaggagctttggcctgagatgccagagaagctcaaggtcacctcccagcaccatcctttctcctccccttccttttggggaggagaaagtcatctgcgaagtggatggaacaggcatctctagcccatgagtgacaaggacattgaggccctgcaaggagctgcagctggtctgagatcacatggccaatccctggaagaatcagagcttggactcagacacctgcgcttttctacctttctgctcctccccatgggagttgtgaagccagtcgtccctggacacctggctatggagggtcagatcctggccctgccagattctcctccgggggatagagacaattacacctagctctcagggcagtcatgggggttagataaccggcctcctggctgttttccaaaacattctgaggctcctcctgcctctggggtctttatagatgctgctcctggtgcctgggtgctcttcctctaagtatgcacctgacttgctctgtcagcatcaccctccatacccagggaaatagcaaccctcaacaggccactccccgtcccctcaccctgctgtatttccttttcagcactctcaccatttgacatgtatatttggggtattaatttatggtccatcggtctccaagtagacggtcagcaccagcaagggcagagaacattgtgtggctcatagtacctgctcctataatgattactgttttttcccccttctctttctaatacttcccaatacctaatagccactgtttactgggccctctctacacaccagatcctgggctaaatgactcacagcttagcgccacaaatttcacaggttcctgtcacaggctgctgtcacttttgtattagaattgagggcggaaggcactgcagtgccttacccagagccacccagctggcaagcggcagagccatgcctccggctgggttagtcccacccagaactcacactgtactgcctcttgtgttgggtttatgagatcagagccttcatccaaactggggactcagaatccacgtatgatgggattggatggatcagatttgggggtagctctcaatcttttgggggttccccttctagccttctcctccttccctgtgcccagcacacatttcctaggatggctccttccctgggattggtcagttagttacagccgggctcactgccccagaatgacaggtaccctttggctggggggacccagcagctaacctaaggcctgggggttgggcagggagcagagagtgggtccaggttcctggctgtccgtgggctgtctgagggcaggtggacaggatgttccctggggcagcagacattcctggtcgaaggtgacaggcagcggggagatttaccatttccggtaacccgagtccctgggatgtcgcattctctttgccaaggacacggcatccctcccttgccagcccttcctgccatttcctaggctgggcctgtctgactggggcttgaagacaggctggagggaccagctctgggtgccagaggttgagactgagggctctggccctgattagcacccccacaaagacctagcccattgccaccctcccagaggcctcatctgtgtagccccttatcctggcctttgagaatccttgccccaaggagaggaggaggtggcttcgtgaaaggtaaatgaccctttgttaggaaccaagaggctgggtcctggatctgcctctgccaatcgagttgctgggaggctcctctctcttctcacggctgcccaaaagcaccattcttaacactctgtatacataatccagctttttttttttttttgagctagagcctcactctttcgcccaggctggagtgcagtggtgcaatctcagctcactgcaacctccgcctcccgggttcaagtgattctcctgcctcagctccccaggtagctgagattataggcacatgccaccatgctgtgctaatttttatatttttagtggagatgaggtttcaccgtgttggccaggctggtatcaaactcctgatcttaagtaatccgcctgcctcggcctcccaaattgctggggttacagacacaagccactgcgcccagcaataattattaatccaacattatgggggtatgggaggcacaaaaatgaggctcaaagtgataaagttccccagcagccggaagtgtcagagatgggattgaacccaggccctccaagtctggttggttccccataacatgctcacttcccttctttgggatttggtttccccatctgataagtgagggtgttggctaggtgatccctcccagcttggacagtacaggatccaggaatgcattggaaccttttgcaggcaggtttctcttgtgtctcattctccccgggggtctttggagagctcactcacttggtgtgtgagctctggggtggataggactgggagagaaggaagaagtggtacttacacctcgtaagtgcctgatactagcacttaggttgtcctgttgaattctgacggcagccttgtgagggggtcatttttattcccattttacagatgaagacacagaggctcagagaggtcaagtgatttgcccagggccacacagctaggaaactgccaggctaaagtgtccagtcaacagttaacagtggtatggggtggcatgtgcccaacacacatttcctaggatggctttgacttattaataaaatatgatagatatagtagtcatcgcaaaaaactatcaacgtgtctcagagatttgaatacctctgcatccaaacttcacctcccaggctgcctctgacactcagaagtagcccagaaatcctttatttagtggtttcttgatttctgctttggaaaatatggtcagttgtaattatgggtatgtgagagttcagaggagagagagctgcgtgggctggagcgggctggaaaggcttggcaccgaactgggagtggagctgggctggccggcagctgagggggctgagatgggctggggtgggccaagctcacagcctccagggacgtttcctgaagggcctgcagtggggctgtgcaccagggaaattgcaagcctcttcaggactccctccctcccggccctgcacctccccacgggggccctggagcaggccaggctccagttaaggcatgttcagccccagacctttgctccggcctctccacccaggcttcccagggaactgggtaaagggctgtgctatgggacagcgaggccaggcaccctgaggcttgagcagttgacagcatgaggactaagatgaccccagccagcccgcccaccccctccacacccccactccctgcctgctctggggcccttggccctgaggcctcagcagctgtcagcagggaagggtgacagaggagggccagaggtgacttcccagcctgcccattctccccctgcttgggccaggcccagagctctccccagctgttgtcagcagctgtggagctttgttctggggccagctctgggtagccccctcctcccagtacatcttcccaccatccttcacagctgctgcccttggggaggggctggggctagtgtgggagacagagtcacatctttggttcctttgatcctaccaacgacctgaagaagaggaattcatgcccttgtttttatggaagagaaaactgattcagagaggccaagcaacttgcttgaagtcacacagcttagtggctgacttcaggctcctggctccccacccagtgctctccgactgcctttcttcaatgtgcatttggcgcaggatgccaggggcttcagggctcctgggcttgactcccagcttggccatttgcgacctcaggcgagctgcttaaccacctggactggaactcccgttttcttgcttgtgaaataagataatggtaccgacctcttgggactgttgagcaaattaaatcagataattaacatcaggtacttagcataaggcttgatgtgttctttgtgctcaagctgagagctggcaacgttaccatcgagggtattaaccacctgtgtgcctggcattctgggtggttctatggaggctacagacacattctttaaatatttgtatcagtcagtaaatatttatttggcacctactgtgtgccaggtgctagaaaaagggcagcgacaaaacagaccaattcccgttcctgcttatattctgcttcacaaagtggctggagagacactactcatcctaaccatggaagcctctggagtgctttcacacactgggattcacatccatattttgcagatgagaaaactgggacccagagaagatcgatggcagagttgagccaggacccagcttttctgagggtctcaggcagtgctgctgagcacaggaggcagccctgtgggcttcctggaggaggcattttgtgctgaatcttacagggcctcagggcctggcaggggaggtggggaacagtacaggatgcagccaccacagtctgggcaggaacaatttcaggaaggtcttacggagggcaaggccttttgttccccagggaggaggcccagtcagagctttaaataccccgtgcagcccagaatagcccccattgtgttggtctgcagctgggggacccagggaggaaccaacatcgccatggaggatcctgagggggctgattctggcagattctggaggtggggcggggaggtcttcaggcacttccctatatggtgcggtggcatttctgtggaaggcttttctagtctggctcaggcaggaaggcctgctttgtgggaagggtggagcagcagctcaagttctgcgtgagcaacgtgcagctgaggggggagcctggtgggtgggggactcccagggacggctctgtgcctgactgaaggtgcctctttgtgcaccagaggtatgtgtgcattggcccactgggccctcctgtaggtgggcctagcccaggcccttgccagggcctcttggcaccctctcctgctctagctattttgggcactggctgtgttcgggtttggggagtgatgggtaatcctgcctagaccaaggctgctggggtgaggttggtggggtactgactggactgccattccagctccctgaatctttgatcactgtagcctctgcccctggcttcagcttcaaagggtcatggtcagcagactctgaggggatgccagccccactgatgaggcagagaagggtgccagacaagcctgtcccttgggacattccctgctctcagtatcagggatagttgtgctttttctaagcaactggtttgtttttacattgtgagacatggaatctagggactggtcaggtttccttcttcccattggctgctggcaagctcagggccacatgagttgtccctttcctagatctctgggattcagcatgtgctctctgtctgcttgcctcactccaggctccatctgcctgccctgcctgagtttttcttatatttctttagttaatattctcttggctgttaagtgtgcatctttgtaagctgtctgcagcctttttggaacagggcaagaggggaggtataaatgaatgatgaggatgatggtgatgatgaccctttgctcagcgggtctctgcagcctgactccttctggctctgtcctgacattgtttctgtttttgttttttgagatggagtctcactctgtcgcccaggctggagtgcaatggcgccatcttggcccactgcaacctccacctcccgggttcaagcgattctcctgcctcagcctcccaagtagctgggattacaggcatgtgccaccatgcccggctaatttttgtattttttagtagagacggggtttcaccatgttggtcaggctggtctcgaactcctgaccaccagtcccaaagtgctggaattataggcgtgagccaccgcacccagcctgtcctgactttgtaatcccctcctttagccctgttccttttgcaggtgggacacagcctagaattttagaatcctaatgttttagagtgtcagtgctctaaaatatcaaaaccagaggaagctttggggtcgtttaagttgatggctttcaaactcattaagcagtgagacccttattttaatcaaaataacaaagataatcacagcaaacacttttttttttttaacagcccagaggtctttttttttttttaaatacctattatgccgtgaattcatagagaataggttccagcagctcaggctccttcccattggttctcacaaagtgtgctttgctgggtggagcaggctggcgctttagttgaacccaggtacctttctctttggcttctctctttttctgatcattctccttcacgcgtttcaggaagctatctcggctctcagagtgcttaatgtgctcaatacgcacattaattctcttggcaagaatcttgcccttaacttgtttgtttacaacaatgctagcagcatactggataacattgtagactcttccagttttgccatggtaacacttgtggggcgttcctttttgaacagtacccattcccttgatgtctacaatatcacctttcttatagattcgcatatacgtggccaaaggaacaactccatgttttctaaaaggcctggagaacatctattgggtgcctctcctctttccctttgtgttcgtcattttggcgaattactggaagatggcggttccggccgaaaggcagcaaacacttatagaacattcaccatgtgctgtgttatctgtagcattttacatctgtatttaaccctcacaacagccgtatgagatagatattattactatgaatgatcgtgcccattttacacatgaggaaacggaggcacagagaggagaaatgacttgctcatggcctcacagctaaccaagggctgaaccagatatttatgtaggtgagaatatagaaaggaaagaggtggatttgtagccgggcacagtggctcatgcctgtaatcccagcactttaggaggccgaggcaggaggatcgcttgaaaccaggagttcgagaccagcctgggcaacatagcgagacctcatctctacaaaaaataaattagccagatgtagtgatgtacacctatactcccagctacttggaaggctgaggcaggaggatatcttgagcctaggaggctctgaggaggcccactgccctccagcctgggcgacagagcagaaccctgttaaaaaaaaattggatgtgttttgatgaaagtgagtgtttgggaaggggcccaaactctaacggtgccccgcttccacctcactcctgtccagagtggccctgaggctgctgaggatggactggagagccatgacctagggctgcttcatcatcggacagaggggagtctgaggcccagagaagggaagggaccagcgagcagagctggttgggagccctgttctcagtcgctgccctgaagagcaccagcacccccttacctgcatggtcgccggccctgggagtgagcccctgccccggtctctgcactcagcagctgaacgaagctctctttctctctggggcacaggtacctccagactttctggagggtccaagcggaccaggaatgactgggtgctgggccaccttctctttcacctccgacaggagtcaccccctgagagagcagactgatggccagggagggaaggctcaggctgtgtctggatttctcaggtgacaggtgtcaatcaccctgaggagagagaacacacccctcctactaccagctagccggccgccagcccgcttttccttccatggggccttgcggcttttcttatcttcaagagcctcctttacagagcccctgggtactggggagcatatcttacgtctaaaatcttacttaaggctaacttgagggaaaggcgggatggttggggtggtgttcccaaagtgtgttctgtggaaccctagtctagtgagccttgcatacataaaaggttccaagttaagcaacttgggaaacaccaaatagttgcacgtgacccccccccaccccccagtcccatcatgttgcttcagtcatttaggacttagggaggcagctcagctttgtgtaaccagcctttcccagatgtgtttgtctcccccgcgcctattcccatccgagagtttctgtgtccaggaaaggacatgaagaaagcagacatggggcgcttcaggacgaggaccccttgctctgatttccagctctgctctccacaggcctatctcagccatgggcctggccctgcctgccccttcctcttcttccttacagcagatgaggaaagcccagcctgggggcagggggagccgacctccttggccacagctgccgggctgttccagcctgttttttcctgttgccgatgcccacgggaacaagcgctgagtacagtcactgaggcctggctgtctggctgtgttgcgcaaggccctggagccagagttctggcccctgctcgcctccgaggcccccacccacccctccgggatgctcttcagtgactatgggcagcctcttgtcaccccagagatgggcttcccagcaggaaagtcccaggcatcatcggcgggaccaggtggtatggagttccttccaggtgtggagccaggggtcttaggttcaagtcttggttcttccaaccctgtgactatgggcaagttagctctctgagcctcaggctcctcacttataaaccccattaattaattaactaattaattgtttttagagacagggtctcactcttttatccggactggagtacagtggtgcaatcatagctcactgcagcctcgagctcctggctcaagcagtcctcctgcctcagcctcctaagtagctgggactacaggtgtgcaccaccacaacgggctgatttttaatttttttgtagagacagagtctcactatgttgtccaggctggtcttgaacgcctggcctcaagtaatcctcctgtctcagccttcattaattaattcaacaatttatttttttagatggattttcactcttattgcccaggctggagtgcaatggcacagtcttggctcactgcaacctctgcctcctgggttcaagtgattctcctgcctcagcctcccaagtagctgggattacaggcgcctgccaccacaccaggctaagttttgtatttttagtagagatggggtttcaccatgttggccaggctgctctcgaactcctgacctcaggtgatccacccgcctcggcctcccaatgtgctgggattataggcgtgaggcaccgaccatgcgcggctgaaaggtgacattggagcaaaaactggaagaagtggagcgagtgatggaatatgtggggacagtgtcccaggcagggggcttggtgtgtttgacgactattgagaggatgcatgtggctattttagaaggcagggagttgggggagcacagtagcaaaagaggttggagcgtggcgtgtgtgtgtgtgtgtgtgggtgtgtgtgggtgggtgtgtgtgtagacagattacatagaacctggttgaccatgattgtgtgtgtgtgtgtgtgtgtgtgtgtgtgtgggtgggtggtgggtgtgtgtgtagacagattacatagaacctggttggccatgataagggcttttcctctcacccgttggtgagtcaggagtcgtgggaaggcctaacccgacaggttcaggaagcggccgtggttgttagtggtgtctcatggcaacataactttgtggaacattccgcccatccttccatagtcctggcactgtgcaaggggcatcattcatgaaatctgtgggcagtgacccaggagggtatgggcaggcccaaccaggttggtgtgcccttgaagccccacagacctgccagggcagcagggcagctgggagccggagaacctgagaaccaagccaggctgcatgcaggaggctggcacgtgaacgctgcaggtgttgccggcagccgtggtgcctggcagatagtgttcgacccccagggaccttcttgctgggcagcccagtccagaagctgttcccgcttaggccacccccaccgccttggccacacctggcacatgggtgaggcaagggcatttcccggtggcttcctggttccctgtaagctggcaggcagctcattcagccaccaggggagacctaatcttggggtgtctgtgggggacggaggagagtgcagggactctgggggtacaggggagacttggcctctgtgactagcaccgggtcagcagcacaactgaggggcggcccttttaaatggaaaagcccactcgtgccgccctttgactcctctgccactcacacgcgtgtcccgctgcaccaggcttcctcccaccccgcgaacgtgccgtgccctctccagccctggcctcagcgtgtgcccttccctccacctggtccgcactcttccccttctctgctttgcttaggtgaagtcatctctcaggcccagctgagttagcatttcttctggaaatcttccccagcctcccagccacctccctaagtgaggggaccctcccctgggctctgccggcccccttccttccccttcagcactctcttcgcacggtgttgccagcacgtggttccgtggcctgtgtcccccaggaacatggagttctgtgtccatttcacattttgtcccccgggcccagcacatagtaggtaccccgtaagtcgaggttgaagtgacttgaattgaaccaaatgggacagatctgatcgattctactttttttaaggatgaggaagctgaagccccctagctagaatatggccagggtggcccggacttggaggtgtctgacagcacagcctgctctgccccaccggctggtggtcaagtgttctcgccagtcccctgcctggtcagtgccagaccgggttgggtgcccacccctagctatgtcataggagcctccaaggcagagaccacatggggcctgcctggagaagggccaggcagattcagagattgggactgtgcctctcaaagagatcaccgcctcattccacatgcctctcccagtagccccaggaaggaggcaaagcggggacctttttttgcttccattttatttatttttattttattttatttatttattttttgagatggagttttgctcttgttgaccaggctggagtgcagtggcgcaatcttggctcactgcaacctctgcctcctgggttaaacgattctcctgcctcagcctccagggtagctgggattacaggcgcacgccaccacgcccagataatttttgtatttttagtagagatggggtttcaccatgttggccaggctagtctcgaactcctgacctcaggtgatccgcctgcctctgcctcccaaagtgcggggactacaggcgtgagccaccatgcccggccttttgctcccatttcatagcggagagaactaattcttggagggattgttctgcagggacaggggtgtcttggaacggatttcagggcccgtgtgacctagtcccctctttcccttaggatgaagtgttatggcctctgtcgtattaatgggaactgaggactagaggtaattctggcactttcaagctgtgtaatcttgggcaagtctccttctgaagttagctttcttctgtcaggtgggttaatttccacctcagggctgttgggcaggttcattcatttggtttgtccgtgagtccgcagatttattagtacctactgtgtgttttctgttgtggagttgcagcaatgctcaaaacagatcaaagtcactgccttccacgtgttgttcacatggactgagatggtgggtgtggatgcccagtgcatacagtagagactcactaaagttagctaaaaggtaaaggaggcaggggcttgtccaaggcaacgtggtgagtgcggggctaagctgggactagaaactccagaccccagcttcctgccctctgggcctccgctgaaggccctgacctgccccagcgctcccgagaagccctggatggaatgcagcttttccaggttgcaggccttgatatgagcttacagagggcaaggggtcagaggtcagaagcagggccctgctggcagctgtgcctctgagctagccaaatacagaagcatgaacccagcagaggggagtcctggtttcagactccgttcccattgcctttgctgtgtgacctggagcaggtaactgtacctctctgagcctggtttccttatctatcaaatgagtgtgcctccagtgtctccctcgtgaggttgtggtggatctgagtgacgtaagtcttgtgaagaccttagctcagcccctggcacaaagaagccctggatgcgtgttggaccctctccttgtttgggggcgtccgtatttctcctggctgactggctggtgaagttcctgccaccttgggggcccctgtgtgagaagctggcaggcctcccgagtggcacgggcagcacaagcatgccagaggaggctgtggccacctcccttccggcccggcgcccctctcagactgccaggggattaaaggccttttggcctttgtgtcgggctctgagcccctggcagtttgtacaacaaagtgctgccccgacagattccttcctgtgtgctgtctgtcgcctgtggacagggcactgggtggcctgggggtggggcagggcaccttgatcctgtgtctggggcctgggttgcagccgagtaggggaagcacttgttttggggttacctaggagcctgcatcctggcagagggggatggggaccttgtctgggttcatgtccctccccagagatttggggaccatgggtcacattgtctgctggttccttggcagtgggcaggggaaggggcactgaggcagagcctgtggtgaccgtggcagggaggcaggtgggcaggcaggagctcttttgtccccccgcccctgcactgtctctggattttgatggggtgagctcactccatccccacatgcctggagcctggccctgggcagctgcagccgccctggggactgtgcagtgctcagaccttcctgcctagctgcgggggcagtcgggggctcagtcccaggcttgggctacaaggagggtggggtggactggctgctgaaggcatgtgaacaatgtgtctggagaagcccaaagccctgggttggtcccagagtcagcctctgagcaggcagacaactttgagccataggacccaattctattgcccaccccttgctagggtcctgcccactcagccaggctcctcccttcatcccagatctggaggcgaccccaggcctgagcccacacctcacactccgcatgcatcacccctcaaccacacctacccctcacccctaccatgcaccctctgcatgatactaatcctaatgcttattaagcacttactgtataagtaattctagtgcttattaagcacttactgtataagtaaacgcctcactaagtgccttacctgcttgatcccatttacccagccgattctctctgagcctcagtttcttcatccagaaaacggaaataataataacacaagctcacagtttcttgaccgaaagcctcagagtcagatgtgttctggaattcagaatttttcaagtttgagaaggtgacatagagcatgtgcccagccggcatgtgacatccccattggagtctgggggtcacaccccatgatcaaacaacggtaatattgctacagtgaaacacaggactcttccctctgagtggagtgaacacactctgaatagcttcatgtcggttcagttcagggcttggcacccaatgagcttgctataaacttttttttttaacagagtcttgctctgtcgcccaggctggagtacagtggtgcaatctcggttcactgcaacctccgcctcctgggttcaagcaattctcctacctcagcctcccgagtagttgggactataggcatgcaccaccgcgctgggctaatttttgtatttttagtagagatggggtttcaccctgtaggccaggctggtctcgaacttctggcctcaagtgatctgtacctgctctccgtatctgtacctctccctccttctctccattctgtgccccactcctgtagttttctcctccgttcttagtcctttcctaggcagccttgtctgcctctttatcctcacccaggccaggagaggaggatccagcctgcattcattgtccctaatgacacaacttggacctggagttccatgtgaccctcgttctcaccaggagggcctggacatagcccacctctgggattgggtgcctcccagaagccctcgcccacagtcctgccagtgttcaaggaatgcctgcccactgggggtcaccctgcctgcatcccagccccaagcaattgttctcagcctgttagaacaattctctggcctgggcccggttgagtcagctgcctgcacaccgccaaaccaggaactgcagggtctggaaaatccccctctctgcttagctccttcctctctggccgaggtctgacccctagacccctcctctccagctgcccgtctggctccaacacatgcctgaagtgctgggttcctctgggaggaagccgggctccctcaccgccggagacgggctggagggcaggaaacctgggttctatttctgaccttggagctgctaatggccctccttgggacctgaggcacatgctgcacagtcccaggccactgccagctcaggcatcccatggggccattctgagagctggtcaggttggggacagggactggccaaccctgggctccctggtattgctctctgcttaggcctcatggccagcccagaggtccagccctgcctcatttcctggtgagcagaaggcttggggtgggatgccagctcctcacctgtggtctgggcagacacgtctcccggggctcactggggaaggggagcattcatacctcctcagcctcctccaagggtcactgtcaactcaggtgatactaggctgaggaaatgcattgcaaagtggcatgcagtgtggctgagaggctttgcaagagtgactcccagtgatctcatatctgcttcattgcatacccctggtcacagaggtgatatagcacagtggtagctgcttaggtattggagcccgaccaccagggttcaaatctcagccctgccacatgccagtttccacgggtaacctgactttctctgctctctttgccccctttctcagtggagccccataagacctataacctggtttaggagtgcctggtgcatagtaagtgctcaataaatgttagctgttattattcttcaagcagatcctggtctttccctttctgggtccaaggtccttctatggtcaagtcccaagttccttttggctctttctgggagcctctttcctgtctggttccatctgctctcccagatgtgaaatacagagctcctggaaccttttgatcttcagctttttacaaatgaagtctctgctcttgctgacttattccttgctatgggcccttatctgaccctggatcctcagaccctagggtgggggctgcaagcaacagcagactggcagatggagggacccgtgctctggagtcctctggtggagtgtggggcacttctgtccaagtcccgacgtgctctggcctctctttcccctctccctgcagatgtgtgttcctggctttctttccatgttgaatctcactttgctatttcctgtctggtcccaaggccacccccgccgccacccgctgaccagctccctgctccctgggaaaagctctggaccttgctcatcattcaccgctaggttttcctttccagacggcagtgtctaggagatgctgggagtcgcagtgctccaggcatgccctccataaccttggttgcaatgagagggggattggcattgacagagccccccaccaggttgaggggacccctcaaatctcctctaaccagagtcagtgcccctgcaccagccccagcctcatacccacgttgggtcagtcaggcctgctccagccagtgggaacactgccctttaccccacccagggaaggaggcagagcgcctggtaggggctggtcttacggttctaaccagggactgtgggaatcccctggacatgcacaactaagaccaccctcctgggatggaaaaacctgactcactgtctctgagaaggagcccaggaatctgcatttctcaccagctcctggacgttctaaagcacactcctgaatgcgcatcccacgggcacagcctagaagtccacaggccagcactcaggaggacagggagagggcagggagaggagaaggaacaggaggcaacatttgccgctggattgttgggggtaagggctttaggccaaagcaggaataagatgtggacaactcagaccttccccaaggtctgagagcaccgcaaacacaaagatgaacaaatggcacccagccactcccccatccagggagctcacagcctaggacaggagatgcttatagattgcacagaggtaggtagtgcctccccaaagcaagtcatcttcacagagtgactggaattcataggtgatgaattccgtttttgtccgttcatttattcattcattcaagtatttattgagcacagggtgcagaaaaggtggagatgaattcatcacagcccttgccttcaaggtgcttccattccaacggaggtacagacaataaccttgtgagcccagaaccagactggggttgaggtcactgtgaacagcaaggagtcgggacaaagagagtttctttctagtcatccttatttaggcataaatacacacaacaaaatatacccattttcagggtacagtcagtaatgagatatgtatgcccagggaaccatcaccccagaagtgtctcttgtgcccccttcccagtcacccccagcctgcccttggtcccaagtgactactgatctttctgtcactatggattagactttcacccctaagggttcatataaatggaatcgtatagtttgtagtcttgtgtgtctggcttctttcagatccacacctatcaatcagtggtttgatcctccttattcctgagtaggtggaggaggtggtatttaagttgattttggaggatgcattggagttcgcctgagaaacaaagagaggaagggcattccagcagagggcccggcgtgagagatatggactgtgggagcagtaggggtggggagggaagggggcctggctggctctttgtttttttctcctccttggcctttgctctggcttggacctcactaccttgtctagcccttgtgggtttggttttcaaaagcgagaccatttccttctggcttaaggccagggcagggcctgaggccctcatgccaggccattgccagtctgtgcatacttgtgcttgtggaatctggggtccagccatcgtgaatctgcacacttgagggccacggggttcccttgggctcccctgggtttgttttcctctaagttatttggtaaaactgctttggaatcatccggatcttgtctagggggaagaggcactcattgcccggacccacacctgagaaggcaggtgttatggctgctggggcccttctgctccggcccacatagtttgcaggccccaaggtggagcttatcctgggctcggcagcagcctgaggtcacgtggagttgacaccacgcctgtccccattcagcccagatactgagctctgcctccgcgctgctgggcccagggatgagcctgtcagtgtggctgcatgtgccaaagctaattctccaacacagtggaatgtgttccctgcagcctggagacgggcaggccagagtgaggcaggaagaggagccaaatggcctggggaggagctgcctggggaggcaacggctttgagcagctcgcccttgacttctgcctgtgtccccacccatgctgaccctggccagccttccacctgcctgtgccccccatctgcgctgcccgaggccacccctttacccgcccgcatccccccatccactcactcatgtcctgggtgtcccttgccttctccaaaggaaaaggagtctttacttaccaaagtgatttacattttattgtctgctttatttgaggattcattcggaaatagcagggttgggctctgaagcctccaggggctaatgggacttggggaaactgaatcaaaagggttcagccccagcctggctcactgagccatactaagtcaaatttaaccactaaggggcctgaaggtgggattctgggtccccctggaagtgaggggaaggaccgtggggctcagtgggagctggagagagtgactcaatcagctctcgtttgcttacaggtgacccatgggctgagggcatacgatggcttgtctctgcctgaggacatagagaccgtcacagcaagccaaatgcgctggacacattcgtacctttctgatgatgaggacatgctggctgacagcatctcaggaggtgagccaaggatccaaggctgggagcagaggggtggggggtgagactgtgcttcttcccactggcatgggggaggagggtgaccgaccattccgagctttctcaaccctgtcccactgtatactaggtgcccagaacagtgcctgacacccagtaggtactcaacaaatacttgttgttgctgattacatctcttttttgcttatagacgacctgggcagtggggacctgggcagcggggacttccagatgggtaagttgctgcaggcctcctgcaggtctccctcctgtcccccagggaagccccagagccagtctcctgggctgagggctccttgggcctgccctggggtacaaagcaagaagaagtgggtgtgatctcttaacctgctgagtgacagttgtgcagactgattggcaggtccctgcaaggctggtgtggccaggtcctgtgcttgcccatgccacaggcacaggtatcagggcactgggcaggtaaagcccagttctgctggggactgacagccagtcagctgtttcacattcaaagcaaagttctcacctcccagggcagctcagctgttgagtccttccccagagccctcctgggggcacagagctggggatcccaggcaaagacaagtggaacagaggggctctgtggaatcgggcattcaggcaggcagcagggcatgcagagcacagatcgagcctgacgctaggcttgggagagaaccttgccttaaggtgggtcatcggctgggaagcaagggttcctagcttagggaggcaaggctaggctcttggagggaggagagtcagcccccaccctggtcagactggcccagcactgggatggggacttatagtccctgcttccttccactctgggatactgggtggagaaggacctaccccaggacaaggccctgtggctctttatggttcctactgccctctctgggaggcagctcctgggacaatctgtgaccagggccaaggatggagcaggtgctcaggtcagaccaactactgggccatcccgtggcatccagggctgccttcaccctaggcaggccttggccaaatctggcctgggcctacttcaggggtggagtcacctccctttagctgacatatccggggccttcaaatgccagtgggtagcatcctaactgggtcagtgtagacaggagggtaggtcactgggtaacctggtcctgactgtgacctcccagagcctggacttggggctctgcctgaaggttttccatttccatgtgtaggtctccacgaggctgcaggatgcctgggagctgggtggggcttgggagagggagtgtcaggtgggccccaggcacacatggcacgtcccgtcctggaatggcctatgctaatgtgtccctggagctgcctctggccaagccaggcttgcctctgagatcaccctgtccattcatgaaccatctccagcccctccccgggggctgcccactgcagcagctctgccccagctgggcagtcctggccagcccacctgcccttcctgagaagcagctgtgagggcagacgaggccagagggggaagaggtggggaacagggcacagcagctgtagggggcccaagaccagggtaggtgcctttcctcgcaagtgggaacaggtggggcctcagaccctccaggccaaaccctggctcctgccagctgcccttggggcaggtccaggcagctgggctgaatgccagtcagggaggcagcaggtgtgcctccctgatcctggggtcccagggtgcccactcagacttgaccaagggcagtgcccccactgcgcccatgagccagagccatcctgcctgtcatggggccatgcctagcctctggcccagtcccagaccctggactccagcccctgagatggctcttcccctcctccccctgggcatggctgtggctccctggctcagctccagccccctgtgtgtcaagacccgtccctgatagcctcccctccctaggaccccttcccacgtctcctcccccagtttctttccatgttctgacctgtctctttctgtcttcccccatgcccgtgtgtcctgctctgacccttgtcggcatgtctgtgtgtgtcccctgtcctccctgccctgggccctcttccccactccttgagtgtctgtctctgcgcctcctccctctgcctcatcctgttcttctccctctctctggctcaccatctctgcttctgtcgccctctgtctttccctctctcccctctgcctgttcttttttttttttctttttccctctgcctttttcttcacctttgtcttaccttttctctctcattctcccccgccccactttctttatctctgtctctgtctttctgtctctttgtgtctccctctctcttgcaatgtctctgcctctctctctgcttctctccatctcgtctccctcgctgtcaatgtcccttcttgcctccttctctgtctctactctgcaggctcagggcagcccctgggccgcccgcccgtggctggcatgatggtctcggagcctgatgaggagtcccctctcagtaagtgacccaggccctggccaggtgggagcgctgctctccctctgcctccctccccatcctctctccccactcttccttttctctcctttctccctgttctcttcctccccaacctgcactttgctgcgagtcacacaagaggctcagaggcacctccctgcagagtccaggggctaggccagccactgcccctgcccaggacacagccaggcccaccctgggcccacagatctaaacacagtgggctggaaccctggcgggcgttcttccccatggggtgttgacgggcagagatgggtgcagcagccctgcagggaccaggccctgcattccagaggccacttgtgtccaccccagcacaggccaatcctgggcccacccgagggacccacagggacccagggctggagttcgggggcctgggtgtgttgcagagagttctgttgagcagggatgggaatcaggagttggtgagtagcctgctccggggccagggctagtcaggtgtgcagcccccacttctaccctgagtgcagggcagctgtctccctctcccggcctctggctccaagggaactcaccagatagggtgagaggagggagaggactggccagagagcacccctattccaaggcagcctcgcccctgctggctgcaccagtgtccttggctctggaggctggttcttttttccttttcttttcttttttttttttttttttgagatggagtctcactctgtcacccaggctggaaggcagtacagtggcacaatctcggctcactgcaacctctgcctccctgattcaagcaatcctcctgcctcagcctcccgagtagctgggattacaggcatgcactaccacgcctggttaatttttgtattttcaccatgttggccagcctggtcttgaactcctgacctcaagtgatctgccggcctcggcctcccaaagtgctgggattacaggcgtgagccactgcacccagcccgggggctggttcttgaaatagaggtggcctcaccttctgccccagtgctcaggcaccagctgcagggtgggagatgggaggtgttcacccagacctgcccttggtctcgaagaacgaagcggggtggggtcaggctgaagggcctgtgcccttcccaggccctagtagaaaggggctttgtggagctccagtccccttccccaggagcgggcacattcctgggcagaggcccggcctcctcgcccgcgctgggccgtggggctgaggccaggggcttgggtggggggactctcaatgggcctctgtgctggctcacaaggggcctctgtggctgagccatggcccccacactccagcccacagagccccgcccacccggcacccaggagcctagcccagcggttcagggcaggcagcgccagggctttcttcacctgagccacagagcaagaatgtcctgtgcacctgcgggcctgatggacagagtaaagcgggaggaggatgggcctggcagtagcacagacagtgccactccctgctctgccacctacacaccggatttcagatttttggattagggatgcttggcttgtatatgactcatttgtcactcttattcattcatatctatcacatacatgaattcacaaatattgtgaaacgtaatgagcataaaatgtctcatatatagtcggtgcttaagaaacgatagatgtactttgggaggccaaagtgagaggattgcttgagcccaggagtttgagaccagcctgggcaacatagcaagaccccatctctatcaaaagtcaaaacattagctgggcatggtggcatgcacctgtaatcccagctactcaggaggctgcagtgggaggatagcttgagccttagagtttgaggctgcagtgagctgtgattttgctaccgcactccagcgtgggtgacagagcaagaccctgcctaaaaaaaaaagaaacaacagatgcatgtgtatgttcacaccagtctgagatgaatttattcagccatcactttcaaggaacccgctgtgtaccaggcacgcggcaggcactggggatgcgggcgtgaatgaaatcccaggttcccctccatcaagcctagagtctggtggtggagagaggaccacagcagcttcgattcttgggcggtttgctgtgtgccaggtgatgcatctgagtacaagggcctggtgcatgtgagcacaatgtcatgcactcctcgcagcaacccaggtggtacatgcagtcaatatccccattaggaaacagaaactcagagccgaggtcagtgcctgaggcatggctgaccttagaactcacaattgttactgtgatgtgaaacctggcagaatctatgcagtacacggtggaaggtgctctgctagggaaagcagggcactgtgggagcccaggggagcggtctctaccccagccagggcagatcaggaagatcaggagacaatggctgagccaagtcctgaggaatgagtaggaactgaccgaggaaggctggcagagcctttcccagtcacacgcaggtaatccctgtgccaggccaactccctctgggagccaccccttcttgtccagccttcctctgaactgtgggggtctcctcttttgcactagcacttggtttctggatcaggccatttcccctgttagttaaagcccctcagtcaagttggggccttggcattgacccctgagcatgtatacctacaggcagtcctgggtgtagcagtgggcacacaggtgtcagcctcgagggaggcctctgggggccatccccccaactctgcctgaatggtccaactgcctaaggccactagatgccaggctggggctctcaaaatgatcctccttcgattttccagtttatttccgagccctggtgaatttcactcgctccatcgagtacagccctcagctggaggatgcaggctccagagagttccgagaggtgtccgaggctgtggtagacacggtgaggtgaagggggtttgggaagctcgcgggtgtggcggggcaggaccgaggatggggtgaaggcctctggggctgatggcactgtgtccctccccagctggagtcggagtacttgaaaattcccggagaccaggttgtcagtgtggtgttcatcaagtgagaaggggctccctgggggctgctgggggacttgagcgggtaacctggagggggctgatgaggatgggaaggaagcctggcaccgcggaaaggcctatgggatgagtcgctgtgggtggaaattcaggaattggtcgggggatcattgggacctttagttgcccttctttgggtacaggctgtcccggaacagggcctgagcgtcggggcgggagcctcatggaggagctgagaacacaggtgtctcgctgaccctcctctcctgcctgtctccatccccagggagctggatggctgggtttttgtggagctggatgtgggctcggaagggaatgcggatggggctcagattcaggagatgctgctcagggtcatctccagcggctctgtggcctcctacgtcacctctccccagggattccagttccgacgcctgggcacaggtgagcctatcctggtgtctgggatcgcctcctccagactcgtggggtcccctttcagtgtctctgccataggctcccaacttgggcttgcacaccactagaaacagggagctcactactcctgagtctgccccatcgatctttacacaatcttggcttggtagagcacagactgtttcctctagcacatacccgttagacccgagttctgctccttccttctagacctctgcacattgacaataggtaatcaggcctttatttatcctgtacttccaagtccaaaacacattagtacttaataataatgagcaactgtttactgagcactgactgcctttatttccagcctccgggtcagtcttcacagcaattcctatgaaggagatgttattcctcctgtttcagagacgagggaactgaggcccagaaaggaaaatctaaatttgtccagaatcagatgggcagatagtgaaaaggcgaggatttcaaacaaactcggtgtctgtgacagtcttgccagaacctgtgatgacagaagcaggagaaactgaggcacagagagactaggaaactggtccaaagccacacagcggttaggtgcagaatcctggcctttgtactctgggtcagcccagatttccttctactgtgcctttggtctcctgttttaacctcctgagtctcttttttttctctagaccgaacagccctagttcatccttcacaggtgtggttctcggccctgtctccatctcagttccctgtctctgggaagaccctgactcagtggaactcagaatggaacaaactccatcccctactatggtgtagcccaattaggaaaagacagtgaaaccatcacctcccttgttccgcacctcaattaaagccaagcgtggtggtgcgcgcctgtagtcctagctactcaggaggctgaggcaggaggatcaccggagcccaggagtttgaggctgcagtgagctaggatcatgccactgcactccagcctgggcgacagagcaaaaccctgcctctaaaacaagacaaacaaacaaaaacccttaattattgcacccagagatcaagcttgctcttctgcatcatcaggcccaggtctaaagactgctgggggtccagccctcctctctcacttttcaataagtcctcctggctagggatggtggaatgtggcccagccctgcagccctcagctcccggctcccaggtggaacagccactgatcacatcttcctttccagcacagacccccccacccccgccggccgctgtggcggtcgcagtgacaccaggtgagagtgtaagccaggccgaggcccagccaggttcctagagaagttaaggttggagaggaggccgggtgcaggggctcacgcctgtaaccccagcactttgggaggccaagacgggaggattgcttgaggcaaagagttcgagaccagcttgggcaacgtagcaagaccctgtctctaaaaaaataaaaaagaagagagaaaaaaattttttaaaggatggagaggaaagaagggtgtgggcaagatggctggctgggcacagcccaagacagctgggcactcccttctcccctccttctttgtcctcactgggccaggctgtggcctgcatgtgtgtggtgtggtggttgcatgcgtgtggcatgtcaactgtgtgtggggtctgttttagagatgggggaggccactgccgcatgtcccatgccccacgtgtgctgtggatgtgtctagtgtgtgctgcttgccctcgttgtgcctgccagaaaccgagctgcctgacacagggccctggagcccactccagccacacagcacctacagcttcccgcacctgcctcctgccgcctctgactccagtctgcttcctttccacctgcagtgccccagttcccaagagcctgcacggaggccgagtttgcctgccacagctacaatgagtgtgtggccctggagtatcgctgtgaccggcggcccgactgcagggacatgtctgatgagctcaattgtggtgaggggatgtccggggccacgagtggtttgggtgccaggggagggccagggtcctacacctgggtcttggagcccatcaaggactatgagggtttggtgcaggcagaggatgggggcataggaagggtgatgacagagccaggcagggggtggcagggagtggtgttggggagtacagggtgggcctggggagggttggggacaaggagcaggtgaggagccatctgcttctgccaaatgccaagcggaatctatccacagaggagccagtcctgggtatcagccccacattctctctccttgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggtgcgcaccggcaggggtgcaggtgggtgcggggagcaggaagctggcccgggaggatgctgctgacccctgcccggtctcctaggccccccgccaccctgtgagcccaacgagttcccctgcgggaatggacattgtgccctcaagctgtggcgctgcgatggtgactttgactgtgaggaccgaactgatgaagccaactgccgtgagtatccgagggtccagctgaggcccccttgccctgcccaggccgcttgctcctgccccgccttccactcctgccccgcccctaccctgcccctccgctttcccccctccccagtcccccaagcctgtttgtttgctctccctggctgagtgcggaaggccctggagacacaccccaaggtttatctctaaccagagccgtaaggccccttggccctgagctggcctttggtgaagctgtgtggttagcctgcctgtggttcgtgtctcgtcatttctttcctttatttttgttaccatgaagcttctctttgttttgtatgtgggtcggatgaatggctaggagggttctatgtgccaaggtcccttggtgatgggtccttggtgtatgtatgcaagtcagagccttacccacccatctgtccaactccccagccacccatgcacccacctatacacccattatccatccacccagcccttcatccatctatccacccatccatctgtcgtccttcttccctcccatccatccttccagcctcccacttccccacccttgtggtatccatcttttccagtcatggacattacgggcatcctgacagttaaataggagggggaggctggagaggcagcgaccacatcaggtggtatcctgtatgtcctgtcccgcaagaagcctgatgcttgttagtgcaagattaaggataatcttcaggctcttctctgtggtcctgggtggtgtgtctgggcgcgtgtccatgttcctgctgtgagcttgtccagcttctccttgccttccttcccctgcccactccacagcaagccccgggggagaggctgcaccatgccacagactggcagagtttgcgaacgcctttctgtggctctaagcttgcctgatagcaccagccccttgggagagataaagtaattgggggctttagttggaaggcccttctcaggggcctctcctggggaagtcaaaggaaggacaggtccttgtggacagcacagaaacagagaacatgaaagctgaatggcctcgtgggctcctgagagtgtggggaacagaagcgcctgagctgcgcccacggctacctcctggtctcctctcgcacctgctctgtggatgcgcggcttccgctcctgcatggctgtgacttctctgtccctgtctgtgtctctctcaagctccatctccctgaggaagaacattggtcaccagccactagagaggcctagcagggcccagcccttgtcccgggccacttccagcctctggccactccatagagggcctgtcagtgggagcacagaccgtcgagcccctcaggggaccacactgtgccaggcattctggtagagaagggtgggcggggcattgctggcgcccagagatgccagccccactggtggtgcctttgacatgggtcttgtccatgtgagcaagatagcgcttctgtgcctctgagcgtggctgggtgatgctgtggttgtgacagtgatgtgccagccataactggcatggggaatgcaggtggagtgaggggtgggggccgggtaatgtgatgagtggttcgatgacagctggtggccgcatcatgctggctgtgagttggacagtgttgtgcagcaggggctaggcatggcgagggccgctgtgggttatgtgggcaagatgagagagtggccctggggatgcccagggaggatggacggggtgggctattgggaaccacctggctttgtccccagccaccaagcgtcctgaggaagtgtgcgggcccacacagttccgatgcgtctctaccaacatgtgcatcccagccagcttccactgtgacgaggagagcgactgtcctgaccggagcgacgagtttggctgcagtgagcagggagctggggtcgagatgcgggccctgggctgggttctaggggttctgtccacagcctcagcctccacccttctccctcctagcccctcggagccctccttccgctcctccttcctttgcccccgacccctcactcctgccctggtctcctcagtgcccccccaggtggtgacacctccccgggagtccatccaggcttcccggggccagacagtgaccttcacctgcgtggccattggcgtccccacccccatcatcaattggaggctcaactggggccacatcccctctcatcccaggtgcggctctgggcccaggtggtggggtgggaatgaggggcagctggtccagagccctaggccagatcctaccacttgtcttggggctcaccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggtactgccggagggcaggtgtcaccgggtgtgggggcagagccgggctgcccaccacagccggctgcagcccccgcccatgccgcccagcaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgcgttggcgggcgggtgagcgctgcgggaggtgggaggtgggtacctctgtacccagggggcacagaggatagatgcggacagagggggccaggtttcgggaaggaatgtgagtcgctgaagaaacactgagccctgtcaaaaaagcatttcggggggaaaaccaagatgtttaggaagagccaaatccccccttgctacctacctgcttcaggttacggcgaggacgggccctggagccagcttccagcttcagatcctgacgtggacgctgtccacctgtgtcctgggtcaagttacccactatctcgtgtctgtttcgtcatctgtaaagtcggggggtgtggaataataactacctcctaggggttggtaaggacttagtggagtcacgtatgtaagcctctcagaattgtgctcagcgcattttcagcacccaggaggtatttgctaacgtcacagtcattgtcctcattctgagagacagaggtgccagtgtacccagattataggagcccaggctttggcatctccttggcctgagggtggcctccagctataccacttactgccgctgtgtctttgggcaagtctcttggcctccctggtcctattttcccaaagatagaggcaggcagatggactcagttctttctggcactgagaggcagaatggcaggatggctgagggcatgagcccaggcactgcctggactggggctcaggtcccagctctgtcgttttccacgtggcatcaagcagccctcaccctgctgagtctcacttcttcgttgcagaggattaaatgcatgtagagagttagctccaaagcactcaacacattttatgcccttttgttggttgaggaacctaaaaatgacttgtataaaacttagttacctggccaggcatggtggcttatgcctgtaatccaagtactttgggaggctggggagggaggattgcttgtggccaggagttcaagaccagcctgggtaacacagagagaccccatctctacaaataattaaaaacaaaaaatctagccaggcatggtggcttgcacctgtagtcccagctacttgagaggctgaggcaggaggatctgttgagcctaggaggttgaggctgcagtgagccatgatcacaccattgcactccagcctggacaacagagtgagaccccatccctaaaaacaaaacaaaacttagttacttcccaaagttgtcccccagtatatttacaatgctaatggccgtggccaccatttggtgagcaggcagttggccctgtggcttgacgtgacagtcaacgaactgccaaaaacccttgcaaggtcagggctgatttcacagttttaagatgagagccccagggctctgagatgttgtggggcttccctgggttcacacagcagtttagagggggagctgaacccagggctgtctgattggaatctgggtggtccaggggagggagtggtgggaattccagggtgagcaggtggcctgtgtgtggatggtgaccaggagggaggaggcctgaagacatccccggaaggcagggaggaaagaggattgagtaacctagacccggggctgtgctcggtcattctgcgggtgaggagctggattcccctgtggttgcagggggttaattcaggatgagggggagaagctattggcagacagatgtggactctgtataaggaagaacttgctaagagtcaaagttgtccagagccgggagggacggcctttggaggttgtacgctctccatccatgacggctgcaccatccaatgtggcagtcactggccctgtgtggctctttaaattgaaatacaatgattcattcctgagcagcacaagacatgtctccagtgctcagtggccacatgttgctggtaccattacttttaatggcaaaaccaaaccagcaattactttttcaccaacctaacagctaccgtaatgaagagtgtaggtacaggatattttcactccaccgaaagttctctaggatggagctgtcctagagatctgggaggatgctgtcaagggaattcccatgtagggtgactgtgtgtgtgtgtgtgtgtgtgtgtgtgtgtgtgtgtgtgtgtacatagaagagggttggactagacgacccatcataacaacagcaacaataagagctagccattttatatcaatgtgctcattttagcttatacctctaggaggcaggctactttaagcaccatcttacagataaggaaactgaggcccttgcccaggcttacaacacacctggacttggtctcctgttcctcagccctgtgtagctctcctgcctgcagggttgttccagccctgaaagtctgtgggtctcttagcaagaaagaccctgagaagtctggctgcaaagaatccccttgtcctttctttaccctgtggttcccaaatggttcccagctatcattccatggcattgactttcccagagcatgctttgggaaatgctgctccagtatttgggaaggaggaaaaaactgcattttctttttcttttctttcttttttttttttttttttttttgagacagagtcttgctctgtcacccaagctggagtacactggtgtgatctcagctcgctgcagcctccgcctcccgggttcaagtgattctgctgtctcagcctcctgagtagctgggactacaggcgtgcaccaccatgcctgtctagtttttttatttttagtagagacgaggtttcaccatgttgggaaggctggtcatgaactcctggcctcaagtgatctgcccgcctcagcctctcaaagtgctggcattataggcgtgagccaccacacccggcaaaaaactgcattttcttcactttggaagagagatcaaagttttctcgaaatcaaatttccactagaactttcccacctttctggattgctgcccctcaagatgggtgtatcaggcaggcccaggctgcagccctcagcctcccccttgccacccacaggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtgaggggcctgggctgccaccctgggtggggaaagaattcctgtgggctctgctccttctgcagttggtggacaacaaggcagacttggagggaaaggtgttaccatgccccgatgcagccccctgtggcagcggctcatccattcagggcaggacctctcccctgcactgttggcttgggaagaagagctggcctcccctcctcccgggagccctccctgaccactcccccatgcctgggctgggttctgtgcctccgcactggcttccctgggtaccctgtgcactgcatgattccacaccctgccatggaccaaacaccctagagtcagggcctgagtctcgcccatctcggtttccctgtgcctagctcagtgcctggcacacagtaagtctcaggtaggcagagtgagggaggagctggaagactataggcacctcataggcacgaggtgtcaagtgtgcccacagctgcccgtgctgatccaccctgttgtgccaggtggactcctatggcggctccctgcgttacaacgtgcgctacgagttggcccgtggcatgctggagccagtgcagcggccggacgtggtcctcatgggtgccgggtaccgcctcctctcccgaggccacacacccacccaacctggtgctctgaaccagcgccaggtccagttctctgaggtgggtggcgcctgagcccttagggctgggagcaaagggggatttaggctgggtaggcactgatgtgtgacccctgccaccttcacccatacccaggagcactgggtccatgagtctggccggccggtgcagcgcgcggagctgctgcaggtgctgcagagcctggaggccgtgctcatccagaccgtgtacaacaccaagatggccagcgtgggacttagcgacatcgccatggataccaccgtcacccatgccaccagccatggccgtgcccacagtgtggaggagtgcaggtgcctgagccggcagggctgggaaccacagagaccctagcaaggatagaggagaaacggcagggcctcaccgtccttgcagcgactcttttggtcctgtccccacagatgccccattggctattctggcttgtcctgcgagagctgtgatgcccacttcactcgggtgcctggtgggccctacctgggcacctgctctggttgcaattgcaatggccatgccagctcctgtgaccctgtgtatggccactgcctggtgagtagtgccagcagacacttgaacactaaaataggagaagggacaatgtgtgagattccctgtgttcatgagctcagcacaagcctccagaatgactgtcatgactgccagatgaactatcatgacctctggatgcaataacagaaatataggtcaggcgcagtggctcatgcctgtaatcccagcactttgggaagcctagatgggtggatcacttgaggtcaggagtttgagaccagcctggccaacatggtgaaaccccatttctactaaaaatacaaaaattagccaggcgtggtggcgtacgcctgtaatcccagctactcaggaggctgaggcaggaaaatcgcttgaacccgggaggtggaggttacagtaggccaagaccgtgcccctgcactccagcctgggcaacagagcaagactcagtctcagaaaaaaaaaacaacccagagatacagcatccagacaagggaggtgttggccctcctctccaccctcatcagactaatcctggagagtgccaaatgaagaagcatggcctgcagagggcaactctagggggaagagcccttggggtgggaccttatttcttaggaatagtggcgagagctgggattgtggagctgacagaagaaaaggctcaagcagggcagcattgtcatctccaaatccctgcaaaggtgtcgggtagaagaaacagactctggagagcagaactggccagtgggtgcagattggaagagggtggcaggtttaggtcaataaaaagcaggcatttggaaccatctatgggacaggctgccgtgtaagatgatgagctccccatcatctataagtggttgcagttgatgctcccctgtctgcaaagctgtgcctccagcgtgatggggaggctgagctagacagcctccaaggtcccccgcagcatctggcccagttctgctctagaagttgagccataccctcctccttcttctagaattgccagcacaacacggaggggccacagtgcaacaagtgcaaggctggcttctttggggacgccatgaaggccacggccacttcctgccggccctgcccttgcccatacatcgatgcctcccgcaggtcagccccagctccgggtcagggggggtttggctggggacagtgcaacaggccagagaatattctgggcagggaggcaggagacttggattcagatctctacctgatcactaagttatcccatgctcctggacctctctaggcctctgtttccttttctgtataatgggccccctgacttcctacagttgctgtgaggctgccgggcagggagatggcgtcatgcctcgtggcacactgtgtctgtgtagacagcagtcatttcccagggtgggaggagaaagcctgaccccagccctgccccatgccctgtccacttgatacctgcagattctcagacacttgcttcctggacacggatggccaagccacatgtgacgcctgtgccccaggctacactggccgccgctgtgagaggtgagggagagccttgggggctgcaggaagggggctcctgggtggggtcatggaagtgctgatggcggccccctctctcccctagctgtgcccccggatacgagggcaaccccatccagcccggcgggaagtgcaggcccgtcagtgagtatggctgccaccatcccctgacacccacctcccaacccaacctgggctgcacaccaggcaccctccctccctgccccagctcatgaaccttggggagccactgttcctctatctgcccggaccacgtatatcccattcccacctgccctgccaacactcgttttgtgtcccagaccaggagattgtgcgctgtgacgagcgtggcagcatggggacctccggggaggcctgccgctgtaaggtacgcgtgccatctgccacccacccaggggccttgggcccagcaccacagctgggaggaggaagaaggaagctccgtcctctccatagatccttggccagtgggtggtaacccagtcagaggctggtggacctggcccaccggccttccgtaccaggacaggtggcctggcgttgggaaggagcactggttagggagtcaggtgaccacagttcaagtcccagtcattctttatgcagcctttgtatctgcattgtacctttgcttttgccatactttgtccattgtcacattgatacaatgatatagatattagtgtccccaatttgtgaatgaggaaatggaggctcagagaagggaggtcacttgcgttaggaatgggagcatcggccgggcgcagtggctcacgcctgtaatcccagcactttgggaggctgaggtgggtggatcacttgaggtcaggagttcaagaccagcctggccaacatggtgaaaccccatctctactaaaaatgcaaaaattagccaggcgtggtggcgggcgcctataatcccagctactcaggaggctgaggcaggagaatcacttgaacctgggaagcagggttgcagtgagctgagaccgcaccactgtactccattgtaggcaacaagactgaaactccgtctcaaaaaaaaaaaaaaaaaaagaatgtgagtatcaagtgtcggtgtaaaaaagaatggatggattctggagtcaggcactcctggtcttaaatcccagagtggatgggcaagctgagtaactttgtgcaagtcatttcacatccctgagcctctgtttcctcatgtgaaggatgaaggtatcacctacctctcaaggtccttaggggagttaaatgaggtgatgtcgaatggaaagcagaacagtgcgtgaaacactccataaatagaagcagcaattatttcaatcaagtcgctgtatttcaagtctaaatttattggtgaaccccctggcagccaaagagaaaagggaaaaatgcttgcctaagtgcttgttaagtgggaattactattcagatggcaatgacgcctcatacatgtgctctttcttttcttttcttttctttttttttttttttttgagatggagtctcgctcccatcgcgtaggctggattgcagtggcgcgatctcggctcactgcaacctccacctcccggtttcaaacaattctccttcctcagcctcctgagtagctgggattacagctgtgtgccaccacgccaggctaatttttgtatttttaatagagacagggttttgccatgttggccaggctggtcttgaactcctgacctgaggtgatccacccgccttggcctcccaaagtgctgggattacaggcgtgagccaccgcgcccagccacatgtgctctttcagtggctcccctgggtcttgggttcttatctggactgagggtggattcggccagagctccaggcagcctctcccatgggctgtccttcagctccaactctgtgcctgcagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccaggtacctctgcaaggtgggcgggcaggaccgccaagccctgggccggatggaccaagcgccagtcccaggccacggcccccatcccagccctttctcctcctcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgggtagtgggtggaaaggcaaaggaaactccaggcagcaggaacagcgcaggcaaaggcttggaggcgggagggtcgtggtgccttgggagaatagtgagatacactgcatggaaaaggtggctggagcagtgacagggcccgaattcaggcctccgcaagctcctgtctaaccctggtcccaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggaggtgagcaatactgtcccctgggggtaggggtgcgggcaggcccttgctcctgcctctccggcattcaatactccaggacgtcaggggctgagcacatgtgtcctctccttggcagcaagcatggcagcggcccgatgggcagccagccacacgggagcacctgctgatggcactggcaggcatcgacaccctcctgatccgagcatcctacgcccagcagcccgctgagagcaggtgtctggagccggggcaggaggaccagcatgggcttggggaggggctccatctaagcggtgcagtacagcacagccacttacagactgtgtgacccttttgtgcctcactttccctgtctgtaaaacggagagtcttaacaatgtctcccatacaggctggtctggggccaggctccctagaaagaagcctgagacggggattggggtgcatgtgattcacaaggagagggacgcaggaggggggaggggccatgcagggatatggtttcaggtcaagtctagccccagcctcagcccacagggagctctggagagtcattcgccggagagtgatcgttctttcaggcccgtgggctcttgtagcctgtatcagcctgtcattggggaccccaggggaacgaggtggtataacctctccaggtgaggaagggtgatggtttggagtaagttgcaggtaacagctgtttgccacggtcctcgcagcctctggagatctggacagggccccagcagcactgtgacagggctgtcgggaggactaataagaccctgccagtggaggactccaggcgtgcctggcacagagccagcactcctattcacgctgggtcttgtcacgcccagggtctctggcatcagcatggacgtggctgtgcccgaggaaaccggccaggaccccgcgctggaagtggaacagtgctcctgcccacccgggtaccgtgggccgtcctgccaggtgagtcctgggccccacgccagcccagccagccccctccatggtgcttcccgctccttctccatgagccctccacacctccccagccctggccatccagtgcccctacctgaatgggccgtgttcggaagtccctcccactgccatctttctgcccccaggactgtgacacaggctacacacgcacgcccagtggcctctacctgggtacctgtgaacgctgcagctgccatggccactcagaggcctgcgagccagaaacaggtgcctgccaggtaagtcccgccctccttccgcccaccccagcaatctgtggcctctggaggcccagcctcaactcacatcctgctcctccagggctgccagcatcacacggagggccctcggtgtgagcagtgccagccaggatactacggggacgcccagcgggggacaccacaggactgccagctgtgcccctgctacggagaccctgctgccggccagtgcgtccagtccctgcctgcacctgcccttccctgaaatgtctaccacccgctcccacacccgcttcatccagggcccttctgagaggcagtggttaaatcctggccttactgcctgctcagtgtcacttggtgtgagatacacttcactttcagggcctcagctgcctcatctgtgaaatggggtagtccaccctcctcagccccttgtgtgagagttgaatgaggctatgcatgtggaactcttagcacagtgccaggcatgcagtggcactgaggacacatgagttcacatgcctgttcttcccctcccctctcccctggtcctgaaggaggatcgggggagaggaaggagccactgcgttcctgactagaaatctgcccccacactcagggctgcccacacttgttttctggacacagacggccaccccacctgtgatgcgtgctccccaggccacagtgggcgtcactgtgagaggtgaggcagggggtggagagggtggggggatgcgcacagggggtgtccctggaatcctcaggcagggcccagcgctcccaacccagaggaatcagggatgcctctcgctcttaacctcgcacaggccccagaagacagtcagctcccctcctcgggagactcaacctctagcccagaattcaagaccctcagacacacatcctagcctgcggttcaccttcagccccctggccccctgccccagccaggccagagtcttcccacaaaacccctgcttctttctgaaactcctgggttcctacctgccccaattcactggctgtgcggtccagggcacgtccctgctcttctctgcccagtttccccgtaacatgggcgagtcaggctcttcttttcttccagtgcatgaggccattgaattcaatatggggccctcagcccagccctggggttctgcttcccttcatccaaaattcatcagaggctttttctctctgcaggtgcgcccctggctactatggcaaccccagccagggccagccatgccagagtgagtaggattggggaggtcattggggtcgggttacccagagtccctagggcggagctaggacagaagcctttactcccctttggctttgcctgtccgagcctgtttcttcatctgtaaaatggggataggagaaggccccaccacctccgagggctgtcgtgagagtgttgagtactcacatcagaaatcagagctcccgctcagtggtgagcagagtggagggaagaggggtgctgggtggcgggtttggggctccagccatggctttcttccacctcaggagacagccaggtgccagggcccataggctgcaactgtgacccccaaggcagcgtcagcagccagtgtgatgctgctggtcagtgccagtgcaaggtcagtccgaatccctgtccctgcggggcctgctctgccccgctgcccagaccctgcggggaaatcaggcagcatctggtggaagccgagacctgggcatggggggcagggcatgggggacagggcaggggctgcccggggctgctggaagtggccagggaggctggcctcaggctgctgggggtgcaggagacccactgagtcccctgcctgcctccttccatccgtctacccaggcccaggtggaaggcctcacttgcagccactgccggccccaccacttccacctgagtgccagcaacccagacggctgcctgccctgcttctgtatgggcatcacccagcagtgcgccagctctgcctacacacgccacctggtgagagcctgtgctgcccagccccaggcggtgttgccacctgctgcctgttactgtccatctgagcactgagcccagcgaccctcatccccgcctcagtaccctcacatgcccccattatttctctcgcagtcctgatctcaacaggaccccattccgcaccttaacaccctcccgtgccccatcccccaccaaggcaccccggtgctcaggctgacgccccctcctttttcccctgccagatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtgggccccagccaagcaccagggtcagccgtgactcagacatgagttcacctctgcgccgtctctcagcaggcaggcacctgccacctgcatggccatatcgtggttaggcacgtggcttttgcagtcccatagacattggtctgaaccccagctctgccgcttgccagccagacaccatttgataaacctcaacttcatggtggctgaggggattggagatcgtgcctggcacataataagtgctcagctgttcatgacttttagctttcatgcagttattctacaaacagatctgggagaggccgggaaatataaagacaagtgagacacagtttcagtgtcattcacgtgcccgctccgacttcactcatccacactgctggctctgtgcttgtgttggacacagtaattctcatgataggtcatgtgtgttgagctctcactatgtgctaggcagcatcctttacaaatcacaaatcacaactgtgtgagacaggtcctgctactgccccatttcataaataaggcaagaggggcttggtaacttacccaaagccccgcagctgggaggtgggaatgccgggatccaaacccaggtcagaggctgcccttcaaatgctctgccaaaggccagagcccacacctgtaattccagcactttggaaggctgaggcgggaggaccacttgagctcaggagtttgagaccagcctgggcaatgtgacgaaaccccgtctctacaaaaagtacaaaaaattagctgggcgtgttggtgcatgcctgtagtcccagctatttagggaggctgaggtgggaggatcgctggtacccaggatggggaggttgcagtgagccataattgcaccattgcactccagcctgggtgacagagtaagaccctgtctcaaaaaaaaaaaaaaaaaaacaaatactctgccagtcagaggtgaacctgtctttgctactccagaacagggtctggtggaaaggtggtgatgatggtggtggcgatggtgtgatggtgttgtggggggcaggggctcaggggtgggctctgggacaacctgcccaaatgtgttcttgagcagcacgggcatccggtggcacccacgctctggggttggggttgccctatccctgttcgttggacacagccaggtactccaggcttctcccggggctggctgccttctggtcccttctcccctctcccttctggggttcgctatctcctggcctccctgctgccctgtcctgcaattctcagacctatctctgtctcctgtcctggcatttccctgcgccccacagggggaggcgtactttgcgcggatgcgccgggctcaccaggtaggcccaggacgtgcgtggtgtgaagttggtgtggtggggcgtggtgccttctcgggtgctcccagccctgcgtggggagatgcgcagtgcccaaggcattgggggtctgcatgaatccaggcggtgtcccatgaccccagggttggagccaggagggtatgtgcctcaccttgcctcacctgctgtgtggtctggtcctggtgccaactgtctgaagtcagaatggcaactgaggtagcaaggagactaacccgatgctaatccacatgactgtatctagccccccgggttcccctggccttgcctctcaagcaaccaccatgaaccctctgtgtgcatgtgggcggcctggagttaacccttgggtgccagcctggagagggggggcatgcatctttcttcctaattagtgtgggcctttctgactaccatgtccgtgggtagaggaccctgcccatggctctagctccaggactttgggaggtcttagctcgcctgctccctccatttcatcagaaccgcacatccctctcagaggagcagttgcgggcagccgtgacagctgggaggatcccagagcccccagagggcagggactgggcacagcgggcatcacaggtaactgaggacctggctaggacaggttgtacctagggccacagcgaggagaccagagagctgagtccaggcaggcacctgagcgaagactccagctttcctgggccatttcccctatgccaggccaggccccagcctgatgcctggtctgctctggtgtctcccctgggaaacattccagaaccatgaatggcttgggctgttgccagggcacacaaagagagtcaggccgaggagcaacaaccccgtccagatgcccctggggctgcctccagcacttctgcccctcccttgctgggcaccctttgtagggcttctcccatcagtcacggcccataggcagccaaacccatcccgggatatccccgcctagctcaggaggaacaagagggcagtgggtacaagggccagagtgccaggtatcagcacttgtgagcagacagtgcagagcgggtggctggctgggcccgtggggaggtgaagcctcacggacgtcctttctgtccctctctgctcccttctgccgctcttcggctcctggtcccccaggtggacgaggctcagagacggatggatgctgagatctggcagctcctgtccagctttgctgcccaaccccaaccccctccccaggggctctctcctcatccccagcctgcagctgctctgcgagcagcacctcctccttcttcttcctcctcctcctcctcttcctcagcttctctgtctttctcaccaggctctcaggtatgtgccaaggtgcccatcaagggatccccacccaccatgctttctagacttcagtcatttctgaaccaacttcaccaatttctgtgaactacttggactattatttctttccaattttctcttaaatcaatcatgtaccaactcaggctggttactctctttcaaatacatatgaaaggagccatcccattgaaattgtttactgatgtgctgtgtaaacgttggtccacaaaagagacccaccagatgggaggagaagccgacccaggccacgcccagagagagcagctggggacctgggccgggattgggaagaaagtcgtccaaagagcaaggccaggacccgcactgtcgggtgggagtggggggctctgtctctctgccctgccaccaggcctccctcccatgacggtccacccctgccggaaccacctccgccctcccacccccacccctgctcccctcggctcttaccacctgcccttccctcctagttctctctctcctacgaaggcttctctctgcttcctggaagcctctattactggcagctgccccgggccttcctgggggacaaggtaacaaggatttggggggattataggggtgtcatagaatcccaaaatatcagagggccctttgtcaaggccctttatgacacaaatggggagaccgaggctcacggtgggtagagacttgcctggggtctcatgttcaggtcagagcacagctgagactgaactcagctctgcccctgtccttcagcgggccctgacccctgacccctggcccctgacccctgtcagaggagctgtctcgcctgggagggtttctctagtgccttttctctgggcttccttgaccttgtgtctagatgctggcctagtttttggtacttcactcagtcattcaagaagcattaattatttactgtgtgctgcgtcgtgtacaggccgagtgggccctggcctcccagagctccctgtccatcccattatcattcctgtcaccatcagtatcattattattatcatcatgagtgctggcattggccttagatgagtattcatattgcctctattttgttccaacaatttcaagtacctcttaagaatacacatagcaggctgggcgtggtggctcacacctgtaatcccaacactttgggagactggggcaggcgaacacctgaggtcaggagttcgagaccagcctggccaacatggtgaaaccctgtctctactaaaataacaaaaattagctgggcgtggtggcgggtgcctgtaatctcagctacttaggagactgaggctgtagaattgcttgaacctgggaggcggaggttgcagtgagcctagatcatgccacttcactccagcctgggcaacagagcaagactccatctcaaagaaaaaaaaaaaattcagcttcctggctgggtgcggtggctcatgcctataatcgcagcactttgggagactggggcaggcagaacacctgaggacaggagtttgagaccagcctggccaacatggggaaaccctgtctctactaaaaatacaaaaactagccgggtgtgttggcaggcacctgtaatcctactgcttgggaggctgaagggggagaatcacttgaacccgggaggcagagattacagtgagctgagattgcagcactgtactccagctgggcaacaagagtgaaactccatctcaaaaaacaaacaaaaaaaagaataggcagtcacaaggtacattcagagaagtgagacagggaggttgaggggtgaggataagaagcaatctgctggagccgagggtggagctggagtactgcagggttatcaagcgtgatatgcattctcaaactgtgtggagtacatcaccatttgtgtcctatattacttaatcctcatgatacccttcaaagtgggtattacttttacttccatttccatgtgaggaaagtagggctcagagaggtgaagcgacttgtccaaggctgtatagccagtagagctagagtttgaacccaggtcattcagactgtggagtctgccgttttaatcactatgctggatctgggtacaatggctcacacctataatcccagcactttgggagactgaggctgaaaaatcgcttcaggccaggagttgagaccagcttaagcaacatagcgaaatgctgtctctaaaaaaataaatcggccgggcatggtggctcattcctgtaatcccagcattttgggaggctgaggcaggacaatcgcttgagtccaggagtttgagaccagcctgagcaacatagggagaccccatctctatttaaaaaaaaaaaaaagtgcctgagcaacatagggcgaccccatctctatttaaaaaaaaaaggtgaaaaaaaaaataaaaaatttttaaaaatcactgtgctgtacacacctgcaacttgccagaaagtcagtcccagaaatggctgtgaactttctggcattcaaagcaagcaggaaaccagttattttatggttatttggttccactccaaaattccttaccatgccttgagctcatggagaatatccctgtagccatgtagcccagggccgtgtgtgtaatcagcaggtgtttgataaatgctggttagctgagtgaacacacaaatgaacaaagaggtaggcttgatgcagtttggtattgagatgaatgtctgccctggtggcagaggagagaaagcaaagtcctgtgggacagagctggggagcctcagctgtccacgtgaaggtcctctgcagcagaagtaaggactccccagtcatgagcaacacagtgcccaagtccagtgggcttgtctgcaacaaagaatctatcggctcatgcaactgcagagtctaagcatgtatggtgtcaggcatggccttatccaggggctcattagggctttatcttggttctccagcttctcatctgactgcagaagggactttctctggcctggtagaaagagcataagtgcacgggttacttgtctatccctgatggggtggcaaagggcagtggtaggttatgcagattggccaggcctggctcatgtctccactatagaggaggaggggatcagggccctcagaccacatggtctgcatgtgcggagacagttgttctttatagaaaaccacggtttagtttctagaaagcaggaactggatactgggcaaacaaaaaccacctgcctaggaggcaaggcctccgaggggctgccgtcagccccacccccatggctgagaacttttgaagcttccgcagcctccccatggtggtcattgtcattacacttgtctgccttatgggaaattcctgtaaatgaaagcagacctggagtttgttcgccggcaccgtcaggcaatggggaatagagaaccttgcagagcaaagaggctgctcagcatcatcaccaccatgtctggggctacagaggaactgagaaatgtcctgtttcccaggcaaccatgcaccctggcctcttggtttgggcagggaggggggtgggggagtgtggcacaggtgcaaaaaggccgccagatgctccatccctcacctatatggtccaacactcacaccccaaggtcagcctgtgacctctgggcttgcctctttgcaggtggcggcctacggtgggaagttgcgatacaccctctcctacacagcaggcccacagggcagcccactctctgaccccgatgtgcagatcacggtgagcatttggacaccatgctgggtgggcagaagggcaggatggaagccaggggcaccctcggcatttgtcctttgtcctttccatccagcactcagttttctggcacaggctgggggagttaggcccatgcccccacatccctgcctggttggacactacccaagcagaggatcctgctgctgggagaagggggcagtgggcatgtgcctgactcctttgggcgcatgagcttgggagagcagagaggtgggaggctgggggttacagagaatctaggactggtggaggacaccctggcaccccagggacccctcggctccccttccaatcctgctggtgtctttccagggcaacaacatcatgctagtggcctcccagccagcgctgcagggccctgagaggaggagctacgagatcatgttccgagaggtaaggggcacctggccatgctgtgtctaaccccaccccaccctccaccctgactcagagcctggctttgatacccaccctgtctctcgctccccaaccttcacctggcagccctcagtcagtgcctgtaaggcaggatttggggggtggtaactgtaggagcagcccacaaagcccactgcccccgcccacgttgccacccccaacccaggaattctggcgccggcccgatgggcagccggccacacgcgagcacctcctgatggcactggccgacctggatgagctcctgatccgggccacgttctcctccgtgccgctggcggccagcatcagcgcagtcagcctggaggtcgcccagccggggccctcaaacagaccccgcgccctcgaggtggaggagtgccgctgcccgccaggctacatcggtctgtcctgccaggtgagtgtgtggccagctccaccacctctgcacaggcacagaggcatcagcaagcaaatcagccggcgtcgccgcagccttgattaccatcataactataatgacccctgcatctgggccctgcatgtattcctcccgacagccctgagttacatatcattatcccctttaacaggtaaaaaaatagaggtgctgaggggtgagtgtgtcccaagggcacacggctaatgtgtggcagaaactaatttgaacctgggtctgattgactccaaagcctagcatgtcctaaccactgggcagtgcagcctcacgtttgggccacactctccgggggttaaaacccagttcatgcccttgagggggcccaccagagacagggagccaattcagaaacacagattactccggcccaaagcacagcatagagatgcctcccagaggtgaacagtgtggactgggagagggccgtgggtgggaggacagactgagcagaagtggggaaggaggggcgccggcctgtgatgttccagggtcacccctgggaggacactggagggaggggttctgggtctgctggctgtgggtggggcacgttgggaacagaggccaaccttcctctctgcccctaggactgtgcccccggctacacgcgcaccgggagtgggctctacctcggccactgcgagctatgtgaatgcaatggccactcagacctgtgccacccagagactggggcctgctcggtgagctgcaagcgaggccaggacagggggtcagctcagctgggcctgggtgggggaccagggctggacaaggcaggcatcaatccaggggatcaggatcatggggcatggcctgtggttcaaagcacctgggtcagcaggccaggtcaccggggatggtggggtggccagagctatggaataacatccttctgtgtaaagaaaactttggttctttactatttttttctttttcttaaaaaaattttttttatctaatacagatggggtctcactttgttgctcagaaggtcttaaactcctgagctcaagcaacccacccgcctcggcctcccagagtgctgggattacaggcgtgagccaccacacctggcctttttactttttttttttttttgagacagggtctcagtctcgttctgcctcctgggttcaagtgaatctcatgcctcagcctcccgagtagctgggactacagacatgagccactgtgcctggcctcattacatatattttttataccttgacttttcagagtagcatgtatatagccccccagggtacgcagtgaaggggcaggtggttgacagccataacctaaacttggagcaaggaacaccctattgttgataccacaaacgtgaatctctttggaggagaatctgtaacccacatgtttttatgaggatgcacgtattttctttttcttttctttttcttttttttttcaagacagtctcgctccgtcacccaggctggagtgcagtggcgccatctgggctcactgcaagctccacctcctgggttcacgccattctcctgcctcagcctcccgagtagctgggactacaggcgcccgctaccacacccggctaattttttgtgtttttagtagaggcggggtttcacctgtgtcagccaggatggtctcgatctcctgaccttgtgatccacccgccttggcctcccaaagtgctgggattacaggtgtgagccaccacacccagcctcttttttttttttttttttttttttttttgagatggagtctcgcttttgtcacccaggctggagtgcaatggcacaatctcggctcactgcaagctccgcctcctgggttcacgccattctcctgcctcagcctctggagtagctgggattacaggcacctgccaccatgcctggcgaatttttgtatttttagtagagatgggatttcaccatgttggcaggctggtctctaactcctgatctcaggtgatccacccacgtcctgagattacaggcgtgagccactgtgcccggctgacaatacacatttttaatgctctgcccccaaatacctgagtgtatacctttcctttgctatcacaggtacttagggagaaaatagaattagcatcaccctttttgacagctatttggatggatgtactttttaatttatccaattccctattcatggatgtttaggtttgtttctagctttttttgcttttttcttttttttttttttgagatggagtctcgctctgttgcccaggctggagtgcagtggtgcaatctcggctcactccaacctccacctcctggattcaagcaactctcctgcctcagcctcctgagtagctgggactacagacgcacaccaccatacccagctaatttttgtatttgttagtagagatggggtttcaccgtgtcagccagttggccttgaactcctgacctcaggtgatccacccgcctcggcctcccagagtgctgggattacaggcatgagtcactgtgcccagcccattttgctttttataaacaccacggagatgagtgtccttgtaatgaaatctttgtgcccttccatgattctttctttaagatgagttcacaaacttggaatttctagatcaagggattgcaaccctgaaaggcttctggtaaatttggcctaatggctggtgcctgccctccttgtgccctgcagcaatgccagcacaacgccgcaggggagttctgcgagctttgtgcccctggctactacggagatgccacagccgggacgcctgaggactgccagccctgtgcctgcccactgaccaacccagagaacatgtgggtaccctagctcaaggcccaaggacacacttccactggggaatgagtggaaggcgttgcactggcttttggggcagaagtgaagggagcaagatggagattgggcttcccatgacctgacctttgcctccccgatcccaggttttcccgcacctgtgagagcctgggagccggcgggtaccgctgcacggcctgcgaacccggctacactggccagtactgtgagcagtaagtttgtaaacagaagtagggggagggtggaggacaaatggtggactcccaagtgagagccttaaagggtgttgctcagaaaagtctcttctaggattatgctccttccctgcctcaaacacttctaagacacctcattgctcttgggacaagcccaccctccttaggcagctttactgtagcagtctcatcccacttctgacacccaactctgtactttagctgggcttaactttttaaatgctttttctttctttttttttttttaaactgagacagggtctcactgtgttgcccaggctggtcttaaactcctgggctcaagcagtcctcctgcctcagtgctggcattacaggcgtgagccaccatgcccagccactttttgaattcttgatgttcaggccttgcttatgctgttccctctgcatggaacagtcttcacccctaaaccacccgttcctggctaacttccccttagccttcagacccagcttcattcactcattcagcaaatttttatcaagcagctcctgtgtaccatgctgtgtgctgaggtgttggagataatggagtgaacagaacagattccaccccagcccttacggagtctgccacctaataagagatcagccctaatgggagataagacagggaaaaagtaattgtgcaaatgtgtatttacaaaccatgttaagttatctgaaagaaaagtacagcctgctctgaggtaatacgagaagtcccatcctcttggaagcctccctggctctccaggctgggccagtgccctcctctgcacccgcacagccctgatatgcttcctgcactctcattttcatgtagaatttccatgttgggttcccaactagtaagtcccacagaccagggactttatcacattcattgttgtatttccaacacctatagcacatgcctggcattcagtcattgcttaatggacatttgctggccaggcgtggtggctcatgcctataatcccagcactttgggaggctgaggtgggcggatcatgaggtcaggagatcgagaccatcctggctagcacatcctgcctctactaaaaatacaaaaaattagctgggtgtggtggcgcacccctgcagtcccagctaattgggaggctgaggcaggagaatggtgtgaaccccggagacggagtttgcagtgagccgagatcgcaccactgcactcgagcctgggtgacagagcgagaatctgtctcaaaaaaaaaaatggacgtttgctgaatgaatttctctggagaatagagaccttacctctctcatcacccaacctgctaacactcccttacactcccctttctcagttcaccagcaccctgcgttggggcctgtctggtccccaaagtgcttccagagctccgagcctcctcacctgacattgggtggcctgctgagcttctggctccccaagtccaccatgaggcactggggcccttgaggcctgacattgccggcccttgttcccccttacaggtgtggcccaggttacgtgggtaaccccagtgtgcaagggggccagtgcctgccagagagtaagtgggaccatggcccaggatggggacgatgggcaaggcagggagccctgggaatttgggggatactgggtctggggacagggctgagggtggggtaccccagcttttgggagagcagagatattgaagacaatgctgaaaggcccttcctgtcccggcccccacccccagcaaaccaagccccactggtggtcgaggtccatcctgctcgaagcatagtgccccaaggtggctcccactccctgcggtgtcaggtcagtgggagcccaccccactacttctattggtcccgtgaggatgggcggcctgtgcccagcggcacccagcagcgacatcaaggtacccatggccctaggctcctcagccccaagagccatcccagtgggaggggaggcaggggcctgtccctgccctagtgggatgctgtccttgtgcatggggctggatgtgagaaagagtgtatctgcaccaacaagctcttgtctcctccccaccaggctccgagctccacttccccagcgtccagccctcggatgctggggtctacatttgcacctgccgtaatctccaccaatccaataccagccgggcagagctgctggtcactggtgagtccctacgccccctgtaaccaagactgcctgtcctgggctgggctgcaggctgcagattcaggcagatggtgcattcacctgctgggagggggcagtggttgcccgaacaaggtcagcagccatggagatgaggagaggtggcagattcaagactcattttagaggtaggatcagcaggacttgactggtcggtgagggcaaaagaaaagggtgggccgggcacggtgggtcacgtctataatcccaacactttgggaggccaaggtgggcagatcatgaggtcaggagttcgagaccagcctggccaacgtcgtaaaaccctgtctctagtacaaatgaaaaaattagctgggcatggtggtacacacctataatcccagctactcgggagaactgaggcaggagaattgcttgaacccgggaggtggaggttgcagtgagccaagattgcgccactgcactccagcctgggcaacagagcaagactctgtcttaaaaaaataataataataatgcacctcagagtcaccctgccctgtcgtccagggaaaagtgagacagggatgggagggcgtccataaaggctgtgtcaccaagcagattgccaccgtgagcagttgttgcttagtacaaccgaggaagcttttaaagggagccggtgtaaaacacgcacctcaaagtcaccctgccctggggtccaaggagctgcagtatgtctaggccagcttctgtcagtcattgactgagacctattctgggagcatcaagtcccctgcacatctgtcccacccatgggtgtgcactgtgggctccagtggcctgagaaagccctcaatgcaaagaagtgcagtggctggcagaagtcaggcaggtgggcacggggggtgggaagcgtggctaggccaccagcagcacaggctacaaacaggtcagagagaatcgcaagtttgttttggacgtgttagagtctgagatgtttgggaagatatctcattgagtccaccaggcaggcatttgggtatgtgagtctgaactccagtaagaggccccagccagagaaatgagtatggttgctgttggcacagggatggtgttcaaagctatgggacaggatgaagtcacctagggagagtgtggcccgaggacagggccccagcccagagtcctgaggagctccagtgtgaacatgtcaaatggaagaggaagggcaggaagagcctgagagagtgcagccatgaggcaggaagagacagggggcatcatgggaatcagagggaaaagggctttcagggcagcctccctgctgggaagtcacataagggcagagaaatagcccttggaggtcatgctttgacaagagcggttttcagtggagagaagggatagaaaccagattggaaggaggcgacacatgggtgggaaggcagcgagtgtggacaactcctgcaagagtcttggctctgaagggaggccaggaagtgggtcattgactgcgagagcatgaggtcaagggggagttttcggaaatgggaaatcctagaatgcactctggaccgaagtgatcgcatgagaaggaggagacgctgatgttgcgagagcagaagaagccccggggaggggtggcactcaggcgcagcagtgggatggggtgagggcaggagaaggggcctgtccttcagggaccagtatctagagagctggtagatttgagaggctgggaaaactcctgacttgtcgtttctattttctccataagtgtgtgtcagcgccactagctaagaaagtggaagggtggttggagaggctggaggagatgggaggaggtgtgaaatagttgtttttgggggatagaaactcaaaccagacggagaaacccagttggagtggggtgtgatgtgtcaggagctcattgtggtctgtgatcaggaactggagccaagtggacccatggtgtgatgttccccaaccacatcctgtggccactctgtgctggcaaggagggtggggatggtggggttcagccagaatgggggagggaggtgccagggggtagaatgagagctaggctggaccaggaaggaagtgatgcctagaggttatggagaaagacaaagtggccacaggaccggggcctagccagcaccggctcacaggggggcttcccgtccctgcagaggctccaagcaagcccatcacagtgactgtggaggagcagcggagccagagcgtgcgccccggagctgacgtcaccttcatctgcacagccaaaagcaaggtgtgcaggtcagggagtggggatggaggaagtctgtcttctggggtctctgagccccacccatgaccccctttcgccttgccctgcagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcagggtacacctcccatctatacctgattctcccctcctgtctctcccccattcccaccagaattagcacagcatttcttcattctgctgatcatttctgagcacctgctgcatgcctggtcctggtctaggctctgcagaagcaggggagagaagcatgtacagtatctcggtcctcctgaagtacacgtcctaggcagggagaccataagcatgggaataaatgaacaagcaagataactacacatggcgatgagtgccaggctaggaatgatgagaaagcaagaaacaaggtgggagaaggccaggagcggtggctcacacctgtaagcccagcactttgggaggctgaggcaggtggatcacttgaggtcaggagttccagaccagcctggccaacaggtgaaaccctgtctctactaaaaatacaaaaactagctgggtgtggtggcaggtgcctataatcccagctactcaggaggctgaggcaggagaatcgcttgaacccgggaggcttaggttgcagtgagccgagatcgcgccactgcactccagcctgggtgacagagcaagaatccatctcagaaaaataaataaaataaaacaaggtgggagaggcaagggctactctagatagggcagtcagggagggcctctctgaggaggtgacacctaagctgagacctgaaggaaaggtaggcattgagcaagttagagagttggcagagtgttcttggcagagggagcagcacatggcaaggccctgaggcaggagcacgttgctatgtttgaggaacagcagagaccacgtggctggggctgtgggagggaggacgggtgtgggcagacgggagagcatggagtatgtggtggatcagggtaggaattttggattttattctaaaagcaacagggagtcatggacaggtctcaaggtgggaggtcacaaggtcctgttgacatttcccaagctccctctggctcctgtgtgcacagatggccgtggagggctagcctggaagcagagaaagtaggcagcaggactgttgtgtgagtcagacgacactccccaccctgagtgcatgttccttttcctcccttgtcagcctcgggcaccttgtccgcccccgtggtctccatccatccgccacagctcacagtgcagcccgggcaactggcggagttccgctgcagcgccacagggagccccacgcccaccctcgagtggacaggtgaggccgtgatgggaatgacattcaaggcctgactctcctgggtgtgggaggggaggggcaggactctgagcaggcttggtgggtgctgaccccacgtctactcgtcagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatggtgagaggccgggctcagggtgggggccgggagtgtgctcagcccagggcgtgttctcacaggactctgtctgcagggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggtgaggagatgggcccacccaggaggaggaggcccacaggctctgcagagagtcccagccaccttccctcccccttcacgccccaccccacctcctcctctgtggctcccttcacctccaagatggtggtctcctgcccctgcatcccagcagggagcccctgccgtcctcttggctgcctggcgtttgtcctccttcatgccccactgggccctaatattggccctgcacctgcctctcccttttatgccctatctgtccccctggccagccgttgtccagctgcctctggggcagctgacccatctcacccacggcaggcccggtcagagcgcacagacatcgcgacactgctcatcccagccatcacgactgctgacgccggcttctacctctgcgtggccaccagccctgcaggcactgcccaggcccggatccaagtggttgtcctttcaggtacggactctctgggaatggaggggtggggagggcaagccagggctcccctggggcctgctgacccctactctggccccagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtatgtgggccctgagcctatggcaggggacccagggtgcaggggctgtggcggaggcggggcctgtacgctgggcgggggaggcggcacactgccccacacgttccaccagcagaagccaggcctcatctccctccctcccagtttctagcatgggatggctcggagcagagccagtgagagtttgaatgaatcactgaggctgagggagtggtgacaatagcccccgtccctgtcctcacgtacctctggctcctcctggcccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccaggtgaggagccaggtgtggctgggccggggctgagccctaggagctcccaaggaagatgcctgtggcttcttcagtgggaccaggacaggggggcattccaggcaggctttgacccttcagcgcctgctcagagagagaaggaggttgagtggacgggagggaggttaaggctggtccagcttacctgggctccctatgagtgactgtttcagaatttgtcaggaagcagcagaatgtccaggttgaatactaagctgggagtcggctgacctggttcaaatcccagatctgccccttagcaaccttgaactagcttttaacttttggggcctcagattcatctatgaaatggagcagtactgcccacctgcttggtcatggtgtggtttttttattattttattttattttattttattttattttattttattttatttttttgagagagagtctcgctctgtcacccaggctggagtgcagtggcgcgtgatctcggctcactgcaagctccgccttccgggttcacaccattctcctgcctcagccttctgagtagctaggactacaggcacacccgccaccaggccggctaattttttgtattttttttagtagagacggggtttcaccgtgttagccaggatggtctcgatctcctgacctcgtgatccgaccgtctcagcctcccaaagtgctgggattataggcatgagccaccgcgcctggccagtcatggtgtggtttaaatgagacagtgtctatggaaagtacttgtgagcacacggaagacgtcctgtagaagggaggtgtctcactgtcatccgcatccttgggcgcagcctgggtagtaaagcttgctggttccctatgggccagaggagctcatcatcaagaagtcatgggtgggtcaatgggcctccagcttgtggttagaggctggggagggaagaagccatattcggctggccatgtggaggcagaagggtgtggccctagtcccagaaaggccacctgtcggccgtccccactagggcctggtcacagcccagagccttctgccccagggctacaggttacagcccaagagttcaggcctctgagcagccgctctgtgtccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccaggtatggcagccccccgggaccaccttgctggaggggctggatgggactgttccagccccctcccaacccaccccatttgcacacagacccacggctcgctgctgcggctgcaccaggtgaccccggccgactcaggcgagtatgtgtgccatgtggtgggcacctccggccccctagaggcctcagtcctggtcaccatcgaagcctctgtcatccctggtgagtgactcccagtgacatggaaagctggaggaggcagagaggcctccggggtggtgagatccaagggacccctcttgctgacagggcagaaggcccacaccggagctggctgcagggccctgcccaggccgactccacctgtcagagtaaccaccgccttcccgtcacactttgctttggccacatgactcctcaggcgtcccctcccacctcctcttcctctctccaactcatctctgccctcatctctctcacttcctcactcccctctgcaaggcgtggcccatgccctggtcctcccatcagggttgctgagctgagggcatcaagtccaggcccccagatgcctgaaaagctggatctggccttgaaaccctgggctgagctagctgcagggtgggcaacccctgccctctcatctcaggagcatctacaactctcactcccatccccactgctgcaggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggtacagggcaccaagaatgtgggacggggccatggacagtgggttgcaggatcctggcccctaggctgaggggctggcacttcctagatcggggggacagcggtggggcatttgctggcctccgggaagcccccctcacacctctgcccacggctgcccaggttcgtggctcccgcctgtacatcttccaggcctcacctgccgatgcgggacagtacgtctgccgggccagcaacggcatggaggcctccatcacggtcacagtaactgggacccagggggccaacttagcctaccgtgagtggggccaccaggctgggctgggatgcagagaacaggctggagtggcttcagagaacaggagtgaccggtgaccatcttatccctcagctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccaggtatgggactggaggacagacaggccaagaagaggaagcgggtccctgggtggcggaggttattgggggagggctagaggctcccctgagatcaggaagccctggaccccattgcacagatgtatagtgcagtggttagaaaccagaatctaggactgactaacctgggtgtgaattctggctccaccacttagcttgtgacctcggacaagttacttaacctctctgtgctatagtttcagggcctataaaatggtaacaatggtacgtaccagccgggcacggtggcttacgcctgtaatcccagcactttgggaggccgaggtgggcgaatcgcctgaggtcgggagttcgagaccagcctggccagtatggtgaaaccccatctctattaaaaatataaaaattagccgggcatagtggcaggcgcctgtaatcccagctactcgggaagctgaggcaggagaatcgcttgaacccaggaggcggaggctgcagtgagccaagatcacgccattgcactccagcctgggcaacagagcgagactcagtctcaaaaaaaaaaaaaaaagtacctcacagaattatcttaaagattaaaatatatgcaaaatcctcagagcttaggctcacagaaagtactctaagctgttaatattttactataatgccattagctattgttgttaccatattttgtagaatttaggataccactgattgcgagatccgctatgattttatgtacctctaagaaaaagcttctatttgtaaggttattcattgtagatgcatcttgattttggagacatcgaaatgtgtgtctagaattgatgggatgtggtgtgagtgtgtacccagctcactggggctcctctggtctaccaccccgctgctggacaagagtcccccttccccatgtgaaggacagggaaactgatccagagctgatggccaggccttgggggtcagagtgaggcagggttgcaggttataggaacaggggtctcctgagggctccctctgactcacccccattctggccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctggtgagtagctctcagggagggcagggctggggacccagggtgggaggccccccactcttgcaacggcaggatcaggaggccaagccgcagactgcacctgccttgagaccaggagccccatctcatctcacctcctagccggctattgaccctttgccctctgtccccagcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtaggaggcaggagctcaggaagcctgaaggaccctgtagctgcagtacaagagcataggcttgaccgggcgcagtggctcacgcctgtaatcccggcactttgggaggccaaggcaggaagatcacgaggtcaggagtttgagaccagcctgaccaacataatgaaaccccatctctactgaaaatccacaaattagccgggcgtggtggtgcgcgcctgtaatcccagctactcgggaggctgaggcaggagaatcgcctgaacccaggaggcggaggttgcagtgagccgagatcgtgccgttgcactccagcctgggcgacagagcaagactccgtctcaaaaaaaaaaaaccacaggctttgaactcaggcatgttcgagttcagacactgttccgctacttgcatgctgtgtgactttaggccagtcacttgtcacttgattctctgaccctcagtgtcctatgattttatgtacctctaagaaaaagcttccatttgtaaggttattcattgtagatgcatcttgattttggagacactgaaatgtgtgtctagaattgatgggatgtggtgtgagtgtgtacccagctcactggggctcctctggtctaccaccccgctgctggacaagagtcccccttccccatgtgaaggacagggacagtgatccagagctgatggccaggccttgggggtcagagtgaggggccaaatgggctcatgctgcctacctcatctcccctgtagcatgtcaacaaacactggtccccacttttctctggtgccaagtctcagtcgtccctggcatgggtgaggtgggacgctagacccagtcctgacactggggcggtagataggaagggagaaggtggttttccctggaagagtttccatcgagttccagctggctgggctgggagtggcaccagggaagggaacaggagcttggcgtgagccgcagtgcccagctctgagcctgcctcctccctcctgaccctcccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactgtgagtgtctcgggggtcatgcaaatggtggagggctgggggaccccgactgcaccctcagcagctcccacaccctgccttacatctcaccctcccagcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccaggtacagggccagcaggtggggagggcaaaagcagggcacaccagcccccaatgggaagaggggggactctcagcacctcactctgtgctcattcagtcattcaacaaacattgagtatccttgctggatgggtcctagaccagtgctgagaatacagaaataaggctccctgacctcagggagatccacttctgcaccaaatctcactgaaaagctgctccgggccatgtcctgtgcctgacactgaagattccagatggaatgagacagttgcctgctctcaggcagctcgcaggctgtgggagccccagcaggatactgtgtcaacactccggagggccttaacaggctttctggaggggtgacaaaaggctagacgtccaccccagcccagagacaggccacatgccatgctgggagcttcacgaaggccactgaggaggcaaggcagggaggcccccagagtccaggggcagcggcagcagtgcccaagatgtggaggagctgcccacacctactgccatacctcctgccatctgcttcctgcagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacggtgagagcagagagggcagggggtacagacaagtggcgcagagggtggcagagaggtccccggtgccatcactgttatctcactctggctgcgtggtccacacccgtctgtccccagtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccaggtacagagtggagccacagcagcgggggtggaaccatggtctcctggggtgagcagagcaggctccctgtctcacggattgggccctgggtagaccgatagcagcctcaacaggctgagcaggaaggcctgagccagctggtgaccccagcgtccctccactccctctccctctccttccccatccgcacgtccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccggtgagtctgcctaggaaagggacgagggatgcaggcaacagtgttccctggggagaaggaactttcaggtcagagtcctcagacctggtggtactcaggcaagggccagcggaaagatgcgtgggttcagtggctacggctaccccatttctaacatttcaaattctcaatagccacgtgtggcttgcagccactgacttggcctgtgcagataaaaagcatttccatcatcacaggaagtttacgaattttgtgagggttaagtgagttagtgcatgtaatgtgcttagagcgtgcctggcatgccagaagtgctttataagtgttaactattattatcatttttttttttttgagagggagtctcgctctgtcacccaggctggagtgcagtggcgcgatctcaactcactgcaacttccgccttccaggttcaagcgattctcctgtctcagcttcccgagtagctgagactacaggcacatgccaccgtgcccggctaatttttgtatttttagtagagacaggatttcaccatattggtcaggctagtctcaaactcctgacctcaggtcatccacccacctcagcctcccaaagtgctgggattacaggcatgagccaccatgcccggccaagtgttaactattagtgttactctggggggtgagattttctatggcagagggtcccaccaaccctgttcccaaatctgacaacggctgtgccgactcactgatctctgttcccccagcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcaggtatgcagctggcaggaaatggtgggagagccgctggatgtgggggccctggctagctttgccaagagggagacctaggagcccccgtggggtgcagtacccccctgtgtcagaggttagaccctggccccaggccttcaacagttccagactggcacctgactctgttcctctgtcctgtcccctattcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccggtgagggtccctgcagtgggacgggaaggccgggggagggaggaagggacagagaccagggggcagaactggcagaaggaaacactttctggcactcggcgagaactgccgctctgattccagacttcacctcccgccacccacacggtcccaggaccaaggagccggctcaggtggagtggttcctgtccctctccacggcttgcgagcataggctttggactatgctcatctgtgcatgagtcccagttcctctggccacacttggagatgttgcacaagggacctcagctttccacctgtcactgtcccttatctgtaaagaaggggtagtagtactcttgtactctactatctaattatagagttcccaaaagcctgggactgcacctctgcgagtattggagggtgatttacacatctttattagagccggtgtggtagctcccacctgaatcccagcactttgggaggccgaggtgggcagattgcctgagctcatgagttcgagaccagtctgggtaacatggtgaaaccccatctctactaaaaatacaaaaaattacctgggtgtggtggcgcctaccgttagtcctaactactcgagaggctgaagcacaagaatcacttgaacccaggaggcagaggttgcagtgagccaagattgcaccactgcactccagcctgggcaacaaagtgagactctgtctccaaaaataaataaataaataaataaacatctttattagtactggtggcatataagggacaaaaaaacacatcaagcctgtccttatttcttggaaatctttgcttacaatggggctaagtagttaaggttttttttgttttgttttgttttgagacggagtcttgctctgtcgcccaggctggagtgcagtggcatgacctcggctcactgcaatctccacctctggggttcaagcgattctcctgcctcagcctcctgagtagctgggattacaggtgtgctccaccacgcccagctaatttttgtatttttagtagagacggggtttcaccatgttggtcaggctggtctcgaactcctgacctcatgatccgcccagcccggcctcccaaagtgctgggattacaggcgtgagccaccgcgcccagtgtgtagttaaggcttttttaaagtgaatcagttgaaaggaaaatgtccagtaattaatagcacagggggcacatgctatgcagaaatcatgataaggggacacagattgctaagcagtaaacatgatccagcacttcttaggtgttggaccctatcatatttacacatattagttcattttatcctcacaacagccctttgaggtagatggcattgttctctccattttacagatggggaaactgagactcagagaggtgaagttgttttccaaaggtcatacaactaatcaatggcagagctgggatttgaacccaggcagtctggccccagagtctgggttcttagccacattctatctgagtctgccaaacattagtggtctagtggtctgtgtggaagtgtctagacctcagccctggccccactggtgctgggagcatgggaggaggaggagatggtggggccattgcctgggggcggggctgggggaatgagaagtgcctccacctcccaggctagcccagctgctccaggcctcaatggaacgggaagggaaagaagccatgtcccaaatggcctctggtcctagtatctgggccccaggggaagggctgagggcatcagggtggcatctcagctcactgacctctcccctgtgccccagccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtaaaggagctggagaaggatgcatgcatcctccacacctgcagtggtcctgcctgaatccagcgttgaagggaaagtggcctcagcaactggggcttgtgggaaatggcagcaggaggtcaatggaatcaggaagttgagagcgggctgggcacagcagggccaccaccagccccacagcaccttggtgcaaaatagaaaaggacatctctggctgggcgcagtggctcatgtctataatcccagcactttgggaggccgaggcaggtggatcacttgaggtcaggagttcaaagccagcccggccaacatggcgaaacgaaaaacacaaaaattggccaggcatggtggcagatgcctgtaatcccagctactcaggaggctgaggcaggagaatcacttgaacccaggaggcagaggttgcggtgagccgagattgcaccactgcactccagcctggatgacagagcgagacactgtctcaaaaaaaaaagaaaaggacacctgttactcaaggctcttgacttcctcctgccggagaaaccatcataataaacatgccctccacaatgcggactgtcaaaggggtcgcctccaacaggatgcgcctacatatctgtgcatggcagtcccagggtgtgggtaccagaggcctgggcatctgaaggctcccagctcaccctccccgctctcaccccaccttggccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctggtgagtgatagggagcagtgggcgatgccagagcacaggcgcggggctccttcccagctctgctcctctcctctctcccagccgggcacttattgttgcctgcaggcggggtttcctaccacggaggatcaagccaacccaggtgttcccaagtctgacaatggtcccgtcccctcaaccagggggaccccagccctgagtttcaggaggacccttgagtccccagggaaaggagacccttcttaggttatatcagccactctcaagccaccgcgcccccaggatcaactggagctggtcttcactgccaccaccttcagcccctgccttgatccccggagcctggcctctctcacccaccccctgtgcccacagctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccaggtacaggggccaggatggggaggattccaggtcaggcaaggttagacctgcagttgctttctgtacccaaacctcatgcaaacaccagcctgcttggggaccccaggggataaaatacgtttgcgggacgagttcaccagcctgcaaatcaggagacctgggtttttctcttggctctgcagctgaatcctttcctgggcctcagtttcctccactgtaaagtgagtgggttggacctctaggattctgtgaatgaagcttccaccagccctaccagctgagaccctgagcttccgagagaactcttgggtaccggcacagttgggcttggggacattccttgtcctggggactttgccctgataactgtcccctcgctgctctgacagacccatggctcccagctgcggctccacctcgtctcccctgccgactcaggcgagtatgtgtgtcgtgcagccagcggcccaggccctgagcaagaagcctccttcacagtcaccgtcccgcccagtgaggggtcttcctaccgtgagtatggcagatgccatgggcaaggggggaagggagggccctgaagctaagcccacccctgctgagcccagccctctgcccctttggccccaggccttaggagcccggtcatctccatcgacccgcccagcagcaccgtgcagcagggccaggatgccagcttcaagtgcctcatccatgacggggcagcccccatcagcctcgagtggaagacccggaaccaggagctggagggtgagccaggctggtgggcaggtgggcaagctgggggcaggcatgggggtgccgtcatccccactgtgcaagggtggggcagaagtctggacgccccacattcatggtgtggccctgagtaaggcccttcccgtctctgtatggcaagagcgctggacccaggagtttccaaggcctttgttactttctgctatctgcgactccatgagctagacacacccaggccggagggattggggaagtgggcccaggggcacaggctggcagcaccaagacacgagaaggaccaggtcaatcctctctcaccctcccccatgcaacctcacagacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacggtgaggggacgttgaccctgtggggctctgccctgtttccagccctgattctcagctcagagcctccaagtttaaatcctccttccaccattgactctgtcttgggcattctccctctctgagcctcagtttccacctcagtgcagtggggagacaggtgcccacccagcagttactaagctggaggccatggcagtgtgggtgagcagcagagccctgcctgtgtgtcagtggttgtcattcctccgcacagggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcaggtgaagccggggctgcctctctgggtctgaggcccagtccatggcccagccttgagcgggtgcttggaggagatagtagtggatgggcaggtggtgatgagtggatggagagaggaagggaggaatgggatgggatgggtggatgacgaatagactggaagatgagagggaagagagaaggaaggtaggagaaggaagaaagaatgagtgggagggtgggtcgaaggccaagtggatggatggactaatggggtgtcatgagggtgagccctcaagcaaccagatgggacagctaaaaaccaaggaaagggccaggcatggtggcacgtgcctgtaatcccagcacttggagaggctgaggcaggaagatcacttgagcccaagagtttgagaccagcctgggaggccaaagtgggtggatcacctgaggtcaggagttcgagaccaccctggccaatatggtgaaaccccgtctctactaaaaatacaaaattaggctgggtgcagtggctcacacctgtaatcctagcaatttgggaggctgaggcgggcggatcacaaggtcaggagattgagaccatcctggctaacatggtgaaaccccgtctctactaaaaatacaaaaaaattagccaggcgtgatggcgggtgcctatagtcccagctactcaggaggctgaggcaggagaatgatgtgaacctgggaggtagagctttcagtgagcagagatcgtgccacagcactgcagcctgggtgacagagcaagaccctcaaaaaacaaacaaacaaacaaaattagctgagtgtggtggcacatacctgtagtcccagctattcaggaggctgaggcgagaggattgcttgagcccaggaggcagaggttgcaatgagccagatggtgccactgcactccaacctgtgcgacagagtaagaccctgtctcaaaaaataaatatataaataagtaaataaatagataccaaggcagggtagaggaaatagggaagaccaagccagagctggggctgacatcagcgtccccactgagtccccacataaccagcctccttgctttctcccagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggtgtgaccaagggctggcacatagggctggcagggcagggatgccctggggtctgaaatgtagacacatgtgatctagagatgatgtcatgcccaggggtggggagtacggggagaccgtgttgctagcatcccccagtgatggccgaggaacccaactggggtccccatagagggacaggatcacccagggcccttcctcaccatggccaccctctgcgggtccctgaggtagcccagtgacttctgtcatcttccactcgactccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagtaaggcctcatcccttctttgtctgcaccaaatggagatctgagccccccgactaggctccaccccacacagaaccccaggaaccccatccagaggtctccaggcgctgcagggtcctggagcctgccctgcccgacacccacaccctggcctgggacctttgctttccttatccccagtcctctgggctcaccattcagcttccctggacactggatccaacgacctgctgccattctgacctttgccctccccaatcctgacctctgtgtccccccactcaggcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggtaagcagccccggctctgcgtggaaggggatcacctttcctcctggccctttgatgacccagctaggcagactcgggtgggaaggcctccctccataaccccacctggaatgccctcatctcccctactctccagggcccgaggcaggcttgccacctccaggaagccctccatcatgtgtgctcagctcctctagctctcacggctgctccccacctttggcacagccctggcactgccaaaggaaaccattctgtgtacataagcaccccagcctgcctcccctgccaggcagtgagaatgctcagggcagggcctggacccaggcatctcagcagccctgggcttaattgagggcaacaaggcccaggatgggctgggtaaatgcttgacagggacaacagtgaatgagtgacaggagcacccaccccagcacgcccagggcttcagtggatcttcagagagcccagcatttccatggcctcctgcatcaatgatacaaatgagggcttttgggccccaaacttaaagcagcacagcatgtagcccactggtcaagagcctggactgtggactcagacctgggttcaaagcacagcttggccatttgctggctgtgcaaccttggccaagtcactgaacctttttgagcctcagtttctttctttttttttttttttttttttttgagacagaatctcactctttcacccaggctggagtgcagtggcatgatctcggttcactgcaacctccatctcccgagttcaagcctttctcgtgcctcagcctcccgagtagctggcactacaggcacgcgccaccacgcttggctaatttttgtgtttttagtagagaaggggattcgccatgttggccaggctggtctcgaactcctgacctcatgtgatccacccacctcagcctcccaaagtgctgggattaccggcgtgagccactgcactcgtcctgagcctcagtttctttatctgtaaagtggagagaacaatgccaaccatgtaggctgagttggaaaggtacacagaggtaaacacagatgtaaaactgtggctcgcagtaggcacttagtaaatggggacagtatgcatcagcccccgcctcccatctgtcccctgcatgtgtaggtgtctttgccatggccaagtccctggattctcttatttaaactgcaggcagaataggctttgctgtccttccttaaaatgtctgagtatggccgggcgcggtggctcacgcctgtaatcctagcaccttgggaggccgaggcaggcagattgcctgagctcaggagtttgagaccagcctgggcaacatggtgaaaccccgtctctactaaaatacaaaaaaaaaaaaaaaattagccaggcacggtggcgcacctgtagtctcagctactcgggaggctgaggcaggagaatcgcttgaacccgggaggtggacgttgcagtgagctgagatcgtgccactgcactccagcctgggaacagagcgagactccgtctcaaaaaaagtattgagtccctcccactcttttcgtggcctgccctccccacccagaagcgaggagctgtggaaacagagcccagcgctccacaggcccttatccatgttggtggaatggcagctgtgtgtgcagatgaatgaatctgccactgaacggtcttttttccctggtcagagaggctatcaggagaacattccttgaatgttgggctgggggtttcctgggtccctggaggggcatcagggacatcacacacacatatacctgcagaacctcatacatgtccccgcaggccctcccggctctctccctgccacctccatcccagcagggtccacgcccaccgtgcaggtcacgcctcagctagagaccaagagcattggggccagcgttgagttccactgtgctgtgcccagcgaccggggtacccagctccgttggttcaaggaagggggtcagctgcctccgggtcacagcgtgcaggatggggtgctccggtgagtggggccgggggcaggactggacttgggcagcatagcccagggctcacagtgagcagagttaaagcacctgccccagggggcgcaacatgaagcactgtccttggacacatcactttacctctctgagcctcagtgttctcagctgtacagtgggttatataagactgaatgaggtccaggcacggtggctcatgcctgtaatcccagcactttgggaggctgaggcgggcagatcacctgaggtcaggagtttgagaccagcctggccaacatggtgaaaccctgcctctactaaaaatacaaaaaattaactgggtgtggtggtgggcacctgtaatcccaactacgctggaggctgaggcaggagaatcacttgaacccaggaggcggaagttgcagtgagccaagatcgcaccattgcactccaacctgggtgacaagagcaaaactccatctcaaaaagaaaaaagactgaaaggagattgtctgaagcacttgcacagtgcttggtgcttggaaggccttcagtaaacagtggcccattcatatttattattagcggaggaaagagaacaggccctggggccagaaatacacaaatgaccccagatctcagctctgctacttgataactgtgtaatcttgagccctagaccataaggtctttgtctaaaatgagtgtggtgccccccaacctgcctgcctacctctagtggttattgggaaactagaatgcaacactgcgtgctgttctacatcagtttttaatgcccacacaattgcaaagcattcttttttttttttttttttttgagatggaatcttactctgtcacccacgctggagtgcagtggcgcaatctcggcttactgcaacctccgcctcccgggttcaagcgtttctcgtgcctcagtctcccaagtatctgggattacaggcgtgtgccaccacgcctggctaatttttgtatgtttagtagaaacagggtttcaccatgttggccaggctggtctcaagctcctgatctcaagtgatgcgcctgcctcagcctcccaaagtgctgggattacaggcgtgagccaccacgcccagcccaattgcaaagcattctatcagttgttttcaactccctgatgtcttattattttttctttatagaatccagaacttggaccagagctgccaagggacgtatatatgccaggcccatggaccttgggggaaggcccaggccagtgcccagctggttatccaaggtaggagggtggcttcaggcctctgctaagagcagggaacagagatgagaaaggcagagaggcacaaggcccagaccctgttccctaggaatccccctaaatgtgtcagaataaagagaattattccattttgccttgcttgtgtctagcatagagtaaaaggggcttgatacatatttcaagggagggaagaaggatatggatggagtgtgtgagtgctcagatgaaccgatgaagattgaatcagtgtgaaccgggcatggtggaacgcacctgtagtcccacctactcaggaggctaagctgggagcattgcttgagcgcatgaattctaggctgtggtgagccgtgatcacacctgtgaatacaaccaagaccctttgtctaaaaaaaaaaaagaagtggacacgtgagtgagtaaatgcataagacctgacaagtgagtgtgtttgtgagtgaatgcatgaaaaagtgaatgaggagtgaatgaatgctggagcttcagtgctcacctttccttgggcagtctatggcctccctcgggccaggcctgcagtgactgatctcactggacctctgcctccctcctccccagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaaggtgaaggccagtggggacttttgttgggggacagtgagtggggcaggggcttctcctgctgccatcttctgcctgcccgctctgctcttcctttctgttcacttgggacattttccattgtgtgtgtttaaggggcaggtttcataacaggtggcagcagcaggggataaaagtgagattcccccagggcagcctggaatgtacagggagagagctaggccatagagcatcaagaagaaaaaagaaaccttgtcctcatctgcagggagtgcctgctctgctgggagagacctgcagcatagtctgagggcagagacataacccagtcaacaaacagacctaatagagagtaaaacaaggacaacagatgcagggcagacacaaacactgtgtgttctttaaaggcaattcctttttaccccaagccctgtgacttgcctccaaacttccttacctatactgcccctagtgtgcacttctcaggtccccaaagggctgcacaattttttgcccaggcatgttgaagaggtctcaggctgtggagtgaaatggatctggccctgaaccctgactctgcccgaccaggagcaaacagccgcttttcccctctgagccataatttcctcatctgtgaaatggaatgtagtggcttccttcaaggggtggtgtgaagatgaaatgaatcagggtgcaggctgggcacatatctgtgactgtcatgttgatggcctatgtctcttccatgcctctcagccttgccccagatctcaatgccccaagaagtccgtgtgcctgctggttctgcagctgtcttcccctgcatagcctcaggctaccccactcctgacatcagctggagcaaggtaagtgctggagagggaaccagcgggcatgacttgggggctgggaacagatctgaagcgtctcagtgtccccaggatgtggcacaggcttggccaagagcaaacgctcaatgttggaaggtgggcctgaggcacagatgggaggtgggcccctggagccgtgggccaaggccagggccctcagtgctagtgcatttgcagctggatggcagcctgccacctgacagccgcctggagaacaacatgctgatgctgccctcagtccgaccccaggacgcaggtacctacgtctgcaccgccactaaccgccagggcaaggtcaaagcctttgcccacctgcaggtgccaggtaagacaccacccctaagaattggcagtgccctgcccactccctgactggcagggtcttcagctgtgctctctgctggcagagcgggtggtgccctacttcacgcagaccccctactccttcctaccgctgcccaccatcaaggatgcctacaggaagttcgagatcaagatcaccttccggcccgactcagccgatggtgagcaggagggttaatttgcggggtgggctggcctgggttgagggacctcgtggagtaactgccatcatggcaggagccctggctgcccctcagtcctgccccaatccctcagccctccctctccagaagcccccagacctctgggcctccaccctggtgtgccttctcttgtgcctcccggcttctccatccctgcctctgtgatatctccagcctcctcgtggctcctctgccaccggggcatcacccccagtcctcctgtcccagcttcctttccccatctctgctccttcctccctcctctgcctccatctcaccctttcctcctctctttctctcgtctcttacgggtctctgactttcactgtccaggcctccttctctactcgggtgagtctctgcctccctctcccccttgagggagactccagtgtgtgtgaagcaaattcagtttctttctaggggcgctcagtaaggcccttgcgtttggggcaccagccctgagatagtgagaaggccctggctgtgtgaggagtgccagagggagggacaggttccgagagtggacaggctcaagagcttgggtggtttctagggtgggggaggacagggagcctgtggctggaagggggccccttacacagtggtgcccacccagggatgctgctgtacaatgggcagaagcgagtcccagggagccccaccaacctggccaaccggcagcccgacttcatctccttcggcctcgtggggggaaggcccgagttccggtgagacccccagcctccccacctacagggggactggacacagggctttggtctggcaagtgctaccctgggctccattatacaaaggagatctggaggaaggagaaaatgtggccgttacccttggtgaccacccaatctgctagagtaggaatagtatgccagtcaggtggaggagggtgcaacctcagacttgggactgctgcaggccaggattcattcattcattcattcattcatgcatgcatgcatcagttatttgctgaccaccccatgtgtgccaggcactgatacaggtaaaacaaaacagaccaaattctggctcttgtgggaagaggtgtattctcactggggaagaataaacaagccataaacagagaaacaaggtgatcacagggagagaggagtcctcagaggaacaaggaggccaggtgctaggctgcagggcgctgagcctggggtccctgtgggctgctctgggaaagctcccagcaaaaggatgtggggagagaagatccaggggatgggtcacggggagggacgacaagacagggacaggaacgggaacagccccagggctgggactgcaggaagtggtgacatccctcctctgggacccctctacccaactgggcccctagcccttcttacaaaccccctatccactctctcctgccccggcctgccccacggagcaggttcgatgcaggctcaggcatggccaccatccgccatcccacaccactggccctgggccatttccacaccgtgaccctgctgcgcagcctcacccagggctccctgattgtgggtgacctggccccggtcaatgggacctcccaggtgagacccaaccccatactgctacttccagccctcatcccgcccttgcccagcctctgttgccattcctgacttccccacctccccagggcaagttccagggcctggatctgaacgaggaactctacctgggtggctatcctgactatggtgccatccccaaggcggggctgagcagcggcttcataggtgagccccctccccacctccagctgaggctgggccttacctggctggctggaagagccctggagagcctgggagggcacctcagggtatgggctgggacaccctgccctgtgctcatcctgcccactcacctcccaggctgtgtccgggagctgcgcatccagggcgaggagatcgtcttccatgacctcaacctcacggcgcacggcatctcccactgccccacctgtcgggaccggccctgccaggtgaccccacaccccacacaccacctggctgccgtggcctccacccctagccatggctggcccctgtggggattatggggggtactgaatgttctcggccttacttctgggggctgctttgcagaatggcggtcagtgccatgactctgagagcagcagctacgtgtgcgtctgcccagctggcttcaccgggagccgctgtgagcactcgcaggccctgcactgccatccaggtacgcaccccgaccgccagtcgctgtcgccccagggcctgcctcttccctttgctgcctccccatatccaccaccatctcaaccactggggcacttccacaccccccactctcacctgagcactctccactcctcccatgtacccatcccccatctctgctacccgaaggccctcaccccatcactgctgcttcccctcctccagccctgctgaccaaattcttaccactaccccgccacccaggcactcccccacccccagcccatcttttttttttttttttttttttgagacgaagtttcgctcttgttgcccaggctggagtgcagtggcacgatctcagctcactgcaacttccacctcccgggttcaagcgattctcctgcctcagcctcctgagtagctgggaatacaagtgtctgccaccacccctggctaaattttttgcatttttagtagaggcggggtttcactacgttggccatggctggtcttgaactcctgacctcaggtgatccacccacctcggcctcccaaagtgctgggattacaggcatgagcccccacgcccggcccccagtcccatcttattacccaggtgcccaccccattacccgccaccaggtgctccccctccaacactgtccagtctctgaagaacctgcagacacacagagtccctcgactgcttcccctgcagtcctccctgtggcctcttctggctcccgccttgctctgctcagttccctcctccaaggcctcccaggaggctggcctggccctcactagcccagccccccggggtgtgatgggcagacctctggcatcaggacccccctccctccagagtcacctccgtgtcttttcactggcctatgtgccccccagaggcctgtgggcccgacgccacctgtgtgaaccggcctgacggtcgaggctacacctgccgctgccacctgggccgctcggggttgcggtgtgaggaaggtgaggggagccaggcctgagacccccagggtcctagtgtcagctggggaggctgggtggggcactctgaggccatgatgggccctacggatgataaaacgattcccaagccagaggatctcgaagtcacctggccacatgtctgcccagcctgagccccttattgagtgagggcccccaaagaggacccctgtcatattggagctcctcccagccccgtgtgcaagggcaggggggctcctgtgccactgcagctggtgccaactggtcctgagcctctgggcctggagagtgaggcaggcaagggtcccagaggaaggcagagtagctggaccccacccgagggtccaggatccccactgcctcagctgagctgtggctgctgcaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggcggccacctggagttccgctatgagttggggtcaggtaagcacccagcaccaaatgcggggctctgcacaccaagccttgtgcccccctcggctcttcaagccccagggaggcatgggaggataaatgcagggatcagggcaagtcccctcttcctgtgcatttcgtctctgtgtcacttgaggccaatccctagccctctctgagccatgggctcctcatctggaatacagaaggctgtagggcattccccatctgctcagggccctgtttgtggtggagagggcagggagccccgtgtgcccccatgtgcccaaccctgcctggcatcctccccagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtaagagcagcctcctcgggacaagcgggaggggaggggtgccaagccttgtgtccccctcggctctccaagcaccttggcattgggcccctccacctgcagccacccacgggccctgggccaggacactgtacctctgagcctcagtttcctcctctgtaaaatgggcatgatcacacctactttgaaaggttgggcagaggattgtctgcactgacggatgaatgtttctagcacacagtaggcactcaactcctgcgcctccctccccacaccgagaatccatgctaccactcagggcccaatgtgggctcccagctcccctctgctgcattcttctccctgctggtacacctgggtctctgcctcccaggcccctttagtccctcggtgtccctgtccccacaggtgtcagtgaatggcaaacggctggacctcacctacagtttcctaggcagccagggcatcgggcaatgctatgatagctccccatgtgagcgccagccttgccaacatggtgccacgtgcatgcccgctggcgagtatgagttccagtgcctgtgtcgagatggattcaaaggtgggaaagcctgcccagggcaccggaggggaggggcacaggtggtcagcgacacctccagcccatgcccacccacccactcgcctctgccctggcccacaggagacctgtgtgagcacgaggagaacccctgccagctccgtgaaccctgtctgcatgggggcacctgccagggcacccgctgcctctgcctccctggcttctctggcccacgctgccaacaaggtacccaggcctggcttctctccacttcatctctgtcttggggccccggagctcgacatagtacccacgggtgtctatgcccaccaactggaccctgcccttctccataggctctggacatggcatagcagagtccgactggcatcttgaaggcagcgggggcaatggtgagtacttgccatggcctcctccccagcttcagctcagctcactcttccagttaccccacaccctcaattctggcctgcaagcaaaacagctttatatgaggagcttgctgggcagagagacagaatgaagaccacagccatgtggagctagggcctgccccacacttactggctgggtgaccttgggcaggcctttgaaaccactctgacctcagtttcctcctctgtattcatgtattcagtcaacaaactattgttgcccatccttgccctgagagcagtaaatataagatgcataaagcaagaccctcattcccaagaattccaccgtctactgaaaagctaaggaaacagtgaagagtgaatgctgattgaatgtttacggacactgtgctaacccctttacagacacatctcttcttatgtatcactaatataataggcgaggcagtggtatagtgggtaagagtatagacttggagccagcctgcttgggttcaaatcctagctctcccacttactagctgtggaactttgggtgagtcgcttaacctctctgtgcctcatataaaatggagatgagtaacatctttccctaaagatttggataaaattttatgtgagagtaaaattacttagtgcatttttttttaaggtggagtcttgctctttcacccaggctggagtgcagtggcacaatctcggctcactgcaacccccgcctcccagactcaagcgattctgctgcctcagcttcctgagtagctgggattacaggtgcctgccaccacaccccgctaatttttgtattttttgtagggatggggtttcaccatgttggccaggcctgtctctaactcctgacctcaggtgatccgccccccttggcttcctaaagtgctggattacaggcgtaagccaccgtcctaaagtgctggattacaggcataagccaccgcgcccggccacttagtgcattttaaatgcctagaacaatgtgtggtacagagtcagtacagaatgttagctgttgttaatattatgttcagctggccgggcacactggctcacgcctgtaatcccagcactttaggaagctgaagcgggcagatcacctgaggttgggaatttgagaccagcctgaccaacatggagaaaccccatctctactaaaaatacaaaattagctgggcgtggtggcacatgcctataatcccagctactccggaggctgaggcaggagaatcgcttgaacctgggaggtggaggttgccatgagccaagattgcatgcaccattgcactccagcctgggcaacaagagcgaaactccctctcaaaaaaaaatactatattcagctgggtatggtgactcacgcctataatcccagcactttgggaggctgtggcgggcagattgcttgagcccaggagttccagaccagcctgggcaacaaggcgaaatcctgtctctacaaaaaaatacaaaaagtagctgggcatggtggtgctcatctatggtcccagctactcaggagacaggcaggaggattgcttgagcccaggagttcaagatcaacctgggcaacacagggagacctcatctctacaagaaatttaagaattagctgggtgtggtggcacatggctatggtcccagctgaggcagaaggatcacttgagcccaggaggtcgaggctgtagtgagctacaattgtgtcactgcactctagcctgggcaacagactgagaccctgtctcaaaaaaataaaaaataaggctgggtgcggtggctcacacctgtcatcccagcactttgggaggacaaggtgggtggatcacctgagatcagttcgagaccagcctggccaacatggcgaaaccccatctctactaaaaatacaaaaattagccaggtgtggtggtgcacacctgtagtcccagctactcgggaggccaaggcaggagaattgcttgaacctgggaggtgggggttgtagtgaaccaagattgtgccactgcactccagcctgggccacggagcgagactccatctcaaaaataaataaataaaataaaaattatctatatataatattcattcatagggttgttgtaaggattgagttaaatgcagtggtgtctgtagctggatgggacgctccccgcacagccacatcataggtgttaggtaaatgtcagccgttctcctcatcatttggtggagggtagcagagggtcccctactcttgtcccctgccagagctactgtggccagtgccggcctgtgggatgggtcatgagcagatagggctgggggggtgtggagccacacacagtatggacatcctgggccagtcactcgcccaagcctgcctgctcttctgtaagatggagagaacaccaaggctctgaaccatttattgccacagtccaaggtgaccaacggtcccagtagctccggactgaggggtttcttgggatgtgggactttcagggctaaagccagacagaatttggcaagtagaatggcgggtcacccgacacggatcctgttgactacacaaaataaaataaaataaaatacattgatttaaggaaagcaattatgctgaagtaaagtaatcaaaacatgttttaagtttcctgacttgctatatatgtgcttctttattaacacatcaaataacaagatctggtgatctcagtagctaccacaatttcaaagcagcaatatgtgtaaatgatattttgaaatatttgcagctactgtcatgtgataagcaaatactagtaacaaagttgcaggtcctaccactgctactttggtttcttgcctacatctcattgaaagaactgctcaatttcagtgagaagtgagtgaaattgaggtgtaatgctttcccatccaaggtcataggctccctgaattctgttggcagcccccgtgggtccccagggactgcaggctcggagccccctagtcctgcatgttggcgtggaggtgggggtcaggggaactgacgggggattttgatgcctgatgcagcaggtatggcaccaccctcctctctcccacagatgcccctgggcagtacggagcctatttccacgatgatggcttcctcgccttccctggccatgtcttctccaggaggtgagactggcattggaagggcccatgggcctaatggggaggatgggaatctgggacttctgtcccctcacccgctcttcctccgcagcctgcccgaggtgcccgagaccatcgagctggaggttcggaccagcacagccagtggcctcctgctctggcagggtgtggtgagtgtgggtatccggctgggctcttggggctcctggggcaggaagctggcttcctggtggccggagtggtggggggaggggaaagcagagccccctggcctcggcagcctctgctctccaggctggggaccccagagaccctgtgcttccctggcaggaggtgggagaggccggccaaggcaaggacttcatcagcctcgggcttcaagacgggcaccttgtcttcaggtaggtcctggcacctggcccttcctctcccttccctggtcccagcaccccaccccccggtcctgccccagctcatacttcttgggcctggatgactgcaggtaccagctgggtagtggggaggcccgcctggtctctgaggaccccatcaatgacggcgagtggcaccgggtgacagcactgcggtaagggaccctgccgggcactcgggatggggcccagcgttctggagtggggcaggacgccccctaccatgggcagagaggcaggtattgagctctgtggagacagaacttgaagccaggggaggggagaacccaccagccagggctcgggcttccatctcggactgaactccgctgggggcaggcgagtgccccaggagtgggaggaaacctgggtgcagaaatgaggaagctgtgtttgtggggcccgatctctcgttcagcgggggaaagaaagagcttgggaaacagggacagacttctgagtctggagtctcgatatcagagggaggggactctgtcgtggggccggggaggaccaggaagtttgtggaaaggggcctgacccagttccactgcagggagggccgcagaggttccatccaagtcgacggtgaggagctggtcagcggccggtccccaggtcccaacgtggcagtcaacgccaagggcagcgtctacatcggtaagtctggggctccttctcagggcaggggcaggaacggcactcccttagggctagagctcgcccagccttcctcgcctcctgggctgctggagcccacaggccctgtcctctcacctcccggcaggcggagcccctgacgtggccacgctgaccgggggcagattctcctcaggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcacc

SEQ ID NO: 35945 - DNA, 78686 bp, Homo sapiens
gggctcattcagcggtcgcgagctgcccgcgagggggagcggccggacggagagcgcgacccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgtgagttcccagacccttcccacccccactggggcgccggcctgcgcgcgagttgaggcgagggcgcgccctgttcccgccggccccggggagtagttggcccgtgggtcgcgcccgggccggccgaggcgcacccagcgcccagcgcgctcggctccccgccctgacccgccccgcgcggcgcctccctccattcagctcgggaaggaggagaacccgagggctaggctgggccccgggagagtttacttttttttctgttttaaacaaagtgctttccgccggttcttccctccgggcgtgtttgctgggaccccggcaggtggcacgctttgctgagcttcacgtgtgtgtttggggctggggtggcgttcagggtcaccgcagcgctgctgtgggtttgcagggagcgtagttccaggatggtctaggcctttcccaaactcacggtgcaccccgtctcccccgcagactggcgcgccccgcacaagttggaaagccactttccatgtgtcctgcatgactttctcagcaaggcgggggcgctccttaggagatacttttacatgcctttgaaaaaaaaaaaaaaaaagatgggggtgggggcgggaattaaccaaacacctgttcgctggactagatcagctgagaaaacaagtctgagtgatgtgcccagcccccaaagtactcggccgcacccgagacccgctcggctcctgcgttgggcgggcacagccaaggggttaaagcaaaatgtccgatctgagcctggactttgcaaacaaggtttgtaagggacaaccccccaccgtagcggtaaacctcccaggagaaagaggagaccggcactactggcctctccttttatttcttaaacagtgtttggttcccacatgatcggctatttaagccggagagggtattttggcgcttagtcgccttaatcgctatggggttgcattcttcatctgtgctactgaaaaataggctgtagcaacaaaaggtctcccctccccacccaggccttgagttgaactaaggaccttccaggaccaacagaccggagaaagcaaagtgcagccacagtgaagagattttgtgtttaggagaggcgaatgggattttagaactggaggaaacctcttgatttcagcggttaacaactttggaattcgtgaatgttgcagcccctgaattttagtcagtttttttttttttctgataacacctgctaggtgaagcacagaaattagctgggggtggggaggctctaggagggtggtctgaggctatatgcctggccagctgcttatactctgctttctctcagaaataattgttgttaagctgtaaatctgaaatgaaaggttcctgttaactcagttaatagatgacgtttattgtctcggaatacttggtgtgtagaatttgagcttgttagtgcagaaatgattgtgggccagcagagggaattcattctcctgggcattctctctctgcaccagagccccactgaaaccggtggcttccttgaaatacttgttcaagcaaaaagtgtgaagggaaagtactgggacaagaaatatcctggcagtggagatttgcgaaacgtgactttgccaggaatctgtgtcgtgaaggttagcagcatgcttgctaaaacttgttactgctgctgggcttctctggtattagagctgaggcaactcctcccgaggtaaggataagcctgcaatggggtctgatgccttctaggaaagctcttcttagcagctgacagaggggagaggccccgtataaggagactgtatgtttcctagagtccaaaggcagtgaccacactttaaagaggctgtggtttatgtcacgtgctgcccacctccatgcttttgtaaagctttattccagcttcaggaatagcattggtcttcccaggagaaccagcacacacaggccatagcacaggtcagttgtcaacctttgacagtaaagaatgtgggtgtaaatggcagagccagtaagactgagaaaacttctggaccagcttcctaaactctatggaaaaactcagtgggggtctttcagggacctggtgggagagagacctaagctgagattccttctcggccttttattagcagctgttaatttactttgagctttaatttctttatctgtaaaatggagatattactgcttactggggttattatgaggattaagagataatatgcaaagtgcttaatgcctgtctggcatgggtacttgctgactaaatggtagctgttaatgatcatttaaaaagcagtaattgtgtacctactgtgtgtcaggtaccttacaaggtgtcttaaacattctgtgattctaagattgcctgagagtaaagccaaaggtggttgtttttgggtaatgatattttaaactcagtcatatttatgaaacccatgttcaaagcaacttaactttaataggtcttaattagacttataacaaaagtgagtttaatgaacagaggactttgaggaaggagaagtaaaatatcagatgcatgggacggtcagataaaagcacgatcatagaagacctatcataaatgtttgtagttcaaattttctatagtgcctttaactattcagtcacattttaaactccagttatgacttttgcagaataatattgtgtcagagagccccaaaacatgtcgggtgttcctaaagctttggagactataaaattgaagtagataccataaacttcatccaggttttcaggctgtatattaaagaagtttcggactccaaaagattactcaatggtcagccaagttggtccgccgagtgactgaggtcagggtctgagcaccttggactctttaatttctcttaggtagttaagattgagtcattcccagaggtggaaggtatgtgatgatgactgtgggtatatccagcctatgaatcatcactcttagctcttctgggaagagatggatctatatatgatcacagggaagaacctagaagaaggagatctataagagatagtctcatgaagtcattttggatttctgccaaccctcattttcttctttatggggtctctctctctgaccaccactgtcttccagaaatgctccaggcccgcggtctgttctgttctgacccttactaggtttgttcttgacttttctcagacttgtcatgttccatctcttaaaatcatattttctgaactagagatcatctagtccaactgcctctttttacagatgaagaaactgaagctgaaagttcagcttgagcagaatcttaacagaatgtggatttgaatctctgacccatgctcatgccatttttaaatggaaaagccagaaatgttcttcagacctagagaaatcggcaagcatctgaattttggaagtgtactatattgtgttgatttatcaaactgcttcccatatgcataggtcagggctatctatttaaatattggtgcctggactcttactattgactctattccagctggccttggaacaagttctgggtccgtccttctttgcctgcctccaccccattcccttctgaaaaagcccagtgaagtgtggctgtagctagccaagaatcagagctgtattcaggatgtgtacctaagcacttgcttccttgcatttattcactcggagtgccatgtggcccagggccatcttccagggattgctgggtcaccttgaatgctaagagtagagaaaaagccaaaacgggcagcgagacttacaggaagtcttaggactctgcaagaaagcagaaataggcaagtttaattttaacacaggctggtgtgagaccaagtaatgacagggttggggaaaaaaagggtcaaagtatttatatggtataaataatttgttggggaagtcaggataaatgcttatataaaaggattcctttattataaagaagtggttattctgtgttctcagttatatagactctcttagcataacaatatattgagatttaatttaagctttcataaccaaatagtaccagaattatggcgcatggtttcctgaagacctcggctcaacatattactgtggacagtgaggccagtgaattatttggtattttcaagagggacagtgagacaaaacagaaaatactgttgtaagcttagatgacagggtcaattgtgcctgaaacactgatttagtgctgaatcagcccattttaagaatataatcatagcttaagaaccagtttaaaatttccccatcctacactaaagcaatgtctttaactcctttggatgtctgtagcacattgtgtctgacaattctgatgttttgtgctaaactgtgatccactatctttaggacatgatctaatctctcccaactggattgtaggttatgtgagggcaggggtcttacattcatttctttgcctgctagcacctagcatatgccttgcaaatacaatagagactgatattatacactcagtttaacctgtgacatcaactcttcctgctgagggtggagagagggagaaatccctttctttaaccctttgcccttccttgctcaggccttggtgtcttctgcctctgaggaaacggaatctgtaagcttagcaaagaaacgcacaagacgttaattcttggtttttgatttttcaaaggcggggggttccagctaagggattttcatgagtgtttgtaaatttcacctggcttttgccctaaaggcagactttagaacctaaccccagaaatacaggctgacctacactgcagtgggtactcgggacttgctgaggtggttggttgttatgaggctggacagagaaggatgactgtggaatagagatctttctgaaagcaacttgacaggggtgtgggggtcaaatggaagtgtgcagtacacgtgtgaagtcacttgtgaattgatagcggcaggtttatttcttcaaggatagtaagggaatcttggatatatttaactctttcggtaggatggtgggaaggctgcttacctgctccgggggtgagcctaggagccatagcatgggatctggggatctgtgtagcacccccgctggctcctgggaggatggtaaagattacgtactgcagcagtgggaagtggacgtagtctcagcccccggtgcccatcttccctttctgggcttgggtacaactctggaatcaaataactttatatctggaaggaagcttaggggttctgaaacctggctggtcttcagggtaactacttgggcaaccttttataaaagtgtgattctcagcccagcctagatctgttacgtcagtttccataagtgtgctccaagaagctgttcttaaagtcttcttcgtttgagtcagactagcttttctcctttacacagaaggcagagtgtaatgtagtgactaagagcagagcctagagccaggtaggatcaaacccttttctgccattgactagctatgattttgtgcaggattcctaaccttcctaggccttcctgccttcagctgtgaagctagtatcctcgcacattagaatagtcctggtccagagtgagcattttgtgtttgttaaatagatgaggaaaccaaggctgtaagaggtgcagtggtggcggcatgtctagcaaacttggtcttcaatctgcatcttccctgcttcccggcctgtgctgtgtatgtgctttctccttttaggtttggttttcatcacgtttaaaggtttggttttcatcacattctccctttcttccattccactctccagttgaaaagtgcatctcagaagagccatgccttctacttagcagcccttcgtagctactaagccatagataaatcccagtgaggtctcagtgttcagagatgagtggacagatgggtgcatagacatgacggggcagtgactgtgagctggatacccatggagggtgggtggtgcagttataggttgggcttactgctaaggaataccacctgtctggtttccaggccttcttagacctctatgaccttgaaagcacccccacacctccatccctaggaggctggataacttgcacaacacccagggcaggtttgaaaacgatttatttttcttagttttttgcttggcactaatgtttgctaggaaggagcttgtggattattgatgacaaaactgcctaaggttggaaagtatgtgggcaaatatggaagtagtgtttccttcacaggtttgttaaactggcatttagatttgcaaacactgatctcttggaattaagttaaaaggctaattgttaattagccctgaactggggcaggtagatgggcctctcaccagtgcaggtccctgtcaactaataacagggtttgataaccaccatcaaatctgctatctggcttttctgcttagataaacaaggcaagacgatctcaaaccagcataccgattccgaggttggcatgtttgtagaagactgttctcaggccgcagtgtggcagcagaccctccccagttcagccccatgccagattccaacgttggatcccactgtcgcttcatctcatcctaaattggcagaaagactgtttagaaaactaagtctctaaaaccaattaaatggtaaagaagactgttctgaattagggggaatgggatgaagtaccactaaacgcaagtcacaaagggcaaaaactcatgacatggagccgtgggtatctgcttgcatgtttatttgccaagcggctagtatattttgcatgtcatacaatctgaaacttacttttttgaaaagccatttcagatatagtataagaaaagcctttgagagaaacatgctttctaagcctgggagtacagaaataaaaataaactttgcaataatttgaaaggggcacactggttagttgaagagtaaggaagcacccagtaatgcctctttacccaagagctctgtttgctttgctcggtgatatcaatgtcactgtggtttcttcattttgaaaaggaagttcatttgtactgaggtggttttaagtgtgtgtgtgtgtgtgtgtgtgtgtgtgtgtatgatgcaaatgataataaacatttcagacccagagggcagaatgtcactgaacctaagccctcctgagccaaataactcctttgtccttgcagaatcaggagcccttctcttcaggatatgctgccattatgataaagcattgtgatgtaaagttaacgagaggatccttatccaagtgaatcacagccaaggggtggaatggttggcctctggtagggatgccccattcagcagcactgagagtttggagttgttctgttctctttccttcttgctgagggtagtaagaaatcctccctaggccccattcccctgatatatcttgcgggtgatggcctcttactggcagtgtgattatgtatgtccctttagaacaaaggtatcgaaacaataaaagttgtgaaatggaaatgtttacaattctacaaggctccagagagattagagataggtaggaaaaaggccattgttttccaatcaaaggtgctgagaacctgttgattggacctaaggaatccagctttgccacgacacaaaacccaagagttttgtttcttttttttttttttttttttttttgttgagacagagtctcactctgtttgcccaagctggagtgtagcgatgcgatttcagctcactgcagccttgacctccttgggcttaggcaatcctcccacctctgcctccccagtagctgggactgcaagtgtgcagcaccacacccagcaatttttttgtgtttttagtagagtcagaatgctaccatgttggccaggctggtctcgaactcctggattcaggcaatcagcctggcttggcctcccaaagtgttgagattacaagcgtgagccaccatgcccagccccaagagttttcaaaaaaggaagagttcaaagaggctcagaaatgatcaagtggacatacagagacataattttaggaaagggatattattaatatttgccagtgagtcctcgttactgctggtgagactaggcccaggtaccgacttaaggcgatactttgaaaaagttgagaggtggcttaaagacctgggtgatgaatgaagaagacctccatgactttacaagtgcaaagagagatgggtctgggcactgctgggccttttagaggctcaaggacagtggccttggggaaggctgaaggagacacctattgaattagatggtgccaaggctgagggaggactttcgggaatcccagactagagaagtgttttaatgccaagaacatgggaaacccatttcagatactgtatcagataagccagcttagaaaagcaccttctaaggcttgccctatatttagaaagggctgctacagaggttaactgagaaggggttgtaggaatgtggagaggcgttgtgaggatcctcattcaggatgatctgggaggtaagctctgagagacaatgatacctctccccaagcttagcagccatgccagaagccagctgagaaggtttttcaatatcatagaatatgtaagctctgtaagctcatttatttctctctgtgtgtgtacatgttttaacccaaaagaaatagggatttttgtctgtattcgaacatgcagggaatgtggtctggacctgccagagaaaccgtggccagctttttggggttttcctatagaaattgttcattcaacagatattcactgagtatttactatgtatttggcactgttctagtgctggggctacagcagcaaacaaaatagacaaaatccctgcctatgttctgatcggggagacaaaccataaacaaaaaggtgtattatgttagatagtaataattaatgcagaagtgttaatgcaagagaggggagaatggttgatgtgatctgcaaaaatataaagtagagagggaacagggagtgcagatggggagggaagtggtcagcagtagggctgcctgggaagactttgctgagaaggtgaagctgcattcctggcagagagaatggcaaacacaaaggccctgaggcagaagcatgttcaggcaaagcagtgagtctccttggaggcagattgtatagggccttatggatcatcgaatgactggcttttactcatgaatgagatggggagcatttgtaggttctgagaagagtaggacatgtcctcacttggattttaaatggatttctctggcctgcagccttgagagtagactgtatgaggacaaagatagaagtaatgatactgactaggaggctcctgtaataaacagataagagatggtgatttggaccaatgtggcagcaatgaatatagtaaaaagtgcttggattcaggatatgtcttgaaagtagagtcaacaggatttcctggggactaggtatcagttgggacagacagagtagagaagaatgtgtccaaagtttttgacctgagcagctggaaggatggagttgtattatggtttggggagagatgtgagagtaatagattttgggggcagggcaggagtatggttttagatatgtcaggtttggagtgtctagacagccaagtgagttatttaggcagttgagtaagcagctgagtcaattaaaaaaattgaatttaaaagcctgaagttcagttggaaaggtttgattggtgatgcaagtagaggagcctctaggttgtgtttagaatgatgaactgatgagggcaccaaggacggggatggaggcctgagccctatggtgttcttacacatggaggttagggagagccctggagactgacacccatggcaggaggagagggagggagtgtgtggtcctggaaaccacatgatggggtttcaaagaggaagtgaaagatcagttatatcaaatgacacttactgagatttgatcgctagattggcaatgtagaagccactggtgaccttgtgagagcactgatggggaggagtgggagcaatgcctaattggagtgggtttgtgagagaacaggagagaaggaattggagaccataggaactcttgaggggttttgctgtagaggggagcagagccatggcaacaactgtaaggggaaatagtgggtttttgtttcgttttgtttaagatgggagaagattatagtgagctggtttgatgaagatgattcagtcaaaaaggaaaagttaatgcaagagaggggagaactgttggtgtgacctcaccaactgagtaggtgagaggacgtaccgtgggggaggtggcctgatgactggagcaagggtagctcatcacagttatgaggaagaaaggtcggatgaggggcacagatgcaggtaggtggctaattatcctggtggaagggcatggggtttttccattgcttctaatttctcagtgaataataataagtcattagccctaagttactcagtagttgtgtaaaagtttgcctcattaggagtaagaacttcactgaggcagatggatgtggatttgaatcccagctcctttacattctgttgattttgacattggacaaattacttatcttcattggtcaaatgaaggtactaatagcacctacctcagagggttgtgaacattaaaggtgaggataaagcacttagcagagtgcccggcatatccaatcaacatcagcctttactgttagggtcccttaaagtaaaatatgaacataattccctcacactggggagtttttgtagctctcttatcttttcagtctggtggacagcagaggttaccctttgggggccaggtcaaaggttaagtttccctatggaagactacaactggagggcagtccacaggccgccatgaagtatacattgttttgatgaagacaggaaggggaaatatgggacttggaagaaggaagagaagatggcagcatgtcaaaactctttggcaatctgcagacctttgtgctatatttgagctacagagaaccacgactttttattttgagttcttacaagactcattttaggtgtggagagagctcttcccatgtgggtctgcagctctagaattgggtagtgccttggatggcacagtcctggtgtatcctgcaggctgagtggacaggagggcgttgactgggtgtgtgtgatacagggtggaagccagctccgagaacgcagcaggagagccaaggctgtgcttcctgttcctgctggcctggttgatttgtctttgtaatcctagtcaatgcatccagcgtctcagtgcatatattgaataaaaaatgacgaatggccttgttgaattgtcaggagtgtagaaaatgaggctcaatcagcactttgggttctaaaatactgtcgtttttcaatctcttctttcaagattattggtatagaccttgagggaaatctgagttcaaaaggaaatagaatatctttggaattttgcaaaagtgtgagtcatcaggacttgagcatacattcccctggtgtgctgcaaatcagatatgaaacatcttcctgaggtggcatggtggtggtataaaagcttcattatagtacagaatgaagtgtgtacttatataaaacacaagtcttcgaagacattgcaagcttttggtggttgctttgcactgtgcctctgtacatgttcacctgcctctgtcattcagtgcttttgtgaaaatggctgggaagcattgaccagctcaaccttttctctctagaaggaagactgagacccagaaaagtcaagtgacagctagtcagtggtaatgtgggccctgaaacctagctgcccagtgcccagtccacctgatggtatgccatacacatcttccgtttggtgaaatagcccattcttggagttaaacttgtgccacataaatcttgcccttaatagaacagtatcttgggtttttaaatgtcccctacatagtgggctgggagagatagaaaatacagccactgtcaccccttcccctgcttactagggcactccaaatgaccatagcacattttttcagtggagtctcagaattcttcaggtcaacattggtcagccttcactgttgtgtgggtgtttgcaaataagacagcacctgtttgccctcctggccttgctaaatcccgtgcatatggaaggcaccctataaatgtatgcctgatggatatgagtcctgttggtttgtgagcttcttaagaacaaggctgacatcttgttcagttttggttcaaatctaatacatagaaatggatattcagtaggtatttgttgaactctttgattccccaaatacactaaaggcttttagagaacaggaaccagggtaaacatttctttagaatgatcttttacatgctggtactttgaaaaaaaattgtggtaaaatatacataacataaaatttattttaaccattttaaagtgtatgattcagtattgttaagtatattcacatcatttcttgcccggaaatgatgttgtttcatattatgaggccataaagtattgataagctaaacaaactttaactcaatatatgattgtgctgtatcatttagtactatattctaatgtgtattagtggcaatgaaatttaaagtttaacatatttatggtacaagttgaaatttagtctcttagcttattatgtgtttttccaatccggttaaggactgctatgagttgaattcagcagttgtatacctggcaccaacagcctttgagaaaccaagtaatttaagtttttaattgagtaacagaaaattgcaactaataaaatgcctggctatattagcttatttgtcatttatatgttgttagtactccttaactcttggtagctttaagatgaaaccaagagtggtttcagttgcattctgtgttctgattgaagctgaggcttgatttgtggcttgaagtttgaaaggaagtgcctgtttgttcagggaacaccaattggactaacagctgtcctctgtattaaggccatctttagcttgtcttgcaaatactttccttgttcactaatcccttctccccaccctgcttcctttagacccatgttaatctattacctgggagcagctctagattcttgagttggtaatgactaatttctccgttgctctcatcctgttgagtttaataggctctcttttttcttactgatgttttcatgatgagatttctaataagttatttgggagctatcagaatagaaactaataaatattatctatctattagctgtcagaataaaagcttactgagggtcctgaactgtgaggccactgaaggcaggggtttgggtctgatttatctgtgtttgcctagagctttaacagagcctgacacttgtaactcttaaaaatatgctttaaaataaatctaaactcaggcatggtggctcatgccagtgatcccagcactttggaaggctgaggtgggaggaaggcctgagcctaggaactcaaggtgagagtgagctatgattgtgtcactgcactccagcctgggtaacagagtggagacgctgtctctttaaaaaaaaaaaaaaaaaaaaaaaaaaaaaaaaaaaatcaaacctcagtgcataagacacaggtgttttcatctgtgaacgagagtagacacattctagtaatacccaatgtttttgtgaatttctttacaattgaaactattttccacttgtagaagttgggaaggaacttggggaatggcctggaaaggtagaccaccatcctcatttcatagaacaagaaatggagacctaggatttgtcatagtcctgcagccagctacagacagagctgtgcctacaattcccttcttgtcctgagttgtttctgcttcatttcccactagaaccccatcccgccctcacccctaagcagaggtccagctagctaatgtgtctgtttttataaaatgccaccagaagcttaagtacgtcggttcgtgtcccatcaaacttgtccagatctctttctcatcatagagaggtaccatcctgagttgctcagatgataaacatttctccattagaaactaggctcggatttgcctgtggccacaaatccagaagcagctgtgtgttccccatgtttctcaccaacccctgcgtcatgtttctgaataaggagtcctggttaccgccacacccctcattcattgctttagattagatgaaaggcgaggtgcctgactcaggccactgactcactctgcttgggtgaacccagctcctcccggtaggaagtgattgccccaggcaggttgaggagtgcccacagcatccaggactaaagcatttggaccctgcagctatttataaacagcactttacagtgctttcagtctgaatattgggactcccctagaaaggacagattcagtcctttctgaaaggaggatagacgaagggtgaggagttcttgttggatgtattttcatagctgaaaggttcccctgaatgctgtcagtgccatggatgttcatagggaaggttagagttcctgtctctgatgtcattcattttatgctgcagctcacttgactgtgggactccctaggaaagcttatctaccttttcagctgttgcacctcttttcttccatgtagtttgccctctgccttacattcactcttcattgtaatgccccagttgccagcacagtgcctggcgcacagtaggtacgtgtttgtgagcttgctttactgatgtgttgtcatgcctctggaacgggctgtaaaaatcaatctttgactctttgccagcaactgcccacataaagagagcatgtgtgagcttgttttatgcaattacaaggtttgcttcatgacttgtgggcgctgattttttttttttaacctcactatctccatcattttctctgcaagattttcagtgaccctcgtgtccatggactgacctccatttttaaaatttcatttttaatttatttttgaataggtagtacagtcacatggtacaaatattaaaactacaaagatggaatgaaagtcagcctcccacccttgatctctgggcatcctattcttcctggaggcaaccattgttttaccagcttactgtgaatctttcagagctacctatacatttacaagcaaatatgtacatagattttttttacccatttgccatgtagattcttttgcaccttgctctttttctcttggtatgttttaatgcctgttcaatcttgtaaataaagagcttccttattatttttaatctctgcataatactcagtttcgaggatgaactatgatttatttaaccagtctgggtattcagataatttctaatccttcgccgttaaaagcagtgctgcagtgaagaactttatgcttccctcatttcaccttaaatgaattaatttaaggtgaattaattaattcctagtgcagagtggcctggccggcgttgttgttttaatggtcacggctgattctggaggagtggctgccctcattcctttctatcctaaccatctgataggaccacaggctacgctatcagtgggtttagtagagtcttttcaacaatcgagtttccagccttatgcccaagctgttggatccctgaaggcttcaatgtttgtgtcctagctgtactttatgcttgttaaaatgtatgtgttaaaattagaatggcttgttggaatgtgtaagattgcgtatagtgtttcatgttttatcactgtgttgagtttacaaagttacttgatgttatttcttttttcttttttgaggcagggtctcacgctttcgcccaggctggagtacgagtggtgcactcacgggttactgcagcctcaacctcctgggctcaggtgatcctcccgcctcggcctcccgagtacctgggactactggcatgcactaccacgcctggctaatctttgtattttttgtaaatatgaggtttcaccatgttgttcaggctggtctcaaattcctgggctcaagtgatcctcccaccttggcccccaaagttctgggattacaggagtgagccaccatgcctggcccatcgtttcatttgatccttgcaacaccctatgagaatatttagatagaacgatttcacagataatccatagtgatactcagctaacgggtggtactgccaagacttgaacccaccattcttgtaacttccttgatatctctaattatggttttggtctgccagtttgttatggagcagaaaagaagatgtaagctttctggaggtagtagctgctacaggcatacactatattatctcagcaatagcaagtccaagtaggactgattcagtatacacaaagaagtattagttgctaaaatattgaaataactttcattctggttggtgcacgttgagtatcccaaatatgaacaaccaaaatctgaaatgctccaaagctggaaactttttgagtgtttttgagtgcctgccaacatgacatgcaagagaaacattcattggagcatttcggattttggatttttagatttgggatgctcagtaagtattaatgcaaatattccaaaatccccgccccccgccccccgccaaaaaaaaccaaaaacccaaaacacttgtagtcccaagcatttcagaaaaatgatactcaacctgtaaatagctttgccccaaacccccctgagtttctttctctacttccctggccagttttcacataggaacccccctaatcgccacgtatttcccccccacaacccagcaataaaggggaaatgccctcataagcgaggagcccctggattgtagctcccgtgctatggccaccatctgtgctcgctaattggttcccaagccatactggtccctaaatattcttaaatctgtaagtgcaggaatggagtattaaacaatgtaagcgtttaggcatataacttgatttctgtaggttttgtttgttttgttttgttttgagagagagtcttgctgtcacccaggctggagtgcagtggcgggctcttggcttactgcaacctctgcctctcaggttcaagtgattctgctgtctcagcctcccaagtagctgggactacaggcgcccaccaccatgcctggctaatttttttgtatttttagtagagacagggttttgctatgttggccaggctggtttgaacttctgacctcaagcgactgcccgcctcagcctcccaaactgctgagattacaggcatgagccactgtgcccggctggtatttatactttgtaaattgcctttgttgttcttagtatcctatttctaaatctgttgtctttttcttttctttttttttttttaacaaaaaaaaaaaaaggccgggcgcggtggctcacgcctgtaatcccagcactttgggagaccgaggcgggcagatcacgaggtcaggagatcgagaccatcctggctaacacggtgaaaccccgtctctacaaaaaatacaaaaaattagccgggcatggtggtgggcgcctgtagtcccagctactcgggaagctgaggcaggagaatggcctgaacccgggaggcggagcttgcagtgagctgagattgcgccactgctctccagtctgggcgacagagtgagactccgtcttttttaaaaaaaaaaaaaagaaaaaaaaaagcctgaaagacctcttttggttttgctttttgctttgtctttgtcttcccggcctctaaaaatctgggtagctggtctgaggtgttgggacccaggacttgctctcttattgctccaccactggagcctcaacctcaaactcaaggtggtggcacctacattccaggcagctgaagaaaggagcaaagaacagagccaaaggcacatgcatgccatcttctaaggaaaattattggaagcagcagtgtgatgctttgtcacacgtcctattcagcagaactgagttgtgtggcacatccagctaaagagggaggttcagttgagtagtagttattcagggtggccttatgcccagctaaaaagtcttttactatgggaaagaggagaactgatgttgggtgacagccagcactctctggcagagctactaagcctgttgtttcatttatctcatttagaaaataaactgtgaccatattaatttccttttcaaagcattgaaaaatttgtatttcctaaactattggagtagtaaaatgggtatggtgacccaccaggtgtgagctcattaagtctatcttttctcttcttgttttttatttaaaatattttattgaaaaatgatggaatttaaagtcgctttttcctttgcagatgaactatttgataacaggttttaagacatgaatcttattttttgagttaacactgataatatttatgcttggtacacttgaaatagaaaaacctgcttggtcacaacatgctagaatttaaaattattaaaagtgatgaattaatgataaaactttattcccataacagaaatttactaagcatctactatgtgccgagcactgtgcaaaggtcagggatggaaatggtgagctcacaatccaagtgtgtacagtttcctagacttggtttcttgaaaggaaaactcactagagattggactccaaatcacaaatgtcatttggcaactgataagtcgggtatctggtaattcagaagcacaggaaatgattaaatgccacatttgacaagatctggcagctgccttgtgaaactgaaagaacaggattgcctggagacaattatcagaacttggactttcatttttccttgctgcagtagacagtgttttattgtggctctttaagagatgtcttagtggtatgaattgcttggtcagctgaaaacttttcacctaatttaattttatttttaatttttttgagacagagtctcactctgttgcccaggctggagtgcagtggcgcaatcttggcttagtgcaacctccaccacccaggtccaagcgattcttgtgccttggcctctgaagtagctgggattacaggtgtgcaccaccgtgcccggctaatttttgtatttttagtagagatggggtttcgccatgtgggccaggttggtctcaaactcctgacctcaagtgatctccctgcctgagcctcccaaagtgctgggattataggtgtgaggcaccacgcctagccaaattttatttttatttttatttatttattttttattttgtgagatggagtctcactctgtcgtccagactggagtgcagtggtgtgatctccgcctcccaggttcaagctattctcatgcctcagcctcccaagtagctgggattgcaggcgtccaccactatgcccagctaatttttgtatttttagtagagacgaggttttaccatgttgactaggctggcctcgaactcctgatctcaagtgattcgcccatctcagcctaccaaagtgctacgattacaggtgtgagtcaccacacccagccccaattttattttaaaatgagctagttatatatttatttctgtacttacaaatttctgttgaagtggaattcttgatcattttaaatgcaggccagttgcttttgtgatttttatgttgttgctaatgttattcttttttccttgaggttattgaaattcttatgttgggaggtaagaagcaagtgttggtggaccaaggtcacaccaaaaatagatcctagggatagaaccagaattccagaattcttttcctgtctcctcctccattttcctgatctgaccgctcttattagcatattccctttaaatagttgaaattgagggttgtgatttcacattttttcccccggtacgtggtaaagactttgagctgaaggagttgaaagttgtggatgttaaaaacacgttctgctttggatgttcctttactgcatgagctcccttgctcttaatgagacacacccatagtaaagtccagacactcagtctggacttaactgagtcaggttaagaactagaaccctcaggcgcaaatgtcacatgagcatcatattcactagaaaatgggtttagttctagcatgctctttcaaggaggcaggaaagaaggcatcttgtgaaattttgggaaggccaggataaaattgctggtcttgtgctccagttaaaggtaacaggtattctttgcctttaattttgcctttagcacagatctcaaagtacttaatagacgttaattataactgaccatgctcttgtaatagattttttttaatgagtaaactggggtgtagtgatgtcatcaaatcaagcagaaaggagactcttggagtagtggtttagagcaagatctgggagcccaggagtgctaggcacaactcctggtttgtcacttaccagctgtgtgaccttggacaagttacttgtcttctcaatttgtgtccacatttgtaaaatgggtaatggcaatagtgtctcttatattattgtctcttatagtgtctcatgttattaggcagagtacctaatatgagagcataggagatgatagctgttggggcattattaataatagcttgtttgcctcctttgaaagtaggctatgtttgtgatttcttagaaggttattagaaatctagtcttttgaatgtggagttgtagtttatagtcaaaagagagcctcagccttttaaccaactttctgtgtaaacatgaaaattccgggctggatttgttccactgtgaattttagctcacacttgcccaactggattatccagtaagtataatttaaaaatagggtttggtttttcttctccaaacacccttaaggttacaaaaaaaagcaggatctgcttcctgccctcaaggagtttatagcctagtaaagtgaaattgggagaagtacttgcccttggagatgatgaaacttgagttaggggtcttgaaggcaaaatcgtaggtaaggcctggagctggagcttggtaattgacagtgtttatggggttgggggcaaggtggcaggaaaatgtgagcacaggcgtcaaagtccttgtgtgcctgggaagtgaaaggaggaggggcagctcctggtggatggccagggtgtggctagatggaggaggagggctcccaattgtggtgggaagaatgctgcacagtgggaagggcactgggctggaagccctacccatgtcagggaatgtctgggcctcagatttttattttctagaatgaagatacttaccccccaattgctgagatatttgaataaaagtatatgtgaaggattttgtaattatagaatgtcctacaaatatgagtagttcgtttgctacttttttggcgaagaaaaatattgggatgcatgaataatatctacctaaggtacctaaggttgtattcatcccatttattgaatgccaaggatataccagctactgctccagatgttgtattcagggaacagaagaagagtccctgtgcccatggagctaacagcattctaggggaggaaagatgggacagctgactttcacgatctcaggtactgatgaagattgtgaagattattacatcaggtgaatgtaggggtgatttagagaaagctggtagctaggctgttcaaggaagggcctctgtgagaaaggggatggttggctgggtgtggtggttcacgcctataatcccagcactttgggaggttgggagtttgagaccagcctgaccagcatggagaaaccccgtctctactaaaaatacaaaattagcccggcatggtggcacatgcctgtaatccaggctacctgggaggctgaggcgggagaattgcttgaacccgggaggcagaggttgtagtgagccgaaatcatgccactgcactccagcctgggcaatgagagtgaaacttcctctccaaaaaaaaaaaaaaaaaaaaagagagagaagaggatggtggagttagccctgaggaatgtgaaggatgcaaccagcgaagatctgagtcaagagtgttcggaaccaaaggaagcgactgcggttactctgagatggaaatgaggctgctatgttcaaaggacagaaacggagtcagtgtggcaggagtgcacaccttagagggtgcagctggagaggcagagaaagggccactcaccatgggccttgtagaatgtggcaggaattcaaatttcattccattgcccatcggaacccactggagggctgtaagcagaggaatgatgtgatatgacctgagatgtgcaaagaacagcagttgcaaagaacagatgtggaggacgggctcgggtggaacaagagtagaagcaaaccagttagaatgatactatagttgttcaggtatgatgtgatggtgactcaggcctttgttttaggagtttgcaggagctcagagcagacagtgaaagtggccaccttgaagcaaaacacaaatgaaagggttgatcacaaactggattaaagttggcagtgagaatactggaaaggaactactgagaagtggtcagagtaaaatgtggaggtagagcctgtagactttactgatgcattggacgtgggatataagggcaagtgaagaatcaatgatgacttctaggtttctggcctgagcacctgggtagatggtgtacatttagtaagatagagaagggggccgggcatggtgcctcaagcctgtaatcccagcactttgggaggctgaggcaggtggatcacttgaagccaggagtttgagaccagcctggccaacatggcggaaccccatttctactaaatatatatatattttgtatgtatgtgtatatatatataaaatatatatataatttatgtatttatataatatacaaatatatttatatatttatatacaaatatatatttatattatatataaattatataaatttaaataaatataaatatatttatcttgtatatataaatatattttgtgtgtgtgtatatatatacacacacaaaaattagctggacgtgggggcacattcctgtaattccagcttcttgggaggctgaggcatgagaatcacttcaacctgggaggcggagggtgccgtaagccaagattgcaccactgcactccagcctgggtgacagagtgagactctgtctcaaaagaaaaaaatttttaaataaaaatagggaaggaggccgggcacggtggtgtaatcccagcactttgggaggccaaggccggtagatcagttgaggtcaggagttcaagacaagactggccaacatggtgaaaccctgtctctactaaaaatacaaaaattagcctggtgtggtggtgggcacctgtaatcccagctactcgggaggctgaggcaggagaatcacttgatcccaggaggcagaggttgcagtgagccaagatcgcaccactgcacttcagcctgggcaacagagcgagactatcttaaaaaaaaaaaaaaaagggaatgcttatggcaagcctggctgggggagaagctgagttctattttgaatgtgttaaatatgagatgttaagtggaaatgtttactaggcaattgaatatctgagtatggagttaggagagaggctggggctgaaaagaggtgttttgagagttatcagtgaatggatggtgtttccagccacaggatgagagcgcagctagagatgaggaaaaggtctaagagctggtggaagagaggagcaaccagcaaacttgaggagaaactggcaagtatcgactgacttgtacatccatctaccttgctgtcgtgatcgacccttatgtttgtgttttgcctgaaggtggccactttcactgtctgctgcgagctcctgcaaactcctaataatccgagggacagaggggagtggtggtgtactgttctagtatctacttttatgattcaaaaacctgttctttttgaaatcacatggtacttaaagatatttatattatcttctctatcgtcttttcctcccttcatttttactttggtaattttacctattaagattgtgaaggaacttgacattttagggatttcttgtagatgttgtaatgaaatatggttttggaatttgatttagaaagaggtggaatgtagtccgttttctttctccggcttccctcaaccttccagttctttataggtggttcattgctttgactaccagaggccttaaatgcaggttgcgtagttgaccatgcgacctgtgaggctccctttgaacctttgtccctatttctgtaaaattaggagctcaaatgagatcaaggtgggcttccttgatttcttccagggaacagggactggtgggagtcagtggcagcaagtcttgtctaaaggtgtgagcagcaacaaagcaacacacgaggcaggaaaggactaggcttcattaatggaggtgatgcttcagctgagatatagaggggattgggggctgggcacgtgctttttggagaatgggcagcatttgcacagtgtgggagtgcgaacaaagagcctggtggaccagctccaggtggtgaccccatcaataggaatagggtgattctcctgcattttctcatctataagtagccatgtggggaatccaaaaaccagttaccaacattcaaaattgctagtgctgttagttctgcaagtataaaattagaaacaaagttcaagcttcgtctgccaagttgaagtttcctaagtgttctctcaaaacccatattaatggactcattttggcgtttgtaaccgggtaagttacagataagggcatctgcattaactggagttgccttttgaaactcctcagccctagctttggtttctcaaatgtggtgtgggtatttggagtaaactgctgtaaggctaagctgttagtaagcatttgattttgagagccctctttcctttgcagctcttataaatggattactcagtaggaattgctggaaattagaatcactgcctcctttaataagtctagttaaggcagggaggtgggccccgtcacagcatagggcagagcagtcacttagcaaggagctcaggaaatgtttgctgaatgaaagagtggagagtgaaaggtcgtgttctcaacctggcagctggcatttctacatcacttttactcagagatttgcagacaaaactttttgtttaaaacaatgctatgttaattataatctaactgttacacaatttttttttttttaaatcacagtacagggctgggcgcagtggctcatacctgtaatcccagcacttccggaggccgaggcaggaggatcgcttaagctcaggagttcgagaccagcctgagcaacactgtagaaccccgtctctactaaaaatacaaaatattagccaggtgtggtgacacacacctgtagtcccagctacttgggctgaggtgggaggattgcttgagcccaggaggtggttgcagtgagccatgattacgcactgccctccagcctgggcaacagagcaaaaccctgtctcagaaagaaaatcacagtatacatggaatacaaaggttttttgtgtttgtttttaagaactagagccttcgaaggagcatgtggcttactggtattgggctgaaggatgattgcatggggcccatctggataatccaagatactttcctgggcaggggcattgacagggatattccctactttcttccacctttagaggatttactttagaaatggtttaaggtttctcaaagttttaagtctgctgtgttggaattattaatactggagtttgtcttttaattgtgtaaattacctggcttgttcattacaaataaccattggatgtcctgtaagtgctaggcactgagctggatgctaggtgatgcaacagtgacaaggacaggtgtggcccctgcccccatggagctgaccttctggggagggagaaggacagtgagcaaatggtctcacacacagtcgtataatcactaactgtggccattgctgtgcaggaaaggcaaatgataattataagagatgggacctgaactagcctggaaagtgggaagttttttttttgttttgttttgttttttttttttgagatggagtctcactcttgcccaggctggagtgcggtggtgccatctcggctcactgcaacctctgcctcctgagttcaagtgattctcctgcctcagcctcccgagtagctaggactacaggtgcgtgccaccgtgcccacctgatttttgtatttttagtagagatggggtttcactatgttggccaggatggtctcaatctcctgacctcgtgatccacctgcctcggggaaggtttttaagcagagacatgaaggggtgagtaggaggatgcctgaaggagagaagaagaaactgtgcaaaggtcctgagccaggagagtggtggtggttggaggggtgtgaaagaagcccactgcagttcaaagagtagagagtgatggagagggttaacccagaatgtgccctttggaaatacctaacctgaaatacttttacctaagccattgttaggatctgagttcttggtgtctgagcacaactgaatgtgaataagaggctgtttggatttcctgctgtggatggcaggatgctattcacaaagaagcctatgtcctgaccctccagacctgctgctacattaggttaaatggcaaaggggcattaggttgcagaaggaatcaacgttgcttatcaactgatgttaaaatcagggaagtatcctggattatccaaatgggcccagtggttcttgtaatgtggaagagggagacttgaagatgctcgcccgctggctttacagatgaaagaaggaaccatgagtcagggaaagttttcctgttgggcactaggcttagtacctgagtgacgaaataatctgtacagcaaaccccggtgacacgagttgtgctgcataacaaacctgcatgtgtacccccaaaccaaaaataaaagttaaaaaaaagctggaaagggcaaggaaacagatcctcccctacaacctttaggaaggaatgcagccaagtgagacctgggttggcctgtggccctaaggaactgtgagatagtaagataagatgaaggctattataataactgtgttttaagccactaagtttgcggccatttgttaaagcagcaatagaaaacatcctgcctacccaactcaacgtctcattgcataggtgggtgttaccaccaagtcacttggcagtgacgacctctggtgcctgctttgctgctcacagagcagtggagagtggctcttactaataatgcctccaggtaaatattgctcagtaaatacttactgagggcctgccacgtgccagaccttgctctcaaagcttgggataactgctgggtgaaaatggtaagatgtgtgccctcaccaagtttcattctagatgcctctcagccctgccccatggagaagggccagcaagagtgtgaatttcacatccagacaccaaccctgactgcagctgctgctaaatagttgtgaacagcagtgacttttccctgaaaaagaagtcccttccttatcttaactacttgtaggaaaacatatatatactgaaatagtttccttccaggttattctgaagtgattctttgggactgataaaatgggacaaactgaatacaataatagttgctgaagcctagctcattactgctggatagaacctgttgtgagtacagagttctcagatgtctttttagatctccaaatcagtcaccaaaataaggaaaatagttttttttataacttaaagtacacacacaccaacatgcatataggctagaaagcctgatatgaggtgttagtctggtagattgacttcttgtttaaagggagaagagtttacagaggcagaggcacagggtttggataaacgcacaaacaagctttaacgcctcctctgcttttcttcaccaggtggggaaggcagggaagtggggggacccttaactaaagagaggagagtaaagactaagcagtcgaggcaggccaccaggtttgctgagggcagccaggaagtggtagagggtgtggacattccctgttaatcactggcccttagagagcaggcacttccccctgcagccagaggagagacagtacttctgtcagtggatacctggagggtcaagctgcgggaaaggagagggactcttacaaggccagtgagctttgaccagatgagcttaccctcaggtatcctgatcacgtggagactggccatatggcttcccagaccaaaataactcacctgtgcctgtgaaaccataccagggccagatgcagctgcactgttgagatttgaagcgtggtgctgttgaattcaagctgctgcatcagtcaggtttctttgccagctttctatccgagcctggggtgaccatatcattcatcttccaaactaggacacgtttaatgaaagggagtggagtgaatgttcaatctttagacaacaggtatgatccaggactgtcctggggaaacctggacatatggccagcctagctaaggctagaagcgttaaccattccattggatggtctgatgacccaaaatggctaagtacaacatagcctgtgtgtggaagggcctcagcacccccaggaagagagggattgtcccaggtgcccttgctagcatatgtctgtgcccatagcatagacagctctctgatgtaggggtctagaataggtgttttctttataatccaaatacaaagcaatatttatttttaccccaaaattattctccttgtatttgaacattacaaaattgttctcttatgagagctgcccttctgactactttattttggaatgacacagtcatctgttctaaacaccttggctaatctaaaaggacctcaatccattttagttgtgaatgctgatagaggttaactttggttttaaataaaaataaataatttaaagaaggaggcaggtcactgtggtggctcacacctataatcctaacactttgggaggttgagttggggagatcacttgaggtcaggagttcaagaccagcctggccaacatggtgaaaccccatttctactaaaaatacaaaaattagccaggcttggtggcgggcacctgtagtgcgagctactgaggaggctgaagcaggagaatcgattgaaccttgggaggtggaggttgaagtgagccgagatcacaacactgcacttcagcctgggtgacagagcgagattctgtctccaaaaaaaaaaaaaaaaaaaagaagcaaagaaatttagttcacattcaatactcattcctcaggatttagcatcgtaattgcaagtactggatgttacaaactttaaaacatcctggaaatgttctagaaaactgggttaggcattgctctctgatgaagtaatatcaaagaaacatacagagtttgattaaaattgcttgatgaaatacaaataaaattatttttaaatgaatgtttagtatgtgtgattttaaatgtttgtataaatttaaacgatcaaatgtcagttgactttcatctgcgttcataaagcttaaatatatatgttagccaaaaaaaagtttggaatgtttttccccgttatattcatttatttaggcatacatagtatgtgaggagtggtagtcatgataagagagacgttgtggtaacagctggggaaaggcatcccccttcaaactgggggggaagctaggctgggatgaaaatctgatgcaagaaatgattgtattttgacttgtggttccagatggcaaactaggtatatggttttgcttcctggctcctcaaggctccctaatagtttagagattatgaagaagcagaaagcagatgggatctgggcttatgaccttagcaggggaaggagccaagtctagagttcatcatgtgcccctccccgccccccaaccaagagtgatcaggtaaagcagggactaggagagaggagtgggtctggaagtgaaggaccacacaggggtccacagagaccaggtgattccatcgttccctacctctgtctggagtaggggctgctggcacttaacaccctggctgtggggaaaataccaaacccatagcactttctggggacaggcagataggggaatgttgacatgtacacgttttacagagcttaaattgattacaatgcacaaaaataatgaattcttttttttttttttgagaccatctttctctatcactcaggctggagtgcagtagtacaatctcggctcctgaaacctccatctccggggtgcaggcaattcttatgtctcagcctcccagatagctgggattacaggtgtgagccaccgcacccggccaagaatgaagtctttatagaagtagattaggccaagtcatgacactagaaataaaaaaaatgcctaaaactagggcttctagtgtgaatgctgggaccccaagaattaagctgtcctcattctggcatttgaagagtggtttgcagtctgataactagctggctacccactcagcctaaagcgaatccctggagtcagcagccccacccaggactccctttcagaattcctgctcagggtgagagcgagccagaaatggacctttttatacaacatcagaacaaaagagaacagggattatcaggcatgtgatgagagctagcagcataaaaggcaatggccgaagcaaaccaacagaaaaactacaagaaacagataatccaggaacacaaagaactgtaggaaaacttctaggcaaaatgcttagaattttgggaacatgttaaacccacagaataagattaggatctgttatgtaaaaggcacagtcagaacaaagagctcttgaagactgcaaatgtgactactgaaattaaaaatgtcagtataaataccagaaaatacagttgaaaaatctcagaaccacagagaaggagggaaaatgagagaaagggtagattaacccaggaggttcaccacctgactagttaacagaggtttcagaaagaggacagaaaacatacaaatgaaacgatccacacacaataaaaagagtttccaggaaattcatgtcctaagtctgtggagtgaaagaggtcccacataggctcaccatcatgctgttgagaatgccttgggtaaagtagagaacgtggtggagcacggtggttcacgcactttgggagactgaggtagctggggcctcaaggtaggcggatcccttgaggccaggagttcaagaccagcctggtcaacatggcaaaaccccatctctaataaaagtacaaaaagtagccaggcgtgatggcacatgcctgtaatcccagctacttgggtggctgaggcatgagaagcacttgaacccgggaggcaaaggttgcagtaggtagagatcatgccactgcactccagcctgggcaacagagagagactgtctcaaaaaaaagaagttacccttttgagagtcagactaacaccagaatttccactggcaacactggatactagaattaattacagcagtgccatcaaggttctgaagaaaatgtttttcaacctggagttttacacccaaactatcaagagtgagagcagcataaagacatttttgtatatgcagagtcacactcagtttacctgtcatatgctattaggacagtatttaagaaagtaattcaaacaagggggaacatcagatcccagatcaaatccagttaccccaggatagccatgaagggctgttccagcatgatcctgtgtagcaggcccggcagaacatcaggtctacattgctgcagaaaggtccaggggctctgagaagggagtgtgagccaagatgagatcctgatttaacgcgggtatggcttgggagcttagagaagattgaggcttggataaaggtgaacaatagaagaaaaaagaaaggcaatgagaaaagccaaggaaagcaagagtcatggtccaaatgtgaagtacacaaagcaattgatagaatgtaagaatagcaagtctgtttgaccttaatgctaggaacagtttcttttgaggctgagggcttctgatactgctcccagacagaaaaaggaaaatcagaatacagtttggttcagcactgagtaatacttatttggctatgtaaaagaatagatgactgaattgtggttaaaagtcaaaatgtaagtggtaataggtcctgtaagtgtaaaggtgtagctggtagatagcaagacatggagaaactaagaggaaagtttggaaggaagaatccaaatgctcatagctttgtctcactaactagggaatcaagatttctgtcaaaagttgaagggaaaatagaggtttaaatctttaaaactcagagtagcaaatagaggaactaaatctagttattaaacataggatgggaggtggcagtttgttctttccttttcatattatggggccaacagttattgcctaaagctgataaatcaatacatatataataatccagaattatggagaagtaaatccagaatgaaaagtaagaggtttgtccggagtgtggggcttgggatgagtttggaatctgttgctttctaccgttaagtcttttattttttgatttcctatcatttgtacttattactttagcaaaaattaaattctgagtttgaaaatgggttaaatgtaaaggtgacacaattgccacataatgctactttctaactttttaggtcttaatttggacaaactaagcaggctgtgttttaaattaagcaataatagtgttcttgttctaatggtgcaatatttcatgtttcctctgaccagcttgcatagctaggggcagaatctttaatccttgaggaaatgaattattgccaaagacagtgaagcaaagctgccattgttcttggagttttaaaagtgtcccagtgtttagaacttttgatttgaagtatttatgcaaaagtataccagctctctttgggggagaacttgaatatatgaaacggatgtggcttacttgaagaattttgaaataaccttgtgttcatagcatgatagtgagtcctgagtctctgtgcccagagctctgattagactccaaagacctgaatttatatcatattcccagttactgttatacttatatcgttagatttttacattccattttagtatctcagtgtttatttcttatcgttaaagatgattttgtggttttgagttttgccttttaagtgtgggtttctgatatgctgaaatcccaaggcagtttttatttcggtgcagctttaaaattcagtggaggtcattgtccactggccggttttgaaatgatcttagttcacacccagattcttgccctttgtttagtttttcttgccttgaccgcatatgggaatagacctctcaggctctgctctgttaatttctatcacctccctacaaaggccctaactcatatcccttggtccctgtggctctgaaggtcgagttgtcacatagctctttcctccttcaaacgtactgggatggtcagtaatgagtgctgcagctgccctggtcctaggagttgctgtgagcatcctggtagtgcccagagagtacctgcttttcacactgaaccatctgggtggcctgggcccagtttttggcatttaagggccttggagggaaagggaagaaagctggaatttgagcataaattggattttgtgtgggctgagggtcctcctaggtgtagactgtccctcctggacctgtacccactctgctagctcaggagccaaccatgtcctgaacagcttagaccagcacccagaccctaaatgacctagattaggaagtagataggttgttctctgctgtcattgtttggacacagctctatttaccttatttattgttcctgctaggcacagcctcagctaatgggctgtgatctcctgcctttaaggctggttccaggcgaattaagagcctttgcttgtttcccaaaccagggagggcagctttaccttgaggatgaaggcgcctccagttgctgaatgtggttggggttactgtgttctctcatcaaggtgtagctttaccttacctttcggtgatgggttctgccaccttatcgcggtgggtcccaggagaccgggcgcaactggagcaggggcgccctctgctgctgggtgtcagctcttcctcccacggctgcccaggggatttgcaaggggcggtggaacactcctgcttcctccatcccctgtgggaccacctgaggtggaggaaggacagtgccaggaccatgtgcaggctgagctcgcccagaggcggtgcaacagctaacgttattctctgtgggtacatttctcttgtcgtttgcaggtctcttttcgaatctgttgtcctttttccccaaaccagcctgctgcccccatcctgccatgtggtctgctgtcatctgcagtagccgccgcatgtaagacacgaggacctcttctgcaagagcttggtgtgggcatttgtgaaattttgtcaccacagcccctgtaaccagccaacaaattcgagttaaatgcctattctttgtcccacacgtattagttacagagagtggagaacaagtggcagatagaggctgagggaagccaacccactctgagggactgggcatgtaaatgggacaacctccacagctttttaaaccacaggacacccaaaagcagctgtaccctgcaggacacagcaggctacagaagcctggggttcagagggtctctgacccttcgtcctttagcgctgctgaccaggctgctgatcctcgaccccttcttgtcacccattgtgtccctcttctcccttttctctggctccttcccttgcagcctttgcatatgctgtgttccttacctggccacctccagtcccgctgtcatctcttagtgacatcctcccttcctctccagcaggtgctggtgcccacagcactctgtaccatcctctcattgcctctagctccctgtggtttcatgacctcatgacctgttcacggatcaggcttccccaggccagagattgaggagtgggggcaattccttattcatcctaggaggctcttaatcagcgtttgttgagtgaataggtgaacgaatgtgggaatgggataaacaggaaataagccctgtgcctgccttaggtaacttagtagccaccttgggtgtgggtgagaagaggaagtggttaggaagacacacagttaagacaatgggactcctgtgctgctttttctaggcttctctttgctggtggttacctttacaggaaatctcttacccagccttcactccacccaactgcaataatgcttttcttccttcccctctacttggctctattatcttaacttttatcagcatacagaacagttttggttgtgatgttttatttgtgtaagttttgccctttcaactaggttgtaaacttgaaatcctgggttttacttcctaagcagctttgtaaagaaatggagacaacattgcaccaagataatttttgtcatggccacccactagctgtgagatcttgggggatgagtaattaagctcctcaaggcctctgtttctttatctgtaaaactggaggactggtctctctcaggggcttccagtgtgaaagtcctggggttctgggcctctgatcctggcaccccacttatcccttccagcaccctccacatgactccacctctgacatctgccaagtacagtaatttaacacattcaccttatagtctaggcagttcacctcccaggtacttgtttgttggcattcctgggatcggggacatcactggaataggagtggagcagacctgtggggacccttgtggccccggccttgcctctgtcctctgtcaagaaggttcaggcaccaaggacactgctccagttcctaatttaaaagtctgtgtgtcagttctgtaccttggtgtgtgctgttttgttccttcaaatgtagggtgggtttggaggtgggggctgactgtgactgtccagggatctgggaggaaggacagtgctggggctatgtgttatccatgagccacccctccttctctgtctgggcatcatctggcccccctccctgctttccaggtacacttgcctccggtggcacctgctgcatgatattggtttaaaaaaaatatgttgaatcctttattggaatgattcctttattgggacccaacaggcatgaaggtaatagagactatttggtttgtattttcatttgttttgcttttgcttctgagatttgtgggtttcttgatggccaggagtggcttgttttctgttgtaagaatttgttgtttgtacaggttcgtgttcccagtccttttcctcagctccagccttgtttccaaaactctcagctcttggtttatctctgtccagtcaggtgtgtgttctttgtctttgtttcttgtcctagttgttccatgagtcagccaggcctcaaagattgtaaacctgatggtgagtaaaggtgttagcaaaagagacctagcaacaaggtcattggatctctaaagagcctgtcaagctgtgagatggtgaaattttaaggactgtggatttggactgggggcctccttataggagataaaaacactcggctggggagaagaaggaatattacagtgcctagtacataagtggagctacaccagttgtccctgaatcctttgtgggagactgataggatgagagaggacgaactcttgtaatgtgacaaaagtgcaaggaagtaagaactgacttggaagaacaaacatcaacttgtacacctcaaatatatctgctttttatttgtccattctaccctaataaaactggagggaaaaaaaaaaaagaattggaaagaggccaaggctgcaagtgaataattcagtcgagttgtatcttacttaccattaggttctctcaattagtatataaactgaaaatctaagatatagtcagaattacccttgaaaactacctcaggaaggcacagtgttagaaactgacatattattgcttattacatttagtgtggccattttttccttccattgtcacaagtatttggtttcttctcttgagtttcatatgatatccctggcatcataggggcttagaggttgtattctttgaagagggtgtcttttaaacaccagatcatacccagcaagaaatgctgatactatgagagacaggcctattttcctcgttttggtatcccctctttggcttcccctgtttagttgtgtttgtgcgttttgcatgaaccagccataggactctacatttgttctcactcactgcctaagctgttgaagaattagtggactcctagacaaagaataatcccactatctcctagttctgactgatttaactgttaaacgtatattaaattcaaatctccaaattgtctctgtttcatcaacaggttgctcgtgggggccccgcgggcagaagcgcttccactgcagagagccaacagaacgggagggctgtacagctgcgacatcaccgcccgggggccatgcacgcggatcgagtttgataacgatggtgcgttcctttccctcactcagcgttcactccggcagcttgcctgtactgtttccatgagggaggagagtggggacaaacatttattcttgtagagaggacttcttttaattgcatcagacttgactgttttttatttgccctgaaaatatttacttactttacttctgaatcatactgggatgccgcgtgttttgctgctcctcctaaccgtggtttctaaaccgatatggtgtagggatgttgccacctagtgatgtgttgaggttctgcaggaggttgtggaaaaactcatttcatagcaatgaagagaatgaatgagcgtatcttgtattcatcagccaaaagttctcacatgctgttaaaatatttgggagaaagacagttttaaatatcagacccctttggaatgagagctggctaacagagataaagttttccctcctgtctcagatagagacttgttttgttaagggctctggataggtagaagataccatgaggtaggcatgttgacatccagtgtacctggcttcttgtaggttgagcagagcaattagtgtactgagaagctctagccaaacctcgtttgatatgttcggtctaagtagatttgcagattcgtgtctatgttcttctcttgcttcttcatcttttagaaataacatttgttggccaggcgtcggtggctcacacctgtaatcctagcattttgggaggccgagttgggtggatcatttgaggtcaggagttcaagaccagcctggccaacatggtgaaaccccatctctactaaaaatacaaaaattagccaggcgtggtggtgtacgcctgtagtcctagctacttaggaggctgaggcgtgagaattgtttgaacctgggaggcagaggctgcagtgagccaaaatcgtgccactacactccagcctgggtgacagagcaagataccatctcaagaaaagaaataacatgtgttcttttattagaaactaatatgtgttaattttaagaagctggtaaaatacacagacctatgaagaataaaaaaacccactggcaatctcagtatctagacttattttttaacattttggcatttttccttctgtctaaagttgtttaatgtttttgtaatgattcaagattaaaacctgtgtctgtattgctacttatggaggagtgcaaaatttggatataggtcacacagtgggtttaaattgatactgaaatgagcacctggtggtgtttgtggtccccgtctctctgactaacagtaactctcctgtttggcattgatacattgtcagctacaagatcctaaagtaaatctgagtctttttcttccatctccagtaaagaagagaacatttaatgctgttaaataaaaaaattggggagtatatagagaagtacccattttttttgttagtttggatggtagctgcagtttggaatactagattttacattgttgccttaagagatgtattttggagggctcccttagtcttacagtttcacttaccttctgcattcaggaccctaggtatcaagagagggcaaagggtattgttggacaaaataggcaactatatagagctaagtactttatgtttcaaatgtttgaaagattccaaaaaccacatctctgtttccttgagatgacaagtaatttttctggattgagtaactgaatttattgagtagctagactcagagtcgaggccatttggaaacagttgcttgtatttttgttcagtgatggtttctagcatgtgcagtcacttggaaggctaactatgctcctttctacagctgaccccacgtcagaaagcaaggaagatcagtggatgggggtcaccgtccagagccaaggtccagggggcaaggtcgtggtaagtgtagagacacatgttcatcctatactgttggactgctggttatgtgccagcaccaggcttacagcaggggacagcagggagcatacattctagcgaacttactgctttaaagcaggaatggatgtcaaaaagaaatcagactgggcgtggtggctcatgcctgtaatctcaatactttgtgaggccaaggcgggcggatcacctgaggtcaggggtttgagaccagcctgaccaatatgatgaaaccccatctctactaaaaatacaaaaattagctgggcgtagtggcatgcgcctgtaatcccagctacttgggagactgagacaggagaatcgcttgaacctgggaggtggaggttgcaagagcaaaactccatctcaaaaaaaagaaaaaaaaagaagaagtaatcacgtaatcaaagccttatttctcctgtgattcctgatatacttagaagcaatcacacaacctacttttctttagaactttcagatttaaataacttattaaagaacctttactaaatattcctacaactctagatggtattaaaaacaaaacaaaactagacatcatttctgtccttggaattttatagctttatagataagttagtaaaaatatgggcatggtcttagaaagtaataaccaggtagttttaacctcttgttatttattctgagttttttcaaatagaagggatagcaaagaaaagagggtttgttaggtggattgggctagatggtcatggtaaggccttcctggttggaatatgatctttttgtctccttcaaaatctggttgctgtaacgaaatttatacagaattttgagaaaaaaaatttagtgaacattgagttttgatatttaaggaatgacatttatggaaaattgatttgatactgtatttttaggctgtgtttacatggaggttagccattcataccctgtagaaattatagagattatttctgtctcttctggccttgtaattctctctgccttttaaaagtaggcatattttgggaaataatctcagagctcagggtgtaagttaggactgattacaaggaaatagtgtggggaaaaggaaatgtctttgttttagctgtgtttgtttgatccctatgaaaacaggtccatgatttctctcctctagaacataattacccactttcacactgatgttctgaaggtttatacagccactaaaagccaatttgaattaagaaaatgaaataaggtgtttctctttgtttatgtgacaggtaaatttacaaataaattgcctatggatacagattgtcattcaattttggattggaggattattctgagtgagaataaggcacattctagtttctatatgtcttcataatggtctccttagtgccactttggggaatatttgctggtctgggatccggtcccaagatgaggacatgcttaatcatcctctttagaattaacctctgtattgaccattttattcatatgtaattttttaaaaacaaggtttatagacaagaatgggctactttcttccatctgcttgcagacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaaggtatgacctttgtatttatagaaatagagattagttcccctaatttctgtaatatgatttagtacattttgagctaaaatgtgttagaagacattcgtatattataaaagttgggtaggatattaaaaatctctaaatgatatgatttttaaaagctaataatagtggaatatatgttttggtgttgacattcttttcccctctaccagtactttactttaattcaggtagttaacttttttttagcaggaatataataattaacattagtattttttgctgttttagatttgtgcgactcatgaagctggaagtgttaattttaagttagtgatctgaaaacttaggaggattaaataatggtatatacaaataacagtgtattaacatggacattaataacagagtattaatatggacatttctctctgtatatgttattttcaaaggccatgctttgctaataattcagtagagttagaagggcagattacagacgaattggggaattttgaggtataatttcagatatgtgaggaaaagtcgtttgattattgtgatgtgagtaaatggagatgtagagaggtaaagaagaaaatggcccacattttttgactgtgtatgtatagaaaatgctatatcataaaagacaacctaactctcatccatgatgaagagaactgcatctgatttggaaataagccatttttgagaaatgtattaataataagtcacataacactttcactcatcagggaaaacttaggaaaatggtcccttttccattcaacaatttgttttaattgtggttctaaatgactcttgaacacctttctctgtgtgcaatcttcaagggtaatttccctttgcccccacctccaccccaacagaatcttcatgtacagtatttcccaggttattttgacctaactgaaataacatgttgaatttagttttattttagcatgaataaatgctttatatagtaaaacaaaacaaaaatatccaccaattatgtatattttaattcatggaaaatatggtttacctgctttataaacctgacctaaaatgtcgccatttaaagccatatagtgatttgggcttactatatgaaaacttatgttttaaattactaattgtaagaatttttaaaagatgaaatcttggttaaagtgatctaaagaaaagatcaatatgtctcacttttacactgcaaaaaaaagacaaattgaggcaggattacagagaatgtaaaatatatatatcaagttcatgtcatttaaaaattggttctctgtagattttgttaactaagcaaaccttccatttttcatctagtttcatggcattataaagatagttcatgaaaatgcatgggacagtttttaatgactcaaacaaatttctttcccataaaaatttacacaaatgtattttacaaccataaaagtcatctctgtccttcctttttttcctccaaattttttttcctgtaactagtgatagcatgggggatgtttattaggaaccatttattttcttttgtttcatcttcatttttttgttgtttttaccatttcattcctttagggattgttcgtgtagagcaaaagaataacactttttttgacatgaacatctttgaagatgggccttatgaagttggtggagagactgagcatgatgaaagtctcgttcctgttcctgctaacagttacttaggtaggagcaggcacagatggctgcctttgcccaccttctcagataccttgtgtgaaactccctcgcagggcctatggcccctggacttctaggctgagaagaggccaggtggggccgggccacttttgctggaatttgataagcttggtgatctagaggcgttaaaccgactgatgcctgggatcctttccttctgactggggctccctcaaagggggaagaaacctcttatcacctaaaatcatccgtcctccctcctgctcagaagtctgtctcttgagctaatggcagcctccgtaacctgaaacaggccgctcatgcagccatgaaaacatgcatgggtgttcacagtaagctgagatctttgttcagtgcctccttccagagatactcttaagaactgcatttaataaagttactcttaagtggcaagtcaagacctccaggtcctccctctgtgattgtggttctccaaggattagccctgcttctggattgggaccccatgtcacagggccccacagatggataaaagcttcccagcggaggttgagcaggactgctaaaacggctttcaggacacccagactgtgtctaagggccaattcttaactcctaaggcttgtttgcatgactaatgggtgtcctaagttattcatgtacattatggtaattacacaaaggcttttaaaagctttaattcttggtatgagttgacaaaaagaataattactgtgcatttcttggaaaaaatgtaaaaaaaagtctaaacccaaatagtaacctgtttaaaaaaaaaaaaagaaagtgaagaaaagtacccagatgttaggatattactggaagaatggaaagtaaaaaacgaaaaaacaggtatagatacatgaataatttcaagcaatgtgctagtaaacacgcactaataagttgttcaggccgggcctggtggctcacgcctataatcccaacacttcgggaggctgaggcaggcggattacttgaggccaggagttcaagaccagcctggccaatgcagcaaaaccccttctctactaaaaatacaaaaatattagccaggcgtggtggtacacatctgtagtcccagctactcaggagcctgaggtaggagaatcatttgagcctgggaggttgaggttgcagtaagctgtgattgcagcactgccctccagtctgggcaacagagcaggaccttacctcagaatgtttcatttagggattacttatgattaaaatacttgattgtaattgcactggccaagaaaccaatactttggtctttaagatggatggctgtggattttataaatttacttgctgtcagaacatttgaaaatatgaagcattttttctcaaacacatttgccacttttagaatggatttcctcaaaagtgaatgcctgagaaagaaatcaaattcatattgttacattcggtttgtctgtactgtgtggaatctgtcacttcaaaagatcagagggtttgggggaacaaaacgatctgcttgaggttttggaagctggcaatgagagcagcttgccggatgcagtggtggcctcctcatccagcgagaacagcagtggctgtcctgcctcttaccaagcataattactttttcttcaatttcttccgtcccgtgcatgcgtacaggcctgctgtttttgaccagcgtttcctatacagatcctgatcagtttgtttataaaacacggcctccccgggagcagcctgacacattccctgatgtgatgatgaatagctacctaggtttgtgacctctgcgacgacaaataaattgtcttggttgtggtcattaaatttttttttttgatccatacagagcataaatctttttatgccctattttgtttccattgaagcacacacaaaaagcatgccatggctggggctctgtggccagatggttgtaagagctggactccatattgccctctaatctggtggctcatgtttttcaattcacttcacaatttgagaactgcaacggtagtggtgaagcttttcataagtaaaacccaataaagggggtgagcttatattattctgcatctgcctcacctttctatagaaacatttacttaatttgaatggttttgatatgggcacttctatttgcttttcaccagatctgttatttgtaatctgacatcctacctgatgctttataatgggtgtgtcctaatgttttctgccctctgaacaagtatataactgataccaatgacaacttcctcacctctgttgtttatactaggttctcaaataccatgtatcatcagtcattgttttgtctgcatgtttgtgtctgagaactaagttggtccaaaacaatgaaatgctatctatggtgtattaatgatgttagcatttgtttttgtctgattaccaaagagttgatgcctcttaccaagcttaattactttttcttcaattttattttattcctgtaaaaatactggtcattaaattacagcagaaccctgtaacatgcactcaattatgcttccagtcaggttatatattctctgtgtatatgatgtaacataaccaaattattcctggacaattcagtatctagcttgatctccttttaccatagttccaatattaaaatagggtggaaattgattcttaagatgtatgaatacttcaaaattcaagttatacataggtgcttttagttaaaagtcttaatatccatagaaagcagtaaattagctagccccaggactttgtccttgtgtcacatctgaactctgtcactcatattacgaatgtgatagctggtgggagggtcaagaggagagaggggtgggaagccagaggaagaggtaatgatggagttaccaatgtcataggcctaaaatatatggattgatgtgaggggctctatatattttgtttttctaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtgagaaagcctcaggttatattatgctgcaaatcatttctgctttgactagcttctatacgactggagaagagccgtcctttcaggttcattgacgtaaagaatatttttattgccgcatttttaccagcctatctttatcatttctatgatggcagcagacagacattcatatccctccccagcgtataggattatatttttgattttcagtttttacttatatgttgggatcatgagtctatgagaattaaaatttgaaaaaaattgactcagaaaacacttgcatgattctgttctgtggtttcatatggggctgatggagcatcagctcccgttgaaaacaggaattggtgataaagtaaaaaacagatatgtggctgttggtgccagttgggggggttagaacagtgaggtcttaatgggagtcctgctgtactatggttctaactcgagaaattggctttgagttcttacccttagtatttttcttggggcgtttattataggctaccttggtttttaaaaaatgttataattgagtcataaattctggagttgagggcctttctattatatgtctttgtatccttagtacctagactggtgttgctggtatgttagctgttggttcacggctctttcccctcattatgtttttaggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccaggtagataatagattatgaaatggctatgatttatagattatttgattgtttaaataatagcgctgctgggcacagtggctcacgcctgtaatcccagcactttgggaggctgaggtgggcggatcacctgaggtcgggagttcgagaccagcctgaccaacatggagaaactaaaaatacaaattaactgggtgtggtggcacatgcctgtaataccagctactcccagctttggaaagctgaggcaggagaattgcttgaacccgggaggcagtggttgcggtgagccaagattgcgccattgcactccagcctgggcaacaggagcgaaactccatctcaaaaaaaacaaaaaaaaaccccgaaaaagccaaacaaataaataatagtgcttgtgtcatcttactttaaaacattttactagagtgtttctaaagcgtttgttaaaatgttaaaatgtgatgttgtcaacagatattgcagttggagctccgtatgatgacttgggaaaggtttttatctatcatggatctgcaaatggaataaataccaaaccaacacaggtaaccaaataaccgggatttctacagctagagtctcaactttttgccctataataaaatatttaggtttaagtgacttttcacacaaatcttattttatttacaagtccacaatagtataaattttttaaaaatgtattactagaagataccttcaaaataaatatataaatgtaatgacttgcttgttctaattgtaaaatttcttagataagttaggaatcaaggtaatccaaagcaaatgaatgttattctaccctgacggcattaagataagaggaaatacgatatattctctttagtagcatactaaatagagatgaaattggtcaaacaaaataaatgactgtaactacatggagaatgtagacaccaaaaattaaaaatgtcttttgagaaaaataagacttgtagggaaggtagggagatttggtttgaaatggcctgattgacttaatacaataaacaagctcatcagaaatgggctcttttctgctttgagatactatgtaaatcggatgacttttatgaaatgaaatgtatgaagtgttagatcatatagaaatttatgacttgtatataatataatttacttataagtgaactctcaaatttcagttcaaaagaaacttgtgtgtctttttcaaagcattgttaagaagctcatggtgataacctaatgtccattcggatgccctgtgtatttcaggttctcaagggtatatcaccttattttggatattcaattgctggaaacatggaccttgatcgaaattcctaccctgatgttgctgttggttccctctcagattcagtaactattttcaggtctgttatctatgattttagtgttaagcatgttctataatcaggttatactaaaatgttgaccttttggactgaaatttgtcatacctatacttcaaaggtttatatgaattgtgaagctatttctttttcttttgaagttagtaaacaatgtaataacaacctattttctaaaatcttttaaagtatctgaggaaaacatagatccaagttagaatttttacttcatatatttttaaaaccttaattttgatgatgaaaaaaacaaaacacatataaaatgtgacagtacaaagaacatacagaaggaaaccccctataattcaccatgcattattaaactccaagatcttgatttctattttattttctgtgattggaccatgtatatttaacaaaattaagaccataattgtgcataattttgtaacctgcttttgtctctttaggatacatagtagacttttcctatgtcactgagtacttttccaaaatgaagttaacaactgtctgtgaggcatcttctgacaggttcagagcttatttaaccaactgccttgctctcactggatggttacgttgcttcgcaatttttttttttgctcccatgatataaaaagctgtggaaaacattcttacttttgtttatatccttgattatttccttattataaattcctggatgtgaaattgatatatgtgcttcaagacttttgattcggtttcgccaagatgacctcccaaaatggtgcgacatttcccatccgtggtgtttgagtctccctttaaccagcgctttcatcactgctggaaatcaccattaaaaattggaggctttttttggtttgttttttaattttcaaaaagtagcagatttattttttttaaagttaataatatagaattatagaaaatccagtacattattcccatcttccacaaaacttgtgtgcatttctctacttttagggtatcatcaaaaggctacactgtaacttctgctgtctaatctggtttttatttaatcttgggctatctctccttgtcaatacaatagatgacttaactttagtcagttaaatgtttgcccctgtctatgtgtaactgatattttaatatccttactttcctgtcctcataagtaggttgactgtcaaccctgtacacttgttccctctttacttgcagatagtgtgaaagtagaattcaacaaccctttgataagaagaggagtaacttccccttattttacaaatgaggaaactgaggcccaggacttggcttgagcttttaaggctggagcctgagaggacagaatgtagcacctaaatcttcctgacttgaatcctgtgcattttttctactaaattgtactagcacttcagggtagttagtaaataaacaccaattttaaacatgaggcagccaaactaataagacttattttctatgttaaaagacacagttttcataattcatgtatattttgccctcaaaattgtgtgttgtatgtttaaaaaacaaaatatgttctaggcagaaatgtctgttaaaattctacagtatgtaaaatactatatctgtggcaactgtgccttttaaatatgctctcaaaacttaagaatgtatctagttagtatcttagaacctagcagctgtctaaatgtaaaataaaaatagaatggtaaacaataaaggaaaatggaaaaacagggaatgtgggcagtatttgaccctttattggaccctaccttcactgtgaatggacttgtgctctagcctaccaacagattgattccagaagttcgagctagctgtttgggatttggaatgcattttcttgtagaaacactgttctccagaatggctgggtttaccacaagcccatcagagtcagcctaactgaatccacgtggtaatgaaaccccaggccccattctgagttctggtggggagcaatggaggtgggcctcctcacccactcatacccctcaacccaccgcatacctgcatttcttgtgcctgtggcagcagttgggccacagacccgtggagacccctgtggctgctgggagcagggcagccaaaacatacgaaaagatgttttcagatggtgaaccagagtagggcgtggaattggattccagcttctcaagtgtttgcggggttgcagtaggcagcgcagagatgggaagaagtttaaaagtttaagtttttgcttgcagagatatcgtgggggtagaaaagttgtcaatcctggcaataggaaggcaaagactgaaggttgtgggtgggagactccgagggaggctgaagagaagggcaagtgtttgtacaatggagactcccaagttcaggattgcctgtattaattcacatactgtagacacgctgatcatgagcatctcaggtattaggtgtttgttggtgtaattcttccagagggtatgttggcaagactactcgtaattaaaaatgcacatattctttgactccaaaattctgctgctgggaatttatcccacagataaactcaagtgtgtgcacagatgatgtttgtgaaagcagaaagctcaacaacgtgaatgtctaccgattaggtactggttaaataaaggatgttacactgatacagtgtaacgccatcaggtgtgaaaaacagtgaactagatctatgtgtatatacaggacaagacctctgaaatggatgagaaaaagccacatacagaacaatggcaattaagttcccatttagttgaaattatacatatattttaatatttaattttagataattttaactgacgtgtctggaagaacatacaaggctacttgggtgttcgggtgggaatggagacaaaatatttactttaacccccacatgttgcacatgtactcataagtgtgtacgtttttaaacaaatattgtataatgaggctctgcattgtatacatttatatctattaacagttattttcttcagcaatgggggaaaacgtcacgtgtattttttttcctgtgtttttaagctgtgctgggcagctaaggatgctctctagtatgtgaattagactcacattcaaggtaacagaggctgagcttgtttttcactccttttgtcttcagatcccggcctgtgattaatattcagaaaaccatcacagtaactcctaacagaattgacctccgccagaaaacagcgtgtggggcgcctagtgggatatggtgagcatccctctgtcttggtgggatccccctcagtttcccacctccacttcatgatgactctattgtcctgaggagccacagggaagatgacaggagtgctgggcaaagggaagagggtctgtcaagtgtttttataacatgttgatcatcaatgggcattggggggattggagagctagggaacatgttgggttttttccactgcaataatggatcttttaagaaatatgtgtttgattttattcagcctccaggttaaatcctgttttgaatatactgctaaccccgctggttataatccttcaatatgtaagtacctagtacctttaaaatatgtctactttctgtctgccaggttgaaagttctgcataaatcacagaaaaataaaactgcagtggccaacatgggtctgtcaattctggtgtaaagaattaagtgtatgttttgtctcccttttaatcaggagggcacagcaccgtgagggaggaaaaaaactccacttggtcgccatttgagttttccagagcagatggtttaggacagaatggcttggaaaagtacttatttgctaccacaaccatttcctccatttctgtctttgaaaagcagtgtggaaaattgattttgtggttgtgaggtggtgggtggtggctggtggttgtgaggtggtgggtggtggctggtggttgtgaaagggcaacggcaggagccagagcacagcacagagtcactgccaggctgccttctcttccccacgcccctccctcccggaacacccgccctgtgttcccaagagcaggcccctagggaatttgcaagccggccctgagaggtcagagacctggtctctgctcctggtttcagctttgatactgactgacccacagggcaagtcccttaacatatgagtttgctttcctgtccgttcagaacaatgcctagtagtcattagtgcatacagttgtgctggagatcaactgagaagacatgaaaagcactttgtcatttattagatactgttctgcttcctttttttgtaattcaaagtaagatttttttaaatttttgtggatacatagtaggtgtatatatttatggggcaacacaggatttttgacaagaattttgacaccgttaatgatactcttaacaatagtggccgtcgtaagctctcctctggcatgttttaatagcagccacacttcttcagctgtgagtcacctgacccctggctccagagtcaaggccaggggcataggaattccaagaaaatcttttctgcaaagaggaagtgaaaagaatgaggaaattctcaacccgggtccggccatggtcctggcagtttgggattctagtgtactgtatctgccaccaagggacactttgtgaagaacaaggtcattctgtcctttcatatggttgtcagcctttacgatactatgaggtaatgagtcctctgaagtgttctccctgttatctaaagtagtagttttctttatttaaaaagatgtcccttataatattccagaatataacctaattcaaataacctaaagttgttgcttgaaacaggaaaaaatagccacataaggactagggtttgcaatggtgaatcctctcacacgtcacagctctgttcttagctgtactctaattcttctttaactttatatgaagttttatataacactaatgaatgtatccactaagacaacagaatgaagatactgacctgtgataaagttcagtgaattatgaaaagggacagtttaaataaatgtactgtctttaattttttttaagtcccccttcacctgattctcagtgtcataagctcagttagccttcatctttccagatttcgagctgtctgcaggtggtttctccgtctccccttctgtggggtcgtctcctgctgtgtggtctctccatgggacctgcagaccttgcacgaagcattcttagagtggatggattatgacttcgtgcacagggggagctgtggccttttgctttgctttttgatgcagccggcattttgtcgagtgtagaaagcaattctttgtgtggcttttaatgacaagaaaatgtatactgtgactcttcaggatctatcatcctttcagtatcatttgtgttatttttacccaaatgccataccttacactagcccacttggataatgggccctttgccagtgtttggaatgaattagagagacaaggagaaaacagtgattctttgactaggcagccagagaaaaaggggaaacatttttattctgttctgatggccattttttcaaaccactctcagtttgactgtagatgtgaaatatcatcagagcactccttgacttcccccaaattaatcacctatataaaatacagactttctcctagctgtagcacagcatttgatgccatgtgtattacttttatgttatgtagctactccattaaccaagtgtttatggatggccttttatgggtggaactttcctttgaagacattcaaagaacatttgctttcattgcttttacttccacagtaaattctaaatgaactaagacagaacttctacaaagctacataagttaatacatctaaaatcttctcccagtagccaagaatgtgagcttattgtttgactgggctattttagctcagcagtcctcagatgtggtgttccatacatatagatatctataattgagccgtaatgagtgttctacttggcttgcccctcaagcagttagcaaaggtggcctgcaaagattttaagatgatgtggactgtctggagggttagggaaggttagagtgaatttggcagataaacggttttcctgcacccacacctcccatacttttgctgtgaggggcacttttgctgtgaggggcactcagcgtgtgagcctttatctggttcattgtgaagctagcaggtcacttataaatggatgatgtcaaggctgcagaggcctaaaatgggggagcattccatttggcagctgtgacatttaagaattctccagatggacacaaaaattactattgaaactgtcagtgtttctaaattttgttctgaatagctcacattcagcataagaatgtcacatcgtgtgtgtgcgcatgtgtgtgcaagtggggaaccagttactgccacttctgttcatctgttccataaatcatatgtctatcaggtgttgtgctagttgctggggactgtggtggggaataagactgatgtgatccttgtcctcggctttgccccactgtgggagacaatcaggaaatcacagcgtagtgggcttaaatgtagagactggagagatggaatactctaggatcgcgaagagaggccaggacaggcttcctggaggaggtgaggtccaagctgaaatctgaaggggaagggagggcttagccaagcaggccaacactgctgggaggtggaagggaaaagaagggaaagacagctggctgagggaaggagtgactcctgcggtggttaggaggcaagtgagacctgggcatctaagaccctgtagaaagcaatcgccttttgtgtttgtgatagagactcagaagctggtgctgcttctgtccctctcagtatgaccccaagcctccccagaaaaggtctcttccaactctaaagtgaatattagaatgtgagttattcattttctgtgttttctgtagcagatttttgtcctggagattgccttctccagccctctgcacactttggtttgctttcccttttgatggttagtgactgcttaatgaatgtaagtaatttaagtattggcccatgaaaaacaaagttagcagccacatctaatgaaccaacaaagaatgcgttctgaagtaaaaaaatgagattctgatcatccacatcctagcttccctccaggttccattagtgtaggttatcaagaacaggctgtgccttctagcccagtgcaaggtaggcagtttggttgtgggagctatattatgctgaccgacaggccctccatccactcaaaaatatataatttaccttgtaattcttttttatctttattattatttttttgagaaagttttgctcttgttgcccaggctggagtgcaatggcatgaattcagctcactgtaacctctgcctcctgggttcaagcgattctcctgcctcagcctcccgagtagctgggattacaggcatgcgccaccaagcccagctaatttttgtatttttagtagagacaggatttcaccatgttggtcaggctggtctcaaactcctgatttcgggtgatccacccaccttggcctcccagagtgctgggatgccaggcagaattcactgtgcccatcctcttttttatttgttaaggtaaaggtctcatcctactgtcgaaagacttctccatctctaaaatatattattcctctgtttagacaactatcctttatcagtgcttcttaaaactttaatacgtataagaatcatctggtgatgctgttattaataaagcagattctgcttccgtaggtgtgactgggcctgaggttctgcatcctcacaggccctcaggagatgctgctgttctagagatctttcccagatagcaaaggcacgaggccacttgaataagcattgactggtttaaagggagaaaatcagtttaggtgctcgggggagtgttgggttcctctgcttatcgttagtattctgtgggttcatgaacttcagccagaaactgattcttaataactgctgctgctgaaaggttttaacttattcttgagctcccccaggtggcacaatgaaaatttaactttgaaacattgttaacagcaaaaggaaggaaaagacagcttgatttgaaccatcacaattgtgcaaatgcatattaccaggaaatatgaagagaaacaatggcaatgttttctacaaggaattaaaatcttaaaaggagttcaacatgcttgtggctggattgtgcatgaatgcacttacgttaatatgattttaattttatctagcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggtgagggctgcagatggtcacatctgttttatgaagaggacagaaaaaggttatatggtgatatacagatttctgaaatttattctggcaacctcttaatcaatacaaaatcattgttttggaattccccaatagcatgtacaccccacttaactctgactgcatgcttttcatgcaggataatatcagagataaactgcgtcccattcccataactgcctcagtggagatccaagagccaagctctcgtaggcgagtgaattcacttccagaagttcttccaattctgaattcagatgaacccaagacagctcatattgatgtaagtctctctgactttcattttgccaaagtttttttgccatttatgatgctaaatcaaatgtctttgaagggaatagaactagtgatttgctttaaaggccattcttttgtgttaatatgtttttaatgtacgcaaagttagagaagacttgtttcccaaattagcaataaacataaaaacatgaaatacaatttggggccagagcgtattttccttcttcatttttggccattataacctatcgagactataaatggtagagcttatattctaacactgtttctcctttagctgtacatagaaagaaaaatacattgtgttttacttaccattgagaatactgaaatgtagaaagcagtgtgttgctagtcagaacattaaaatcaaggaatatcaaaattcagcaaagcaaaaaagtattattagcatacagtagtcatttagtgcctaatatagcctaagtcatctttggaagaaaaatgtgtattagatggcctgtgggatacctcatatgaggtggggtctgtttgctaggggtttaggatggttaaggtgcaaggttagcccgggcagctatgacagcttgatttggcattatgttcttgctttcaaaatctaattgatgatgaacgggtgtggtggctcatgcctgtaatcccagaacttcgggaggccgaggcgggcaggtcacttgaggttaggagtttgagaccagcctggccaacatggtgaaaccccgtctctagtgaaaatacaaaagttagcgggtatgatggagcatgcctataatcacagctactcaggaggctgaggcaggagaatgccttaaacccggcaggtggagttgcagtgagccgagatggcaccactgcactccagcctgggcaaaaagagtaagactctatctccaaaaaaaaaaaaaaaaaaaaacaactaattgatgatgagtgtctgtccactatggggctgctggtactggtgccttactgaggcagctttgcagaagtgagtcctcactgtctcaggagctgatgcttacatctgcatattgtcaatcatttttgtcaccaaatatagttccttatatttctgtatacttttatgtacttttattattatcatgttaatattacttgtgtacattcccagctccatagctagagatgattttctatttatcggtgtgattatcaagaacccattggcatggtgctagtatgctgtttgcttacctgaccttaagctctctgtttcgtcatctctacaatggagatcataataatagtatctttttagaggcctgttgtgaggattaaatgagttaagatatgtaaatcgagtattataatcgttggtatcatcattattattgatacttcttatagtagccctataaagttagaatggtggtatctccacgttacctatgatgaaacttggactctgaaaggttaagtgacttgctagctaagtaaggggtagagctgcgtttcaaacccaaatctgtgtggctgctgggtcacactcttctataccacactgcctccatgccctggtcaaagtgttcttcaaacacaattttactaaaggacagaatggaaatttgatgtgtggcaaagtacatttaaagcttgaattctgcattggtaattgtcacacagggaaatgaactgtgtggaatagccagtcacctacatcgatgccttcctgagtcctgaatggtgtaaattgacaatagttttcgttttcctacaggttcacttcttaaaagagggatgtggagacgacaatgtatgtaacagcaaccttaaactagaatataaattttgcacccgagaaggaaatcaagacaaattttcttatttaccaatgtaagaatcgttgtgtagcactagcaaaaatgattctggcttcatggtggctttgtgttaagaaagtttactggaaacgtattgaggactttgcctttttgttcttgttttcttatttttaatagtcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgtaagtattgttagagaccagctgagaggggaaaaaaatcaacactgtgtggcaaatgagtggattgtgacctagcgtgtgtttcttttacaggagaaacagttgagttgtgttgccaaccagaatggctcgcaagctgactgtgagctcggaaatccttttaaaagaaattcaaatgtaggtgatgccttcatatactgtattttactgttttaaataccattgcagtgtctgtatgcatggcctgtgttaacagctatttatgtttttttaggtcactttttatttggttttaagtacaactgaagtcacctttgacaccccagatctggatattaatctgaagttagaaacgtaagagttacatcaacctctccattcagaattatttcatgaaaatatgggcagtcaatgaattggccctgatctacctcataaaagaagtctaattgtagtgagaaaactgactggtaaaatacaaccctattgtttccttttcattttcagaacaagcaatcaagataatttggctccaattacagctaaagcaaaagtggttattgaactgcttttatcggtctcggggtaagtgtttgtgtttagcataacaaatcaatgtttgaaagaaccatttacaatcctcattaaaactggtgttttttaatttgacagagttgctaaaccttcccaggtgtattttggaggtacagttgttggcgagcaagctatgaaatctgaagatgaagtgggaagtttaatagagtatgaattcagggtaagttggagcagttggtcttttcattataccaaaagctgacatatactaggtatggtcttgagtatgtcattttaataaatcagcaatattaataagcattgtaagtaaatcatgagttaaaaattagtttgccagcttttaaagaacatactggcttatagtaaaaattttatcctccaggatggagaacaattgtcactgttcagaatccagttcagtttagaatgcgttatgatttattccttcctcctttataaggtcatctttctcactgcttgtggttgaaagaatattaatgtatgcctacctttcacaagcccagtttttgtggtgaatgtagatttggtatatgcctgtaggaaaggcagtgactggctctgaaccatttcaaagtaggcaatcacagtgactctctgtcctgttgaataaacataaacatagggtacagagtctgttcgtaactcacacatgggtttaggtctgtgtggctgaaatcacattcctgaaggcatagtgaccactgtggtgaaagcctcaaatggcaagcatgggcccacctgactccggcagaatgaagaggctgaattctcctctgtgtgtctcttagcattatagacacagctggggcaggtggtggtggtggttatgatctctatgcaggtgcagctggaaaagaagtctttgggttctggaacagtctcgacaccaagagggctcttacctcctgtgtttggcttctgccgcaggacgtcactctgttcccagcttggactctcagattcatggctgtcctaataatggttttgcagaatctcctctgggacagaggcagcttcatttttgcagtggatggggttttccagaagcaggttgttggtacactgccttggcccaggacttgtcattggccaagcagggtggttacagggcagttcacaaattcacacatgattttccctgggcgtatgttgagaacatggtatatctacactgctgattctgttgcatacagcagttgttcctagaacgagttagctatcagttgtcctttgacctttttgtttttatttacaaaaatctttaggcacaagtctttattttgaatgccctatctatagtccatttttggagcctgtgcttttattataggattacgttagatattttagcttctttctcttggtaaaaggagctgctacttaaatttacattgagaagattagactgagataatatgtattattttctaacaggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggtatgtcggtagatttatctaatgtctccataaatgcaaattagagaaactaacttgttaggggaaaatcattactgttcttaggaaagtggcatattctggcaggttgactttctctttggttgtcacaatttctcttttctagttgggtaactgagggaggctgaggcatttttgctggttaatgaccattatagtacataaggcagagtcattcagtgcttgctgaggcaaatggtattttctgatgtttcatcatgacccagtatgttacataataaggagaactgggggatgctcctggggtaatagtagctgctgttatccaggggccagccagtgttcactccaagtagaaccaaactcattggaaaagataatggcatctcagcaagtaaccttgaaagctttttatgcttatttttaaaatagtaattatttattgtgtactcattgtgtctcaggaactatgctaagcattttgttttcattttctcatttcattctctggatggtcctatgagggcgtttcattatcctcaccatttcacagatgaggacattaagattcagagagcaagtaactctctcagtcactcaggcgttaagagacagattccacatacaagccctgctctgcctgatgtcaaagcctgtactgttaacccctctctctatactgctccatgcttagataactggcctatcatttgtgttccagtttgatgaaggtttgcatgtttatttcttttattttaaattctaaggtgactgggtatgatcagtgatcagagttggtggcttatagcatgatcttctactcatcaatgttaaaaatcaagataatcggttattactaatctttgctataaggaaaatgcaattttaaaagttcttgtatggcttagttttcattgctctgctctgaatgagctatataatgggtctttttgcttctttctctgttcttcagtgtcacttattccttcaagatgtgctgactaccatgttttaggaacagagctggaggctagggatacaggaataagatttgatctctgatctcagtatgcccacagtttggtggggatacagaggaacaaagaaagcatatttctctttctctgagttttaaggtcagagtgggaatgaattacttagtcctatgagtaaatcaataaacttgaatttagagtgataatacttgctggttttacacttacttctgtgcctttggcaggagagaggcaaatattgttgattatgtgaatctggcactgtttgggaggatatgctcaagaggcttgtatggtaatgacaaagaattacataaattggaactattttggatataatttttttcaggagtctcacaactcaagaaagaaacgggaaattactgaaaaacagatagatgataacagaaaattttctttatttgctgaaagaaaataccagactcttgtaagtatttttcaagagctgtgaatatttgagaggatgaggggaaggatttcttcagaacaatgtcttttgatgaccattcttctttttctctctagaactgtagcgtgaacgtgaactgtgtgaacatcagatgcccgctgcgggggctggacagcaaggcgtctcttattttgcgctcgaggttatggaacagcacatttctagaggtatgaccttggcttgaggctgtcccatggaagtaatttgcctttgcctaggacacttttcacttccctaatgcattcactgtctccaaacaggaatattccaaactgaactacttggacattctcatgcgagccttcattgatgtgactgctgctgccgaaaatatcaggctgccaaatgcaggcactcaggtgagaggttccccagcttcattcaggttcagaacatgtctcttttccctgtaccccacactcatgtcctgaagtcatgtgctttggtgctcatttccctcatagccccattacggagaaaactgtcttaaggtactggcactgcaagctgtattttaatagaatcattgaaaaaaagaagtaaatctagggtcatccagttcagcagtgcccatggtaggtttgagaactactggctcaattcagagaatgggtgcacctcacagccctctagaaacctgtgtcttctaccatctctaatgctgcagccattggtgtaatgccccagtgatggcccatcccttggccagctgtaattattaaaaaagatctcttcatagctgactcctgaactgaaccttgtaagtccctggttatgcccctcaaacaagtctaaaataagttctctctcttggccatgtagcagcctctcaaataattgaaggaaatggtcatgcctccttggatgtttcttattcttctcagagcttatgcacccagctcttgagttatgcgtcacattgggcacagctgaactggctcctggcctctcccttcctgggcaatttgattcccacgtggacagagcagctgaggtggggtctgcttggtcccacttaccctggggcctttacctctcagcatctcggcaccacacttctgtcagacctgcctaaaatttgctttttcaaaccattgctgagcagcatgtttgaatttctagcagctgctatttttgtgttagtgttctactgaaacttccaggtgttttcatcagaatttgttgtcaagctgtgtttccagtatcctgtccttgagctatttgtaaaaatctaaatgtatgcctttaagtgtatccttacattttatgtgatttgctttgggtccattgtttcagtttgcaaagtaattctgaatcttgcttcatcatttgctttctcaactttctatccctgaaagttttaaaaactgagaagcatgttctctatgtcttcatccaggtaatgacaaatatgttgaataggactaggtgtagaaccttgtagtgaaccaatagtgaggggttccctgtgggagtctagaacccacagggacttgtataaagatctcgaggcagaatgactgcatgtcatggtgggaataatgaatgggaatgttttgcaaaagagactggagaaagaaatactgtgaattactgttcttaagttaatctgccagtctacttatggaaatgttctggcttcagtcatttagctagctgaaaattcagggagcctccctaatcattctgttttctgaaatatagcagtccttacgatttattatccaagcaagaatacatttttgtttttatttagttttttgagatggagtcttgctctgttacccaggctggagtgcagtggcgcaaacacagctcactgcagccttgaatgcctgggctcaagcaatcctcctgtctcacctcctgagtagctgggaccacaggcatgccaccacgcccagctaatttttcagttttttttgtatagccagagtctcaccatgttgcccaggctggtctttaactcctggactcaagcaatccgcctgcctcagcctcccaaaatgctgggattataggtgtgagccactgcacccagccccaggatacatttgcctgagacaaatgctgtactgggcaagctgctgcgataagtggtatcaaccagcactgtcccggtctctccaggacatatcaacaggcatcataagggactttcaaataaaccacaccttccctaaggatcctttctctgcatctataaaggcagcaggtatagctttctataactgtaaatcagcaactctgaaaatcactgagatttcagagctagacagagaacactttagagggaagggactaacattaatgaagccttaataaaatgtctgcagcttactagatactttatactctatcattcaaacttcagaagaatgccaagggtaaacattgtactcattttacaaacaaggaagcagactcagagaggggatataatttgagaccctcaattgaaacctgtaattgtctgacttcagggcttctgttctttgactctgtggcacttggtccccttaaagtccccaaatctcaaattgagataagaaaactgaatccaaggaaaggtatctccccgtcagggtcacccgaccagcaagtagagctgagaccagaccttgggtctgatgtctcctcttcaagtgctgtcttcttctggaagatgatggaactctgggggccctggtgtccagtctgatgactgggtcacaaatgaaagtgaggttctcttgggcattttatgttcttagagcttggagaactcatgcctcccagtgggaattgatgtcttcacaaattggtagatttgtgaatgggttactggtctcatatctagaacccatgtcttttgaaaattgagacattttcttaacctctagtcttctgacaccttttctgttttctgtgatttctgacatacaatagctcagatgtcatatctgcacatttcttgagtagtttgagctgtagtttttctgggcttgaagatctaagcttaatttggcttaaaaaagcaaaaaaacttttttgtttctttataaccccacgaatttcaagagttttgtgttcatcttttaataaaacacagttaaactttgggaggccaaggcaggcggattgcttgagcccaggagttagagaccagcctgggtaacatagcaaaaccccatctctacaaaaaaatacagaaattagccaggtggggtggcacatgcctgtattcccagctacctgggaggctgagctgagaggatcacctcagctcaggaagtcgaggctgcagtgagccaagagtgtgccactacactccagccaggacaacagagtgaggccctgtctcaaaacaaacaataaaaaacacttctaaattaggatactattataatgaagtcagggagagcagaagtcacatgattgagccaggtaagccatgctatattttagcatcagttaaattaaatccatcttgttaataaacacccatgaaagacacatgtatgccttccctgtgctaaatgttagagatgcaaagttgggtaagatacagtgtcaactgttaagaatgtcatgctgtaggagacagaaccaggaaaacactgtcaaattagccagggaaattgagggggattgtttattggttgtatttatattgtccccatttatccctaaggaagcaagtagagagtatccaagcttcctggctgtcaaaattttttttaaaatgaccaaaaaaatgcataattcttcaggggaataagattttcccttttggctctaaattcagagaacaacttaaaattcagagaacaacttaagatacggatccttttataagatggcctgttatatgataaacaccaagagtggatgatgtccttaatagataattttgtaaaagatacgaaaatcccttcattgggtgacttcctgtactgaatgaagttcaatgagaacagtgggtggtacattacagggtaatttagagaaggtattttggcagttgacaagctaatgtagtctcagcactgctcactggtaatcgaatttaatgcatcaacagagcttatatccctcttccccttatgggcacatggtggatgagtttcacaggtgtgcgtcatccccatggaaataactacattgtaatgaaaccaaaggtaagaaattatttttggagttgtaaagctctacagtagtttctactcacctgttcatcagtaacagttggtgtgacaagacagaacaaggcttggagctctgggaatcacagcccaccctttgtcttccatctttggtcacctggctctatggccagcttccccttgttctcaatcccagctggagaatgactgtcataccagaaacaaaaacaaaaaaaacaaaaacaccttcagttgacagtttaagcaaacaaccaataaagtcttcctgactggcctctcgccctccagaaccacggagcacatctgccctttaaatgtgtagccaacccagtccctgactttggttctcagtctttgatgcccagtgagttaacaatatgtggaagttctggtttgaatggtgccaggcctggggcttagagcttcagctggattcccatccaccctgccactccaggctgcaaaatcaaaaattactttgctcagttgttaacaatattggatcccaaccatttatgggggtggctttcccctactgtcagctgttttaaagacacttgtgcacagtgtcattataataaagctgattctccttgccgaagaccagtttccactctccacttccagatttactggaactttttcttacaaatgaggatggcccttccacatgaccatcttgccctgaggatacactgtacaccttccttgtgttagataatagggcaacaaagttaaacaagatacagtttaggctaattgaaatcatctatttggtttgtttcattgtagtcagcttaccaaccacgtaactattctattgcttcactggtctgtccctgtttcttcttcccttctttgtagatgtccctgtgctgaacgcagtaatctcttccctgtcaggggagggaaggagaggggaagtgagccacgaggccaccttggggctcagagcttgtagaaaacctcatttagagcataacaggaaacatggtggctgataaaggtgttttatgcctgcctgttaccatcagtataattggctaaatctcaagatgtgattgctgtctattgaatgtttaaagaaaagcagttttgctgcttttaagtattttttgtaagtcaggtgaggttgagaaactgtttcctagaagtggaaagggaagtactttgatgagagatttttttaaagaaaaacaccaccgcatagaagtattgaagcacagtgtagacatagcagcatccagggttcaatatggacatagaatatttgactgaaaacacttctcagaagttaaatgctccccctgagttttgtttccctttactttacattctcttaactcagaaatatcagaaacttcaaaccagtggatctctaatcagtgtagtttacaaaatcatgttcacaataatcaccaggtctttagcatgctttgaaaaatagttcctggtatcacaaaagttcatttgcattctaaacccatgtaactgagttgttggaattgccagaagcagctttttaggtttctgagtaaacaccatttctatttaattgatatttgcaaactatcctatgtttagagtttaagcttctcagcagcaggagcaacttaagcgctaagctgcctctgagtgggtccagggtctagtttgttcatatacctttttgtagaagatggcaccaagccatttcaggaaatgttattgtttatgagggtctttagtgtgatatcctaagaaaaaggtaaaatggtgtccatcagtcatgcagccctatccctatttttgtatttcacaacatctttaaagtctgaatgaggaatgttggctacttttgcctaaactggcccttttctttccattgctgaatattaattaaaagaaagtataggccaggtgaggtggctcatacttatgatacccacactttgggaggtcaaagcaggaggatcacctgaagccagcactttgtgaacaacatagaccctgtctcaacaaaaaaatttttaaaaaaattagctgtgagtggtggcatgcgcctgtagtcccagctacttgggaggcagctgaggtgggaggatcacttgagcctgggaggttgaggctgcagtgacccatggtcacaccacttgcactccaacctgggcaacagagtgagaccctgtctccaaaaaaaaaaaaaaaaaagtatgattgttctcaaaaagataccaggttagatagatagaacagactggctgttagatctatttaactgggtatctttttgagagcaatttgtttagatacacagactggctgtatattgataattgctggaacaggatgatgaatacttaagggttcattatacagtttacttgtgttgataacaaattttttttaagatacattaacaaagaagtaaccactttgtcagaatacaacccagcattttcaagattctggggaaagatcttcaaggaatgtctcttgaagcaatattctgttaagagaaaggatcttgcatcagaaagtcatctcatccattcacaggctgcattgtccaaaatatattcaaaagcagaattagaaccataaactcctggtgtgaactcttgccgctgtatgtagtaatgctgctttcttttctgccctgtaggttcgagtgactgtgtttccctcaaagactgtagctcagtattcgggagtaccttggtggatcatcctagtggctattctcgctgggatcttgatgcttgctttattagtgtttatactatggaaggtaagtcatatctggcatttgaatttcataacaaactttatttcatgttttaaaaaatgggaatcagcactgatagtacgttttctttttcattgcttccttttttctaacattatgaaactcttttgacatagcaaatttgaggaaaattttaccatgaacacctgtatatttaccgaatattttgtatttaaagtatattatttgtacacaataagtttcttcatttgtctctcacacataatttagcatgtttagcaaataacaaatttagattttattactttagcattttcttcacctaagatataagtctggatctaagccaaattgttagggtgtagtaataatctgaatgtgtatccctgctaatttcagtttctgtgaagaatgttcatagcagccattggtgttggttatgcttacagctagatttggaatagaagagtatgacatgaatgaataactctatctcaagggggtcactatagcgtgtatcaaacataaggaaggtctaggttcaatatgatgttcctcattagaatttggccctttgactgtaaataaaatgtaatatcttcccctgattctaccagtaaagagtctacattatgaaaaactgcgtatgagatggatacaaactcttattgcccaaagattacaacctaaaaattttagattattcccagtgagtgatagaggcttacagtcccttatctgccattccaaaaagctctgaaaccttgaagtatatataatgacttatttggcaataaaacctgacgtgatgtgaagagaggctacttcgaagtctttatcctttatgattaatttcactgcagaaatactaacattttgattatagtagcattaggtatgcagtgcattactcattttaaaggacaaaaattttggattctcaaacatgtccggtctggagggttctgtatgaaccatcaaccccctaggatcagactatccttttcttttcattggatccaaaaatataatacataagggttcaagatagtcttacttgcaaatattgagcatctgtttttgctttattttttttgactgacttttgcaaatttgagataattttctgatgtcttctagacatgggattgaagctcatgacaaaactcctcctggtatggagttttagccagttttacctctaatgtttacctcgggcagtaggttcctctggcacacacagccagtcaatataaaacattttttcaaggagatgccttgaagaaaaaaaaattttttttgagactgggtctctcgctctgtcacccaggctggattgcagtggtgtgatcatggctcactgcagccttgacctcctgggctcaagcaatcctcccacctcggcctcctgagtagctgggactacgtgccaccacatctagctagtttttaaattttttttcataaaggtgaggccttgctgtgttgcccagactggtcttcaactcctgggctcaagcaatcctcctgccttggccttccaaattgttgtaattacagatgtgagccattgcacccggccttgaaaattattttgatatcaaaaactaaagttggggtttgatatttgaggatgatgttgtgttttctggaagaggtcataaggatggtctttttcagagcattggcagcctttaatgagggtgagacagcagtggatttaaagttagaaacctaagctgtatataatcttggtcaaatcattccatctccctggggcctctgtttgcctcgtctgttaaataagttgattggattattagatgatttcattattttgggagtttttgttttgtttttgtttttttgaagctctgaagtgtccaggctgtcaaggggactctaaaatacgacttatacaaccccacatgagaagcatttttattactttatacttttattcaactgaattatttaatatgttaaagtcataggattttagggtcagaactacagttcaatggcccttaaattggattttgtatatccatgtagagggcaaagctaaactaggcaggatgaagatccctacttcaaccacagtagttcagattgtatccattttaaatatcaggattctgtacaggattttgtttgcaggtgaaaaaaaaaaaagtcccttgggctggtctaaatcaccttcattttgctaacaaagatgctcatgaccagggatattaagaatgttgctggctgggcgcggtggctcctgcctgtaatcccagcactttgggaggctggtggattacagcactttgtggcaggtggatcacgacgtcaggagatggagaccatcctggctaacacggtgaaaccccgcgtctactaaatatacaaaaaattagctgggcatggtggcgggcacctgtagtcccagctactagggaggctgaggcaggagaatggtgtgaacctgggaggtggagcttgcagtgagccaagatcgtgccactgcactccagcctgggcaacagagtgagactctgtctcaaaaaaaggaaagaatgttgccaagttggaggcaggaccaggcctcttggctcctggtttattcttcttcccaccctatttactagcacatattattgaaagctgcccaacaaaactctatactgatggaaatgttctggagctgcagcatccagtatggtagccattagtcatgtgtggcggttaggcacgtggaatatggctggttcacttgaggcacagagttttaaatgtaatttaaattaatttcaatctgaatagcctcacggagccagcagctcccatatattgtacaaagtgaatctaggcttttaccttcatgagttgctggactaggaatcagagtttttcaggagattttatttgaccaggttaaattttataaaagacagttccatggccttatgaactagataaaagtaaataggaaaagttctctatcactgaacgaaggaaattatagtagaaagtggaattatacttttatactcatttagagtgacctaacctgaggagcattgggtccctaccatttaagggttttatggtgctcagagtttgggaaaatgacagcaatcattctttcatgatggtgtattcgaatttgtattgtgattcaccccacagatccaaaggcctcaagtaaatggcatttgttccataaaatttactgtaaaaggcagaaaaatacccatagtatatctatattttatttggatttgtgcttttatttagagaatttattttctaacctttgtctcaataaactgccgaagtcaatcttttgcctcttttggagttcatattctcctgcaggaagaaactacccaaagctacaatcagcaatgtatatacgttttccctattagaatgatttttgtccacaagatttctgttacaaagagaaaaatcaatgagctgactagtgtcatccatataaatatttgaccagagatgtatggtgaagggtgtattgaatatgacaatgaaacaatgcagtggctgttcattgttggttgactgaaagtggtctgtttgtaaacaagccactagtagaaggcagattaaaatttgagatgttctgttgtttggctcttatacacaaaactgtaaaattgactaaataccttgcttccttgtagtgtggtttcttcaagagaaataagaaagatcattatgatgccacatatcacaaggctgagatccatgctcagccatctgataaagagaggcttacttctgatgcatagtattgatctacttctgtaattggtaattgatcaatgttttttaattgctagctgtgggacccgctatggttgtggtggctaactttaagaacaacagcttgctatgtgtgtcccattaacagatgtttccaaatgtccacactggcttgccttgcttggatttgttttattttatttcacttgaaagctcagtttttgttttttttaatgcacagtctttcgttgcaggtgagttattttatgttcttgttaaatatctaccacagcaatgaagaaaatttgcaatatttgtacacacaaaaagagacttttagccctccatagtagcccagtttgcaatgtgttattaattcggtatgtagcattccactagggaattcaaagatgcataagaaatcattctagatttcttgtccattttggaattttccacagatagaagctgtgtcgaccgcctaattaacctgttgcatgttggaaatgttgtgtttctcttggtgaggcttcctcactgtcatctttttgttctctttgctataaagtgatggggaaggcttggaatgctttttactgttgctcaggaatcgttttatgctagctaagcatgcaacttccatttcctgcatgtctcctacaggtcaaagaccattacaacaaactgattatcagcatgatgggcttttatggccaacttcagaagatgatcccttaccaaagttaccttccatctacaaaattctagtacaaaaaataccctgaacagtttttattgcaatatgttgtgatggagtttgaccatatttcatgtatccagagattttatccaaccttggatctcagttgattttaaattcaagtttctcttatttggaaatacatggaaataggaattgctagtgatccctttcaccatttacgtgggcatgagaggacagaattactcctgtaatcctttccatggcactatcacagtgaatcacaacattgccattcagctttacatattacccttaatttccctctttgtttaaatggggtagacagcagtcatattttgtaatagataggtactttggcttttttttctttttttttgcacagaataataaatgaatccatgtagaaatgacctggaacaaaacatcttggtccattttgcctattgatttagtgataactatacatataattttatcttgctccatggcatttttataacataacatcattcaacataaatgtcctgttactattgacgtcacacaataaacacattaacagttctatcaatatcctcattcttctaaactgcattttaaagttgaaaacacctttttttaaaaaaagtaaatatatttcatttaaaaatttaatctcaattcaaattttttcagatatattctcagtaaaaatatactttggatcagattgactatttaaatgaattttatatatatatataaacacacacattaacagtttaaaggtaaatgtatttttgcaaaagaagagaaattagggagtgctctgaaattcagtgtagtgatgcacttctgaagtcctatgcagcacatgatttttattgcaggaaacagttactatgtgattaatgaaatagcttaattagaagcacaatagcaaatccaggcaacataaatgacctcctggctaatgagagaagtgatatgtgtactagagcctcagaggagagaaaaagattataaagttgacctgttggaacactggcatattcaaatagtaatttgtaaaatacttgtgacatgatttgcattttattagtgggaaaggggcatgaaataatctttggtttatgccatttaaaaattattcttaatctaatctgataatcagatattttacatatcatattgtgattatttttaaatatggaagcactgttttcataaactcttaaattgttagtaaagaggtagcctacatttgttataaaatgtaaagagaagatgaaaatggacttttcttccagttttacagctgttctcttccgttgatccccactggctcttctttcatttcagcctcttggttctttcttaaaagaaaaccatgtctttttccccttagtccagaggtagacatagctgaacagaaagcttagacattcccatttagtgtatttgcttctttgtgagattaatttgtttctctttctctttccctcttctctagtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttatttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatc

SEQ ID NO: 35946 - DNA, 82387 bp, Homo sapiens
gtcccaggcggttccgctcaacagacgctgctgtggctgcgccgggctgcgacactgcagttgtctacgcggccggggccgggacgaggaggcgttggacggggtcgcatacgttcgtcccctcgcattgcggccccgacagctgcgccaggatccccgggcggcggcgcggggcgtgaacgctctggggctcagccaggcctgcgcgggcccgaggccggaggaacccggactccggcgtagcggtgagtgcggcgccggttgtgggagcggcgggagccggttggcggcgcggcctccgcgtgcggttcggctgggcccgaggggctccccagcctcggggcctgggaccctgtcgtcggcgccgcacctgaccgctgggtgtgcgcgcgggcggcccgcggcaccaggagcagcggcgagcagggtgggaggcggcccgctggggtccgggaagcggctgacgtggggcctcggccctgagcccacgcgagccgggagctgcagcgcgaacggcgtggggcggcgctgaccaggcagggaggatgcactgcgtgcctcccggcgctgtggggcggggtggggaggccacccccttgaattaagagggctctgccgcggccccagcagtgcggtgtccgtggaaggagactcagccctgcgatttcggaaaacccttgtttggcggggcgggaggggctgttgctgcgtggggtgagaagaaactaggtgcgtgaggtgggtcgaccttggtgattggttctgggcactatcgtggtggtgggactgggattaagactgtcgtttggggtttgagagttgcagctttgcttttccccaagtgcgttttaatcatatactgttgataggttgggtaactcggggactgcttactaccagcagtcctgtggggtaggtgttatcaggctcgtttcacagatgaggagcccgaggcacaggttttcaaatggttttcgcaggaagtctgatactagaaagtgtgctctaagctgctgtataaaagatccctcgaaaatgaaaaggctggaggaatgtctttaaaattatatggaagctagaaaggcagtaggctttgtgaacgaaattatagctgaaaagaatgacaaatagctgacatttattgagcttttattacatgccacgcactgtttggagagctttatgtacagtgtcttcacactgttaacagtcctctggggtgggggttattcccattttacagcgggagaaactgcagattggacgacttagcttgcctcagatctcagctagtaagaagctgggattcagacaggcctgtgtaaatccagagctctgaaatctaagcactatattttgctgcctctccttggtggctggctgaatagtttccacagtggattttagtctgggtggccaggagagttgtagtttgatgataccttctttcatgtttatcaacctattttgtttccccaaattagttctgagagttaagggtgctgatgagttgctcctgaaagtgtattagaagggtattataggggacaggtggtgtgacatgggaatcttttgcacagacttgattttgttttctggcatttttctgggcagttcctcacacttggggatgagtaagccttctaattgtcgcatgcgttttctctctagacttttcctggtttctcttttgtataaaaatattggttttgtaggatgacattgggtgtggggcagagtggtccattggacctaagggtcaaggtgacaagtcacctcgtatctttggatctcagttactgaatttgtaaggctttagactcagtgacttaaagcttaaatattctgagggtctaaaatgttctccttgaaggaagaaaggaagaatgggagaaatgaagaacgcacaaattataaggggaaaatcatcctctgtctggtttggggtgagaatcagatcttaaagcctcgaggtctgtttcatttgcttttgtgtttccctgctgtttggttccagttaagtgactgtttcattcctcatttgattaattgactcacctagagccatttaatttttgtgatatgtcaggcaccttattaggtgctgggaatacagctgtgaatagagggaaaaatagacaagaagcaaatggtcatacaaacggataggtggttgcaagtttgataggtacgatgaaggaaaagtattgtgtgaatgaggattatgagcaagattgtgatgtagatggaaatctagtctagggagctgttttttgaattgatgtggtgagattttgctagaggacagtcttgaaatctgagcctgcaattatgtacataatgcaagagtttgggaagttgtcagcaacaataattcttttcattgcacagtgtatttcatactcagaatgtcatcccggctctcattgcaagatacgaaaatgagataggcaactttacaagttgtcattctgtctgccttcagggtacttaaagcttaaatagtcctctaatactttctcccactcaaaatgaactgtaagggggagtaagactcttttatgtgagatttgggcttgaatattggatttagattttttttaggaaagctaggccaagggtgataggcttttaaaacaacgagcatcataatgactcaaaagtatccattgtagcatacgcttcacagggtcatttaacttaaaagtctcatcatcttaggagatcattttttgatggctggattgggaaatatagattgttaaaaatatataaatgtctcagttgaacatgtatgaagccaattcaaataatacattgcaatatatttacttaatggccatctgcatgcaaaacaccgtcctaggggtaccatgtggcataaataaaaaagatgaacttgccaaagttactgctttcaaagagatttcagttaatgtatactaatactcaaatttaaggtttttttttttcaaagtgctagcatatctcatctgatccttttaagagccatatatgataaacagaaatactgagaaaatggagataaaaaattgtcaggatatggtgataaatagtaaatggagtgggagaaagaggtgctaagtgattactaggtttcagacctatgcaactaaagaggtatgtgtgctattcactgagctggggcttaactggtagagaactaggttctggatatgggaagggcatgactttagttttggaagtgttcagctggagctgcctttgaggcctttattgaggtactggttttgtgctgagaattggggtggccatttaccgttttgaagacctccatgtagaggcaagagctcaaaccatgggtatgggtgagattgcctgtggggaggctatagaataagaagagaaggaggcctgggatggagctgggcagaggaggttgagcttgtcaaggagacaagagtggccaggaaggtcagaggacagccagaaacagatgttcctgcaaggcgatgagtcagtactgtggaatgctcctatgagagaagaattgagaaccatcattgaatttagcaacatggaggtcactggtgacctttgaaagagatgctgatctgcaggtaggggtgggatggggagcagtgggaggtgaggaaaacggagacagaaactgtttccaataggtttgatttcagcatgtttaaatgctgatgggaaggctcagtggagagggagtggttgaatatagactagaaaagggtttgtgcagagttcctaaaaggatggggttgggatgggacccaaagtacaactgaggcctgtgtctttgctgggaggaggggacaccttccacagtaacagaatacaggcctgtaacctatggagtactaagcaaatgccaaaaattgtcaagaactgttaaatttctaaaaattagcccaattttagttgactcatgacagtcttttagaaaactttgttgcaagagcattgtgtgattgatttaaaatgtggctcagtcttaatttcatccctcaatagagtatatattttcatctgacttttgattgtaatttatttattttctgaaaaaggagacattgtaaatgttaaatcctgtggtgccttccttacatgtttatttttggtttcattagaaaaaagctttcagacggtttctgttttcctgacatcataggtgccttaattcttttaatttaaagtttagcttctgttattattggaatatgtttatttacgtatttttgatgtttcccattttgaagggtaaagaattggatgattcagtagtttcaactgatctgctaatttttgtttagaattgaagatacttaaataaccaaccttttggataagtggcctccaaatacagctttctgcttgtttgtgaaggtatttgttattaaggattcattcattcatgtatttacttagtgtctgttttgcaaggtactcggaatttggaaatgattgggcgagttcctgctcttaaggagctcacagttcaccacaggaaagaggtgtatgaacaaattacagcatggtggaacagaagaaggtatatgagcaaatatattacaggatggtataatcagtgcagcagtggaatctgctaggaaatagagaaaaagtgcagagcaggcacagagtagggaaggaaaaggggagacttctcagtggagatgatagctgaactaggttttccaagatgaactggagttttcccaggtcaacagggagccaggaaatagaatgttttaccttgattttggatcctctgtgtgtgtgtgtgtgtgtgtgtgtgtgtgtacacagatgtgtacgcattggagatgttataacgctaccaaagaatattgttagaaaaattaaaaattgcttatcttactatcctcatgttgattgctctagctgtgaaaagctgcacattttcccctgtcctgtcatggtcaacttttctgtctcctatttgatgcagaaagtaactgaacttaattatattatttggatacaaagcctagtttttgtttttctaaatgaatggtctttggaataaggataatagccaacacctttatagtatactgtggccaaatgctgttctaatttttatctcagccttgcaaaataggtacttttttttttttgagacggagtctcgctctgtccccctggctggagtgcagtggcatgatctcggctcactgtaagctccgcttcccgggttcacgccattctcctgcctcagcctcctgagtagctgggactacaggtgcccaccaccatgcccggctaattttttgtattttcggtagagatggggtttcaccatgttagtcaggatggtcttgatcttctgaccttgtgatccgcccgcctcgccctcccaaagtactgggattacaggctgggagctactgcgctgactgcaaaataggttcttttatcattctaatttttacagctgaggaaactgaagcacagagcaatttaagtgacttgcacgattgtgtgctaaatgtgtgctggatttcatcccaggcactttggttccagagtccctgttcttaacctgggcgctgcatctcctctctggagtgacagtttgaagttcatgttaacctttgaaggcatgattgtgtagggaaaggagctgtgatgacatttaggggcagttttatgtctgttttaattacacaaagttgctgccccaaataaaactgccctgccccccccgccccccccccccccccccccccccgccccggggaaatcataaggaaattgagagaatttaactagaattttcttttttttctttttcttttttttttttgagacagagtcttgctctgtcacctatgctggagtgcagtggtgtgatctctgctcactgcaacctccgcctcccgggttcaagcaattctcctgccgcagcctcccgaggagctggaattacaagtacccaccaccacactcggctaatttttgtatttttggtagagatggggtttcaccatgttggccaggctggtctctaactcctgacctcgtgatctgcccatctcagcctcccaaagtactgggattgcagatgtgaaccaccatgcccggcctagaattttctttttggacttgaacataattcctcaggatgctttcccctttaaccttacttcgcaggaattgttattgactttttagattggaatataaaggaatttgggatcccatagtctgctaattccattttcttttcctgtcttttaactaaaatattgacgcactttctgtatgtttgaaaaatatttcataaaatttaatccacttaaagaaacccactcctttcccccaaatcttacagctaaccactgctctgaatttggtgtttattattcctatgtatttctgtacagctttattacacatgtgtgtttccttagacagtgtatagtattgttttgtgtattcttaaactttatatagatggtactgcatgtattcttgttcagcatactgtttattttatccccactcaaaatcacttagcagtgtggtttcatgaattgagtttcaactcaattcatcagtgtgggttcatgtagatttaggtcatttatttttactgtgacaagttagtacattttaggtctataccatatttatttcccctttgctctcttgatagacttttaggctgtttccattttttttgttattacaaacattattaccgttaagtattattgaacacaagtctttgttttaatttttgacactgtagttaacctgtgctcctttttctctgttcttcacatttttgtctcggccttcctctaatcgtttcattatttgagctaaggtaccattctttgtccattatacttaacagtacaaaactgtaatgggcacttttcctcgaaggctctttttagtaatctttactttagttaactttctttgctttttttttttttaaataaaaatatcttaaaatatagaaatatcttgaacatattttacagatatatattattttacttgtaattccatgcatgactgcagggataattcacgtgtaccctttctcttgggaaacgtttctgtgttgatgtacatttgatttagctaattctgtattttagtgtttgtttcctttaaatattttcctctaaatgtagtgcacttttttcattgcagtttggtgggtaggaacatgagctcagagttaagattgcttggattggaatccgggctctactttttagctgtgtgtctttgggcagcgtatttaatttctatgtctcaatttcttcatctgtaaaatggagataatagaaatctacccgtagattgttgtgagattcaaatgaggtgtctggcatagtcattactcaatacatattagctatttttattagttttattttttgttagagtatgcagtattttctaagcctactcagtttgtggtgttgccttcttttttgaagcagcattttaacacagacatctatgcctcaaggaaatgtgtgatgttttataactgttagtggagattgggaagagatactgtaaactgtagcaaaccataagttgaggtacattaactagattgttatattttaatatcaataatttaggatttggttgggcatggtggcttatgcctttaatcccagcactttgggaggccgaggagggcggatcacctgaggtcaggagtttgagtccagcctggccaatgtggcatgagtccagcctggccaatgtggtgaaatcccgtctctactaaaaatacaaattagctgggtgtggtagcgggtgcctgtaatcccagctacttgggaggctgagacaggagaattgcttgaacctgggaagtggaggttgcagtgagccaagatcatgccattgcactccagcctgggcaacagagggagacgctgtctcaaaaaaaaaaaaaaaattaggatttatcgtgtttcaatttttttgaaatacgtataaagcactttgaaagtgagttgacatggtgaaattctcagataattaccaagggtctactcttgttagttttaaataccttttgtaatatgaccctgataatgattcagatggtgtttctaagtatattatcctatgtcatcaaccttgtgttgttcagtggagaaggaaccattgccatccatgtatgtaaagcttcataggtaaatttgagcgagtgacttaacctttctcagccttccatttcaatttctgtaacataaagatttcaattcttacctcacaaggttatcatgacttatgttagttgcttccttcatctctctggctcccctgtcttctcttgtaacttcctttttttctgttttccctatgtatattctttcttcctctttatcccttctctgcccttcacaagtagttttttggtaaatggtaacaagacattctgaaccagtgtgtgagtgaacccattatattaataaaaatacacattatttaaaggggactaggaaatgttaattctgtaaggacaagaggatttaggccatatgaagttacagaggagatgctgtaaatgttaaatgagcagtataaaggacagagaggtcatgttttgccacagtagccagggaatggtcagctgagcaaaatgagactaatgttagatttgaagaaagatttgtgaggaaggtattcacataggatgtccagtgggcagtggagtttggaagattggcaaataaaactgagccatcaactgcttgggaggactcaggaagctgtgaggataaatcacatcccatggggaagaaaggcacatggacttggaggacaaaagcaattaagacctagcgtaacctctttatttattgattaaactctgaaagtagttgttgaatgaattaaaccttctaggaatagaaagggagaactagcagctagcaaatggagagaattgagtggctctgagttgttgcaggaggagctttgaaggtctggcccgagttgtttgtaaccctgccgttgagactggtggtgtggcattgtctgtgccatttagtctgactggacttctggtttttttttttttttggtctgtaatcctttcttgcttttgggggatggagagggatctgcttcatcactgttctttttacctccttttccccctcctttacttgactcaggatttttgttacctgtgccatatttatttcttaggtgtctttgactttatcagttagctttgtgcatttccccatgtattcattgatgtgtttactacctggaatttaatggggtgtttgcatgagtctcttcctcttttgacatctcaataagcaagattctcatggaaaccatctcagaggcagtgggcagtaaatagatggagtgaaagatgaggcagaactgtttctctgcattctatattgagatgtacaattgtttaacaaataattacaaaagaaaatgagtgccatgagagagtgccctaaggggtcagcggatgggtagagaagttcaggctggggctagggccagtggaggtttgggtatcagagaatgcctaatcaatttagatgctaagagataactaggctttgaatgtatgcagaagaataaaggacattccaggtagagctaacagggcaaaatgagcaaaggcagagaagacaggtaagggagacaaagaagtggatggaattgatttgtttgtagtgtgcgaagtagagagttggaaggtgagagttgaaaagtaagctgacttcaagttgtggagagtcttaagtacttggcagacgagtttggaattgttttttattccttcttttttttccccttttggacaatgaggagggaattgagattcttgaagagaggattgatgtgaaatacgggttataagggagtggcaacgtcacactggcaacatgaatgaaggatgcattgatggaggagggggagaggggactagagacagaggaatagttaaggatacagttgaattctgccaggtgacaggagtaaggacctgaactgataaagtaacacgtgagaaagggcaggaggcaggggatgacagaggaagcagaaccatcgggacttggcaactgactggatctttgcagggcaagggaagggaacattaccaaatgctttttaagttttgagtaagttctagaaatgggaagagtcagctttccatttgagttgggaaaggtgaaagcagagtgacagtagaagatgtggaaaggagaattcagttaaaaaaatttatttttaaaaatgcgaagtgggatagctgggatctcctcaaagaaagccagatgaggggtcatctgggtaggcgatggtgagatcagggagtggcggaaagtgaacaaagttctgggcttagatgtttatagaatgaggtgagaagtcagtgaaagatgtgtaaagtgcttatcactaggggcccagtaggcattgtctagggaggcctcagctaaggctgggtctcacaaacatgtggcattggtcctggctgtataactctccagctggcagccttgtgagtaggagtgaagaaaatgcagtgaatctgcagggagcggttgtgttttagagctctaggatagcaagtgctcgggagtcctccaggaaggacatggttgtcacagaaacattggttcctgggactaggctttcaggggacaagagaagacacaagggagttggtggccaagatggagtgggagagcaggtctagtgggtgaggggttgtggggttactaacagcctattctcattctgttaatttttaaggcttgaattagttttctaatgataggagtcttgttgctttgggaccacagatgtgaatgttattattattatttttgcttctctgctttatctgtggcattactgctcttgtggcattcccccccacccccgactcccttgtttttggtgaacataatagtcaccgtaaaaaagatgtataattctagggaaaaacttaagtagggcaaatgctcaacagggaaaagttcataatttagaatacaggtgtgcctaaggttataaaatagataatagtactaagacaattaattttttgttttattttgagacggagtttcgctcttgttgctcaggctggagtgcagtggcacgatcttggctcactgcaatctccgtctcctgggttcaagtgattctcctgcctcagcctctcgagtagctgggattacaggtgcccaccaccacgcccggctaattttttgtatttttagtagagacagggttttaccatgttggccaggctggtcttgaactcctgacctcaggtgatcctcctgcctcggtcttccaaactgctgggattacaggtgctcctggccgacagttacatattttttatagaaagaaagtaaaagtatcttaggaaaatttaaataaattattattcttaacatctgtcatccatccatctgtttgtctatcggtgtgatggatgctcccaccaggtactttgctagtggacaccaaggatagaatgatgaataagacaaatacggcccttccctggtgcatagagtgggaaggtgaacattaagcagttccacagtaattatttaattacagttgcagtaggtcctgtgaaggcaaagttgtggggtgccgagggtggggaaccagagtaggctgtcttgagaggcttctctgaggaagtggcatccaactgatctaggagaagggggatggtagtggggcggtgtggtggtggggcaactgggccgctttctaggcagaggcttgaagcaatgtggggtggggtgggatggtgacttggctttggggaaaatccacaagaagggcaggagtttgtgcagaggtcttctgagatgaagctggatgcaaaaataaatgggccacagcatgcatgagacagaaataaaaataaagccgtctcttagaagcaatccattgagagtagactgggaagatgagggaacttggaggcttgactgtgccaactagttagcaatatctgtatcaagtcagtatgcttctttggtcctcagttactacaaaaagtttaaattttattattacaaaatttgcaaacagttaactttttatgatttgaattttatgattagcaatgttacagtttaccaaaattatcttcagcagtattaaaacatctataaatatatataacaatatacctgaccatatattatgttgattttggtattgttcgcctattaaggccaatgggaaacttttcagctagattggatattatttcataattccatagagttgtatgttttgaacagaaatatttttagtgtcttctctaagtttactattcaatttcttgtttaaaagatcataaattgacctagtgtttcaggcatgtcaatactgttgctatataaatttgtagaaattataatgaatttatatatttgctttaagtttttcttctaagaatgtgtgtttgatgagaaagtttggaaaatacgtaaaagcataaattctacattctagatatagccagtgctgaggtgctttcggtcctgatacctgtttgtgtgtatgttaacaaaagtggaaatatattgtgtgtaaatatttaacctacttctcatttatcatatcatgagcaattcccatgttattgaatgtttttgaaaatatttttagtggttgtataataatctactatatgtacataatgtactttaccatttcccaattattagatttgcatattttcattacccattattataaatagcaaatggaagttctcaagtaaatttgtttttcttcattaaatattcacagaagtggaattgtttggtcaaaaggtatgaaaaatttaaaggctcttaataaaaattacaattgcttcccagagaggttgtacttatatatctgtgccctttagtttgagtgtgtctttccattgcacctgtacttggatttatttttttatttttatttttttttgagacggagtctcactctgtcacccaggctggagtgcagtgacgtgatcttggctcactgcaacctccatctcccggattcaggtgattctcaatgcctcagcctcccgagtagctgggattacaggtgcgcaccaccacacccggctcatttttttgtatttttagtagagaccaggcttcactatgttggccagactggtcttgaactcctgacctcaggtgatccgtctgcctcggtctcccaaggtgctgggattacaggcgtgggccactgtgcccggccttgtacttccatttatatattgaaaaccagaagagagatgttgtttcatatgaataatattttgtataattaaaaaaatttcttggctgggcacagtggctaacgtctataatcccaggacttcgggaggctgaggaggaaggatcacttgcacccaggagtttgagaccagcctgggcagtatagggagacttggtctctataaaaataataaaaaatactaactgagttgggtgctgtggttccggctgcttgggaggattatttgagcctgggagttcaaggctgcagtgaaaactgtgatcaagccactgcactccaacatgtgacagagcaagagaccctgtctgaaaaaaaaaaaaattagcaacccgagtatttattttagttaaaccagtcttaatctagacctgatttaaataaaaagcaataattttgcttattggatatatcctgctgaaggatttggagaaagaatagaaattttatagatttacagtttttaaattacattggctcactactgtaatcccagtactcaggaggcagagatgggaggattgcttgaggccaggagttttgagacagcctgggcaacatagtgataacccgtctctaccaacaaaaaaaaaagatataaaagtaaaaatagaattgaagaattaaaaatcttcatttatgtgaaaatttgaatggagaggtgaagttaggaataattgtaaaaatttagcttttgatttacttttttttgcgttgtgtataacctgctaatgttaaggataatatatacaaagtgatcagaacagtgcctggcacgtattaaatgctcagtaaatgtacctattgttattgttactttaaaaatgtctccttccagctctctgaagattagctcatataatacagtgtctctcaaagtttttatcactgataaaactttatcactgatcttatcactgataaaatcaagaagattggggacggaaggaatgggatttttgtttttgaataaaaacctttggagtggtgggttggagggaggaatctcatatctattcgtcatgattcagatcaggataataatgagttgatctgtgtagtgccagttgaaatcttgatttttattcaatgaaataaaaaaattcattggtttggcttttcactgattgatttatatcccattctgtattccttttggttcctggaaaagaataggaataatttctgtaaatttgaccttattggtattaactttcatatggcaattttagaaagaagtgcctatggaagatgacttattggtgaggcttctttcctctttaattgcatgacgttatagcgcagaaatgatcacatctatgaacctagatggccttactgattgctgcttgacgggttgttgaatgagctgatattgaccagagtttctacccctcctcccctccccttttgggttgtccagttcagtgtcataagcacagacataattccttagcttattgctgggttttttttgatgatgtttctttttgtttttccctgttttaaaattttattcataaaatcagccaacatttattgaacatatactaggtaatactttgtaggtttcttgggattcatatttcaaagatgcatcattagagtgtttacctcgttgaagtagatagaaagtaaaacagtaaacatacaatccatagttaaaagtgctaatgtagatgtatgtgcaaagtgttttgggttcttagaggactgcaagtagatattagaagacttcataaaagaggtgacatttgagctagagtttggactgtttcaccagtataaaagtattgggattaataagcaggggaaggagcaatagtgtgtgatttgtaaatcataggagcagctttgattctggtacccattccctaccctcatgtgggatagcttttctcaacagatgtttgagcaagagctagttattgctttatggttttttttgttgttgttgtttgtttgtttttttgtttttttttgagacagaatctcagtcctaggctgaagtgccatggcacaatcatggctcactgcagcctcaacttccccagctcaagtgatcctcctacctcagcctcccaagtagctgggactacaggcgtgtgccaccatggccagccaattaaaaacatttttttttgtagacactagatctattttgtccaggctggtcttgaacgcctggactcaggcattcctcctgcctcagttacccaaactgttgggattacaggcatgagcaaccatacctggtcctactttatgactttaaaatattttctttatgcctatttaaattatagaatataaaatagtatttataaaagtatacatttattcatacccgctatgtatcacatactcggctagattctaggaaagcagagaaaaaaaaaaagtccttgcttcaagaagctcacagtctgttgtggggagacagaaaagcaaagttaaaatacagttgtaataagttacgttaatggtatgcctgaagtgttttggaagctcataggaaggacatctaacccagccttgatggaggaggggagataaacgatggaggtaaaaatagatggagagagttcattgaaaatctatattcctttacttctggatagagcatagtttttctgagttaggaggggattggagatgggacccaggggacataccaagcataaaggcatgggacaagaacacacatggggaatgcttggggaactgaaagggtgtgttacaggataagtcaattaacagtagagatcaggcagggggaggcctgatagattgagaaagatggtggagagctcaaggggattggagttctggatgaggtcaaaggattgaagtgaaagagttggtggaataggactggttatggttaagagtagttttggagttttgtacttgagagatggttttgtacttagattgtttagagggtgttttttaaaagttagttttgtgattttccttgtaatgaagaggtggagcagatgatagcccagatggaaagttccatgagggcaggatcagttgaatactcagggcctgtttatgtaaatctgaactttggtattgagaatgaaaagcatagcacattcgtagatttacttttttggtgagaaacatctatattggcatttgttgtttttattagatactaacctcagtgacggctacatatacacttatacctttataaatacctagttcagaaatgattttgtaggcatgtaacagtttctgttctttgcattgatgtttctggggagaatggtggacatagtgtaaaactggcatatgtaatgcctatatattatatactacatcatgtgttagattacatgctagaaatttggatggaacactacccagaattgtgagtcactatttgggaattgcccttgatgcatggataatttacccgtagacaattgggagctgtgtatttaagttaataaaatttctttgtattacatgatgccagagtacaggcatgttaattataggtgatcacagtttttgtttcttgttattaatttcaaatagctttatgaaataattatatttgctgtctttcttagataagtcaagaacataatgtgtttcttttgagctccttcagggagagtaagtttaatttattcttccactagaaagaaagatactgtgctttattcactgctgcacacccagtgcccagcgtataggagacactcacatttgttgaatgaatgaatcagtctctgcatccctgccacctagcacagtaatggacatgagatactgagtaagcatttattaaattgagttgaaagatttgaatatattaccagaaaatttttggaaggccaaaaatctcatatcagaatgaccagtatatacttattaatggaagctcaggaattcctgaagaatagcttttctgttggtaaatatgtactaactggttgagtaatatatgctaatgtaatttaaaaaattatgtgattgtgaaggcaggaaagcgatggattgtttcaggccaggcccactgcttgctgtactttaatgtcattgctgcttatcgccttctctgcagccttgttgacactcctgacaacaagtgtttgtctttggcttctagggcactgtttcctgttcctttacctttcttgttggttcttctggcatctgcccttaatcctttatcctacaattgaatatactgtttctgaggaattctgtgttctatgaatagagtcaatgatgactgtgacctctgcatcttcagctgtttggagccccagccctgtatttctaacaatatagtgaatctctcttctggtctttcccacaaacttaacatccagccctatatttatgcgctcatatttgtgtctgttcttcttgtattcctcgttacacgccaccattctttcattctggaaatgtagactttaattttcagagcccttactctatacatcctacctgacaggtcctactaattttacctcagagaagcctgtacagttggtcctgtttcttctgtgtctactgccttaaattctgcacttcatcacttgggctgtggtaataaccacatacctggaatccctttcggtttattttctgtgttgacccaagtaatcattcttaaaaaaaacaacaacacacatttaggactgggaacagtgactcacacctgtaatttcgacactttgggaggccaaggcgggtggatcacctgaggtcaggagttcaagactatcctggtcaacatgggtgaaaccctgtctctacaaaaaataccaaaattagccgggcatggtggcgggcgcttgtaatcccagctacgtgggaggctgaggcaggagaattgctggaacccaggaggtggagattgcagtgagcctagatggtgccactatactccagcctgggggacagagcgagactgtctcaaaaaaataaaataaaataaaaaacaaatttagttaaatgctttacttgaaaaccgatctcatgctatctacaacattttcattgctaactccccccatatatttcctgtgttccagcgatctcaggctacttgtgattactcactgtatgctcacccatgcctccctgttaggcaggagtgaaggaggaataagagcctggagggatttattcagctttgtctgtgggtaattatactcatcctgcatcttgaaagatgagtttattttgacagtcctcttagctgcttctgtctctctccaattccataccccattccaagttttggacagaagagtatgattggaccagcacattcatgtttttgatacaggcttcactggtcacaggtctgctggatacctgtggatgcacacatttgccgtagtctgcggtgttggagatggggacagaacagtatcacatatgtgaaacagagccagtgcttcccttcccaacagtcgtaggccaggcaatgtggactgtgggttgacatcactggagactgtttcagaatcagaataaagaccaataataaaccttttttttttttttctatttatggaatatgggagctgtggaagagaggtattactaggctggttgtttgcttcagggatctgcttctcatctttccaggacttaattcagctactacctctgttaaaatttttctttgatgctgtgcaacttactgaataagattttacctgctgatctgtgatgtcactattgccatatacaaaagtcccatgactatttctggttttaaaattctgtattaacaattcgtgttttgatatggaatagggcaaatatgcattaaatatgctgtttctcaaagttttttcttctagataaatgttagaattaatatatcacataagcatacaaaacaaacacgtaagaaaaatcctagtaggattttcattgggattgcatttggtttatgggttaattttggcagaattacatttatcctttctactcaggagcaagtctgtcttttcatatattcagggtttttttgtgtgtgtctatcagtagcattttacatacacagacacccatatgtaaatatgaatgttatattacatgaagtattttaaacttgcgtttgctattgtgactatatttccgtttcaatttctaactggtgattaataatatataaaaaaactgtcaatttttggccgggcgcggtggctcatgcctgtaatcccagcactttgggaggccaaggtgggcggatcacgagatcaggagatcaagaccatcctggctaacacggtgaaaccctgtctctactaaaaataaaaaaaaaattagccaggcgtggtggtgggtgcctggagtcccagctactcaggaggctgagacaggagaatggcgtgaacccgggaggcggagcttacagtgagcagagttcacgccactgcactccagcctgggtgacagagcgagactctgtctcccaaaaaaaaaaaaaacaaaaaaaaacctgtctatttttattatttacttggtatcgaagtatttttgtgaattctccctctggttggatatttttcaaatgattccttcagattttcttgtcaggcaggcacttatctgcacacaataatgattctgtctttttcagtattcataactgtcgtttattttttcattgcattggctaaagtgcagtgctgttcagaagacatgccttgagagccgtaaatgtaagccatatatgtagttttacatttctagtaggcaattgatttcattacattgtttaatgtaatatattcaaaatcttatttcagtgtatatgttcaatataaaatttattaattaactattttatgttctttttttactactaggtctttggaatcccatgtgtattttacacttagatcacatctcagtttggactagccacgtttcaggtgtgcagtggcacttgcggttaccgcattggacagcatagagttagagccttcttgatatataataattatgatcatagttggccttgttgtcccttacttggttggaatttgcttttcagtatgatgtttaatgttgatttctaataaatatactgtttttaagtttaagcaattttgtttctgaataagatgttcctttaaaacttagtaattgatattcactccccgccccacccctgagatggagtttcactcttgtcgcccaggctggagtgcaatggtgcgatcttggtttactgcaacctccgcttcccgggttcaagcgattctcctgcctcaccctcctaagtagctgggattacaggcatgcgccaccacccctagctaattttgtatttttagtagagatggggtttcaccatgttggctaggctggtcatgaactgacgtcaggtggtccacctgcccaaagtgctgggattataggtgtgagccattgcgcccggcctcacttttcttaaatacttaagaaaatgtatggtgatgctcacacctttcccctcctacttatgcctgttaaatatagaggatggtagtaataaagaattctcatggtgaagcatcttttcactcagagtaaacaaaccatgcttggttatggtgtatcattcttttaactcaactggattagatgtgctgacattttaggattttttccctcatattctttaaagagattgtcctatgtggtatgtcacgttttggaatcagcattatatcagctcttgtaaactaggtaacaaaacttcagatcattctggcttaacaaaattgttttaaaacttaaaggaatatatgcacatgattgaggactttttaaagtaatttcttagcaaaatgtatttgtggaatgtaaattttctaagtccttgaaagtctgaaaatttctttattctacttgcaattgattgggaaattagctgagagtagaattctaggttaaaactttcccttaaaacttttaaggccttgttcatagttgcctaccttcctgtgtttctgagacatctgatgccattatgattcttacttctttataacagcgatctccaagctttttggcactagggacccagtttcgtggaagacagtttttccatggacaggggtcgaggaggcagtggggtgggggatagttttgggatgaaactgctccacctcagatcatcaggcattagattctcataaggagcggacaatctagaacccttgcatgccgaattcctgctcctgtgagaatctgatgcagctgctgttctgacaggaggcagagctcaggcggtaatacttgctcacctgctgttgcctacctgctgtcaggtctgtggcctgggggttgagaattcctgccttacaggaagggtgaccatatatcctgatttgtctggaatacctccagatcactgtttttttttttttttttttgaagacagattctcgctctgtcgcccaggctggctggagtgcagtggcatgatcttggcttactgcaagctctgcctcctggcttcaagtgattccgctgcctcagcctcctgagtagctgggattacaggcagatgccaccatgcctggctaatttttggtatttttagtagcaatggggtttcgctgtgttagccaggatgggctcgaatctcctgaccttgtgatctgcctgccttggctttccaaagtgctgggattacaggcatgagccaccacacctggcccaaatcacactttttaatagtacctccttttattctgatatgtatccttctttgttgatcagttatagaatcaccttatttgtaggtggtttgctttctgttttttttttttttctttttttctttttttgagacaaagttttgctcttgttgcccaggctggagtatagtggcaggatcttggctcactgcaacctccccctcccgggttcaagcgattctactgtgtcagtcagcctctctagtagctgggattacaggcatgcgccactatgcctggctaattttgtatttttagtagagatgggtttctccttattggtcatgctggtctcgaactcccgacctcaggtgatctgcctgcctcggcctcccaaagtgctgagattacaggcgtgagccaccatgcccagccagccttttgtttttttaggaagatttgaggatattcttatactctgagctttgagaatttacgtggctctgtctagaagtcagttattttttccctcattcatctgcccagtcctttcaaactgaagactagtatttatcagctctgggatattatattgcagtgtgctttaggaatttctgcttgcaaaatgcttcaggaatttttgcctctttgttctttttttctatttctggaactccttgtaatggaacttgaatctcttggattaatttaacaccttattttttaaaatgagaattaaattttctatattctaccccttgcttttgctcttctttatctggaaaagagtctccacctcattttctgacacttgtattgactccttaatttcagctgctattaatttcaaagaactttttcttatttttattccttctgttaatatatagcattgcattcttgtttcatagatggcaatagcctctcttatgcctttgagaatattacatagacatattttaaaatttcccacatttcctacattgtctgtttccactgaggcactttttgtctgctgtttgtctctttctttgatagtgatggtttttcacaaatatctggtgattaagaactttatcttctgtctggattttgaatttttaaatggttttcctgtttctagtttctttttccacaaataaattctcaacatttggcaccaggtttaatattatgaaacagatccgagtatgtcatccccctgctaataaaagttagaagacttttaagagatctggataatgtttcaaccacttagggcagcaaacattcacagtggcagtgaggcatttgtcttctagggccactgcaacaaatcaccacagactgggaggcttagaacaacagaaatttattctattaatgttaatagagaccagaagttcaaatcagtgttactgggttgaaatcaaagtatcagcagagctttgaaggctccagggaagaacctgttccttgcctctttcagttctagtggctgctggcattccctattatcagtccaatctttcaggccagcatcttcaaatctctctgctccatcttcacgtcaccatctccttcatgtgtgtccaatctccttctgcctctctatttataaggacatttgtgagggcatttagggaccactgggtaatctagggtctttttccaaataaggtaacatttgtagatcctagggattagggcctgataaccttgaggtcctttattcagcttactacaactacttagagtcttctgaaatttctcttttcttgtacagttcccttcgcgtttacaaataattgttattattgcctgcagttattgtctgcttgaacaaaaatacatgcatcaactcagtttatagtgatttccttgaccttgtcttctccaccctagacaaaaggctgcaattgcctgttttcctaatgcagctgatgcacttctcatagtttttgccacgttaaagtgatttgtcaggctctaccactgactaggaattttcttttttttcagtactatggtgtcattcttagaatgcaaagtgtcgggtctggagctgagtaaggcatttaataaatatttgttgaagagatttttaacatttattgagggccaattacatacctagtaggacctgtcaccttgggccatttaataaagtagggtaaagtaagcatggcacataagtttccccagggcatatttgtcaaaagggattgctgggtcataggagtctacattttcagcttttgctagatgctgccaaattgctctcttaactggctgtacttccgtaagagtgccaagatctatcttgtttgccatatctttgccaacacttgtgaatttttttcattaaaaaaattttaatgtaggaaatgatactgttttaatttgtatttccttgataattaatgaggttaaccatttttaataggtaataaacaatgtggaattttctgttaatatacatagcctgctttctcctgttgctcttttttatttatagaaattctacaactatggatatgaattatatatagcactgttctcttttacatgtgaggaaactggcacaagaaattattaataacaagaagatttctaagttatttcccccctggatgaatagatgcatgaccttgtctggagtcatagctaataagaaacagcagggattttgaacccagtagtatctgagtttaaggtctgtccttttttttttgagacagagtctcgctctgtcacccaggctggagtgcagtggcatgatctcggcttaacgcaacctctgcctcctgggttcaagtgattctcctgcctcagcctccagagtagctgggactatatgtgcacgccaccacacctggctaatttttgtaattttagtggagttggggtttcatcttgttggtcaggctggtcttgaactcctgacctcaggtgatccacccgtgtcagcctcccaaagtgttgggattacaggcgtgagccaccatgcctgactttaaaaaaaaaagtttatttattattttactttaagttctgggatacatgtgcagaacgtgcaggtttacatgtatacgtaggtacacacgtggcatgttggtttgctgcacctttcaacccatcatcatctaagttttaagccccacatgcattaggtatttgtcctaatgttctccctccccttaccccacccacctacaggcccaagtgtatgatgttcccctccctatatccatgtgttctcattcttcaactcccacttatgagtgagagaacgtgtggtgtttcttttctgttcctgtgttagtttgctgagaatggtggcttccagcttcatccatgtccctgcgaaggacatgaactcattcttttttatggctgcaaggtctgtccgtttttacaaaaattaataacaaattaaaagttaatgaagcagtggtatgttgaattaagtgattcaaaaaaacttagcttttagctctacttgttaatatattcttaaaaataactatataatgactgctaacctgtttgcttcgcaggtgatagagaaaatcattgaaaaaatttgaaagtgttttttaaaaacaatgtattaatatcaccacatatacatcttaatacttattctttatcatcatcatgagtaaatgaacgcagcctttatagtatactttttgagttttggaaataccttattttttataatagagtttattttttagagcagttttaggtgtacagcaaaattgagaggaaggtgcagagatttctcatataccccttcccctacacaggcatagcctccctctttatcaacatccccctacctccccagagtgctacattggttataactgatgaacctacattgacacatcgttatcacccagagtccatagtttacattagggttcactcttagtactgtaccctccgcaggttttaacaaatatatgatgacatgtatctaccgttataatacatacagaatagctttattgccctaaaagtccttttgtgctctgcctattcatcctcctctgtgctctaacctctggcaaccatggatccttttaccatctccatagctttgccttttccaatatgtcatatagttggaatcatacagtacatagcattttcagactgtctcctttcactttgtaatatgcatttaagtttccttcatgtcttgtcatggcttgatggctcatttcttttcaacactgactcattttccattgtctggatgtaccacagtttatatatccattactttgttgaaagatatgttgattgcttccagcttttggcaattatgaatcaaactgctatggacatgcatgtacaggtgtttttgtagacatattttcaactcttttgggtaaataccaagcactgtggttgctggatcatatatttggagtatgtttagttttatatgacactgtcaaacttccgtagtggctgtaccattttgcattcccaccagcaatgaatgagagttgctccacatccttgcaagcattgggtggtgttagtgttttgggttttgggcattcttactggtgtgtagtgtgtgtactatatgtttttgaagaaaagttacatgataaaaattttgtttgctagcgtgataggttggtgtttccagaaaaactcaccggaaacttttcatgtgaggtttagaagtaaaatagttccaggaaaaagttggcattcggctctgattaactagaatatgagtagtaatgcttgtcttttttatgtttgttttgacaggttttgacacaagggcgcatatcttcaaagcacctagtacctcctaccattgtcaactggtaaaatatttaattttttattacaatagatttcttttatttgttataaaataaatattaagttaaaaccaattatggctaaattgaccaaaaaattgtaattctcattttatgattatatatggaagatagttttatatttactttaattctgtataaatcaattgggacattaaaccatgtcattgagcagtattgtctatcttcctttccttaacttgaatttcactaagtatctgcaagggatttgaactcagtggcctctttattttggatagtttagcatgaattagaccattttaatatgtgatggtcatttaaaatttgtatgaatgttactgtaaatttctaactggacattttagtagagattgtagtttcaagggctttttgtcaacccatagaaggttctgcatggttattacagttgtcatggggcataagaaatatagcacaattttattctttctgtgtcatctgaagtgaattagagtttatgaaattttagggcaaaaatttaaggacgaaggtttttagcgttctgtgaaatgaaaaaattgagtaggactgctgtagggaatagtctatgttggtaaagtgctttgatgatgacgtaaaggcagtaagcattttatccattagaatcatgatagttgacatccttcttttcagaatctcatttcgaagtcttttttcatatcagttgaatttattaatcttaacatttttaactgattttaaaaggaaatcacacaagtaatatgtttattattaaaaactgtaagcaatgtaggagcatctaagtaaacaggaaactcctatgttaccctggttcttttgctagggattatcccttattttcatagagtgtatctttccagacgctttgtttgcgacgctttgtttgcgtatccaagattgccatcttttaatgaagtagatgtgatggaaaaaggaatatactttgtccactttaatagtacgcctcactttgttttagacatgtctgtgcctgcgtctctttgagggatatacgtgatcaaattaagagtgcttttgaagtgactaggtaaacccattgtaacacagtactcctctacaaatttcttttagtagttaatgggttatgggaactccaaactttgaattcttagctaagaatgcatcaagagagtttagcagatttacaataaaattgaaattgcaaagataattatgacatattaaatgatagattttaaataggtagacatttatagaaatgactgtaattactgttgaggatcagctaggtttgtgtaggtgaagaagtggttttggagcttcagtgcatttatgtgtgctcagtagggtacttaggatatttgaggagggaaaaggccgtcagaaactgatgtgggagggtggtgcacaggaagaagtactatggtacagtgacaaagataactttgtcataattttgcctaaaaagagaaataagactcgtagtcatgttatataggttaactgtgcgatgaagtaaagggaatgtcatgaactacttgggaaacccagtgtcttgaatcccgaaacttagaactcaaccttttcacgtttgggaattgcttatgttcagaagtcccatgatttaagagataatgtaaaaatggaagttaattcacatttgtacgtgtcctttgtgtgattgtcggattgaaacattttaaacttcttaagaaatgtagcgaagcaaatttggatttgtatgtgaaagtgacctagatgagaagtatggaaggagacggagacagcagcaagtttgctcctcccttggtttcagaggaaaatggtttttaagagctgggccagatgtttctcatagctacttaaggtggattccttttttctgtgtcttctgtttttaagtgtaatctggtttttgagcacttgcagaaaagctgcagaggccagggaatgacacagcagagaatggaggtgagagggaagacaactggtgatcttagttgctttgattttgaaatatgttgttcaggaatagcttttcttagtggtaaaataattgggaatttgtaggaagaagaaaatatgttgtaaagaatttaaagataaaaaagcaagtaatatttgaatacaacacaagactattgactaaaggaagtaatcggatgtttaaaccttatttttagctacttaacctttacatagtacaaatgaagacaatatgttaattgtgatgcaggttatttattctgtatatttccacaacatacttttaagttctaattatatgttattttccttttcttaactttgtttttttagctggtccatgcagactacagataagaaactgggcttttgggggtgggaaggggagtggaggaagagaaaaggaaacatctaagtaatcttactgaatgatatataaatcgttgaaattaaagaaaatatattctgggtagacttagcttgcaaaattattttaagctattgtacctcttataaatggaataagcattttaaaatcatcttgaaaatcttcagaacctttaattcttttacattctcaaaggttaaacataaccggaagagctgtcttctctcaaatatgcatactttgttcattagatttacttttgctaactttttttttgtatgtttggaactgttatatttttcctctggcctttgaattttctttaattttattttttatttcaccctgggggaaagagaggtgggtagatttgtttgtttgtttgtttatttttgagacagagtcttggtctgtggcccaggctgaggtgcagtggcgcaatcttggctcactgcaacctctgcctcccagactctggtgattcttgtgcctcagcctcccaagtagctgggattacaggtgcgtaccaccacacctggctaatttttatattttttaatagagacggggtttctccatgttggccaggctgaccttgaactcctggcctcaagtgatctgcccacttcagcctcccaaagtgttgggattacaggcgtgagccattgtacctggccgaaaagaggtatatttaaaagtgaatttgttacttcaactaacacaaccttcacttaaaaattaggctgtctgttcactctccttagtacaggttcatgtaatgccaaatgtagtacgtagctggattgagttggaattatgaagatcctcaaatattcatgagccaggttgatgtcattaagtaatccaatagttcatgttctcctgaaatacttatatagctggctttctcattaatcattttgtaggaaatgattggaataaataaggagtagtactgaaaagagtaaagaatcctattcagtattgtcttaatcagttttgggaaccctaggcatcagtagaatatagtcttaaaatcgatctagttgaactgcatcaatattaatggtgaacaaattaagatttagtgacctgctcaagatctcttagtaattggcagcagagctcagtctagtctagtgtatgtgtttatgcacatatgcatgtgtgtatatgtatttaaaatccctgttgtgtatctaactgaaaaagatatatattcctttgcctgatttctgtttcctgttgatttttatctagaagagggataaaagctgttttttaaagaaatagtgggtcttgatcagttttggggaaattgaggggactgtatttatagtttagggagagtactcaagagtcctactgttatttccgctatcatactaataggactgaaacaattttaaaattacactggataactgaaacttaaaaagttggctttgttaaactgctttttcatgtagatatattcatgggaaagacttgctataataaatgttcctccctctctcctttccaatgtttatctttaatgccaacatttcattttctgaggttaaaataaatataggctttatagttttcttaaaaataaaataccaaattattatttcctcataaaacttcctagttgtaaagtggaactttttatctaatccagatagtaatatgactaaaccttctaataatgtttttaattgatttcctgtccagaatcttttcgacaattttatttttgtattaaggaggttcttgcatggattaatgatctcgatttcagccctgtagtcattgcgatgtcatacattgcaactgtgtgggcatagttgaaatctttgaagttgttgaaagattgtgttagtatttgaggatttggagaggaaaaattctttgtctttactaaatacataagaaccactgtattacacataataagttagtctgtgtgttgttgatatttgtaagaatttaaaacaactgtcctacttttaggtctgctttttttcgggagggaggcagcaggatatatagtaagtaaatgttttaaaaccattctcttgaactaggtatctaggtatgtatttttattatgtgtttagctttggatgcctgagaagcaaacatgtttgtgagaaccagggtgcccctctaaaaaagaaactctttcccgatagtaaataatagtctctggttgcactttccattataactctgagagattaattctgggtaggaaatagttctttctgcccttcttgaccctggtttcctatttcataatacatgatttgcgtcattcatctgggactcttaagtctctgtagagtgtgtatgactgtcacctaacttttgtggaaaggagactctcaaaagtagtgtattaaaggatacttttttctccccaacaataaggtattaactatagaatttattaagagagtatagggtcattaaaaagtttggacatgccttggagagacatgtaggttaatatcctaccttacctgctagctgtaagtgcctttggggacaatctatttgaaattgggttttgtgagaattaaatgagataacataaaaagttcccttcactgtgcttgtttgcctgcactcagaattgtttcccatttattgcaagcttggtgaaaaattccagccacatttcatactagcaaatacggattccttgatatccagcattgtgcaagccactcatttatacttcattagagataaaatgctaagccatattattattattgttatttgcagatatgaacagttgtatagtattggtgcctgagtgtggtaggctgaaagaaaaatacagaggaggaaatcagattgagtggtgggcaggattaactgagaagtaaattgtggcatatcaagatgcaccgtctgcagtattttctccttttctgtcctctcttccccctgtcctcatcctctgctgcctttgactttgtgggagcatttctaagtgttggggctctctgcctgctctgcaagttgagttttcagattccttttcatgatggtggtggatgtgaggggcataaaatgtctgcttgctctgtcagtagggtgtgaatataataccattgttgacttcttccctccttagacagtgtacatgtcttagattctgagagtgactcctgttttctttgttcagtccatgagttttgtggaggttaatttcacaggtctgccaattttgggttgagttaccatgttgtatctctcttgcgcctaagagattcttgaaaccccagatctaagcaggtagaaccatttgatacgttagtctgaaagtgatccctgtggcaacctacttttttcctgtttttctcttaggaaaacacgtcatctctgatagaagattttcttccttctcttttcttttctctttttcttccttctctcttctcttcttttctctcctctcccttcccccgctttccgcctcctttccctctccttcccttcccacctctccccatccctcctctgcctcttctcacctcacagggttgttttttctcacagggtttctttctttctgactttgtcttttcacaaagtcttgctctgttgctcaggctggagtgctttggtgtgatcacagcacaccacaacctcaacctctgggctggagagatcctcccacctcagcctccattgtagctgggactacagtcatgagccaccgctcccggcaagaagctttcatatgagcatttgtagcaatttttgttttgaaaaattgggagttgttacagggcatttgactatgatattaataatattatttaatagcaatttttaacataaaattttattttaacatccacttcataccttttggaagtatatcatttgaaagtgatttcctggctgatggttaagctccgttactttacttacatttgtttcataacacaagatctgaataacacaaaatcctgtctggtctccttttccttcagtctttccaagtcacctgtgttcttcctctcaaataatagaggtcatacagagaagagatcttccttgtgcttgatcattctgatttaaaacaattgctaattaaaatataagatgtaaataactctttgatctaatgcaactgaccattggcatagaacattttaaaaaacacatttcaagtgtttgaacctagctatttatcacacaattttatatttcaagattttgtttgctcatctttattgtataagtagtaataggtcattttcttttaatgctgttaaacttaattcatcttgttattttaattagcagttgtgagagtttagtgaagttgggagttgttaaattcttcatggtgaaagattaatggacttagacctgcatttaaatattcagggataatttcttaaaaaccttgacttgcctatatctttttctgtagtcaggcatgaagccaggcatgcccgtgtatacattcttctcagttggcaaggtatcatagaagttcttctaggtcaatgcatgtacatgtagcttacttttaatggctgcataatagtctgttcaatgggtatatatgtttttcaggcattctttgattaatgaatctttagatcattttctatttttggttttttgccactgaaacagtactgccatgtctcccaggtgtgtgtgtgtgtctttccaagttttatcttcagactatgttactactagttgcagttaactactcatccccaaatctgtaaatatgtcttcctgtgaccctgacactactctgtcgtgattcttagtgatttcaatatcgttctaacactgtggtcttattatttcatactccagcctgcctttgctattccttttccatgaccattcattctgccactctcctagatgactattttatactttctccttaattttctaataccttcctttctgcctccctcacatccaatgattttgcttattactctgagaaaatagaagcacccagaagaaaatcttctgcaagctcctattcctgcacatctgtgtccctgtttctcccaccctctctcctcctccagaggtgtggctctcttctgcataatactttcctctgctggttcatagctatcagtctgcagacaagctctactatttatgttaaaaacaaaagaacctcttttgtcctggcctgttaccattactttgttcttttttttttttttttttttttttttttattgatcattcttgggtgtttctcgcagaaggggatttggcagggtcataggacaatagtggagggaaggtcagcagataaacaagtgaacaaaggtctctggttttcctaggcagaggaccctgcggccttccgcagtgtttgtgtccctgggtacttaagattagggagtggtgctgactcttaaggagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcacttcccagtaggggcggccgggcagaagcgcccctcacctcccggatggggcggctggccgggcggggggctgacccccccacctccctcccggacggggcggctggccgggcgggtgctgacccctccacctccctcccggacggggcggctggccgacccccccccccgccgcctccctcccggacggggcggctggccgggcagaggggctcctcacttcccagtaggggcggccgggcagaggcgcccctcacctcccggacggggcggctggccaggcggggggctgatccccccacctccctcccggacggggcggctggccgggcggggggctgacccccccacctccctcccggacggggcggctggccgggcagggggctgactccccctcccccctcccggacggggcggctggccgggcggggggctgaccccccccacctccctcccggacggggcggctggccgggcgaggggctgaccccccacctccctcccggactgggcggctggccgggcgggggggctgatccccccacctccctcccggactgggcggctggccgggcagaggggctcctcacttcccagtaggggcggccgggcagaggcgcccctcacctcccggacggggcggccggccgggcggggggctgacccccccacctccctcccggacggggcggctggccgggcagaggggtcctcacttcccagtaggggcggccgggcagaggcgcccctcacctcccggacggggcggctggccgggcgggggggctgacccccccacctccctcccggacggggcggctggccgggcggggggccgacatccccacctccctcccggaccgggcggctggccaggcagggggctgacccccctcccccctcccggactgggcggctggccgggcggggggctgacccccccacctccctcctggacggggcgaccggccgggcagaggggctcctcacttcccagtgggggcggccgggcagaggagcccctcacctcccggacggggcggctggccgggcggggggctgacccccccccacctccctcccggacggggtggctgccgggcggagacgctcctcacttcccagacggggtggctgctggacggaggggctcctcacttctcagacggggcggttgccaggcagagggtttcctcacttctcagacggggcggccgggcagaggcgctcctcacatcccagacagggcggcggggcagaggtgctccccacctctcagacgatgggcggccgggcagagacgctcctcacttcctagatgggatggcggcggggaagtggcgctcctcgcttcctagatgggatggcggacgggcagagacgctcctcactttccagactgggcagccaggcagaggggctcctcatatcccagacgatgggcggccaggcagagacgctcctcacttcccagacggggtggcggccgggcagaggctgcaatctcggctctttgggaggccaaggcaggcggctgggaggtggttgtagcgagccgagatcacgccactgcactccagccttggcaccattgagcactgagtgaacgagactccgtctgccatcccggcacctcgggaggccgaggctggcggatcactcgcggttaggagctggagaccggcccggccaacacagcaaaaccccgtctccaccaaaaaaaaacgaaaaccagtcaggcgtggtgacgcgcgcctgcaatcgcaggcactcggcaggctgaggcaggagactcaggcatggaggttgcagtgagccgagatcgcagcagtacagtccagcttcggctcggcatcagagggagaccgtggagagggagagggggagggggagggggagggggagggggagctactttgttctttagagctctttctacttactgtctttctgccctttcttgaaccctcttcatttgagctttggtccttaacacttaagctcttttcaagtttaaggtcagtggagaccttcacattatcaaaaccagtgtttaactctcaggcttcctcttttatttcctcttttttggcttccctgttcatactctgtgcccattttccttgtgttgcttgacttttattttaatttataggcgctctttgtatattttgtcagcattttttcctggacacttgttttccttttgattcttttaaagttgtgtttcgtcatacagaaatgttaactcctctggattttgtaggaaaataactctataagaatcaatgagaattttgaaaaatgtgggtagtgaaggtcttaccagatatttaaagcagaagttctcaagcattagtgtacaaaaacctgcatggttgcattttaaaaatgaatctgtcacaggagttttcaatttttaggtattggggcagtaaggaacatagggaggcatatctgaggaatcttcattttaaatgacctctaaggtaattctgatatgattggtccatgggccacatttaagaaacattgcactttgggaggccgaggcgggcggatcacgaggtaggagatcgagaccatcccggctaacacagtgaaaccctgtctctactaaagatacaaaaacaaaattagccgggcgcagtggcgggcgcctgtagtcccagctactcgggaggctgaggcaggagaatggcgtgaacccgggaggcggagcttgcagtgagccgagattgcgccactgcactccagcctgggcaaaagagtgagactctgtctcaaaaaacaaaaacaaacaaacgaaaacaaaacaaaaaaagaagcattgctgtaaatttatatttggtataaaggggtattagcaaagtagtaggcaaatacatggcaggaacagaatggtgtttagaaacacattcaagtgtgaatgagaaattattaatgaagaggacattttgtctatttgagaaaagagtggtttatttaaaaatgctttaggcagtttatctgagaggaaagaatttagctttcaccgtcatacgatatagaaaaataaacactgttgaattaaagatctagatgtaaaaattaggtaaacactggaaaaaatacaggagactgatagtttaacctttggatagctgaggccttttaaaactagattggaaacctagaagctgtgaaagaaaaattgacagatttagctgttcaagtttacttttacttttgaaagataatgttctaacacggtgaaatcccatctctactaaaaaatacaaaaattagctgggcgtggtggcaggcgactgtcgtcccagctactcaggaggctgaggcaggagaatcgcttgaacctgggaggcagagcttgcagtgagccgagatcgcatcactgctctccagccaggcaacggacgggactctctctcaaaaaagaataaaaaaataaataaataaaaagagaaagataatgttacaggacaggggtcctgatctaaacctgaagggaaggttctcggatcttgcgcaagaaagaattcagggcgagtccatagtgcaaaatagaggcaagtttattaagaacataaagtggcgcaagaatagctactccatagacagagtaggatgctcctgaaagtaagaggaggaacgcgcccaccctgggtacagtgctggtatacatgggaagatgtgctctgctacagggtttgtgataaaggaataattttcttaattactatattaagataacattgcaaaaatcaatgttatctttaaagcaaaattaggaatgcctttgttctccagatatcgggatatctggacactcccaagtctggatctgttttttaaacattattaatttgttcccttaactggaaacacccggaggctcggaatgcctaattttctgggaatgcagcccagcaagtcccagcctcattttcctagccctcaccaaagacggagtcgctctggttcaaacgcctctgacagtaatactcattctaaggtgtagcaacataaagtatctatgactagttctaaagattttttagagccacctagcaaataagatgcggttgtccaaatttgttactttacttaatttatctagaacattttagaaaaattaaatggcttaattgaatgtggctggtatcactaggctgcatttgacgcccttgaatacttgctctgtggctctcccctcccttggcttttgcaacactgtcctctccattttcttattggtttcctcagtggtactttctccttctcggccccatggattggtttcttttcaaagttttctgtccttgagcttgatcttgtagatttcctatgtgttctgtttgggcattctcatccttctctttatggctccaaaatgtgtgcctctagctctggcctctctgaagtttcacagtttgtgtatatttggatgactcacaggaatcttaaacccgtattttcaagactgtatttattttctttctaccaaccatgcaaccactgaccacctattttacttcttgtatttctgtcttggtggaaggcaccaagatcattttctctccttgtattgttacagctctaattcatgacttaattctatattgtattcagatacagaattcgttgttgggaaggactggggaaacagctgtaacatttgccaccctcagaagctgctggtcctgtgtcacaccaccttagcctcttgatcgaggaaggtaaagaattactttcactgatttttatctaatttctttgccttttgtttctgctgccttcacattgtcttctacagatagttattttctaaacctgcatttgtgtacattagaatgcaaactaagttcttttcaaagggcacaacagttcaacttcgtctcctcccagccctgctcttctggtttattttttgttgcttgaacaaaagacaaactttttggtgcttggtcaatctgtgtggtgccataacttctaaagctccatccctactcccactcccctacaccatcttcacttgtcctcagccttttaagatcacaaaaaattgccatttgatccaagaagatttctcagaaaatgccagaactagtctctaccttttactgtactcttcctgaagcaccattaacacttgattaatacttacctttaggttatatgatcaatttgagttaactttttgtatggtgtaaggaagggttacaacttttgcttgttagttatttcagtaccatttgttgaaaagactgttctttccccattaaattttctcaccaccccattgaaattcagttgtccataatataaggatttatttctggattcttaaattgactccattgatctatctgtctgtccttttgccagtaccacaccatcttaattacttttcctttatagtaaattttaaaattaagacatataagtcatccaagtttgttctttttcaagattgtttggctgttctgggtgcttttaatatccatgtgaattttaaaatcagcttacttatttctgtctaaaagccagcttttatacagctgagatcttttttaagctaaccttagatttaatgaactagttatttaggtccaaaagaaaaggctgggcatggtggcccacgcctgtaatcccagcactttgggaggccaaggtgggcggatcacaaggtcaagagatcgagaccatcctggccaacatggtgaaaccccatctttactaaaaatacaaaaattagctgggcgtgattgagcacgcctgtagtctcagctactcgggaggctgaggcaggagaatcacttgaacccggaggcgaaggttgtagtgagccgagatcgcgccactgcactccagcctgggtgacagagtgagactcggtctcaaaaaaaaaaaaaaaaaaaaagaactcaaatattgttgaggtagcaaatattctatcatctgaaacctcagtggtaaacacaatacccaaatttaacatatttttgttacttgttaaatacatgcgtgtaaatatattcacttaagtaaactaagtggacaaaattagataagtcttttttcatatccaacttatttaacttgatacactttccagctttcaacataattgcaaatttttataatcttgtaagataatgttatgtaattcaacttgtcagtattattctagtgctattagctatattaattacataaagacattgatgtaaggggactcaaaaattcataggtttgggtagaaaatgagaactagacagtgatttcatcactataaatttagttgttacttagcgtcccctgaggctaatgtatggcagatccctgtagccataaattgcattctgggctttaagggattaaaatataattcaaatccttcaataaaatcataccattcacaccattacctttgaaaataaatacttggaattctagtacataccttagatcttgtttgtacatgccattcaatttattataatgctttaaaaaagatattgatgcaggattcttgctccttagttcagctaaatccaggttcttgtctcatgaccagaaaaaaattaggcatgtggacacattgaaggatgaggagggcggaatttattaagcaaaaggaaagctcagcaaagagaggggtcctgcaggcaggtttctacctcacaaattgaataccagggccaccacacaggagctgaagagtgcagacttctcctctgcatgaggcacaaattcctggtggctccaccctagggcattattcagaaagaatcagtcaggaaacggtgggcaaactgggacagactttctccctctgggtcacgggtttcaacctggaccagcagtccagtctttcagccttcaggttgctttaggcttgaaggtgaggtttcaccggggactctaccctatctgcctaggtatttgtctgcctccagcctctatcaatatggtactacaaatagaaggaagaaaaaaaagtcaaatcacaccttaggaaattacagcctagtagcatcagtaaaaatggtactgttagtcatgtcatgaaatagacgtaaaattgaaggttgattttctttttttttttgagatgaggtctggcttcgtggcccaggccggagtgcagtggcatgatcttaacttatcgcacttttcatctcctggtctcaagtcatcctcccacttgattccgcctcttgagtagctggtactacaagtgtgtgccaccatacctggctaacttttgtagtttttgtagagacagggcttcgtcatgtttcccaggctggtctcaaacttctgagctcaagtgatccatttgtcctggcctcccaaagtcctgggattacagttgtgagccaccatgctggcctgtttttcaattattgattgctttcaagttggaaagtgcattgtgaaacactcaaagatgttgctgggattatttagttcttttgatactatataaataaatgacagagtaacaccatagttatatgattggaactcaagaaatattaaatgataggattgaaaagagttatatgagtcatttgtccagaatttataaaatttttttctgtatcccaatggaataaatttaaactatgtatattctctgaaatagtcttccagtttgcccaacatgcttgctctcctgactagatattagctaaaaattaacaaaacagtcttttctcctgttactgtgtggtaaagatgtaaaaccctttttgccagcagggctgccctctactggactatttaaggtattcagtgagcaggtcaatatgactattttacaagaaggtaacacagtgggtataaatgtaaacatcccatatcccaaacaaactgaagttccctgaatagttaaaaaaaaaaagccctttaataaacttttaccattaaaacaattatggtcggctgggcgcggtggctcacgcctgtaatcccagtactttgggaggccgaggcgggcggatcacctgaggtcaggagttcgagaccagcctcaacatggagaaaccccgtctctactaaaaatacaaaattagccgggcgtgatggtgcatgcctgtaatcccagctactcgggagtctgaggcaggagaattgcttgaacctgggaggcggaggttgcagtgagccgagatcgcaccattgcactccagcctgggcaacaagagcgaaactccatctcaaaaaacaaaacaaaacaaaacaaaaaacaattatggtcattttgagaactggtagtgaagtttatatggtcttagtctccatttcaaccttggaggcagatctgtggcaatgagaatagtaatgtataggaacggtgggtctgctctgatgtcagtcttttatgatgatttgtatattaatacaaatcacgtttttgtgagtccattcatgctgtggatgttttcttaggcattagcataggtcatagtggacacatactgaataggtcatatctgttaaggctcttgctacaaagcatcaaaacttttcagaactatttcctctgtgaaaattcattttaagtagcaagttgtttttttctgtggttcattcccatgcctgagatttgcagtaatgtagaactagtttaccatcactgctgaaacactcatagaaggttccaaattcctggtccagggaaagagcaaaagcctgactcacataaataaacaactgaggttgcaagtttaaggaacttttttgatgaagtcaaggagtctttggatggttcgagttcactctactgcctgcttctttgttttcataataggaacatgtcccacagcctttagtaggatgtcagaattttcttgatgttgccagcaggatcctgtgtcccaggaaactacagtggaataaggggggtctgaggtgcttgctttggggagacctctagagtaagtcctttgctgccagcagcagttaagggaggtagctgtgacattgtcttcagcttctgccatcttgttaggtcccaggtgagattttgaaaaggattgttcaggggtggtaagagctcaaacaggcctgcctcagcctcatgataagccactgcatctggctaatttttttatatatgttttttgagacagggtcttgctttgttgcccaagctggagtgcagtggcaggatcacagctcattgcagcctcgatctccctaggctgaggtgatcctcccatctcagtctcccgagtagcagggactacaagtgtgcaccaccacaccctgctaatttttctcttttttgtagagatgaggttttactatattgccccggctggtcttgaactgctgggctcaagcaatccgcctgccttggcctcccaaagtgctgggattacaggcatgagccaccatgtctggccatgatattatttttaattcaaaaacaaacatgcaaaattaaattttagtgagagaacttagttggataacatctttcttctgggttattagggtatgtttattctttgcaactctgatgttctaggtgtagcaagaccgtttgttttcattttgccattttcctgtacagaaagctttaatgtctccccatgacctttatggcaaaaaccaaattccctcgaccagtctttggattactacacaatacattgtcaaagaaaatagcctggaatggtgaacagagcctgaggctcagttgggagtcctgacttctcatcagctgtgcatgagcaaatttggaggtgttccttaacttgtaaaatcgatttggatttttggtattttaagcatgatttcctttagttctttttttttttttccagagtgctagaattcagtcttttagttctttgaacatatttataatagctgctttgctgtcttgtctactaagtctgacatctgggccttcaaggacaatttctgctgcctgcttttcccttctttctgtgtgtcatacttttctgtttatttgcatgcctcatgattttgtgttgtaaactgggcattttagatagtattttgtagcaactcggaatactgattttccctcccctcttccagggctgctgcttgttgtgttgtttccttatttgttaactgacttggctgagctattacactgaggtttgtttattctgcacagtgtaccctcagatgtttctcctcaagagggtacacttgggcacgcacatagtcaccctggactgcccttcttgagagatgatagccgattttcagcagggctttctttaactctcagatctccttgttaagcttctgctttcattggtatcaccacccagcaactattcttcactaattgctaactgattgctttattgttttggacaaagctttgggccataaatttccccacttgtgatccagttaaattaagatgccctttgtataggggttgtgtttgatggcagtctttgaggcttgtcatgtcaaaaaggaggattcttaggtatctctttccctggttctctgtgaaacttctacagtagttggttagtctttcacttgctgctgtcacagaactaccagcctcattttttttttttttttagatggaatcttgctctgttgctgggctggagtgcagtggcgctatctctgctcactgcaatctccgcctcccaggttcaagcgattctcctgcctcagcctcccgagtagctgggactacaggcgtgtaccatcacgcccagctaatttttgtatttttagtagagacggggtttcactgtgttggccaggatggtctcgatctcctgattttgtgttctgtcctccctggcctcccaaagtactgggcagcctcatcataattgcttaccaccaatgtctgtgttgtttttgacagtgccattaggcatgaacttttccattctttgttctaaatatagtcggtcttagaaattgctaaggggctctgtgttcttacagcctgcttctccagcctgtgcagaacctttgtgccattgttctggagctggggctggggacagcagcttgattttcttatagttatatctgttctgtgagtggtctactaggccatcaatgtacccatcagtcttctctgtttggagcttcttggcctgcatggaacctctgctttacaagaggtgaggcaaagatgatctgtgcttggtgtccttggcctgatgcatctggggtagagcttctgccctaagaatggggactggatgaaagagaaaggattcttcagttctctcatctatctacacttgcctggaatagaatttctgcaacacagagctaggggtaggaggtgaaaaatgctggctgcttgcgtcacttgggaagaaatcgtagtcctggatttggagctgggtagggttaactagttactagttagcttcagttttgtttcttcaagaatgatggccggatgtggtggctaacacctgtaatcccagcactttgggaggctcaggtgggagaattgcttgaagccaggagtttgagaccagctggggcagcatcatgagagcctgtctctacaaaaaaaattttgaaaaattagctgagtgtggtcacacatgcctgtagtcccaactgtttgggaggctgaggagagagaatcgcttgagtccaagagtttgaggctgcagtgagctataatcttgtactgtactctatcctgggtgagatcctgtctttaaaaaaaaaaaaaaaaaggtattattacccacctgccacacaatggctgttcccctctgcccggagtgctctttcttacccaaataggcacatggtacgctctctcttccttatgagtctctgttcagatatcacttagctgtagcacctctccaacgttgccccagtcactttctattttccttacctgggtttattttcctcataacatttatcaccatctggcacgtacacatgcatgcatgcatacctacatatttgcttgtctacctctcccagtgaacgtgtaggttgcacgagagtgggaacttaggccgttttgtttactgttactttcgcagtgcttagaacgatatctaacatagtggattttcaataaatctgatgaatgcaaagtacagaatgaccaaagtatactgctttcttgcgtcatagtttaacctaacttgaaaactatctgtagagccattgtggaaaatgaattttttgtgtttgcaaactccagttgcttgttgctgactagagtgagaatggggctcacagggaaggaatgtggtgattatttggcagtggctgctggggctgtgagagaggatggatgtgttgtatttgtaaagtacttgccatccctaatgcagtgagatgctaaagcacaggaaatgggtaaatttttggtcttcccccaaccctctttctgacttgctccctttttactactgggaaatgtttgtggatacttaaggttttggttggaacagccgcctgtttacagtatgatgtggaaacttttcttgtaattccgttgttaatagatattgtacaaatgagtctcttagaaatatcaagacattgtaggggaccagtgtggtagctgctgcctgatagaaaaaaaaaaatcttcatttgccgatgtaacttttctttaaattattttaaaatgattttgaactaacgcctttctttttcttcctcctagattctcgctgaagtctgttaattctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgcaaaaaacaaatttaagaacaaaagactcttgggaacacgtgaagttttaaatgaggaagatgaagtacaaccaaatggaaaaatttttaaaaaggtaagatgatctttcattgcctttgaattctttcgaataaaatatcctgttagaaatgaagtaaagggcaagcacagcctgcctccattagaattcgctgttgaaggagaagcagtgtaggaagggggctagactaccttctaatttcttcctgtacttaccagcactgatatgttctgagttttcagaaggacatcgcaacccagtggtgtggagctcttccccagtgtctaccagggtttggaatgtctagggcagttttgagtatgaaaccatactccctgtctctagagcagctgggtgctggaaatggctccaggttttggggtgggacctgctgtgttaaatgtggcttagatgtgggttgcagtgagtgcttcatgtctttgtactttggctgtggcagttgcatggttcttaaaacatttcttttcagaaatatggagaaacctgccattgttgatttgaaacaacgggcaagatgttctcagaggcagtgtaacagcgattaagagcctggactccagacccagactataggtctgaatcttggctttgccacttaactggctttctgaccctggaaaagtaggttaactaattcgcctcagtttctttttctgtaatatgaagataatgatcattactgacactcaagagccaagctgttctaagagctttacatatatcatcttaagactcacagttaccctatgagttagttgttattattttcactttacagatgacagcactgaggcacagatagttgaggtaacctaccccagggacactacagctagggaagctgggactggaatccaggccttctggctccagaactcataccctccattcttcactgatcacagctttcatgcttgtgaggattgagtgtgtgtgtatatatctgcaatgtgcttagaacaatttgtggcacttaatgtaaatgctctagcttttattattagattactattatcttgagaattcaatgaggaaaattatagtagaaaattcaatgaggaaaattagatcgtggaatagtgtgtttcactggtagtatagaaatggcgtgagaatgccgtttatgaacttggatatgtgacttccttatgagcagttcttgaaactctagtaagttaaaaattgaagataaagtattttttagagggggtacagtgaagtgatgtgtagttggttgataatttggttaggtaataggtttaatatcttttaaccatttccagctactttgatccccaactggctttttttcctgtcagttacaaggaaaccgtcaactcttgaaggagagtccaaataactgcaactatggaatgaaaaactcagagctcctcttttactggagggccagagggatgttgcttaacctcctctatatatggcccattaattttgccacttaaacaaatttcatacatcattttcctcaaaacatgaaggagatgccaagcaagttgatgtcagtaattcctagaaactaaaaacattttaacttgacaacagaatatgtaaatttcctcacgtttaaatagagtagttgtgtatcttgttttatctgaaaccatcctgatttatacttgttgctgtgacattaatagtgcccccttacagtctcaaaagtgccctagtttggatagttatgtggtcaccttatttttaagacatattccctatttcttttgcagacttagaaaaaactgaatttttttctatttaagatctcgctgaagttaatagcacatttctagaaattgaaatcatgagttaagcatgtttgatttttcttttccagcctatggattgtaatttccaaaacattttatcataatgaagtttgcttttgtcatatttacatatctggcactgcctttttttttttttttttttttgagatggagtttcactcttgttgcccaggctggagtgcaatggtgccgtctcagctcaccgcaacgtccgccttctgggttcaagtgattgtcctggctcagcctcccgagtagttgggattacaggcatgcgccaccacgtccggctaattttgtgtttttagtagagacaaggtttctccatgttggtcaggctggtctcgaactcccagcctcaggtgatccgcccacctcggcctcccaaagtgctgggattacaggcatgagccacagcgcccaaccagcacagctttttatggcactctgttcttgagtctgtttttgagaaatcgggtagttatgagaaggtactgaaaacagtacatttttatgtgcaaaagttttctacttttctatctgcttatagattcatttttttgtctttgatatgctatttgaattcaaaggttggattctcttttagtctaagcatatatacagaagtcttatgtttcaggaagcttcgtttttctccggtatcccacacatattttattcattttaatgtggctagtattgtctttcagtcgtcattcggtatgtacagcagcaaactagttctcaattgtgtaaaaagaagaaaagcttatgtggtgaatatgaaatttcttcctaattcgtgtatcagtataactggacaaaataaaatcctagagctatgatagttgtttcctaaatgtgcgtgtgtaagtgtatgtggctctttcctgcttatcttaaccatagtgcctttgtattcaatgattattcaacaaagtatgaagtatttgaactcataaaagttaggtgagacagactgttttttagcaactttttctgtctatagttcattactgtgaagttttatttagttagtaaaaggaggttttgaatttctatatgtcagaagatctgcctactagcatttgctatgaaattggcatttgtggttcatcaaactttgttcagaaggctgtgtctagactgtgtcttgggaacatgttatagttttctttaggttcattgggaaagtagaattaatttttagattttgcatataataaatgaaacaagtagtttctcttggccatactcaagaagaaagtgtgcagtgtcgctggttagctgaggctttagtttctgttcattctgtgttgcagctgtggcagtgatctgcagactgcagagtgggtatctcagctgcatgttaaacatgctaggcctttttcgttttcccctctcttggtttcttgttacacccattgcattgcatcagtagcagcatctgcctagggtgttgaaaaggggaactttcacaactggtgggttaagctgtgtactttctgctattagtgcctgctagctgatcaagctcagtgaagtgtgtcttcattaaatagtttccatatttgaagataatcttcaactggaaaagaaaacgaatgttgtagcaatatttaaaatattttttgagtaagacttttggggattaaccccagaatgttgtatctgatatggttgaaggaaagatgcacaagccttatttcaaattaatgaactttgaagctttgtttccatcttatcccaacagtctattttgaggtcctgaggggaggatgagtggatgaaaaaaggcagtggcgatgaccctgctctcgttgtgtccaaggtagagtagccaccagcttcactacgaccagattcttccttgggggacagaaaaacaaaaggcacttggttgcttggcaggccttttcagggtccttttaagtttcatatggttttataaaactgtagcagagttaagagctggaacctgtgtcagcatcacctgattccagtgttcccagcagtaaatgcattgcactaacgtcgtcttgaaatgaacagtgaaatgatttcaggacaaccttaaaatacatgtatacctgaaatagaacaaagctgcaaagactaaaaatagaaacagaaaagagtacaagctggctcatatactttgtgagccatcagaaacacttgattttttcttagatattttataaaaataagaagagaatgagggattatgtaatatggtgcttagagaagacttcactatgacattccttctaaattgatccaaaaagataatagaaacactcatttatgtccttgtaagttgacttagctttcttttcctctttcttaatgccgtcttttgtgttatttcttagtcacatttttttaccctgtttgtgtatgtgtataaaacttattttctgatttattaggacatttgcatcatgctatatgtaacaaattatggtcagtctcttggctgggatttgtgggttggttattatattactcttctcttagtttccccttccaaactgtccctctcctttcatcctatttattaaaggcactgctgcataccaaattgttgaagccaaaaaatcaggggtgtctgatttacatcccttacagcctccccccgccttttttttagcaggcctccttgcttccacacttgcccccaactgtaattcactcacacacagcataaaaatgatttttcacaattgttaatcaggccaccttactcacctgcttaataagacccggacttctttctacagtgcagttgaagcattgtgattttatgcttaatctctggaatgagtttgcctgggttcatattctagtcccattacttattagttacatgattttgaacaagttatatttactctacatctccatattctcatgtgtaaaatagggataataatagtaacagttttttacaggtatggtaagagtttaataagttaacacttgccgtgtccttagcatgtagtaagcactaataaaggttagttaccctcattatcattatcatgattattacaactatccagatctcttgaatatttttactctgtggctcccctcagaataattttttcatagtgatcttcagttgcagagagaatggttaaatgaagccaggtgtactttactgaagaagacaggaatgtgtgtaattttgaaatatttctaaatagtgaaagtaaaacaagtcctagtgcttaaagaggttttcagtaggagacaagattaccacctgtaagtagagagaaggaagggtggaaggtgtgtgtgtacgtgtgtgtgtgtgtgtgtgtgtgtgtgtgtgtgtgtgtgtgtgtattttgagacagggtctcactcttgcccaggctggagtgtagtggtatgatcatagctctctgcagccttgagttcctggggtcaggtgatccttttgcctcagcctcctaggtagctgggacgacaggcatgtactgcacgtctggctaatttttacacttttttagacatggggtcttgctgtgttgcccaggctggtctcgaattcctggcctcaaatgagttgcctgtctcagccttccaaagtgttgagattacaggcatgagccagtgcacctgcccagaggaggctatttgaatagagagaaggtttcagaggtatttcagagggtgagaaaacgaatagaccagggatgtatgataggattgcttcagggtgttgaggtcctagatttaataaggttggctgttctgcagcagtgttcaatgatattggcaaggaataaatagtttaatcttgtcttgggctagccatagggacaaagttaggattagaaacttttccagcacaaatcagatacaatatagagtgggtagtgtcctctaaatgtaatatttatgaaaaacataattactagatgattcagtggtttaaagaattaaaatcatgagattcagatttcgttttatattttattttttacatatgtggaaatcttacgctcatttgattcctttgccacatggtggcatcattgcatgagtttacatatttagattatatatcaaacaccttttcagaacacacatagtctttgaaatttataaatcctgtcacttacatattagaatctggaaggtagtgcattcttaacctttagagtgtaaaattcttaataattataatccagttcctgcacattttggccaagttgtcatctgtcttctaaccctcacagagctccttttgaagtcattggagctccctgtgctgagcatttcatgggggtaaagagcaaggtgagagtttgggaccagtaaagtaaataagtaccatcttaaatgcagttgctttatccatcaaaataaaaatttatttcttaaatgcgtaattgcatgggacactagatggcagcatttatccttttccgtttttatccaacctcttctagaaatttcttaaatgtttacatttataaaatgaacatggtcagatgattttaaggtgtttgagatgtatattactgacacagccatgtttgggaattaattacctatatatttttgcagagagaggagctttttatacagtccgtatgtaattagggatttatggttttgtctaagttgaggaaaatttctaaagacaatatgttaaaaaacttcaaaagggagtttttactaatgcatatttggtattaccagcacttacgataaacagataaaatattgaaaacctggcggtgccagtaagcatttaaggcttgaatagagggactttgaataatataactagtccacctggttatgtaaacagaaacttgtttactttgcttttgcttatccagagtttggtatggcaattcaagttcagcaatcataaagatttctgttagcttggatagagaaagtttctgtgaatcattttataccgtctgatactgacatttaggaattcctaaatagagagaaattaaaattttggcatctgcggtacttggtactaggctaaatattaagttaacacctacatcatttaaataggtgaaatttataagtagattattagtgtatgaccatttggccaggcagttgacctttacgagcctatcaaactctcaatatttttgaaaaccaaaaataaagccaaaaaaccccccagttacaatataagatttgagttgttatagaagatgtcacaaaatagctaatttttaaaatagatttttcactcaaactcagtttctggctttttattaaaaagataattctatgcaaacgtaactttctggttcatcataacatttggacgatattctggtttcttctgtaaattattattttgattacattaaaaaaatttttttttgttttatcaggttattcttggacagtataattggctttcctatgaagatgtctttgttcgagcctttaattttggaaatggattacagatgttgggtcagaaaccaaagaccaacatcgccatcttctgtgagaccagggccgagtggatgatagctgcacaggcgtgttttatgtataattttcagcgtatgtagactttcttatcttctggaagaatgaacttaactgatatttattgaaatactttactctgaagaggttaaaattctgatgttaattttcacccagtgtccagttagtggagaactctgttgtgacttggaatttttggtttattttggaaaataaatcaattatatgacaaattgtaccaatcagtgttgcagtgaggcttgaacctcttcatgggagactttcaggtcttgagaactagacctacacttaggggccgttgttccaataccatttctcaggaatcctctttagaagttactgtcaattttgttctgtcacctctatcagtaacaacagttgacctccgaaacacttccatactgaaacctggtgaacttcaaggtgcaggttaaacaatagagttttcatattgtaattatctgaatggtaattgtggtggctcagtctgtgagatagttctggaagcataagttcagaggtctcggtgccaaaatgtgacagtaatttgtggatgtttagtctcatccttcagatgaaacagaaaatacactttcaccagatttcttgctgtaaattcctccaccttttctttttcttttttttgagatggagtctcactctgtcgccaggctggagtgcagtggcacagtctcaggttactgcagcctctgcctcccgggttcaagcaattctcctgccttagcctctcgagtagctgggactgcaggcgcatgccgccatgcccggctaattttttgtatttttagtagagatggggtttcaccctgttggccaggatggtcttgatctcctgaccttgtgatccgcccacctcggcctcccagagtgctgggaatataaacgtgagccaccgtgctaggcctcctacaccttttcttttaaacaaacattccatttttgttgtcacaggtttggatttacattgtttcttttgaggagctttaaaagaattattttcaaagtcattttgtgtatcttttttgagttaggcagaaagtaaataaaaatctacactattcatgttatgtaatttcagcatttcagagaatgtttgtctttagatatttttgcttgagaataaacggtactgccacttgtttgtgctcttttcttgacatacaccgtaaatctgacattcagtgtgtcatcctatttgtatatgttctttttcacattgtaaagccaagtggccaacaattaagaatttgaagtcttagaaatcagttataattccttcacaatgtggtagtcccagagtaacatctgtaagtgaaacaaaataaaaatttaaatatcttcatctttaaaaattggaaatcttggggcatttaggggaggatgagtaggtgtaatgttgattagtatgataagataactttaaaaaacataacacttatagactgtggatttaacagtttagggctcctaatgcgttattatgattcatctccacattcagagactttacatttgtagttaaatgtttgaatatttgactggctgctgcttttccttttagttgttacattatatgccactctaggaggtccagccattgttcatgcattaaatgaaacagaggtgaccaacatcattactagtaaagaactcttacaaacaaagttgaaggtgaggactctagttactttctaactgtctgatactttagaattttcagtgtcatgagccctattattgatacttagttcttttatgacttttaagtccttaatctttgtggacttttatgaatatcatactttattttttcctttagaaaataaaaagtagattttgtatatattcatgtataagtaatccagagttataaattgttaagatgcctatgtttaaattgaagaaattacgactactttttctcttattgtgctcatctattttctagtttacttttagtaaatttgtaattttgaagggttatattttaaactagtaatttttattttacttctgaagcattaagtaattacaagttttcagaattgtttggaagttaaaaagggagacttttaattatattacagtaaaaagagtttctttggtctctagacaactcccagaaatatctgggctattctatatgggggaaggaggagaaaattcacatgtaaacttgttcaaaaagaaaattttgaacaagtttgcatgtgaattttctcctccttcccccatatatttttatgtagtctcttgaaaatatgaggggcttctggtttctctacagtttaggcaacctgtgtttacatgcccgttttataaggcagtacccttcttgatcagggttttaccaaaggccaagggtacacacagtgaatctaatgctataaaataataatttaaattcagaccaatacttaatcatctgtaaaaagtgatattatgccagtgtaccctttcttctttcttttttgaggcaagaaattacttaatgattcaccgaatatggtaaactagtattcttattcgctaagctgcttgaaaaataatgaacgtgatgaatgttggtgtatttctaggatatagtttctttggtcccacgcctgcggcacatcatcactgttgatggaaagccaccgacctggtccgagttccccaagggcatcattgtgcataccatggctgcagtggaggccctgggagccaaggccagcatgggtatgttacacttttctaattccttacctgtgctttctggtgaccacattctccagaattatgccaaagttttgattctgaggttagctcaaatgacacatcagttttctaacatcagttaggaaaacaggtccctctaggtatactttcatcttgtctttaaagaaagttttaaggaaaaatataaacattaattattaatgttttaaaggtagtatttatttgaaatttaaaatattttacattcagttttcatttcttttttatggtgatagttttgggtggtttaaagttagtttataaataatgacatttatcttgtcctatgtgaattacctgtaagtgttaacagagtggctaaacctggaggcctccttttactccctgttccagttcttccctttcctgaggtgaaaaccttaccctccaactagcacacctaggcatggtgactctacaagttcctattctcaaaaaagcgtcagaaaatgttagctagtgtactagtgtttagagatactgcaaaagctgctgggatgctgggactgcatttcctctgtagttggaaacctagtaattagatgtaagcattcactcaactcaaattttaggcacctggaatttgagtggtagtgggatatttagatgcagatatattgtggacagtggtgtgtaaaagtctagtactcgagttatgtttggacttagagatttggaagctagaagcagttaggttttaattatagctgtgggagtagggggtgaggtcaccaacagggaatggtggcttcagaggctactaaggactagtcagagaggaaagaagaaaatatctagtagtatgtggttcctggaagccaagggaaaggagatcttggtgagtcatcagcaggatcaggggctgcatgcagaggtcagatgacacaaggattgtaatttccaagaagtggtggtgttggagaagggtgctgtgcattgaaggagtgaagggctgatttggaagtaaagacttccaagtgtaaacattatttaagaaatgtatcttgactgacaggagaggaagggtattctattgggagtacatttaaataattttttcacactcatttagaagttcacatgtagagtagttctgggagtggttcagacatatcagcaatgccaaccatgacctatttctctttgttcttctgctgtgccacctctatagcttctcagctgttgtccttaggctggtactcttctgatttcaaatggttcacatcgtgttttaatgcaggactctgagtgtaaccaagttagtcaccattctgaagcagtgaatagtttttagcaaacacctagatactctagtccaaagctacctttatttcttagttgaattactgggataatcttgtctccctgataccttttttccccttgtaaagttagttagccacacagcagccaaagtgatcttttttttcacagataataacatactcctgttcaaaacaacattgctttacatccagaacgtaatccagagttcttcccgtggcctttgaggtcctatgtgtggtccctgatagccacttgactattgtttcttgccactcttcctcttgctcactctgttccagccacactccttgctggtctttagatatgctgagcacattcctacctttgggtctttgcatttgcttatttccttctaattagaacactcttctcccagttccagggtttccatggctcccttcctcactttattcaggcctttgctaaacgaaactctacagagacggtctccaggcttttccatccaaatagcatctattgtcatcttctcaccttgtcttgcttcagttttcttcataggttaatctgtttgtatatctcaatagaatatatctcccatacgtgcagggacttgatctgttttgttgatctcagtataactaatatttgttgaattgagttaaattaactcaatttgattgagttatttatttgatgataatgaaaagaaattgttgatacagctgaatctcatgaaagtgtatgtgtgtgttttttctcttcaatgcagaaaaccaacctcatagcaaaccattgccctcagatattgcagtaatcatgtacacaagtggatccacaggacttccaaagggagtcatgatctcacatagtaacattattgctggtataactgggatggcagaaaggattccagaactagggtatgtcatagtaaagtaacattgagtagttaagtatttatgtctgttataatgttagcatttgtgtcattttattaatatatggctaaattagtccctcagagtctgtttgtagtaggcatttccttaaaaaataaaaaaggacattaaaattaatggcaaaatagttatagttgtgaggttgaaaatatatcatatagatatattttaaaaagtacagaacttaaatttgtatagttgtaaatcctttgttttaatcagcttgtatttgctgctgtagttttttttatatctaaatacaattcaggtgaacaggtaacttaatttatccactaagtatttgttgagcttcagtatttggtctctgatttttcttgttaatacaaactccagtggtagcagtggaaggtagagtggagtggggaagagactgatggaggaaaccagatggaagtttgagggactgtcaaggaaacattgccagagatgcaattggtattctgatgaccgatagggtacagtggttggatatttttgatgcttttatgcacagaaattacaaacatacacgcacacacacactcacgtaattgctatggtactgaacttggggatggaggaatgtctcttacgtatgcatacatttcagaaaaaattaagtgcaacaattttcttacaggtttgcctcagttaccttctatattttggttatgggggcagctcttgaagtatatacaaatacttacacattttctgtatattaagatctaatttattatgtaatccaattcccacaacaagagtcttatctgtaaaatttctggcagatagttgtggattctactttaactcttctggttggcaacccactagatgtaaagaccatttcctccttggatgatttcttctgttcttcaaaagaaccctgtattattatttgtttaagccactgtttcttgtgcctcagtactttgcttcagcaacgcttataattcctgagtgcttttaagtaggacgggaaacagcattccttcctgcaagtgtgcgcctccttgcttttgggttgagctgtaattctttttccctcccatccccagcatctgcctatcctctgttttcacctgtctctctctctctctcacaaacacatacacacttgaccagcaaattgatgccctggggcccttccatgtgccttcaagcttgctcccattatagggcacttttggcatagacgacacctgacttttgtttctgacgtctcccttttcttttagagaggaagatgtctacattggatatttgcctctggcccatgttctagaattaagtgctgagcttgtctgtctttctcacggatgccgcattggttactcttcaccacagactttagcagatcaggtaagttcagtgtctgtgacttgaaatactaaaaaatcatagtgaattgtaatgcatttttttcagtcagtatgacagtatattgcgagagcgatggttcattttaaaatgagctttagccttttaagtgcttcttagactgtaagtacattaaaataatttataataggctttttgatctaagaataccattgaattttaaaaataaggatcactttatatggatcactttttcttattttgtagtcttcaaaaattaaaaaaggaagcaaaggggatacatccatgttgaaaccaacactgatggcagcagttccggtaagaagtgacccttatttaatattgagtattaaagaagtatcacccgctacaaagcattagtgctagtgaaaaatatattgttgacaaggtagtttatgtaggatttattccttattgattataaatattgccttaggcgctatgggatttcttcagtcttgttttagcttgctttcttatttactaagcactcaacttaatttcagcttctgtgtgtaattatcaacttgtttgcctaaataccttcttgttaaaataaaaattattttcatgatatctgttggtgaattcattgacacttgaagcctattgagagctaggagggaaagtgtgagatcacctccttttaagcaagctgtatagttacctcctgagtcctcagggaaagtctggcctaaacaccaaacaaagtgacagagaagctggtgcagctttgaatgacttaagaggggctgttcatccttacataatataggggcctgggaataagacaagggaaatggggcagcagtgattttctggctccttataacataggctgagtttgtttggaaatgatgggaattattgtcgggtacctaaatgcttacgtcaagaataattacatagttacttcaaagtcaaatataaataatcagtagtttctttctataattatagtttctttagtatccaacttaaattcttagttcacttaaaaatgacgtacaatttaaagttgtggaggaaacattattttaagtcattaaagtatacttcacagtaatggacctagcaagcaaaatgcagcacagacaaggaaaacttcctggtgcaatatcgaaagtcaaatagccaaacaaaaactcccaaacgttgcatggtctttttgtgagcaaagaatgtggtactgtatatttttataagataaagttaggacattttgaaaaaccatttcagacggttgttcgtttattttgtgagtaggttttagttcagaattagtaagataagcaaagcaatataaagaatatcttacaatttatatgagtatctagatatatttctgcttttaaaaattatttttgtggaaactttatttttaaactaattgtggttcgattttaaaagtttgatcttgataggatacatctttttgaaaaattcacaaaaggttttttccttcttgctgaatcacatccacagttgaagagtacttcttttaaaatgccttaatattgctagaaatgttaatctaatgctaagtgaatatgtaaggcagctgttattattaactatgttaaactcatttttatacatttaggaaatcatggatcggatctacaaaaatgtcatgaataaagtcagtgaaatgagtagttttcaacgtaatctgtttattctggcctataattacaaaatggaacagatttcaaaaggacgtaatactccactgtgcgacaggtaagtaaagactctctacctccttctttctcctcttgataatttaatcatttagttcacattaatagcccaattaattgagatagttataagaaagaaatatatttcataaagtcaagagaactctttaaaaaaaatccatcccaggccaggcgcggtggctcatgcctgtaatcccagcactttgggaggccgaggcaggtggatcatgaggtcaggagatcgagaccatcctggctaacacagtgaaaccccgtctctactaaaaacacaaaaagaaattagcggggcttggtggcgggcgcctgtaatcccagctactcaggaggctgaggcaggagaatggtgcgaacccaggaggcggagcttgcagtgagccaagattgcgccactgcacgatctgtctgcctgggcgacagagcgagaatccgtctcaaaaaaaaaaaaaaaatccatcctggctgaacacggtggctcactcctgtaatcccagtgctttgggaggccaaggcgggcagatcacctgaggtcaggaattcaagaccagcctggccaacgtgacaaaaccacatctctactaaaattacaaaaattagccagagtggtggcatgtgcctgtagtctcagctgttagggaggctgaagcaggagaattgcttgaactccctcgggaggcagaggttgcagtgagccgagatcgtgccactgcactccagcctgggtgacagagtgcgagactcttgtctcaaaaaaaaaaaaaaaaaaaaaatccatcttgacatgggaggattgcttgaggccaggaaatcaagaccagcctgggcaacatagcaagattccttctctgcttagctgggcatggtgtcatatatctgtaatcccagctacttcagggactgaagtaggaggattgtttgggcccccagtgggaggattatttgggcctgggagcaatgactgcaccactgcacaccaccctgggtgaaagtgagactctgtctctttaaaagacaagcaaacaaaaaacctttgtaatagtatgagcagtttaaaaaacctgcaatgtcattaaaagtgtgttttcacttaagattttgctatttgtgagtttatattttctgtgaacacttagggagttttaattattttgagaaatagtttctcttttgcttttatatttatttcagtatgaatataattaaatgttttgtatttaaagctttaaatgatcagttttgttccagcttgtatttgtgtagtgttaatagagtacatagatttatgatttgatcataaaatagcttagaagttagaaaatggaagtatgacattcaaagtattttttatggtaatattaatatagttttcagatgcttcacataatttagaactttgtaagtttttttcctgccttacgttagttatttcttcagtgagttgtaaagtcggccctctgtatcaacaggttccacatctttagattcaaccaaccgtggatcaaaagtattctggggaaaaaacaataaaatataacagtggaaaagaaaatacagtataacaactatttacaatgaatttatattgtattaggtattataagtaatctagagataatttaaagtattttggaggatgtgtgtaggctttatgcaaatactatgccgttttatataagggacttaggcatctgagggttttggtatccagaggactggatgccaagggataactgtaaaagctgatttgaaaagtctgttaataccatttttaaaaaattgtcaccgtgtagtcttcaccttttgcaaagatttttttttttaagtactacctctcctttttgatcaaggcagtatgcaatctttgtattagtgtattttcagaaacatcaattagatgtttaacttgtttccttttttaaatgcttcacagataatttactagattatttttaacaaacaattcaaagcttgaattagtgaaacttcaaaaacagattgtggtatacaaattatacacatttctaataaagtacattaaagcaaaaattaatttgattttaatacatttcataaagatgatagaattgttcagtattaatatatgataaatattttatgtaaataatgatataaaagtggccataagcaagggttttcctgtcactatacaaaactaaacctgacaattcaaattcgaatatcacttgaaaagctcttaagaggaaataataaattctttaccttgttgaacttcaaaaaattaacatttggggctcaagagactctccaaattggctgtgtgaccttggataagtaacttaatctcaaaatctctcatatcaaaactgggggattagtttaagtgatttggaaaatcccattcagttttaaaatcctgtggttctctaatttttttctttagctttgttttccggaaagttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaaggtagtgttctccatggtcagaggctggagtgtgatgccagacgtttttttggggtatgggatattttctgcaaatatataggagaagagtagtaaggtgtttgtgaggcagaataatggtggattccaagtactatgatcattgatatcaatttttagaatgtattagatgcatctggagtcaataatttatctggagaagtttttatatcaaactgataggtaatattaaaaaccacttagcattttggaagagaaactttagtaacaaacactgactgttttgtgtacatttattttctcacatcagtgattaaatttctttttatgtagaaaacttaaggtgcttttgtttatttgtgtaggtgagtatattaaggctcaggttcagaaatgtttatgaggatttctgtaagtgttagagaaggaactaagttctggtctagggaatattattaccagagtttatcatgtggttgtgtttgaggaggagatctaccaactaatcagcagttctgagatgaatcgcatagggcctcatgcgtcccttttatgggagaaagttattttgctttccggtacaggatacagctgtgcttctcctactttgtatttgccatatacggatagatacaaaacctcatgactgatttttccctatttattttgagtggctctgtataccattttcatgtattacttcatttttctgtttttcagttatgttctctgttttcgtatatttttggaagctagttctaagtcatgttttgtaggaaataagcaatcttaaatacatgcataggggatttctttcttctgaggatccttaatttcttctatttttaagattcaaattgaatgattaatcagtaacagtttatgttttaaataaaagtctttaaaatgttaaatatcagcctttcatttctgatatttggtctttgaagaggaaacataatgcaatagtaattcataatagtggagggttctttcctcacatccttgaaagccaccagtcttattcttcagcctggctcttgagctattgctgtattaattttaaatagggtgtgatagcataagctgatggaagcctgcagagatctcactttgaaatggtgatacattacatgggaaaagattagagaggtgttttatactgcacatcggtgaggcctaataagaaagtagaatagacgtaaaccattgttttcatcatcctttaagacagggatttcaaactcaagaaccaggcagctacctatttaaatgagtcaagtgggccctaatgtaagacaatgtgatgggtaaggattgattctgagggaacaggagcaggcatgccctctctaacagaggccgtcagttctgctgtacctgaaatgtgggcccattgttgctggcgattccacacttacatctaaaatttcctgattttttaagaatgacaataactaatttaaaaaaaaaaaaaaaacctcaatgtaggccaaaaaatacgactctacaggcctcacggcctgtgcttcaccaatatgtgacttctgcttttaaggaatagctggggatacctcagccttaggataaataatcatttttggtaatttagaaaaatgaagcagtgtattagctactgttctcaaatatcctttttttcatttaattcctagtgtgggactacaatactggcagagtgggagcaccattagtttgctgtgaaatcaaattaaaaaactgggaggaaggtaataaactattttaaccacagagcattaatttttaaagtattaaacttgaaaattagtgcttcactttcttgctttagaatgtaaacacccataagtgctcatttttgtcctttgtgatagacgtgttttatctcgaactatatgaatgcatttatttttcttgtttcaaagatgtttctgaagaactattattgttttcattttacttattacgtagatgcaagtaagaattatggcaaaaacttgagaaatgtactaataagtgaataatgtcaataaattaggagtgatcataactttattttgcagaagtaaaattataaaatttattttatgaaattgtggatttttaaatgatttttttctttttttttctgagggcttcaaccttgtattattagaaggaaattttcactgcaattccatagaagtctgtttattctcatgccatttaaaataatggtcacttaaaaatttatttgatcctgttaaaatatacaaattatctgtgttttattgggatgcacctttcctctacattaagtaaagataaagattctggccgggcgcagtggctcactcctgtaatcccagcactttgggaggccaagacgggcggatcatggggtcaggagttcgagaccagcctgaccaacatggtgaaaccgtctctactaaaaatacaaaaattagccaggcgtggtggtgcgtgcctgtaattccagctactcgggaggctgaggcaggagaatcacttgaacccgggaggtggaggttgcagtgagccaagattgcgccactgcactctagcctgggtgacagagcgaaactctcatctccaaaataaataaataaagaaagattctaaggcttggatgtcttttagctatctttagcagaattagtgggaatatttaataaatttaggcttggagtcattttgaaattatctataagaataaatcttaatatgtagtaactcactttttttttttttttttttttgacacggagttttgctcttgttgcccaggctggagtgcagtgtcaatggtttcggctcactgcaacctccacctcctgggttcaagtgattctcctgcctcagcctccctaatagctgggatttcaggtgtgcgccaccatgcccgactaattttttgtatttttagtagaggtggggtttcaccatgttggccaggctgacctcaaactcctgacctcaggcgatccaccctccttggcctcccaaagtgttgtgattacagacatgagccactggcccagcagtaactcattcttatatagggatttgttctattaattgcatgacttaatacttctgtcagtttatcaatatgatatttaagatgttgcagaatctttcaaataatttgtctcttgtatttataattttatacaacaaatggaagatgttgggttttagagtttaatttttttctcagaatagaagtttgaaaacataaatacttatggtttagcaactgagattttgtgcctactgttaaattgataaactttgttcattcatagtgtctgccttttttcctttgggaagttctaattggattaaaataagatgactgtttagaaactagtagtttcaaattttcatgtgttgtatttaactcaactattaactcaattattattttattaggtggatactttaatactgataagccacaccccaggggtgaaattcttattgggggccaaagtgtgacaatggggtactacaaaaatgaagcaaaaacaaaagctgatttctttgaagatgaaaatggacaaaggtggctctgtactggggatattggagagtttgaacccgatggatgcttaaagattattggtaagtcatctaatatttttttgaaaatgaatgtttctgaaatagtttacacaagaagcacaatatatttagaggaggcgctgaataatataaatctttatgtaatcttagtttgggttgttgcatcactcctggaatataaaatattacggactgtggaatttatgaggcctgacatgttatgagttctcaaagatggttcagcagcagtggtattttaaattactcttagataaccttcagtcattgtttcctgcctgtgtttctgacatctagagattagtggatggagctctcacagtctgaactgcacccttgccttgccctgcccaggagaatagaggaaagccaggcagctcaagtactatgactcatatgggttgaaaaataccttattctgcttctccttttaggttctttttttttaaaagttaatggcatttcagttagccgtgtgtggtgtctttgtcgggcacctgtaatcccagctacttgggaggccgaggcaggagaatggcatgaacccgggaggcagagcttgcagcaagcggagatcgcgacactgcactccaacctgggcaacagagcaagactctgtctaaaaaaaaaaaaaaagttaatggcatttctatccctgtcttgctaactagaaacctgggaggagactcaagactgttctcttcagtcagcttcccatgcctattttatatcccactagtttattttatgagctatgtctcaaaatcatactcttctctctttgtctctcttacttgatcattggtcaggcctgtaccttctgccaccctctcccaataatttctctgttgccatgtttacccccttaaacacaccctctcactgccaccatgtaattactaaacatggatcttactggccacaaccatttaatgtctcctagaagctcagttcagggtgcccctgttaacattgttcccctcttcaccttcatcgtcagttgttttcctcctcctccttgatgcagctgaaattagagctgatgttcttctggcttttgccagtgttgttgcacctgacctctcacttttcccttaggactcggctcaagcagctgagcatagtgactcaggcctgtaatcccagctactcgggaggctgaggtgggagtatcacaggagcccaggaggccgtgattgtgccactgcactccagtatgagcaacagagtgagaccctgtctcaaaatctcaaaaccaaccaaccatccaaccctcagctcaggcctcacttgcaagaattttttccaaatccccaggttggagagtcttaacacttagcgctaccattgtagtaccaatgtattgaagtaatacgtttttgcattatgcatgtctccagataggttgtgaacttgcagatggcattgaatatcttcttcacctgcctggtactaatggataccagaaataaacctgttcagaagaacatacttgaagccctgctaatggagtccattaagtagaagttaattgtttttctttctttctttttttgagatgtagtcttgctctgtcgcccaggctggagtgcagtggcaccatctcagctcactgcaacctctgtctcctgggttcacgcaattctcctgcctcagcctcctgagtagctgggattacaggtgtgcaccaccacgcccagctagttttcgtatttttagtagagtcggggtttcaccatgttggccaggctggtctcgaactcctgacctcaagtgatgtgcccgcctcggcctcccgaagtgctgggattacagacatgagccactggacctggcctgtttttcttttaaaagcatgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccagcctgggcgacagagcgagactccgtctcaaaaaaaaaaaaaaaaaaaaaaaagcatgtatttagcagtacaaaaattagggcctaattttaatatgtgcttttaatttcagcataaccattaatgcttaattttgcaaagttttaaataatttgatagcaaattacttagagaatggccagtatttatatatgtattaaatgttactaatattattactcattgttttcccctctccacctttctttgttttgcagatcgtaaaaaggaccttgtaaaactacaggcaggggaatatgtttctcttgggaaagtagaggcagctttgaagaatcttccactagtagataacatttgtgcatatgcaaacaggtaagaacgtggaattcatactacttttacttaaaatatttgatgtccatagacatttcctacctgtatggaccttctttgtaaaaatgttccgagaactcttcctatctgttacttgtgggaatggcctccttctcattgcagccattagctgactcttttccttgtaaggcttcccctgatctttctctctgtccctgttttctgctttacgtctcactgcagtgtcccatggagggaggtgaagaaaataaaaccttccttcctgctgccttggtacccctacctacctgtccctcagcaggggaagcttcacagaactactccagaggaatggggagtaaagaagtggcagtgaggagtgtgctgcttacttactcctgctctacacttgagcctgctcggcactccaggcaggtcttggggctcctatgtaagctgtgttaagctgcagcctaaacacacagcctccccacctcatgatgatgaagaggcagctggggacctgtctacgacagttgacatgaattattatgggaaaataaaatctgttatcaggaaaactaatttagaaacagatgttgggggtacagcccaagttagaaatgaattgcatttatttataaatgattctggtctttagccatttagtattttctttagtgatgatacagatctggatttattcatgtgatagtaaccagaagcatcttcttcctgatgttactattttatggccttcaaaaaagtatttgccttcgttgggcatagtcagagttcctctatcaatacaaattctgatgataacaaaagaaaaaaaagaatatattcacatcattttgattcgttgctgaatttttaagatagtttttaatttatgttaaattttagttttttaaaacacatgctatgaaatactgatagggtttaaaggtgaatattctaatatttgtaactttcttttaaaatgtgtacatggcagtattcataacagtttttcatagttgaaattcatcatgaaatgtcagattgaagtttatttagcaacgaactctgccaaagcattggaaaatattatgaatcaaacagtaaaactggcggttgcatgaaatggatatgccagtgccaagtatggcacatgcattttaaaaaaaatgaggagttatttactacttgtcactgtaataataactgcagtcaacacagttcaccattttgttccttatctgttatcctttctatatttcagttatcattcttatgtcattggatttgttgtgccaaatcaaaaggaactaactgaactagctcgaaagaaaggacttaaagggacttgggaggagctgtgtaacagttgtgaaatggaaaatgaggtacttaaagtgctttccgaagctgctatttcaggtgagtattcggttaaactgatactaaaaactgagatgggaagagagtacttacatgcattcaacctgttttaaggtttagggttcattactttctgctcagaaaccatttctaccgttagtatatggaagagtaaacttatcagtcccccattcaagccttgctacacaaattaaccactcccaccaaactgatgtacatgtatcttgaatgttcttgtctctgcaacctttgctttctgggttaccctttctcttatgtcagctgttcttcaaggccttgctcagttttctggccacactagcccatagtgatcaggccaaaactccttttgaaactttatacaatgttagagtactggtagttggttgtactaatagtttcataaccatttttggtggggtgaggagtgcccaagactagtttaatattgttggtctaataaaaacatctgtgtcttttgagttgttgtgtcaagcataaaacaagcgtgaattattttttattttatttatttttttaagagacagggtctcttctgttgcccgaaccagaatgcagtggcagtcatagcttactgcagccttgaactcccaggctcaagcgattcttcccttcagcctcccaagtagccgggactaccagtgcatgccactatgcctagctaattaaaaaaaatttttttgttgttttgttttgttgttgagatgaggcctcactatgttggccaggccagtcttgaactcctaggctgcagcgatcctcccaacttagcttcctgagtacctgggactacaagcatgtgtcaccatgccaggctccagcatttactttttagtctcttcacatttcagtaatgtcagattccacacagtcttttaagtcagccctgtggtacatgccttattggttttgctcatagtgtatattcctttggaaaccactcctgaaatatttttaatctttgaagactgaaaccttgtgtattatttctatgtttacttttacaggttagagttaatacatctttttttactcccaaggcactttatgtctttaattttgcatatttctttcttttattgtagtaaaaatctcataacgttcaatttactatcttaacattttaagtgtacaattcagtaatgttaagtgtatttacattattgcacaactgatctttataactatttcatcttgcaaaacggagacactatacccattacactaattccccttccctctctcccccttccctccacctttttactttatgtttctaaaattttgattacttgaggtacttcatacatgtggaatcatacggtatttattcttttgtgactgtcttatttagtgtatcttcagggtttattcatattgtaccatgtgataggatttttcttttttaggttgcgtaatactccattgtatgtatattgcacattttctttatccattcatctgtgtttggacatttgggttgtttctaccttttgggtattgtgaataatgctgtgatgaacatagatgtgcaaatatggctttgagattctgctttgaattattttggatatatacccagaaatgagattgttagatcctatggcaattattaatactatatttaattttttcaggaaactccatactgtgttccttaatgactattgatttacattcccaccaacggtattaagggtttccatttctccacatcctcaccaacatttgtatatttttttctaatatccattctaacagatgtgaagtgatatctcattgtggttttgatttgcatttctctttttattagttatgttgggcatcttatatatacttgttggccatttacatatcttctgcagaaaattgtcgattcaagtcctttgcccattttaaaatcagaattctgcaccctccccccccaccccacccccgtagttaagttgtacaagtttcttacaaattctgaacatgtattagtctgttctcacactgctataaagacatacctgagactgggtaatttataaaggaaagaggtttaattgactcacagttctgcatggctcggggaggcctcagaaaacttactgtacatttgtggcagaaggggagagagggaagcaaagggacatcttacatggcggcaggcgagagagcaaatgaagagagagagagagaaagcgaagggggaagagcccctaaaaccatcagatcttgtgaggtctcactcaccatcacgagaacaacatggagaaaccgcacccatgatccagtcacctcccaccaggttccccccttgacatgtcgggattatggggaatataatttgagatgagatttgggtggggacccagaactaaaccttatcaggacattgcatttatttgtgtcttttaaaatttcttttagtaacattttgtagttttcagggtacaagtctttcacctccttggttaggtttattcctaagtatttcctcctttttgatgctacattaaatggtattgttttcttaatttctttttcagaacagttattgttagtgtatagacatgcaattgatttttcgtgttgattttttttatcctgcaactttgctggaatctttattagttatgaaggttgtgtgtgtgtctttagagtttcctacatataacttttctttttgatcttctgattgttctattcataaatgaaagtggagtattgaagtctcctactattattgtattgctttctatttcttcccctagttatgtcagtgtttgcttcatatatttagaaacactcaagttacgcgtatatttgtaattgttatatcatcctggagaattgactcttttatcattatattgtaattaatgtccttctttgtctattgtgacaatttttgtcttaaagtctgttttatttaagtatggccatcccctttaggttcttattttcatggaatatctatttccatccttcactttaggttacgcatgcccttggatctaatgtatgtttcttgtggatggcatatacttgagtcttgttttatattcagttggtcaatctgtatcttttaattgggcatttaatttacatttcaggtcattattgatatgaaagacttttcatacctatttccattttgttaactattttctgtatatcttgtagcttttcctctcttgctgccttcttttgttttgttgattttttgtgtgtataattacattctttgattcccttgtcttttatctttgtgtatgttctatagacattttctttgtggttgtcaatacagttacataaaacatcttaaaattattaacagtatattttagtttgatagcagcttaatcttccgtctcatataaaaacttgactcctttgtaactctgctcctccctcaaaaaagacctttttattgtgtagtcattaatatagattcataattactttttatgtctttgttttttaaattctatacagatttaaatgtgacttatacacctatatcaaattactttcagaattctgtatttgcctatgtatttacctttaccaaggagtattgtagtttcttatggttttgtgttactgtttgttttcattttgctttaacttgaagtactcctatcattattttttgtaggactggtctagtggtgataaaccccctctactgttgtttatcaaggagtcttaatttttcccttattttcgaaggacaggtttaggttacagtattcttggttgacaattttttttctttcagtattttgaatactactattttctaacctgccagttttctgctgataaatgatagttcaatgagagcttctttgtatgtgatgagtcatttttctcttgctgctttcaagattttttgtgacttttgacagcttgattacgagtgtgttttggtgtagttctcttcctagtggagtgttttgagctgcttgaatttatactcccatttctcttctcagatacaggaaggttttggccatgatttcttcaaataggctttctgctcctttctgtcttctttttctgaactcctataatgagcatttttccacttgatggtgtcccattcattccttaggttctcttcatttttacatttttcctctcttagtaatttcagaagtcctgtcttggagttcatagattcttttttctacctggtcaagttgctgtcgatcctctagtgaatttttcaatccatttattgtatttggttccagaatttctatttggttcttcattttaaaaaaatttctttcatttatactttcattttgttcatgcgttgttttcttgttttttttcaggtgtctgtctgtactctcttgtaattcattgagcattcttatgacggttattttgaatttggtaattcatctatttccatgtctttctggggtttatttctggagatttaatttgatcttttgatagcctgtgtttttctatttctttgtatgtctttatttttgttgggatgtcagcatttgaaaaatcagctacctttctctgtcttacagtctgcttttgtattgagaggactttgtccagtcagccctactacggattctagagccagccatcttaagccttttccgaggctgtgtcctttttgagtttgtggggtacaatctaattgaagaggtttgctggtttctactcaggagctccctctggtgtctgtctgtgatattgtggcctcactggtgctgtagttggccatggtactggagctctacctagtgtctgtgatactgcagcctctggttcatgttaatctttgttcttgacagctcccaacctggtgccctgttcctgttatttagattcaggaaagacagaagcaagtttcttgcaccccagaagtcagaatattggatgtgtgttccactcctcttagggatttcttccctattactttgtactgtgctgaggggagggtctctggcaagcgaatgccttgcatttttctaccagcctttgatgcggttggtttccttctgtcccggagtgtaggaacttcttaagtggtttctgggtttcttacacaggcaataaataggcccatatagcattgttaaatccatgtttctgtaggggaaggagggactgcgttttcctatattgtcatcttgctgacatcactccttaacacatttctttcatgtatcatatggctagctgtttacccatttccctttgttagattgcatgctacttgaaagcagaaacttgtcatttttttgcatttttaaaagaatgtttagtaaagcactttacatgtagtaatagttttttaatatttgttgaacaaatgcttagaaaaataagtcagtcctactgacgacatacggtttttcaaaactacatctgccccttaatctcctttaaatgttttcctttcttcccttcctttctcccttcatttgctgctatcatgaatctccttagtattaggcaatatgttagtaacacaatagtgagcaagcattctgtatccacatagcttgtagggaatatcctggttcaatgacataatttgtcttaaactttattattttttaatttctgaagtaaatgtgctctgcataataaattcaaggaaaacaaataggcataaaggaaaaggtgaatttccccatttcctttctcctggataccaggctctagaggtgtggagtttatagcttggtatgtatccttctcctcacatctaggtgcatataagtttatgcagcctgtgctggaacttgtcttttttttttttttttttaacctaacaataggcatttatgcagcatataatgaagtttcagtcagtgacagacacagactgcatatatgacagtggtcacgtaagattataatgtatttttactgccttttctatgtttagatacacttaaatacacaaatacttaactattgtgttacaattacctatggtattcagtacaataacgtgctgtgcgggtgtgtagcctaggagccgtaggctagataatgcagcctagatgtatatatagtaggctataccatcgacattcgtgtaagatatgctatgatgttcccatgatggcaaaactgccaagtgtgtgatgcatttctcagaacatatccctgtcattaagagatgcgtgactatattggataccctattagatacctgtctaaatgtaattttttttttttttaaatgagatggggtttcgctctgttgcccaggctggagtgcagtagcacgatcatagctcactgcatcttcagatctcctgggctcaagtcatcctcccacctcagcctcctgagtaactggtactacaagcgtatgccactatacccagcttatattttttatttctattaaaaaatatttttaagttacttattttagagacaaggtctcgctatgttaccgaggctggccttgaattcctggcctcaagcgatcctcctgcctgagctttcagagttactgggattacaggcatgagccatcatgcctggctctaactcgttttcaatgacagaatatatattctattttgttcctatatcatattttatttaactcattttcctcttgatggggacttgttaaatagtttattgttttacttatgtttgtattttgaggaatagattctttagaagtgacattcatggttcacttgttggttgtgcattttgatggatacgcaaaaagtggggaagttacaccatttgctaagaacttaaataccttttcttcttttctttttttttaatcatcttagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgagcgaatgtatggaagaaaataattattctcttctggcatcagtttgctacagtgagctcagatcaaataggaaaatacttgaaatgcatgtctcaagctgcaaggcaaactccattcctcatattaaactattacttctcatgacgtcaccatttttaactgacaggattagtaaaacattaagacagcaaacttgtgtctgtctcttctttcattttccccgccaccaacttactttaccacctatgactgtacttgtcagtatgagaatttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaatacaagggtattgatatgaaattatgtaaatttcaaatgcttatgaatcaaatcattgttgaacaaaagatttgttgctgtgtaattattgtcttgtatgcatttgagagaaataaatatacccatacttatgttttaagaagttgagatcttgtgaatatatgcctgtcagtgtcttctttatatatttattttttattagaaaaaatgaagtttggttggtgatgcatgaaacaaaatagcaagagagggttatagtttaatagtaagggagataacacagcatgtgtagcaccagttgataattggtctctagtagcttactgtcaaaatgttcaatgaagtcttctgttcatctgttgaaactaggaaaatacccaaacttaaatggaagaattctgaaagagaggatagaatttaaagaacaagagtatataaagttattctttgaatatttcgttgactatatgtacattgagttatctatatttgtaaacaaattagtcatggaaaattattctatctcaaagtctccttttagtctagataatcattatttcattttaaaattagtgtttttcctagtttgcactgatgcgtgtatggatgtgtgtgagtcagtggtagcttatttaaaaagcaccttatcctttctcccataacctttgtacactaaaaaatgaaagaatttagaatgtatttgatgatagcattctcactaagacacatgagaatttaactttataaccgcgtgagttaagatttaattcataggttttgatgtcattgttgaagttatttgtaattcagaaaccttgcttgtgtgatacatagtctcttcatttattactgcttgtctgttgttatatctggattatcaaaagcaatagtgcaccaattaagatgtgctcaaatcaggacttaaatcataggcaccacatttttcatgtcagactagttactttgttgattctcagttactgtaggcatcaaaaggcaaaaatcaaaaaaaaaaaaaacaaaaacaaaaaaaaagatgaacctaggtctgtgtaaagtaaggggagtgttaggagcagccaggactgtgtagtgtgtgtttggttgcatcacaaacatcgtatgtggagacattgcaatacagtgttttttgttttcaacttttcttgtattgtatatttgtattatgttttgaatgcttttctcttttcataattaaatattaatgtttgggataactgccaagaagaagtaaaaatattgaatggaacttctatatgaggatgctgtgatctaaaaattaaatctcagtgggcggag

SEQ ID NO: 35947 - DNA, 82387 bp, Homo sapiens; identical to SEQ ID NO: 35946

SEQ ID NO: 35948 - DNA, 35316 bp, Homo sapiens
gtattttaggcgccattttcgagtgaaggacccggagccgaaacaccggtaggagcggggaggtgggtactacacaaccgtctccagccttggtctgagtggactgtcctgcaggtaaagtacttctcttcctggtcaggttgtcacgctcttacttcctgccttgtccgcgagcgcctggaaaatagaggccttgagcccgagcggcgaagtccgggcttgaagctgccgctgggagatttctcttgctgtcacccctcccccctcggccgctccccggcggcccgggctcccgcgcgcagctcccgggcgccacttttccaagctactcaaatgtctcggggaggccctgagcctcgcagatcttttctttaaaaaatcctagtctctatctggaaaagggcgtctccccctacccctcttccttctgccaacggactagtcaccgggtctcagccttcgctggtgacctttcatggtttactgtccaacgggactccgcctggggagctggagagacaaactcttgccactccaaaattagcaagcgctgccagcgtccgacttgaagttgctagtggttagtcccagccttcgcccttcgcggtccgaccgctgagaggagggagacttcgttatgccccgggccgtcaacggcgccaggagctaaagggcgggcagacgaaagcgggcggcgagtcgccagttagtcttcaccgctctggagagagttgctagccacgggatcctgacccggacacgaactcgtttctccacgtcggtgcgcgcttgcatccctggccccgaaagcgtgggaatgtccggaaatgctggcgtatgggagttccttaattagaaatgcgttagcgaatattatacgcttatactatgggcggacgggtggagagccttaaaaacaacaacaacaaactaagcagttgctcaatcgttgattgatcctcaggcacgtctagattttcccacttacataggtcttgttaagaaaccagtcctgccttcttgccactcgtgtctttcgatggctcccttcccgaagtcccgctgcctctaagcggagtgttaagcggggctctcggaagccggtggaccgagatttccccgggtggggcgggcgcggtgtagcggcccgcgggctgacttgctcccggctgtcccccggccccagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcaggtgagtgacccgccgcgactcggcgggaacgcgcgctgtgggactggcaggcaaacgcgcccagcccgaggctggctggggttgttgagcgcggagttgacatctgaaggtccggtgtcggtccggtagaggctcaggaaagccatttggcaactttgagataggattcccgtgcaattttggtgtaacggcgctggaagggatgggggcgagcaaacgggttcagttgtgaatttttgtttgtgacctgtggaatggtacaggtcacaaacaaaaattcaatatctttattgtattcccgctaaaatcgagacggtcaatcaagagagcaagtggacttttttcccagagacaatcaatatgactatgtgagcatgatgaaaagttttttgaccctaacctcacctccgtggtgttagattgccgttaaagagaagacgataatttatttgaagccactgtagcttttgtgagtccaggagttgggtgacattattaaaccctcgtggcagtgtcgctgaagttcatgagtttccaaaatgaaggttccaggtgctcagcggtacggagaattgcatctagagccttaggatttaacctcctgtttaggataggcagcaggaaatagcttgttacggttttcccagatttgctctatgatgtagtgttttgactcttaagaggtataggtgtatagaattttgtgaccggtggcatttctttcaagaatttcttttttagtaaaaccaagctgaaggtttagtcacccccgtgagtttaagataataacatatttaagtggaaaatatagactcctaagtttcataaataacatccctccatcccctactttaaagatgggcagtcattagttctccgaactaattgcactaatgtaggcttttcccccgccgtttgccttcgttttcctttcctttcactgacttagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataaggtatttgtatggaaataactattttataactttttaaataactattgtaaggtaatacgtttttacaagatgtttcagttttgtaactatcctaaaattcattcactccctatttatcctgatagtctttctgtctctctctctcacacacacacacacacgtttcatatgattttaacactgaaattatcttttgtttatctggttatctttggtacctctagttacaaagttttccattgaatggagtcggtgtgtgtttctgtttgaaagagtattttcccttggataatttttttttcttaaagccttctatggaacccttagataatttaactataaaatgagttttctaaaacgtctgcgttagaattggagcattcttattgaatgttgaagcttttaagagagaacttgatgtaagaaaactcaagtcgtatgcctgtgattagcaatgagaacttttaaatacttgcagtttttaactgcaagtaaaaaaatctaacagtttcagttaaaatcagtagtattagcatgaccttatgaacttttccgtgttttgtttttgtttttttaatgcagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggtaagggatttttactgttattggcaagttcaagtaaggaaaatggacttaaatgcattacatattttatttttggctttaagaaatttgtatgtaattacagcggaaagcattggtttcattatctctgaccgtattttattttgggggagtggtggtgcctgttaaaatacttattttttagctaaagaaatgaagtataaatagttcatagtaatcctttttggaataaaagcattgagcagttttagggtcctgagtactaaataggcattattttactataaatattcagttcatttttaaagttatattttgattgctttagaataaattagctaaacttgaaaatgtagcagttagccggttttaccatcttcattatttcagtgcattttaactctaatgttagtggcccctgagtatctgtgatatgaaagagctttgcttcagtttgactactgctgtaattaagtcctttagaaatgggggaaggacaagctaatgtttgttttctagaaatggagacaactagaggtaaaatgtctagattatttacctgttgagactttttctcttctgtttaataatgtaggaaattgattgttcaaaaatgactcgatggaacctaaaaatatagaaaactaattacataatgaaattgggaggtgatttgtcttttgaattcgttttcctttttttaatacaaagtgctttaattacacagaatcatctattttaatttggtttcttttgtgctttctattgtacaagttgggttggaaaatagattgccaggaaatcagattttattccattgcatattaattacatttgatttatctaaattttagaagcctttgcttcagtatgacagaacttttaaggttaagggaaagtgttaaagtagatttgcaattgatttttttaaaaatctgtttaaaagaaaatcaagggaatttagttgttatttctttgtgattctttttactttaaattaacggcacactctttaccctcccacacaaaaaaactaaagtgtatcacccggttactaccttccttcctttttctttgaatcatcattttaaaaagctgcagctttttaatctgtcaacatgttaataatttgtgtgggttttggatatggtgggaatcttgtctacgtcttctcaatcataaacgtttttaggcttgtttggaggtgggttttttcgttggctggttggtttggcttcttgatttttgtgatctttgagaaagggaccaaaacagcatggaaaagtatcaattctttgctaagttgggttattaatgagaactactggcagtttgtgtgcatgttcaattgaagtttttaatccatagaattagtttcagtatgaaatgagtgaattttgaagtaggcctatgacttaataccaacaattgttttctggttttgtttttcctcaaaacaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacaggtaagtttattaaagacttcaaagattctcttattcttgttacttttttttctataaagctaggttggatgaatcctacatttttgaggccttaaagtactgtagcagcacatcatggtttacatgctacagtcaagatgcgaatcattatttgctgctctagaaatttaaggaaattcattcaaaactatgttttcatcatcagatgttcgttttatgtttggatgaactgacatacttgttccactctagcagcacgtaaatattggcgtagtgaaatatatattaaacaccaatattactgtgctgctttagtgtgacagggatacagcaactattttatcaattgtttgtatttccctttaaggtaacattttaaatgaaatgtattatattttaatctatccttttcctttgtttttgttcttattatctcttctgatatataaccaaaaaatgaaaaaatctgtacacttggtgtttgatttacctaagcacctagttaatttaatctttgtaacactttggatggttaacttaacctttactcaagttggtttttgttttgttgaaaatgacttacttggtggaaccactactactgaaagaacgaaactttgatattacattgttaagtatcagagctgttacagagcaagtccttttaaagagatgtaaaaattaagtacctgtgccaaactgatttttattagaaaccctgttttctttaagtaaaagtatattctaccagcatggcttggtaagaaaaatcccctatctttttttccctgtcctcaaaattcagaatttttcggaaaaaaaaaaaattagggtaaaaccatggctttgtcaagttcctgtttgattcgagggtatcttcttttcctgtgttctatccagaatcaccgaagcataataaaagcaaaactattttgtgatgcagaaatgactgaaataagtagggaattttgttagggtgactggatgttcctaataacaaacttataaaatgttagcctctgtttccattttagtctttattcttcaattgtttctaaaaattattacttttagacattcatagtatacaaggtaaatcagtatcattctaggataaccttttttaatatcttttgttaccaggcacagtatatttgcaatacttcaacctaaacttatttaaaaattaatgttgaggaaattaattgcagatatatttctaaacaagattggaatttatagaatgtggcattaaaggattttgtgtgtttttaaaatcaaattgaactgttttattgacttacatattctgggacttggtttggttaataatggataaaaagttatgtccctatataatactaaatttgatgatgataccaatttgcaggaaattgtacttatgtttatcttttgcttaatcttttaccgtcatcctgggataatcaaagttttacatttatccaaagattcatcaaaatacactgcattttaacccttctaaggataatttttttctctgtacagcatctctgtacgtaattcagtaataaaggaagctaatgtaatattgtcccaacgaagtaaataatttataaattgtcaaatttatattacatttgtgcttctgaagtatatgggatgctaaagccaatttgttcacatgataatctgaacctttttatgtgatctttacaattgtttaaaaaacatttcttcccaaataatacaaaggtgaatgttccaagttaacagattcagtttgactcaattaaatttatagataaggaccttaggaactcacttgttaggaataagaaacagggattggactacggtagaactaatagtgcccaattaaaactttgagggaaagtgacaatggtttctatggattgttttttttaagtcgcttatgaaaatctcagactcctaactggcaatttaaagcatttgatggtaagtaaaaatgtgatttttattaccttctctcctactgaataacatctatcttaaaaactgatttgggaggctgagaaattggaaacagcatcgtagtatcaacatccaagacctaaatcattacttggaataaaacatgtagactatttggccagtaatagtgattaacagcaaaagtaatctaaatttagtaaaaataaacatttatttttgagattaaaaagaaccaaattttttagaagttcctaagagtaaaatttttcagtgttaatatattcgcttagcaaatttttcaagtaggcatttttattacttaaatccattaaaaatttcattaattggccattcaattgaattcctattaaggcactatgctaaaatgctgtaagtaatattaagatggctaaaccttatttcttgtccttaaagacacatacatgccttcaaaaagtttgttgtgattgaccattgtgttttttataatcgtacattttcttttatatatacctactttgggagcctcggtcccgttgtaagtctgtacaagtagagttttattagctctgtataacatttcttgggtaactatgacttataaattaggggtgcttttgctccattcaggggtagaagaatggttaatgtttttactaaaaagttgtattaatgattgctgcctcaggaatatttttgtaaactcctcaaaagctacaactattagcacaactttaattttgtcaaagttttcaacttcatatgcttttgtcttcatattacaaaatctaaagtttgaaacacgaaccaggctgggtgcattagctcacgcctataatcccagcactttggaaggctgaggcaggcagatcacttgagcccaggagttggagaccagcctaggcaacatggtgaaactatgtctctatagaaaatacaaaaattagctgggcatggtgacacacccctatagtcccacctactcaggaggctgaggtgggaggactgcttaaacccaggaggcagaggttgcagtgagccaacatcgtaccactgcactccagcctgggtgacagaccttgtctctaaataaataaataatagccaagttcttttttttttttttaattattttgtaatttggagatttaattaacctaggtctgagttgttgcctagccatctgttcttttttccaatgtacttctcttaagcttgtcacataaactacttgggttctagtctcttagtctgtagaaatgagcctatgctataatatcaaaagaaatttttagttttttcagtaatgcctcagttttccaaaggtgtctgattcaatatccacaactagggtgaaggtggtggagagcagcaaggaagctacctctaaccaaccagaaatagatatcaagaagtccagctactaacaagttactctttctgttttattttagaaagatactaaccttggtggtttagttccttggcctctggtagcttacaaagatcaaattagagtaaaatgtattggaggaagataaagaacactaatttatagtatagtataataaaagatatagaaaataaaaagatgatcaagataaaaacttaaacctcagtaattttaggccatttaatttttatgcaaacactcatatttgctgtaagaatcactgaaaccctccttcatagtaattacaagtaaaaataaagagaagaataattgaggccttactaggacaacaaaactttgttatagctatgtactgtttgagttttctgtagttgatgcttgctaaaatttggattacatttgaataaggataaagggcatcatacctattcattcctcttagatttctaagctgtatttcagtaaattgattctcaaagagtggtataactggatcataatatccttgtttgccactcaagaaagtgttccataacttaagataacagtggtgggaaaaatcatttaagaccttgtttcatatgctttaagatacaagaaatagagataacactgggaacatatgaaactttgtcagcatcagataatagtgttgtagcgacttgaaacattttttgtctgtgattgtgccagtcactatttgtgacttggattgaaccttgatatgactttaaattcaggttgatgttttaaaattatttctgaaatatattgagcttattgccctaaattaaaactatattctgtaattttacatgagttatgtaagttttctgaagaaataaggaggaatcctttaggcacagactgtcaatctacagattacataggagatggcacaaatggaaaaagaaggaagaaaggaaatggtagcaagtggtagggcaggcaaaggacatcaaagaacagagcaacaagaaaagtcccaggttgtcattgtaataccacagtagtcttaatagtcaaaggacaagtaaaggcctgttaatagcctgttgattcaataatgctaatctgataatatggtaactggtttaaaaaaaagcaatacggtataataatcttaagactgctgtaatcccagcactttgggaggcccagacgggcggatcacgaggtcaggagatcgagaccatcctggctaacacggtgaaaccccgtctctactaaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaagactgaatgttatacaggagttgagatgtaactattttgctttgtaaatatcctgcctttaaaaaaaaaaatgctcaactctattagaggaaatcatagctgtatctttcattttatttggagagagaggaacaaacaaccaaaaatgagcaaccattgttatttacccaaagctaagctgtttcttaatagctgtactctatctcttcagtaagtaatttgccaggagaaatacaatgtttttaaggaatatttttgtcagcgtaaactgttaaacactgaatcccaacttttagctatctgaaaaatgtatacttaaataatacattatggccatttgactcaaatgtaagttcttttgggatggtttttcattttcttaaaataagtgttcagatattctccttgaattgggtagaatattaattgtcagatattgttttttatttggatgataaacactaacccacaggatttaaactacaacttctagactaggcatggtgggtcatgcccttaatcccagcattttgggaggctgaggcaaaaggatcgcttgagcccaggagttcgagaccagcctgggcaacatagagggaccaccatgtgtacaaaaaaaatttttttttaaagattagctgggtgtggtggtgtgcatctgtagtcccggctacttgggacactgaggtgggcggatcgcttgagtctgaaaggtcaaggctgcagtgagctgagaccacaccactgtactccagcttaggtgacagaacaagaccctgtctcaaaaaaataataaatgagtgaacaaacaaactgcagcctctagatcagtagttctcagctgacagtaattctgccccttttcccataggacattcagtaacgtctgaagacagtttcggttgttatagctggtagaagtggggatgctactggtgtctagtgggtgaaggtcagaaatgctattaaagcatcttataatgcccagcatagctctccacaacaaagaatatccagcccaaaatgtcagtagtgccactgttgataaaccctacgtagatacaaacttgaataagactcttggcttcctcagtgacttaacgttcatcctgtgtaatccaaaggtttgggcatttttccaggcttcaatcctgtctaaaacttaaactcttgctgcaaacatttagagagaactaacagttgaaagcagaataaaatactttatataaatatctacatattttcacttatataccgattcatacataatataatgaatgttatggaaaataacttttggggtaacagttttactttgataatcattgtgcttatagactgtcagaagtatcgaaaagtgatttatgcaaataaaattatttcttaatgagtagattttcaaataagctgttttgtccactgttattgaattgtttactttttgtaattatgttgaggcttttggtgaattatgatgctctcattagtaagttttaccccacatttttaaggttcacctgtattcacttaggaaataggaatcactaagatatttgaattaagaaaacaatatactatttttaatgtgtaattctttttgttgacttttttcgtctttgctattttgttgaaaataagaggtatatcttttttcatttgcctgtacctattcttccattgtaatagtctagagtacaaacaagctactcctataacgtagcagcatttggcctgaacatactcagacacaattttctctccaccatcaaactaaatgactgcctagcagtcagccttgatggttacttattatggattttttttctctttactcttcataattaaactgcataaatgcaaatatgtaaagttaatctaagattttaattacagttcaaagttgttatattagtgattacaaactgaaagttttctgatgtcttatgtaccagtgccattagttttctctagtcaaggtggtctgtttgatttctgttattaccatgagaaataggtaatatccttttctgtcaaaggctcttgtttttagaaaactgaacatgtaagtttttgactacctttgaaacccattacttgttaaggaactcctaaaaaccatgtttgtagagaaagttggtaatactactttgggacagggttcctaacacagtttaaccatgcaagtgtttttgaaaattctttgttttagaacaggagcttcaattgtgttattaacaattgataatgtttccactataatcagattgcagattaagtgaaagctttcctaaattttacttaaagaaacaagttttatttatttatattgaacattctagttggggaaatgagtgtgtgtaagtgggtgtatattacacttttataaggatttatctaagggaatataaattcatgtttcatatctccctgtgtaaaattaaaactcttaggaataccagtgaaaataacatttttatttataccttattaaatcattgcactactaactgtacattatttagatgtttattactcttggctttattatttaactgctcccaattctcacttaagattgatttagctaaacatacacagtgagtatgaaatataacttttttttaaagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaaggtgaatcatctgtagactttcattgtaaatcagaatgtttcatttatgatctaacaaattttagtaagtcagatattcatgttataatacttaatgaagaagtgttatattgaaatttatatcttaacatttaagatgaacattctccttattaactgtttttatctaatgtttgcatattttaagttcatattgtacatatgaagtgtgtattcagtctttaaacttttaatttctgtagttaaacagggtaaagatggtggaaaaggaaaaggatgccttagaaggagagaaaaacatagctatcgaatttcttaccttggaaaatgaaatatttagaaaaaagaatcatgtttgtcaatattatatgtaagtgccttgattgatattaccaatttttatattagtttttaaccattaagtcaaagcccttctcttttcctagagaaacatgaagactgaagtgaaaaaaaatctctaaatattgttttgtgtgactgaatgtgttagctcatgcctgtaattccagcactttgggaggctaaggcaggaggatcacttgaggctgggagttcaagaccagcctgggcaacatagcaagaccccatctctacaaaaaaaggaattatgtggtgaacttatccaatgtgaggactatctggctgtgacacctgtcatcccgttgatcaccagggttgaatttattaaattaggcatattaattcattgaagttgactttttagtatcctgctttaagttgggaggtaggttcacaggtatttattactgtactcagtccttttacgtgtgcactttttaaaattcgtgtaatagcagatctgatttttttcagcttatgatgaactgttttttgagatgggctgtttcacccagggtggagtgcagtgtgtgatcacggctcactgcaatctcaaccttccggactcagttgatcctcccacctccacttcatgagtagctgggactacagggcacacaccaacacacctggctaattattattattattattgttgctgggatttttttgtttttattttttcttttttctttttttggtagagatggggtttcgccatgttgcccaagctggtctcaaacttctgagttcaggcagtctgcctgcctcagcctcctaaagtgctgggattacaggcgtcggccaccacattggtacaatgaaatcgatttttgttcctaaattctagccttgacccagggggattttcccctcatagcctaggcagtcatatattgactagttaataatattttagaaacagttagttttactaaaattgttatacagttttggaaatggcattttaggagcttcaatttctttttttttttttcctccctatagttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagtaataatattttgggaagtactaaaagtatttagataattgtattacatgtgtatttatatataaagttacttctagcacattgtgagtgtaagacatttgccagcatatcaagtggtggcccccttagtgaaaaaaaaaaacttgccttgcatccagttccttgttacagatgaaattccctactctgaagtcttagaaccgtggggatgctaccccctagtggcgtagcacagtaacaaacaataagcatttggcttcacagtttaatcttttagtagtccacaaatctgatagagggataggatttgggtttttctagatagatttttaagggttttatcatgtccctacttgatgccatttttcaatgacactagtatctctaattatttttaaataaaaaaatttgtatagtaagtttattgtatagtaacttgtaagtatattcgtaaaaggtaaaaccaaaattttactcctatggtaaaatttttatatacctagacattgtagtcactggaaaatgtgttattttccctccaacttagaaaggcaaaatagctgtcataatcaaaaatacaggtgcttcttcaactatggggagagggatcatcttggaataaggagagttttaggatcctgccttattaagagcctggacatatttatagaggaagtgttccaggtaggaaatgtggttttaaaatatgtgcacattcaaaataatgacttacaatatacttgctttgctaggaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggtaggtgttagaaaaaaattcttaaaatttcacgtctgaatatcatacctagttttcatggatgtgtttgccccttattgcctaagagaatgaattagtattctaaatgttgttttaaggtttgtctctgaacatgattttaccccctcaagggaaaccttgcttctactgactttattttgcaggaggttttttgtttggttttggaattttgcagagatggggtctcagtctgttgtccaggctagcgtgcagtggtatgattatagtcttgaactcctgggcttaagaaacctacctcagcctcccaaagtaacgtggactacaggtgtgagccattgctcctagcttgactttgagttttaaagtttatattacaataatatgttattgggaaaacatttaccaaatcaggagttccattttggtgttaattttaattttctttttcctaaagtagtagtttttaaagatatttaagttaggtattacagacttaaaaatattgcctgtcttctacaaaaactaagctaacaggatcagagcaggatttcccaagaattaccaatgttggccaggcacaatggcttacacctgtattcccagtgctttgggcggccaaagttggagaattgcttgatgccaggagtttaagaccagcctgggcaacatagtaagatcccatctctacagaaaatccaaaattagccaggctcagtggaacttgcctaaaagtcctagctagtcaggagagtgaggcggcaggatgccttgagttcaagattccagtgaatagtgatcaagccactgcatccagcctgggtgacaaagtgagactctgtgtcttaaagagagataggaaagctcataatttggaatctcttaagctgtgttcatgttcatagctctgtcatatttaaacagatatgataccttaaccccagccccgcaaaaaaaaagctttgttccatatggttacacaataattatagattaggctctactttacgctataagcattttctaaatgtatttgttcacaaaatactttctgcttagcacagctgataaatacgttgagtcagtgtttaaggaagtggcattttgggaaatgttgaacttcacaggtactagataatcagagtaaacaaaataacaaggctttgggggtaaccccaaagacttgacagacttagctaagtgtaactgttacagagtgattagcctttaggcatagactgcatggataagtgattattatcagaagatgttaatggagtaaaatattagccctacatgatgactctggaagagtaaagttgtgaaagattttagggttggggagatggtaaagataatttgtggtaagttatgatataccaggaaggatagtttagaaaattccgtgtagtcagagcatatttatagctaaagaagaataattacaacctgaaatcaggagagaaggatgacagacctgaggccctgccagagacagttttccttcataagaggtcaggtgtttgtagaagtagttttactattagattgagagaatatagaaattacagtgaatagtcgggaaaatacttgttaaagctagctaatttaactctgattataaagaaaagaagaactagaggaccctgagaaatgcctttaaatatgtcaaatattgatagtattgggtaacataaagatgtatgctcctataacttgttttataatctcaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaagtaagttttttttttttatcagtgtttattttggtggcttttttttttttaacttaaagattattttttcaaaaatactgaaacctgaactggtaagtttggacttttaatgtccaacattcctaaaactagtcaacctagacttagatgactattcttttaattcctgctgacatgttttttaaaaagtttactaaatgagagtttgtagtagtagcagaaggtgtgatgtcaaatacagtaccttgattattatatatgccactcctaagcgtgttgaatcatcatattttgttgccacctgtaaaacctggagccacactaagcgcaggttaatgtctcttttgtttttgcttctatagctcttgtgtaatagttaaaagctgtggctcttgtttcagttcttggttcaaatcctaggtcaatcacttactgtctctgttcttgtgccggttgtcatatctccaagtcatcttccttaaaatgagaaagaatatatctactttgtgaaaataaagaataaatatatctatataacgtactgagaaagaaaataaatgttagctataattttagcattatattaataaaacgagagcatgaagttgtcacattgatatgtattatctaccccaacaagagtaagcataaaattatctttgtttgtatgtaccacagcatttttgacagtgctaagcatgttaaatacctatgttaatggataatggtaattgactgcattaaaaagtcatggtagagtctgctttggcatatcaacatgttctaatgtcaaactataaaacttaacaggttagaatacctgtgtgatgaagtgtcacttaatagagtctgctttggaatatggacatgttctaatgtcagattataaaactttacaggttagaatacctgtgtgataaagtgtcaatggataatgcagtagctttcatgatgggatacttcatagttagtggattttcactgtttgcttatttaatatatattgagtactcatgtgccctgcaccccatgttaatgacaaagctaggcctcaaatgtctttattcctcagcgtaatgatcgatctcacaaagctcttgtgaaatcagttgggaaaagactatgtacagtgaatattgacaactaggcaaaaactgaatctagtccacttgtgagaatttcttatttctatatactgtgcttatagaatctcctttcttaaatcgaatataaaatgtatggtttcatttcagtgtaggtttgaaagtaaatatctgtccagatttaatgaactcatattttaacagagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggaggtaaatctttgcttctctgttgcatcagaacatcattcgtccacttcagctttatacatttttgtttttaatctccgcgtcagaggtgactagtgataaattttcttcattttgtataatctcaaaagaatgaggtcagcatttcagtattccatatgtgaactgagactatcaagaaactatattatccccagaagcaccatatagtaagtaaatcaccaccaccaccccactgtagaaataatttaaacaaaagaaagtttgtgtttctttaaatcttaagtatagacaatttaaagataaataaaaaacaagtgtatatgtatttatataatgaatatacaaacaactatcttaatgtgttttgggttttgaatttatggatgtagtttctttgcttgcattccaaaatgttataaactaactaagatgtatagcttatcggtgcctgtcccccatccttgagtgaattagatgtctaaggaatttcgtaaactttaatctccaaagatctccaaaacctcagtaggcaaggtggcaataaaaaaaaaatctgtttgaagtgtaattatactgaaaataaatatgagtctttttcattttagttaatgcatgctatttggtcatcagggaatttcatgaccaggtagaatttaaatgtaaattaagttagatccagtgactgcttctgtcttcctgggattcggtttcttttgggatgaattatgtcagtaacttggtttaaactttatgccagtacagtaagtaatagacataatttaaatctagtggatggaggaatataccagttagaaaagatggctgctgagaagttggagattgagaaacagaggttgtgtttatgtgtgcatgtttgtggttcctttcttgttgggagcctggcatttttgtatagcaataggactatccagtcatctttcgtttcagaggtgtgctttttctccagtaccccccagccccgttcagctaaaataaagcacagcataaccgtagtcctgcccagtcattttctgggtcagcttttcattagggcagagctgaagaattagggcacacttatgtataactatgtagtatcaaactgggatttccacagccccagctatacttctctatcaggatgaactgtttgctcctgaaaaaaatattacacctaatgttttcttttattgacccaagtaatttatgccccttttaaacccatccatattttccacaaccaaaccagcaattgccatacaggtgctcagttttggttcaaatttttattgttggtctttctttctttattgttattaaagcattacaactaattcagtgctatgactggtcatatttagaagttaatgcttctggatttcattttattttcacttttagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattggtaaagtagatttttggggggcatggctttactttttttttttaagaaagtgtaacttatttttttgccttgacaaccatatttcaagtgtcactgtatataaaataagattcattttgtttgttttaaggcacatttatttttaaacattttgcccttacagtttcttgtttacttagctttagataaatacaattatttcatacatatcaagaaaaatactagtaatgtcacacaaacttaaaaccattttatccttttttttaaaagagagactttagccaggcacaatggtgtgtgcctgtagtcccagctgttggagaggcagaggcagaaggatcacttgagcctaggagttcaagtccatcctgggcaatatagcaagactgttttttaaaaaatgaaaattaaaaaaaatttttttatatatttggggtttcacaccattttacttaggtttgggctagcatttaaggatataacaagggataatctaaaaatccaaggctagcaatagtgaggaccattactgcttcttagcttcgagggaagggagttgtggtccagaggagatggggaaaatggataccttaaccccacctatttcctgccctccagtcttagctgaaacctcaaattggctgaaggtggagagtcaaaggagccagttgatgcagtccttaagtcagcctttcggagaagggaacaaattgatgtaaaaattacccaacatgattgcttctgcatcttgtatcgggacttccaccttattttcttaaagataaacagtttgatcctattcatttgctctcaaagaaagcccaaaccagtgaatactgctagatagttgtgtaatagataaacagataaatgtgtttcatcaggatttacataattttagatgcttttcaataattcaaagttttctgagttttgcttatagttcatttaggttttaagcttcatgttgttttcataaaatgaaaacagttctttcattttgtgctcattagaaattcaagctgcatattcataaacttatacatattttgtattttgttgtgtacccttttgttctctttaaaaccatgtctacataaagtttttcaattaaaagaagtttttaaaacttgatgaatgaaatggtcctgtgcttttctgcctaactcttttttcaccccactcttcattattagggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataaggtgggtattcgtaataacctacctataattggaattttttttttttgagacgtagtctcgctctgtcacccaggctggagtgcagtggcatgatcttggctcactgcaagctccgcctcccgggttcacaccattctcctgcctcagcctcccgagtatctggtactacaggtgcccgccaccacacccagctaatttttttgtattttcagtagagaggggtttcactgtgttagccaggatggtctggatctcctgaccttgtgatccgcccacctcggcctcccagagtgctgggattacaggcgtgagccaccacacccagccctataattgaatttttaagtgctaagtgtgtttttctttttggattcaggctttttcttaatggttactcagtgaacacctgatgggttttgacgattattttatgttctggggttatatgattataaaaaattgtttgacatttgcagtgcctccactaaaggaatgtacattccagagttaaaaggaaaacctttattgagataatttacctacaataaaatttatcattttaggccaggtgcggtggctcatgcctgtaatcccagcactttgggaggccaaggcgggcggatcacgaggtcaggagtttgagaccagcctggccaacatggcgaaatcccatctctactaaaaatacaaaaattagctaggcatggtagcaggcgcctgtaatctcagctactcgggaggctgaagcaggagaattgcctaaacctgggaggtggaggttgcagtgaacctagattgcgccactgcactccagtctgggtgacagagtgagactcaaaaacaacaaacaaaacaatcattttaaagtatgtaatttggtgggtattagtatattcacagtgttgttcacccatgaccactatctaattccaagatatttttatcactcccagaaagaaaccccatagacagtaacagtcgctccctataccccttcaccccctccgtaacactaactacttttttgtttctgtagatttatctacatataaatggaatcatacaatatatggcctttttatacagctacatttacttagcaggttttcaggttcatctatgttgtagcatgtatcagtacttcattcccttttattgccaaatggtattctgttacatcattttgtataaccatttgtcagttgatggacatttgtgttttcactttttgtgctttggcaatacttgtgctacgaacatttgtgtacaagtttttgagtgaacatgtattttcagttctcttgggtatatatatacctagggtagaactgctgggtcatgtggtaattctatgtttaactttttgaagaactgtcaagattgtttccacagtggctgtaccatttcccacaagcatgtgtaagggttccagtttctttacatcctcgttaacacttgttatggtacatctttttgattatagtcatcttagtgaatatgaagtggtatctcatggttttgattaggattttcctggtgatttatgatagtaaaagtcctttcatgtccttggccatttgttatcttccttggagaaatgtctgtttcaaatcctttgcccattttttaattggtttctctttgttgagttgtaggatttctctattctgaatacaagtctcttgtgagatatgatttacagatattttaccccattccttggattgtattttcactttcttgatggtatcctttgaggcacaatttatcttttttttcctttggttgcttgtgttttgggtatcatacccaagaaaccactgcctaatccaaggtcacagtgatttgcctcctttgttttcttctaaaagttctatagttttggctttatatttaggttttaatctattttgagttaattttatcacgtgatataaagtagggctcaaactactctttccatgtggctatccagttattccaacaccatttgttgaaaagattctttaccccattgaattttcttggcatccttgttgaaaccacccaaccattaatgtaaaggtttatttctgggctttcagttttattacttgtgctggtataggacactgtcttgattattgcagcattgtaataagttttaaaatcaggaagtctgagtcctctaattttgttctttatcatattgactgttctgggtccctataatttgtatatatgacttttaagatccagatggtcaattactgccacaaaaaaaggcgaggaagtaactgggattttgatacaggttgtattgaatttgtagatcagtttagatagtataggcatcttaacggtattaaatctttagaaccacaaacatgagatgtcttccgtttaggtctaattttagaaccttttgtgtataattcttgtttcttttgttgaatttattcctatgggtttttttttgtttttttttttgagttttcttttttgttaactgttgtttttgtttgtttgtttgtttacttttagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtaatagtgtttttgtttcttggtttgtttttttttccccccacagcattgactttatttaatcttgttggggagacatctgaagctgacttctctcccctgttttccaggtacaatgactggtggtggaagcaaagtaatgaaaggaagaatgggttcctcacttgttattgaaatctctgaagaagaggtcagcatatctaaaattgtatccagacttttttttttttttaaatagctttaccgaggtatatacttactacaaaatttggccattttaagtatggtgtactcaaattttaatagatggcgttttctataaatgactagggattttttatgtaaagccctttaaagttttagaaaacaaaatattaatcagaaactatatgctcaaagtacactttttaattagtacatttggatcatacagatattccataacttacataattatttctgttttacatttaatttattggggttttttttgtattattgctgtattacataattttttacttcaaaataattctttaaaagtatagcaaagacttgatgcaaatctcaacttcagagtattttaaacttttttcctcctcaaaaacatgttctgaaatagcttgaacaccttttcccaaagtgttgtgctttgatttttttccctcccgtattttgaaaatacaagtttatgtccttctgcttaagtatttgaatgctgtaccttcattgaaataataggtgactgtacaacacttagttacctttccatctgattttctgatcaagaaattacttgaccatctcctgaactttaagattgggattggaacaggtggtttgattttgttctggtctttaagatcagaagttttaggctgggcgcggtggctcacacctgtaatcccagcactttgggagtctgaggctgtcagatcacaaggtcaggagttcaagaccagcctggccaacatagggaaaccacgtctctactaaaaacacaaaaattagccgggcgtggtggcacgcacctgtaacagtcccagctactcaggaggctgaggcaggagaatcgcttgaacccgggaggcggaggttgcagtgagctgagaccgcgccattgcactccagcctgggcgacagaagttttagttttcttcgtaagttgacttttctgtcaatctgaaatggctcttagagaaaactttctttgtaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccaggtatgtgtgtgtgtgtgtgtgtgtgtgtgtgtgtactgaaactattgggattcaactggaatttatcagaaccattttgctatttgcttacaatttattaaatatataagggagggaggatctataggcagatataactcttgatgattttgtttcactgagtactaatagataacgccctgtcacagtgttgttccaaccacagctattcctgttttccgtttgtactccatagaaacattactttccttaacaactatatgaccctttatttttattctcttttcaaagtggaattttttttaattatgaaaaagcaatgcacgcccactgtttttttaataagtttccagaaaatacccaaatgatcaccttcattttgacgtatgttctttcaacttttctaatacctagtttgcatgtaatgtatttatatatgtggtagatatgtgtagatatataaagtgtgcatatggtttttttaatgtcatactagcttttcttaaattatggttttctttccaaggcagtataaatgtactttgtttttaattgctttagagcattttgtttataacataatttgacaaattttttttgtattatgtacatggctatgtttaaaaaaatccttgtaggtataccttgattcagttatttccttagatttcaaaaattacaagtattacaccatatgtgtacaatgtttaaggcatttgttgcataatgccagattgttttcaaaagttataattcatgcactactaacagcatattcaaataattatttttccaagtctttgaacactagggtggtctacataagtttgctaccttgtaaacagaaatgtggcattttaacgtgtctttataatgagcttacatattttgtgtttgttggccattttcattttttatatcaatggcacatatctttcctcttcctattagtgtgtgtctttttcttgaagattttaagtgccctttttaaaaattcacaatgtttaaagcaaatgttaaaatattgaccttaaatgttaaaacttttttgtagcgtttaatagagcaagaagaatatttgaatgtccaagttaaggaacttgaagctaatgtacttgctacagcccctgacaaaaaaaagcagaaattgctagaagaaaacgttagtgctttcaaaacaggtatgtttagagatagaccttttttggggggaaaaaaaaaacaggtttttaaagcttgcaatatttaagaagcagtagaataataatagaagctaagtatatgcaagtcattgcactattttatggtgtttgttataaagtaagtgttattaatagtctcatttgacaaataaggaaactgaggcatttgcctaaggtcacacagcacgtggtggtataggaataggtgatttttgagtccatgcttttaatgtcatactttgtatactttggccctaatctttccaaaaccccttcaagatagtggttatagatttagaaaaattatatcactcagataacacagggaataagtggtatgcaatcaaagaaaaacaatgtgtacttgaaaacttaaaatatatatatatgtattttttttctttcataacttcttcttgtgcagttatagacatgtaaatgttctaccaaaatagaatctttaggcaggaaaaggaattcacaggcagaattggctctgtagccttaattgaaatcccctgatcatgcacttgagcagctgtgcttgtctttccatgttggcttcaatcaaacatagatgtgcatcttaatgggagaagggatagtggattatgccacagtccccttccaggtttacagaatcttagctagtgactccagcaaacacagcaaggttcattttattcttaagacagatccctgttacagtttgctttgtgagccaaggaagacaaatactgattaaccatcccaaagaactaatgagagtggagttggagcgattatccaactgctccaaaaatgtggggattttcttccaaaagaaaaagatttttaaatgttgacacatttccacaatgcatatcaaatgtgcatttatattaatttgtgtctgtgtttatctgcatttctaatattcaggcactcaaatagtatctgctactggccaggctttgttttaggtcctactgatagagcagtaaacaaaaataaagtctcttcccagggagcacacatgtaagatggcacatatttgagtggaggcccaaagaaagtatgagtgctaacccatgtatgtttgagaaaaaagcattccaagaagagtataaaggagcaaatacaaaggctgaagcaggagtatgctgggaacacaaaccattgtggctggaataaaggacggaagaacccagattctctgaggccttcacccacactcccctttccctgcaagcacccacaacaatggctttgatggtacctgatggtcaattgagaagccaaaatgtatatctgtgctattaatggcaacattttcatggagagactgcaagagtctatatgtgtttcatccttatttgaaaaggaatccttgactttgttaggagctctatatatctcctctcatagaaatgccatatattatcaggagactgttaatatctcatgtggaggacccatttgtgcaagcatatctttaaaattaaatattttcaactattgaacatattcatatttttaaataaaggctacagtaaaccattatatcgaaatctgtgcaaacattttatatttaagataaattgggctgcgcatggtggctcacacctgtaatcccagcacttgggaaggccaaggcaggcagatcacttgagatcaggagtttgagaccagcctggccaacatggtgaaaccccatctctttgaaaaatacacacgcacgcacacacacaaacacacacacacgccgggtgtggtggcacatgcttataatcccagctacatggtaagctgaaccacgagaatggcttgaacctgggaggtggatggaggttgcagtgagctgcgatggcgccactgcactccatcctgggccatagagctggagaacctctaacttcgttacagaaaatccagacttctgtgtgactgcttgccagaagaaacatgtccaatttgtttatgccttccaaattatgcaagtacttttgattgaattgacctaaattatgtctaaaccctagccacagaggaatctgggaaatgttaacttttactcttcgttgtcacaggaaggaacgctaattcatcttatatcctccactttgttttaatgtggagaactgcgaagttatgttagcagaagaaaataaccacaatttcttcattgtgggcaagttaatattgagttaggcacatagtgtatctaaggctaaaaatcattatgaactcagtagtcaaggaagtgccctaagaaaaagttgtaaagatattttaaaagaagctgagaacatgaagccattaagaaatggtgtgtttacagccgagctagtgtgtttaactttgtgcattgttgtaacaccatttgttttgatacaggatatcgtttttttttttaaggtgctttttcccatatgcctaaaatttgttttaatgcatcacgtcaagtcatagcaactgaagaaatgtacatctaacaaatgatgttcattagcataaaaacacaaattaggttctttattttttaatttcagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacaggtagagtatgcatgttaccctaacttgttttccctttccctgccttcacattggaaagggggttactatgtaatgttccataaaatgtttctcttactgttaatttattgaacctgtctgacacattacctaatgggacttccatgacggaaaacctataatgaacatttatcctatggccaattaaaaaggctggtaaacaggtatgccataggaaagtacaggtagactgtaactccccagttgctgtgagggcatagaaatcagttttgtttctctggtctcggggagggagtagttggtccttaatttaaatagatacaggccttaaaagaataagtaaaagaggtaaaaatgggatcacttagcaaaattaattctcttggtaacttacattttagtttttatttttattttttgatacagagtcttgctgtgttgcccaggttggagtgcagtggcacagtcagggctcactgcagcctcaatctcccaggctcaggcagtcctcccacctcaacctcccaagtagctgggactacaggaatgcactacaacacctggctaatttttgtattttttttgtagagaccagagttttgccatgtttcccaggcaggtcttgaactcctgggctgaagcagtcctcttgccttggcctcccaaaagactgagattacaggcatgagccactgcacccagccaccttaaaattttaaatacctagaagatttcattgtccttaaaaaaaaagatttatctacttaggtttttttttttttttttttctttttgagacagtctcgctctgccatccaggctggagtacagtggcgcgatctcggctcactgcagcctccgcctcccaggttcaagtgattctcctgtctcagcctcccaagtagctgggattacaggcacacgctaccaggccctgctaatttttgtatttttagtagagacagggtttcaccatgttggtcaggctggtcttgaactcctgacgtcatggtccccctgcctcagcctcccaaagtgctgggattacaggcatgagccaccgcacccggccttaatttttttagagtatttattgaagtgtgtctgaaataaagttaggtatgtatataaaatattgaaatttaaatagccatttctttttttagaaaaaattttaacaaattgattgcatattgattatctggttaaattaatccagagtgttttgctcagagataaggaggtaataagggagaagtagtgtcttgcttttttggaagtacttgttgccttgtcttgaattgggaagtatttgaaggtacaactttatgggtgtagagatttaacaatctctgacgagaaaatgacaaaagaatttgataatctaatggacagtgttgcatcagtctaaagttgaatgatacaagcagcttatataagaaaggcatttataattaaaaatatacaactcatcccataagtgtttgtataaacctacaaaaactgatttaaggatggtttagtaaatcataaacttaaaaatatatgaatagaaaaaatgtcacattaaatttcatgaaaagttctttagtaggttttcagaaacaataacaaatcaccttaccacatttttgatgcatcattttgcttctttagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggtatgagttgctttgtattgaagaggagatgggatgatactggaaccaatttaaagagctggatatatgacagtgcctagaatgtagtaagcactcatagacttaaagttttataactatcaatttttatttgtacaataagaatactataatttgtgaatttaaatgcttaaattattttaaaatggaaggggcatgaggagagattggtaattccttcatctctgtaatgtgaaaatgatggctctatttggaaaattctatctagcagttcttttcggtgtttaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagaggtgagattgttaccgtttagtttaattttaaacatattctttatgaaaaaggagggtttggggaggattgttttagggggttggggttcttaaattttgtttgtgagctacattgtgatttttaattctgtgatcacttctaaggtttataggggacataacaatataaattgttatatacagaaaagtctgagtaacgattagaattagacaactaccctttcaccctagggctgatctggacatttaagaaaagattacatggacacttttgagtgttacaactatttttcttgaagtcctttgaaaaataattgataaatcagtcacaactcctgttgttttcatagctgtgtaatttgtcatatttttttttaaacaatgaattgtatgtaatattatgccttctctaactctcccctaaattgaacttttagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggtatgaatgaactgtgtatgtatactagttggagttctttttagtccttagcctaaattctgatctttagttttgtataattaacaatgctgttggccgggcgtggtggctcacgcctgtaatcccagcactttgggaggccaaaggcgggtggatcacaaggtcaggagttcgagaccagctgggccaacatagtgaaacctcatctctattaaagatacaaaaaattagccaggcgttgtggcacgtgcctgtaatcccgggtactcgggaggctgaggcaggagaatcgcttgaacctgggaggtggaggttgccgtgagccgagatcgcgccattgcactccagcctgggcgtcagggcaagactacgtctcaaaacaaagtaataattaacaatgctaattatcatatcaaatttatctgaatagattttccctatcataatcttttcacaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcaggtgtgtaattatgctgagtttataatcccactgttacctttttctacatattctccaaactcagtatttcttggaggtaggatgtgaaggcaagatgtacaacttgtttcatttactagtaaatactaatttgcttgcatgctatttatgcttgcagtttacaggggcagacagccagtatttacaaaatatttgtctagttcatcttttcttaaattttcaaggcatttttaacatgaggattgagaaattgtatttgataaggagaaagaatagcaagaagtataatacttagcttgctctttaaatcttaaaactttggtatgtgctcctatgtatgcatcctccaataacgtttttataaaataacagaaaagagaattcatatttgtgaaaagcaagttacagattcctaaaaaagatagtagaactcaattatggaaagcaaatcacaaagtcttaactttagctttacaggtaatttgactatgattttcttaatcatttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgtaagtaatcattttgggattttcattccagaaacttttaggggtatcctaaacattacacatggaattctttatttcttacaattgagctttttctttattgtctaataactccatctccatctcctctggtatcagtggagaccaaattattttttatttgaaccaaatatttccattttggaggagtaaaatataaattaaaaatgcaaattagtagcagaatcacagctagaatcctaggtcatcttcctagatcttttccactagaagtcaaaataaccaaattcctttcacactcaaatactgttttatgaattattcctgccatcattcctttacatgttatcaatgtaatgtttattgtccaaaaaatatttgaggttacatgtttgtgtgatttacctgttattacttaatgtttgacttttctttgtttctctttaggaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatccgggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagc

SEQ ID NO: 35949 - DNA, 14085 bp, Homo sapiens
acaaaaaagcttttacgaggtatcagcacttttctttcattagggggaaggcgtgaggaaagtaccaaacagcagcggagttttaaactttaaatagacaggtctgagtgcctgaacttgccttttcattttacttcatcctccaaggagttcaatcacttggcgtgacttcactacttttaagcaaaagagtaagtttttaaaaaatgagaacacgttacctattagtttctttttctacaagtaaaacttttctaaagttttaaaatgtgttaaatgtaattttgaattatgatactgtaaatggattgatggatttgaaagtgtttctatagttttaaagttaaaatttattgtaccaaatatatattttgactgttaaaaaagtttctattaacattgcaacaggtgaaaaggttcaaacctttccgattagaataaaggattagtttactggatgtttggtttttcattttagagtatcattttattttgttttttttttgtaatcagtaatagtctaggtgctatcatttgttgggtggggggggggcggttaggcgcctgggttgggggatttgactgactacatcggaaaaatcaaagtgcaaatttgcttagcgtgcttcctatagtattctacacttcatagaataaagtgcttttttcatatggaaatcttgattgatgttctatagctttgcaaagccaacttcttttgtgacgaagtgctttgttaaaacatcgtggttacttgacttccacgtggttccttcctagaattttccccattaaacaaaaaggtataaaattcaagagtattaatattatgctttaaaaatcaacagtaaattgttactttgtgttagcaaccgctatggaaagatttgagaccctcaggagagacagcttttactcgaccacgttggcagtttaggagatgaaatctcttgaatgggtggtggctagttacagagcattagagatcagacgtttaaaaaagagtgtatgccagggtacttttccaaaaccgtctcctaaaacgggagctcctagaaagagcaggaaaaaaactttcttaaacagcgctttgggagctccccccgccaacacccgccgccccgcaccttccctctgctcgaacctgtaacagaattcagaactctggggcagttctttggagttggagctcctagggcaaagataacgctaatgcgttgtttaaaagggttcaatttttaaaatacttttattggtaacacccattctgttcatcagaaatgcagccatgcatttttgtgcccggtaaagattttctgttctgtgtaaatctacaaactaaaataattagtttagattcttgacgtgaccctgcagtggaagtatttgcaccagtgaatgctgaaaagcaaataaaaatgaaagctttgcggaggccgtgggccggacgggcgcggggcgcctcctgccatcttagcgtctgccgggatccttcccgcgccttcgctgcccgaaccagctcggtcttgggacgtttcccccaaatcctcacaagtcaaatcgaactcaggtccgagttcgtcactgcaaaggaacccggggtgcggggtgggagggataggaggagagatgggctgggtgccaaatggtagaacaaatggttgatttaattaaagttgtcaatctaatttcccatccctctcacaccagccctttttttttttctttttcttttttcctcttaaacttgctgaatcccactatctccgcgttggtaagaaaacctgaataccttgggaattgtgcttaaattgcacttgcaactcccctggaagttcctgaaacttcccgagaatgaggcggggcggctcaaggggaaagggcagggaggagagaccctcgggaagctgatgacgcgtccggggcaagtcagcctgtttccgagacgcgcgcctcacggtcgtagcagcgctgcgcccaccctgcccctttagtgacccagccagcctttgctgggggtttctgataacgctcatcgataagctctccttgctcccaaaaggcgtgcttctctttctctccaggtacaaagtaggggtgggaaggggagagctacacaatgttgtaaaaagaagcgtggctttatttggaagacggttgaatttcttttgcttcctcgacccagttagtaacgacaagaaagatactgaatatcgccctccgaaaatcgggcgcatttgaactcggtgaaaagtgtccctgtgaggaagcctaatgtttacttttgtgcaaggataactggaaattaaagcgtctagtaatgcagagatttcattaagcgagcgctcccctcccccccgcgccaggaatgaaataagccagttagacagaaaacacttttgggagaagactaattacttctgggtaggccgaattgactggaaattataccaagcaaaggcagtacattccattccgtcctggcgatgttgattctatattattagaacattgttcccccagtgtgggggtgctttgtacttcccaaagtcagggtagactggttacctgggaaaatgcagtgttagtgctttgctcctactttcttcactgtttaaacatgttccacatttttctaatgccttctgagggttctcaacccagccactgagttcctcacccttggcgactgtgataccaacaatgctgtcaccctccttgggaaacatggttgcaaagatgctccgcaggaggcagataaaaggctgtgctttcagatactgaaggttgctttgttacttagatgtttccaattcctgcatagagaaggagggaaaacacggggtgcattctttcttttcttttctctacatccaggggtgtagcttggtttgagcctttatatatgatacccgcagggaagggaatgataggacagtcaccagtgattaataccttccactccgcctttcctgttgttctgacttatcttcaggattctcagttatttgaagagatgtgtgggagcttatccgcacacaccagttcaactctggagagaaaaagtaattatctagtgtttattattaatgtaatattctgtatggataattcaagttttaaaaaatctccagagcatctcttccatgggagattaatgtatatattttttaaattcttagcataattgtctaaacctccatctaaagtcaccttttaactatgtatgtacagattgtcttttacctattttcaaactgtggttagctctttttttttaatacatcagtggcttatacaatttcataaatttcacattccaatttccctatgcttttaaaataatattttaagaaaaatatatgtttatcgtcagctgggcatgatggctcatgcctgtaatcctagccctttgagaggctgaggtgggaggatcgcttggggccaggagtttaaaaccagcctgagcaacatagcaagaccccacctctataaaaaaaaattttaaaaagaaaatgtatgtttgtcaatcatttcttagttgctgttttgctaaagaaaagatgaaaaatttaaaaccaaatgagctatatctaaaggtcgtctaaagagtaagaaccaaactttactgagctgttactaagagcatcacatgcatgagttatttattaaattctcattgaaaaaaatagactatcttaatcaatacacttgtgagggccctaagggtgtctttatatgattataaaataacaaggctattcactaaaaatagtcaatttggaggtggaagtaagagtaggggcagaggaaacgccaaggactgatagaaatatattaagttacatcacaattgaagaacatggcttttagcctcagcttctgacttgggattttctctctggtagccctaaattgatcttgagaaacttgttttgggggagaattgagtagtagctgttgaactagggagaggattgtcttttatgggatgcaccatcctctctttggatggagttcctcacacctcaattcccatctcatctcattaagtggatgctaatgtaagttcagtgatgaggaggggtaagagctggggaaggaaggcttgttggtgtttttatgttgtcctcccctctgcccccaaaataagcagttcacaacatcaaatacctacacaaatgtgcaattatttataaatatatttttacatacagtaagtttgatacactatagttaggccatctaggtataaataaggaagtaaaggttgggtattatctgatgaactgggaatcttttccatggtacttgaatctaatcactttagtgcctgcatagactcagactgtaaagatgttacattaaccagggttaatatcaactgctgctcttccccttcagagccctagccttccccgatatttatcattcttgaaataaacacgattttaaacaggctatttcttcttgtaatagtgtccttgtctacaataaaattgtgtggtgcaatcggagttagaacatcgtagaactaggggacaaccacacagttgtgttttttcctttttttttttgttttgtgttttaaatcttaacctgcaacaacctaacagtgaactgaatgtacaagcatgatacctgatgcagttctacaagaatcctaaccctcattaggatctcatttaacaaattcaggaagctctttgttaaaaagccttttttcttttttcttttaagcctgtcaaatttagcagtgggggttgcaaagagccttttttcttaatttagctcttttgcctgctcaggaatcatttgaagcatgttgtttcaacaaacagttctctgtttcagcaattgtcacttgaaaatttaacagtatgagaatgagatgatgacaatagttttttactgtgaagtttcctttttaattaatttgaaactttagaaatttgagatataactacaattaagagaatcccaaagagacagaaaaaaacaaactttttttttttttttgcacagtatctttctattttttgtggaagccccatttaattcatttaacatgtagctataccccaattaattaattcttttcttttcttttctttttttgagacggagtttcactctatcacccgggttggagtgcagtggtgtgatctctgctcactgcagcctccgcctcccgggttcaagcaattctcctgcctcagcctccagagtagctgggattacaggcacccgccaccacgcctggctacttttttgttgttgttgttgttgttgttgttgttgtttgtcgtttttttctttgagacggagtctcgctctgtcgcccaggctggagtgcagtggcgcgatcccggctcactgcaagctccgcctcccgggttcacgccattctcctgcctcagcctcccgagtagctgggactacaggtgcccgccaccacgcccggctaatttttttgtattttttttatttttagtagagacggggtttcactgtgttagccaggatggtctctatctcctaacctcgtgatccgcccgcctcggcctcccaaagtgctgggactacaggcttaagccaccgcacccggtctacttttttgtgtttttagtagagatgggatttcactatgttggccaggctgatctcaaactcttgacctcagatgatcctcccacctcggcctcccaaagtgctggaattacaggtgtgagccacatctcttactctttcaagcactggggatacagcagtgaacaaagcaaactccctcgtattgttcacattccagttaaggaagacaaataataaatccttctcatggaaggaggtacatagtaatcaggcaaatatttactatatcaagtagagagaaagtctattaaaataataattttttaaaaaccagggcaaagggaataggaaatgacaggactggggaaaggatgttgctatttcatatttggtggtcaggaaagttggctgatgaggtgagacctgcaacaagtgaggacgtgagctgcgtggatggagcagagctcatcaaaccaagctgattgttggtttgttttctcaagattgactgattactcggagtataggttggcaagtagggtgaccaggctaatgacatgaaacctagcaaactgatgatggctgagatcaagctaagggtggctgttttaagtgcggaggaatagacaactgagttcactcaatgacatttactggaggggcagaggttattataaaagtgaaagaaaacattacaagggtttgcatttgagtttttgggcatgaatatttttgggtgttagtacattagacacacacatgatttccctttcctcccaaaaaatccattaaatgattttatcgggaacttccatagacatttccttatgtaggtttagactctgattttattctttcagatattaaagtccttcaccttctcttttctttcaatcataaaaagatgctggatatcaaatttcactttagttttcaataatcctatttacctttatttaagtctccattctcaactcattacatttgtctcttcttgagaaaaatatttaaagtcgatagtaaaatacttaattctaataactattagtatattaatggcatggaaagacttgactgcaacttcggcacatgctctagcaaaaggcatagtcaaatgtaatttaaaatcaaagctttatttttaagagatctcatttgaattaaagcgtttaagttcttctgctctcagggagctgcagatggagatgtaaggagtgacaaggggctgtggagccaaggctgacctcaatgccgggtgcccagagagctgctgctcctggtactcagccccttggattttttagactgttccttctgctttcctgacatttctcccactcctaaatattttgaacaagaaagggccagaaatgtcaagaatagtaacaaacaccaaaaaaaccttacttcctaggccccacctccagaaattcagattcattcagactggtgaagaccaggaatgtatgtttttaacaaatgctgccaagtgactgtgatgcagttcaggaaaggggccagaggagcctcaggctggtcacacttagtgcctgtagctttgggcatccatccagtctagggggccatgaagagcaatggaaatgtaatctaacatggtgcatagacggcaaaaagcgtggtccagctgctaagactctgctcttaacaagaactttgcacaactcctcttagacagaccttggtctacatataaagcaccaactcagtatcctagaggtgaaggcatgaatatatgtgatatgtccagctgcgttggtcttctcatgtatcaaataagaaatatacctgtttccccctggtgaataaaagtgcagtttatagtctgtagatcaatgccagggattctgtaaacatataattatgcccttttattataagagggtattaacttaccatacaagacttggaaaaatgaagatattaaactagtttgggaaggtgcagcagggaggaacaaccagttgccaaaatttgattcatggcaaagtgagcaactaccaaaaaaaaagggaacaatttttgttacctgtttttgggcagctgtcacattaaacattatttgatggtatctatgatagtggagatcgacaggtagctacatgttacaggatactcggtgtccaattcgataattcgtatcttattaagatgaaagagtataactcattaatgcaaatgacaactgcatgggtgcttaaagaaaagacaactttgcaattaagttactagagtattaaaaaagaactaatgaagagctgtctgatgacttagttcacatactatggaactgtggagtgtttttgtagaatctcaaaattatatgaaagtcatgtatcatgaatttttttatagaatgtaaataaagactatactttcagggatcatttctatagtttgttactagaatgtaaataaacttagtgatgaattactataagcatctacacaatcatattttactttgagtaatgatgaaatcctagctaaaataacttctgttctgcctggtcatatttctagatatgataggtttgtcttcagctctatcgttgcatgaatgtgatgagatgtatgcaaagtttatctttttatacttgattgtttttgttatttttcccctagcaattgaaatatgtgagcaaaagcagatgacactggcaaaatactgtaattttttacaaacagaattagggccaattttacacatcatcacatagaaactgtctattgatatagctccaaagattctgtttgtctgaccctcatggactatacttcttcatttccagtctagtattttctgctaaattgtagggtttttttttctttcacattctctcaccatcaaactgtccatcacggctaaattactccctcacttcaagcctttccttggctattcaactgtctttgtcagcctttcaagcctttgttcttatttgactgctgttttaaattgatgctgttttcatacatcaatttcacttcctaacttgtcacttcagaatctaaaatgacccttcctaagtaaaagggaagctccctttcttatgaccactgggggagtgttatttctgtggccttcacacccacctcccactcttactcagcattctttggcactagtccctgggctgtcatcaaatgtacccatgataccgtggtaccatctagctggtgcatagtttagctttatggctcagccatctcttctttgttcggtccaggaaatcccaggtcaggtgcccatttcattttttcttgttctctatggccagaagatgcagtcattagacagaaatgtaatgttgcttactgaggaagaagactcccctggatttcatttacttcctacaaggagatacagctcaatagttcaacaccagaagagaaactcctttatattcagatagtgaacatatttctaagaagcctaaataatcctacctttagatactctatttagaattcattactaagctcctgcaaagtcttagctttgcttgtttttaattattaaacaatctttgactaatttgtccttttctaaatcctccaattactactatgtgctgaaaattagcctatattccctatgcctgccacatcatgttactcacttcttcccagctttcagccctggctaaggttgtgtatatcaaagcctggaaacatttctagctttagcgcagccttactgtacttttaaaaccagtgtgaggcattgaaaagacttgcccggggattgtgaatcttcttctggctctgtctatagctaaatatttcctataccctgagaacctctgagaacctcaatttttatcagctaaatggataatcggcaattagaagcataaattgaactagacaactttggggattcttgttggtttctactgacttacatctttttagtgagacggagtctctctttgtcacccaggctggagtgcagtggcgtgatctctgcaagctccgcctcccgggttcaagcgattctcttgccttagcctcccgagtagctgggactacaggctcccaccaccacacctggctaatttcttgtattttttgtagagacggggtttcaccatgttagccaggatggtctgaatctcctgacctcatgatccacccgcctcccaaagtgcttataggcgtgagtgcattataggcgtgagccaccacgcctggccagatctttttcttatcctcagtaatggagaaggcgtggactttagatagctagatattgataagaagttaaatgggatgtatagcctgagggtccaaagcccagtaagggaactttaaagtatataacaatgaaagatgaaaaccaatcttttctggctggagaaaacaccctgaagtaggttttgtttgtttgttttttaataaggctgtgagtagtattgagacaaaatgaactttttacatgaagtgtgatgtgtatttagtctttgtttttcaaagtaggttactacatataatgacacattgtagcaaaagagtatatttccatacagcctactttttctctggacagaaggctgacttctgagctacataagtcactgcttaagaaaaaaatagtcaccattgcttgggaggctaaggcaggaggatttcttgagcccaggggcctgggcaacatagtgaaatcctatctctaaaaaaagaaacagaaaagtgtaaatgacaataatatagggtatgcacaaattacacttgatataccattgaaaaatcttccagaggccaggcgtggtggctcacacctgtaatcccagcactttgggaggctgaggtagatggatcacctgaggtcaggagttcgagaccagcctgagcaacatggagaaacctcatctctactaaaaatacaaaattagccaggcgtgatggcacatgcctgtaatcccagctacttaggaggctgaggcaggagaatcgctggaacctaagaggcggaagttgtggtgagctgagattgtgccattgcactccagcctgggcaacaagagggaaacaccatcttaaaaaaaaaatctttcagagtgaaattagtaataaaatgatatataatagcattaaggttttggaaagaaggttatggatgtgtgtttataggtattcttacctggattcttgatacctatgctttgaataacacacatcaggattttgcttagcaaacacagatctaccaggcaaaaactgtcctcatttatcagacaaataaaaggagcagaggcttagcacaggtggcttctcaagtcacacagcaaggcagtggttgagcaagcaatacaccttcccaggttaaagactgcaactcatcatctgttgcttctaagacttactttgtctcaacaaacaaaacaaaacacttgttagatcttttcttcgttggcaaaaatgggacaggaagagtttgcacttggttttttgtgaaagaatgttagaaatacgtgaaaccgttggtagtattttgactatcacctgaaaggtactaaatgttaaactagtaatttgcaatctgtgatccttgaattgtctctttgtttctttcaggtggtgcccaggcaacatgggtgactggagcgccttaggcaaactccttgacaaggttcaagcctactcaactgctggagggaaggtgtggctgtcagtacttttcattttccgaatcctgctgctggggacagcggttgagtcagcctggggagatgagcagtctgcctttcgttgtaacactcagcaacctggttgtgaaaatgtctgctatgacaagtctttcccaatctctcatgtgcgcttctgggtcctgcagatcatatttgtgtctgtacccacactcttgtacctggctcatgtgttctatgtgatgcgaaaggaagagaaactgaacaagaaagaggaagaactcaaggttgcccaaactgatggtgtcaatgtggacatgcacttgaagcagattgagataaagaagttcaagtacggtattgaagagcatggtaaggtgaaaatgcgaggggggttgctgcgaacctacatcatcagtatcctcttcaagtctatctttgaggtggccttcttgctgatccagtggtacatctatggattcagcttgagtgctgtttacacttgcaaaagagatccctgcccacatcaggtggactgtttcctctctcgccccacggagaaaaccatcttcatcatcttcatgctggtggtgtccttggtgtccctggccttgaatatcattgaactcttctatgttttcttcaagggcgttaaggatcgggttaagggaaagagcgacccttaccatgcgaccagtggtgcgctgagccctgccaaagactgtgggtctcaaaaatatgcttatttcaatggctgctcctcaccaaccgctcccctctcgcctatgtctcctcctgggtacaagctggttactggcgacagaaacaattcttcttgccgcaattacaacaagcaagcaagtgagcaaaactgggctaattacagtgcagaacaaaatcgaatggggcaggcgggaagcaccatctctaactcccatgcacagccttttgatttccccgatgataaccagaattctaaaaaactagctgctggacatgaattacagccactagccattgtggaccagcgaccttcaagcagagccagcagtcgtgccagcagcagacctcggcctgatgacctggagatctagatacaggcttgaaagcatcaagattccactcaattgtggagaagaaaaaaggtgctgtagaaagtgcaccaggtgttaattttgatccggtggaggtggtactcaacagccttattcatgaggcttagaaaacacaaagacattagaatacctaggttcactgggggtgtatggggtagatgggtggagagggaggggataagagaggtgcatgttggtatttaaagtagtggattcaaagaacttagattataaataagagttccattaggtgatacatagataagggctttttctccccgcaaacacccctaagaatggttctgtgtatgtgaatgagcgggtggtaattgtggctaaatatttttgttttaccaagaaactgaaataattctggccaggaataaatacttcctgaacatcttaggtcttttcaacaagaaaaagacagaggattgtccttaagtccctgctaaaacattccattgttaaaatttgcactttgaaggtaagctttctaggcctgaccctccaggtgtcaatggacttgtgctactatatttttttattcttggtatcagtttaaaattcagacaaggcccacagaataagattttccatgcatttgcaaatacgtatattctttttccatccacttgcacaatatcattaccatcactttttcatcattcctcagctactactcacattcatttaatggtttctgtaaacatttttaagacagttgggatgtcacttaacattttttttttgagctaaagtcagggaatcaagccatgcttaatatttaacaatcacttatatgtgtgtcgaagagtttgttttgtttgtcatgtattggtacaagcagatacagtataaactcacaaacacagatttgaaaataatgcacatatggtgttcaaatttgaacctttctcatggatttttgtggtgtgggccaatatggtgtttacattatataattcctgctgtggcaagtaaagcacactttttttttctcctaaaatgtttttccctgtgtatcctattatggatactggttttgttaattatgattctttattttctctcctttttttaggatatagcagtaatgctattactgaaatgaatttcctttttctgaaatgtaatcattgatgcttgaatgatagaattttagtactgtaaacaggctttagtcattaatgtgagagacttagaaaaaatgcttagagtggactattaaatgtgcctaaatgaattttgcagtaactggtattcttgggttttcctacttaatacacagtaattcagaacttgtattctattatgagtttagcagtcttttggagtgaccagcaactttgatgtttgcactaagattttatttggaatgcaagagaggttgaaagaggattcagtagtacacatacaactaatttatttgaactatatgttgaagacatctaccagtttctccaaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaatttagtataaacat

SEQ ID NO: 35950 - DNA, 136122 bp, Homo sapiens
gtgacgccccaggaaagcgctccaggccgagggcgggcggcgccgccgcgcccgacgcctctgggggtggggacttcgcgggagtcgccggcggaggcgaggaggagctctgcgcggcgcggcgggcgatccgagccgggacgggctgcaggcgggggtgctgcagaggacacgaggcggcgggctggagacatggaccgcggcgagcaaggtgagggcgcggacccagcgggcttgggctcgggcttggactcgggcttggactcgggctttggctcggcgcggggctgagcgcggcccggcggctcgagcaggtgccgagcctcctgggccggcgccgcaagttgcatctcccggatccggatctggcatcctggggccctggaaggagcggctctggcgggggcagatgggactgcatgtgtgagtgtgagtgtgcgtgtgtgggggagagggagagaaggttctgggaggtggcgaaggggctagcgtcaggggctggcggccgtgatgcgctttgggtggaaagccgcgtgaagggagcacggcgcagccagctcctgtaagtgactggaaccaggaacagaggacagtgagtcgctctcgtccctccaggtgggaaacccctctctccctcataaattaagactttctgccttcttctaagttcaggtggttaggatttttggtggcgtatgacccatggggggtttgggaggcagatatttatcatactagaaacccccagattgtggagtggtgtctgtgggtttgagggaagagagcttttcgtaggaagggtgaaatcccacaacacaaaaccttcagtctaatttaccatagcgttgggtgcacttgcttctgaaaacagctcaagtgaaattacccccaaatagagcaatagtaggccatggttttcagatttaaatagtttcatcctagagatctctgctgatcataagcctgtgactgtacgcagatgtgtgtggcacgcttttaaaaagatacataaatgctgaaaaaagaaaacaaggtaggtaatcttgggaagtgaggataggaatcactcctgttttgagccctgacacaagttttcatgtattgcttattttcctccagtatgtgccgtcatgtgtgcatttttatgtaaatcaaaccatattccaaatatactatcttgtactttatttttttcagactctggtgttttttttgtttgtttttttgagtctccacctgtagcccaggctggagtgcagtggcgggatctcagctcactgcaacctctgcctccctggttcaagtgattctcctgcctcagcctcccaagtagctgggattacaggtgtgcgccaccacagcccggctaattttgtatttttagtagagacagaggtttctccatgttgaccaggctggtctccaagtcctgacctcaggtgatccacccgcctcagcctcccaaagtgctgggattacaggtgtgagccactgggccaggcctgtactttactttcatttacttgtaagatagactctttggagtctttcagctctttcctcgctccccttcagattaatttcagacttaacacaagtgcttacaaacattacatacaatatgctttatatgtgttacctatgtgtatatatatattatacattacctgtataacgtatatatacacatacatattattatctaaattttaagcttcttgaggttagaaacatttcatctttggttgtcctgagtgggataacatgatgacttgtacatagtagacatgcaaatgtttgagttagaaagcttgtcacatgtcttgtatatattgttagccggcttaggggccaccatgtaagtcagcattatgtctgtctggctttcaatgggggcgacgcaggacgggggagacatgacgacaaacgtgcccatgtgtatttgtatactaatctgttacacactgtcgtttgacataatgatgtttttagaataactatgtttggtacttgtcaaagtaaattaaacggctgtgttttacttacgtgagtggagtaactagttttagtagtgtttgtgttctagcttgggtggtaagaatcaacagtcattggtagcactgcagtattccaacttcttgtgtagtttttataggactagtttaagtgtctaattctaagacatatttttttcaaatctttatcttgtaagatgagtcttttcgtgtctataattttcccatatgttctttgggtgaggtggaggactctgctccgaatgaaagaagaggcactgccttgggagggtcagttcatttactccaaagctttgctgtgttagaacaacgtggccaaggctgggtgcggtggctcacacctgtaatcccagcactttgggaagctgaggcaggcagatcacttgaggccaggagtttgacccctgtccaacaaggtggaaccctgtctctactaaaaatacaaaaattagctcggcgcggtggcaccggcctgtagtcccagctattcaggaggctgaggcaggagaatcactagaaactgggaggcagaggttgcagtgagcttagatcaaaccactgcactccagcctgggcgacagagcgagactctatctcaaaaaacaaacaaacacaaaacaaaaccacctggccattccttactcttgcttccacctgcctacctgccttttcatctttatgttaccagtgcacacagtaggtgcttagaaatatgtgttgactgcctaagatgagtgaggaaagtgtccaagagcaggccccagccatagtaacctctgtgtccctccaaatccatctcttgtttcccactttctcctgttctgttttccctgtctattctcaagaagcagaacttagccagagagttgctgataaggcagtgctgggcttggaggataactttacatggaagatcttagaactagtagagtggatgactcagtcttaagtgaatctggagcaagactcctgccttaaactggaaaaggcacaacctgggattttaaacctggtgttcactagcaaactgtgttggctgaaataaggtttatcaaactctgtgattgtctcctgaattgtgattttggcaacatacttaaaaccaaagcagaaaattttaggatttgttgaacttttaatagtttttaatgtacatggagttttcttatatttgtcccttaaaaaatccctaatgaaactctagttgtaaaattaaatgccctacctcttgtcttacatgcatttatctattgaaaatccctcttccaaccttcttatgtgaagttatcaaaaaatctgttcttgctactgattgtacttaacagagctgtaaatttttaaaataaacactgagttttccttatgttttcaaccacgagtattctaatgctctgtagtatcaggcccagattctgttgtttttctactttctctcatacctagggcttgaatacaatactctgcttacagtgagagttcagtgaacatcaaatgatttaaaatacgttaaattgcatcatgcctttcaagagtttccaagcattaagctcagcgcagcacatttactgtgtgtggtatttcctactttgatagagcagtgttgctaactagagcatacattgtgtagaaaaccctcctgactaccttttatggagctgaataaatatgtatacttgagtgctctcatgttagtcataacctttagtttagcactgttatatagaagtgacagtcacgtagcccactacacattatactagtttgaatttaaacaaagcaaaacaactttataattttaaggggaagaggaatggttcctgaggccaaaaaactagagaggaaaggcttcaaaaaaagaataacacaataatatgtcactatcattttaacattgtaattgtgccttagaaataaataacagaaatgtggggtatcatttatttaaaaataaagcaaatgtagagaataatggataataattttgagggtctactcccaagtctctgggtgtgacccaccccatccaggctgttaatttatttggtcaacagtttcgtgatttccatatggtgctgatgtctttgttagctcttcttcacttcctgcatttatttttatgtggcaggctgcctagtccctaggggaatagctgagtggtaggaggggttgtgatcttttagcaagatttcaaaacagaataatgtatgcatgtaataaaaacaaatacgctcactcacagtgcaaaaccaaaaagaacacccaaatccctggaacttctgtgctactaagtcttttgttgtaggctaagattattttccttttggggttaattatttctgccttaattattgactgttgtgaaatctctcttctgagacattcccaaattttatttaaactagtgggtaccagctgtactgaaaccataattttagccatgtatttttattagaaaaatgtttccaggggattaaggaattttaatatttagtggaagttttaaaaaagaatgtaaaaatgccttttggaacctaagaatagttgtctattttagaaaaatcagaaatattgatggagaaaaaagaaaattacccataatcctgtgcgagaatgagaaatcatagttagcatattaatttatacctgttcatgtatctatgctttaaacaaatcacaattttattattattttttttaacagtgtctcgctctgccacccagggtggagtgcagtggcgtgatctcggctcactgcaacctctgcctcctgggttcaagcaattctcctgtctcagcctcccaagtagctgggactacaggcgcatgccacgacacccagctaatttttttgtatttttagtagagatggggtttcatcatgttggtcaggctggtctcgaactcctgacctcaggtgatctgccctcattggcctcccaaagtgctgggattacaggcgtgagccactgtgcccggccaacaaatcacaaaatttcttattgaatattgcattttataacttgcccttttaaaaaaaccctaaatgtatttaaaaaatacactttaatggccgcatgtggtggctcatgcctgtaatctcagcactttgggaggccaaggcgggcggatcacctgaggtcgggagttggagacccgcctgaccaacatggagaaaccctgtctctactaaaaatacaaaattagccgggtgtggtggcatatgcctgtaatcccagctactagggaagctgaggcgggagaatcgcttcaacctgggaggcggaggttgcagtgagtctctctctcttgcccaggctggagtgcaatggcaccaatttggctcactgcaacctccacctcctgggttcgagtgattctcctgcctcagcctcttgagtagctgtgactacaggcgtgtgcctccacgccataatttttctatttttgtagagatgggtttcatcatgtagtccaggctggtctcgaactcctggcctcaagtgatcctcccgcctcagcctcccaaagtgctgagattacaggtgtgagccactgcgcctggcctagagcagctccatttttaatggccatttgtatgtatttatttatagatgtaacattttatatactgttatagacaatatttaacttgttccctgttgatgaacatttacattttgccttgtaggggaggaaaaatttctccctacccttttagggtttctggcgaggcctaggaattaaaccaacatgagatagattaacaggagaaaagcatgcaaattttatttagtgctttttatgtattacataccttttaccctcacaagaggaatgaagactcaaggaagtggcttggcctgatcgattatatactaggtcaaaaaaagagtggcagttgtggaaaagtaactaggaaggtaaggtttagtttagcaaggtttctttatgcagatttctttgggcttggacttcctgtgataagaatgtttctttcttcctggtagagggaggacatctttcatatgggagcttcatcttctgctttcaggaaaaagagaggaggtttgggtgcccttcttaacacctgctgtttttcaagtgcctttagcccaaaataatcagcatgctaaagtggaatgttttgggatgctgtgtcctgaactccttcaccctgatattttgctgttaaaacaaagctgcagcaaatgtatgtgtatgcaagtcattccataaaaatgccagtgtgtctgtaggaagaattcttagaagaatgtggctgttcaattttgatagtgccaaattctgctccatagaagtggtgccagttatacttccaccagcatgtgcgagcgtttgctttcccttgccatgtggccaggatgttgccacacttttccattgttgcttgtcttataggggaaaaatggtttctcagtataagtcttactatatatatttaatataaaggtagtttacttcttttgatatgtttacaatctacatggcattttctgtgaaatatctggccatatcttttgccaatttttctattgtattttatagaatgtaccccgtttatgagatgagttgttaattttttttctagtttgtcataccttttttgactttatagtgattttttttaaccaagaagaaatactaatagctctttttttttttttttttttttttttttttgagacattgtctccctctgccacccaggctggagtgctggagtgctggagtgcagtggcatgatctctgctcactgcaacctctgcctcccaggctcgagcagttcttgttcagcctcccaagtagctgggattacaggtgcgtgccagcatgcctggctaattttttgtattttttagtagagatggggttttgccatgttggccaggctggtctcgaacttgtggcctcaagtgatctgcccacctgggcgtcccaagctgctgggattacaggagtgggccaccatacccagcctaactaatggctcttttcatttatggattctagcttttgaatcatttttagaaatgcctccctcactttgagtttatgcttttatggttttattttttatgtttaaatctttcctcaatctggagtttgttttgataatgagatgtgaggtataaatcttaacacctccacctccaattggccacccaactgcctaacaccattcattgactaatggcttcttcctctattgatttgaaataccactgttgtcatgtactaaattcttacattcttttcttttctctttatctgtatgttcattgccagcagctaaacctagtttaagttattgtagcttcataaaatgtaaaaatgtctggaagggctagtttgctctgattactctatttttttttctgtcagtttttttctaggtattcttgccagactatttccaaacgaacattagaatcaacttatctaggtgaaaattcaacaaaaatcatgctggcagatctttttctccttctctctcctcccccctttcccctttctgtctgtctgtctctctctctctctctctctctctctctctgtctctctctcacagttagaatttggtctgtttctttattcaataccccaatatatgttcattagggttatactgtatacactacacataacagttttgttttttgttttggatattatttgataataagaattttaccacatcattaaaaaaagtttccccaagctataatttttgataattgcactcttccactattcaaatgtttatttaactctttctctcctggagtaggtttacattccattttagctatgatactgctttaagagaaattgttttaagataaatttccatagacaggtcaaaggaggtgaatatatgtaagcttttcgatgcctgttactgaatctcattctggaaaacataactgtcaatgccctctttttctcatggtaaaaaaatacataacaaaatttaccatcttaatcgtttttaaatgtacagtacgatagtgttaactgtatgtaccttgtgcaacagatctctgaaactttttcatttttcaaaatgaaaactctgtactcattgaacagcagcttcccaacttccccattcctccatcccctacccctggtaacagtcatagaaaccgtgattttatgagtttgaccactttagatacctcatataggtggaatcatgcagtatttgtcttcttgtgatgcttattttatttagcatgatatcggggctcatgcgtgtgtagcacatgacccaatttccttcttaaggctgaataatattccattgtatgtatgtactacattttctttattatttatctatcagtggaaattaaggttgcttccacatcttggctgttgtgaataatgctgtaatgaacatgagtgtgcaaatatctctttgagagcctgtgttcacttcttttagaaatatactcagagatgggattgctggatcatatgataattctgttttaattttttcagaaccttcatactgttttccataatagctttaccaatttacatttgcaccaacagtacacaaggattccagtttctctccatctttatcaacactcgttatttcccgttttttttgtttgtttgtttgttttgttttgttgtgttttgagacacagtctcactctgtcacccaggctggagtgcagtggctcaatcatagattaccataaccttgaactcctgggctcaagtgatcctcctgcctcagactcccaagtgctggacttacaggttgagccattgtgccaggctgttttgcctgtttttgatcagattagttgttgagttgtacgacttttttatatatatgttctggatattaaccctttattggatgtttggtttgcaaatattttttcttattacgtaaattgcctttttattgtcttttttttcttttctctttttaagagattgagtctttctcttttgtccagactagagtgcagtgatgcaattctagctcattgtagccttgaactcctgggctcaaggagtccttctgcctcagtctctctagtcatttccttaaaaaaaaaattacagagcttataggcttcaatttgtctgtttcctagagaggttatagatgttattatccatttgtatttccctctagagattgttacttatctactttgggatcttagtgtgtcttgccttctcattgttctctgtcaccttccctccttggcaagtatttactttttctattttgcttatcattttggttatgttggatctttcaatgttatttttattagcaaaatacagtattaggagcaaatattttccaggtgacattttgggggtaatttgcatggctttctgtggctttcagtacttccttcttggtgtcttttctgtttagacacttgtaattggtactaaaaatagtgatttcagacaggctattaatttacatgccttggctcataatcatggtgagtgtgttttatgttacagctatacaaatgtaaatgtcagttttaaaaattatttaaggccaggtgcggtggctcacacttgtaatcccagcactttgggaggctgaagtgggcggatcacttggggtcaggagttcgaggccagcctggccaacatagcgaaaccctgtctctacaaaaaatataaaattagcccggcgtggtggtgcatgtctgtagtcccagctactcaggaggctgaggcaagagaatcgcttgaacccaggaggtggaggttgcagtgagccaagatcatgcctctgcactccagtctgggtgacagagcgagactctgtctcagaaaaaaaaaaaaatatatatatatatatatataaatgtgttcttgataaaagttttggattgggaacttattaacaggatgaaatttcacccattgtatccttagtttatttggaggcattgtggtgtggaaaaggagcttatggtccaatcaggagggcttaagaaataaagatgatagtttatccaacccactagaatgtgtacttggctagaaatagtgtcactagaataggagactgccttacattttattcccagcttgcagttcaagtatgaatgtagtaggtactccataaatatttctcatattgcacatacatcaatcaaaaagacttctagcattaatagagtcagatggatttggatagaaaagactaagaattaaagaaggaacatggtttggcagggagataggaatatatgttctaaatatgcttatagtcttacatataatcactgaaaatctgtctgtgaatataagttaaattggtactttgctcctaaggcaggtatgtaagaatgtgtgtgtatacataggtagaagagacggtgttggttaaatttttattcttgaaaggatattggatatagtgctcaataaatacttcataaacacattttcagtgctgttctattgaagttagttatttacttctttttttctttttcttttttttgagacagagtctcgctctgttgcccaggctggagtgcagtggagtgcagtgattgaggctcactgcaacttctgcctcccaggctcaagcaattctcgtgcctcagcctcccaagtagctgggactacaggcatgtgccaccatgccgggctattttttttttttttttttttttttgtatttttagtagagatggtgttttgcctcgtttcccaggctggtctcgaactcctgagctcaggcaatccaccctccttggcctcccaaagtgctagaattacaggcatgagccaccgcccgtgtccagccagttatttacttctaatgcattctgagcctaggagacatggatggccttagcacatgttagtagtagtttttaaaaaacacatttcagaagggcaagcagtatgttgacagtagtggaaagtgcttgctactagtaaaccagaacaaaaattctgtaaagagggaaaaatgcaaacattttgcctgcctgagacatttggcaaatggatgattaatcttccatttcagtatggaagttggaatattccatatggaagttggaatattaagtatggaatattattttatgagaacccagaatgagaatgatgacgatgataccacatggcctttgagaactcttactaattttctacatattatcttgtttcagtctttcagtgctgcaggaaggtaggactggtacattttcattttatatatgaggaaacataatctgaatgatcacgacttccccagatgtactctgctggatgtggagagctctacaaaagcttcgttccaaatctgttgtctctaagagaataatctggagtccaagaaaaatttaaactactttttttttttgagatggggtcttgctctgtcacccaggctggagtgcagtggtgcaatcatggctcactgcagccctgaccttatgggctcaagcaatcttcctacctaagcctcctgagtagctggggccacaggcgcacaccaccatgcctggctaatttttttattgtttgtaaaggcaaggtcttactatgttgcccagactggtctcgaacccctgggctcaagtgatcctcctccctcggcctaccgaagtgctgggattacaggtatgagccactgcctggcctaaactacattttctaatcagtttatagggctaggaacatctcatactttttaaagaaatgttttctttccaaataattgaaacaaaattggaatcggaagtaacagagcttcagctttgcattacaattaagttttccagctggggttttactgggtcatttttagtaatacaactactgtggttaccagcaacaacatttattgttttctgtatgtcaggttctgtctaaatgcttttcatgttttatttttgaaaaatttcagaacataccctatgagcagatgctaacagtatccctacgttacaaatgaaacagggcatgaagggacagagtaataactttttcaggggcacacagcttggcgcagacaggtctgggattttgatctgtgatgtctggctagagagtacgtgtccttacccagcctatacctatactacataaaagttgcagacaatcttccttttccttgcaaaggtgttgttcaaaagcacagtacagctgtggtaggagccatggaaaggagcaccaagcagtgtatctataccagagtctggccagtgtgtctgatcttatgcatcagaattgattgtaaattagttcagaatactgaacctgaagtcatatcgaggttcaaaatttggcttcatcattttctggttgtgagacattggataagtcactaaacttctctaaggctgatatctcacatatgcatgaaaattaggtacaaatctgttactagtactggtgctcaatagatactgatttttgaaactgaatattagatacttctgtaaaatgctaactcagtggttcccagtttaaacgaaacattttatttctttagagacaagtgtgatattggacatagtgctcaataagtacttcataaacacattttcgatgcggttctattgaagttagttatttacttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcatcgttttagccgggatggtctcgatctcctcctgacctcgtgatcagcccgcctcggcctcccaaagtgctgggattacaggcgtgagccaccgcgcccggcctacttctttttttttttgagacagggtttcgctctgttgcccagcctggagtgcagtgatgcgatctaggctttgagcctgctctcaggctcataggccattctgaagaaacaaacatacaaataggctgctgtagtagagtagatgttgtgaaaagtttataaccctggctgaggaggaagtgagcaacgctggctggggtcttcagaaaagaattcccaaagtaggtgacctttgaacttggacttgaaagctgctattgactgaatgtttgcatctccctcacccccattatccaccactctggcagtggtagataatgctgaaagatttgggttccatggatgggggtggggggtggagttgaggagaattgggttggggttgaagaggagtggggtggggaggaggagaatgggagggctggtacaatggattgcaggcctgtgggaatgggggaatggtaaagggaaggcaaccggaaagggaaactgctctttggagaagtcatgggtgttttaaagggaaatttggattaagtgatgggaatttgcttggctattcccaagcaaatattcccaagcaaatagactatagatattaaatttgaatgtcgtttttagttcctcagtagagaggatgagtagtttggcatttgtgtgtgtttgtaaaatgagagcagaaactagaggcatgggagaataactggatttgctatgcctgtggatgccactggttttagttaagatgcttttaatgcaaaatgtattttaatagtgatatcgtagagtttgaccttcaagaagctcaagtctgtaagcaataattcactttaatgtgtaagagccttgcagagaataagaacatattaaatatttgcagaatgaaagtattatactttccctgggtggtatgatagccagagaagcagtttagtctagaggtgacatttgggtgaaattgtagtaatgctgtgattttagaattttaaccagtgatttctaagggccaacctgaagcttgttttcatcgtggagtgccttggctatgggactgatttgtgcagcttctagatttgttaactattctcgctcgggtttttttgagaaatgattttcattccagaacagcagttcctcgacctgagagtcggtcagtgcttttcttcaggtcattgttgagggggaaacctatcggccaagcctgcctctcctggtgactttatagtgctgtgactttatagtgactttacactgctgattgtgtcagggattcaatgaaaatcctgactgatggtaaagagggcatggcagatttctcttggtttaggagttttatttttcccagcattaccatcctttcccaaacttatttccttttttttttttagccttcaagaggggcctctggttccaggagccctgtcttcgccttggttgggctctgtctggggctgtggtcactgcagatgacattctcttgactggattattaatttcatgatgatgactatagatactaaatttgaaaagtagtgaagtctgatgaggcaaccagcttttcaaagtgcattttgtgaattccctccaatccaaagtggagcgggaacctcaaatcactggttagacttggtattattaaataatcagctccattttggcaaagagcagtctccctttctggttgccttccctttaccattcccccattcctgcaggcctggaatccattgtaccagccctcccattcttctccaccccaccccactcctcttcaacccgaccccaattctcttctactctaccccaatccacagagcccaaatctctcagcattatccaccactgcttcttatcaccaaatccagtatctactcttccctctcaacctacttggcatccccacagccttggaaagtccagcactgcatttcttaattcgtaccttcctttccccctgagatgttcacattccatgctcatttctccttgtttctcctattctttttcctgggccatctaaacagcttaatagcttcaaatatcacacgtcctcaggtctcctaaaccttgatatcctgcccagctctttctcttagaaatccatatgtcactcctgaatctacccacatcaacatcccacaaagacttggtgatggttttaaaacatgttcacacattcgttgatactcctccctccaaaaggtgttctgattcccctctccttgaatatgggctggcctttgtgacacatttctaactaatagaatgagacggaagtgacaccatgtgacttctaaggctaggccataaaaagccacacagcttgtacctgcctctcttggaactgctgccttgagaaccctgagcgaacatgtaagaagcctggacaccctgagtctgcatgctggaggccaggcagacagagacaggtgccaggaaacctcagttgctaggtcttcctggtgtcagtagcccctcatgtgagcgggtgcaccttcagatgcccctagcctcagtcttcaagtccccccaactgaggctgagtggagcagagaatagctgtcctgaccaagccatgcccaaactacagtagtgtgaccataataaatgctgttgtttaaaaccactaagttctggggtggcttgttatgcagtattggataactggagcagaccttaaatatgatgtaccccccaaacaaatgcatcatctccatcccttcatctgctcttctttctatattttcttttcttttctttctttttttttttttgagatgaagttttcctcttgttgtccaggctagagtgcaatggcacaatcttggctcactgcaacctctgcctcccgggttcaagcgattctcctgcctcagcctctcgagtcgctgggattacaggcacacgccaccatgcctggctaattttgtatttttagtagagacagagtttctccatgttggtcaggctgatcttgaactcccgacctcaagtgatctgcccgcctcggcctctcaaagtgctgagattacaggcgtgagccaccgcgcctggccctttccgtattttctatctcagtaacttctccattcaatctgaaagattttctctacttttccttttcctcagatgcctcgagtccccctccactgctcaacgtctgactattccaaccctgagccttgcagaaatccagcactcacaccccatgacaccccctacctggtttgaggattcataaatgcctttttgccctctcatacctctgcattgttgcacttgctgaatcttcttcgtaaatttctttccttgctgttctctttattctctcaccacctcaaatcactggaatagggagacccaaggaaagggagagagatggaggaacggccagtcagtggagcagtcagaacacacacaacatttattgattaaatttgctgttttatacaagcatggttatggtgcatgaaagcaattacaatagtaacatcaggcctggagcagttgtttatgcctgtaatcctagctacttgggaggctgaggcaggaggatcgcttgagccctggaagcggaggtgtcagtgagccaagactgtgccactgcactccagcctgggtgactgagtgaaaccttgtctcaaaaaaaaaaaaaacaaaaaaccaaaaacacaaaaagccaaccaaccaaccaaacaaacaaaacaaccccaaaaaacaattataatagtagcctcaaaggtctctcatcacagatcatcatatacataatttatgtatgatttatgtattatataacattttgttctgcaggaataatagaaaaaaaaccctgaaatggatttcctactttgtttatttattagttaatttcattgctacttcaaagctaatgtaggtgttttgtgtgtgtgtgtgtgtgtgtgtgtgtgtgtgtgtgtgtgtgtgtgtatgtcatgattcaaagcatagaagaaacattttgaattattaattgagaatttaaaaatcatacttcattagtttagctatttgagtttctctgtatgaattttgggctgaggagaaacatagaagccacagcagctttcccttttcttgattcaaaggtgtcataatttaaaaactttttagaagatgaagaggacatttgattttttgttatcacttaaggggagagggaagtaagcagtgagtcaattgcaattcaaatccggtgccatcccaggacatagacctctgtagtattgtcacgtccaccttgggctttgcgcacattggccaccagggagggttcgactccagagagcctcacctgtgtctagagcttggggaggctgcgggctgggcctgcctcttccacaggagtcctgggagccctcctgatactccccatgggggacaacagggcccgttgcttctctgtctctcttccttctcctgaccaagttgcctgcccatgcagtcaccctttagcttttgatgataatattattttttagaattttaaaggtgtgttcattttcccaccaacactcctacttcataaccttattttgtgcagtgaacaaaagaagatgtgattgtgtccttcacagtggggcaggttctgctcatcctttttgtagaggttggaaaaggtgagtgaaagggcgcatagggagggatggggatggtttgggcctttctgctgttgaagagtttgaaattcttagttcttttcaaccagttctatgtggaaagaaaggtattttatttgacagtgatactaacattgaaggagtgtttcctagggcctggctcccgccaagcatctatgggcagcaaatgccctgtttgtccctcacatcagccctgggcagatgtattttcccttttcctgttttactgatgagggagcttaaaatttagggagattaaggacctccccaagatcatagagtttatcaccaatattttactgactctccataatatagagagctcttatcttaaatgaattggttacagatgtaaatttgccaaaatggaggtgatttatttaataataccaagtctcaaatgttggaggttttaactttgaattattgacttaacctctagtagaatgttatgatgccagtgtagccaaaaaagaaaagagaaaaagtcttgcttttgttgattttaaaagtgcctgggacctaggaggggagagggcaatgatgagatgtggaaagtgctggaagggaagcattctgcttacccctgtccagccttcttgagggatcattgctccctttgaggaaatagtttttccttccaaggcaatatactctgcttattccaagggaagccaatggacagctcaccgtgcgggccccgtgtcttggaagcacctgtggtgccattaacttccttcagttcctggagcattgcagtcaaagcagctgtacttaatgtagttcgtattttcctgcacttgaagtaattctttatcattttttgcataagttatacataaccttagtggagaaacctgtgaaagcatagaagtaagacatttctttgtaataaaatcctagtaacctcagcactctcctcccacatttgttagtgcctaagagtcttcttttatttaatatacatataaattcagggtcaaatatgctatcagaaacaattctaatgaaggtaaaaactaattttattcacaaatgtttttgtgtaccctctctttctcccctccccagcacacaccccgtcaagttgatattcaggttcttaatcacaagcatttacttgccacataggctgtctttggcaggcctatcagtttcctcaattcgaaggaaacctgagatctgcttgtgcctggcattttttttttttttttttgagacggagtctcacactttcgcccaggctggagtgaagtggcgcaatctcggctactacaacatctgccccccaagattcaagtgattctcttgcctcagcctcccgagtagctgggattataggcttgcaccaccatgccctgctaatttttgtatttttagtagagatggggtttcaccatgttgacccggctggtctcggactcctgacctcaggtgatctacctgccttggcctcccaaagtgctaggattacaggcatgagccaccgctcccggctgcctgacatctttcatgtgagagatctttggagctagatgcaccagttactcttttggatattaaatggtagtgggtgttttttgttgttgggaatgagtgtttaggaggaagggtgttttcatcacagcatttcacacctcctttggtgctgccattcgagtttgcttctgcccatgtgattctgtcaggtactatcaagggttggcctggcttcttcatcctcctgctgaggatatggctggcctctctccccggtcagctctctacctgtgggtaggaaaaggtattcaagattcacctcctgctcctggggtcgggggggcatgaaaggcaggtctgatcttctccctttctcgagctgttactggctatttagaaaagtctgttctggaaggtgcgtctaaagcctgggtgttgcctttctagcgttgcagtattctatttttgaagtgatagagaggtgcagggctcttgtttatattgaaagctgcttaccaggaagtacttaggtctcttctgacaaaaatcaacataagcgcaattaacattgtcttgcttttaacttaatttgctttctaattcatttagcaatggatgtattactaaatgaccttgtaatatatcttacacctgtcaaaagacaaaattacaacaaatttagttatagatctaattggcatttattcattatttggtaagtgggcagcctccattctataaaagagactgagcttccactgggcaatgtcagaacagtgccttttataagggaacaaagaaacagaacaatagaaaaaaaaagctgattggttaacaacaagttacttcaggttacttcttttaaaggttaaagcagaagagactttcttattatgctgattctggtagtttggaatctcctgtttccagaaaaaactgatctttttttggggatctactgcttctttaaagtttcaatatgattatgtggcagtaagcatgagtgactcactttggtgtggtctggcttttgggtcctagtgcaggagcttagtccaaaaacagtggcctcccataatttttgtttaatatactttaacaatcacttcggctgtttcttcaagttttaagcctattctttttagaggtaaaatatacttttgttatttctctttcccattgtaatagtctgttctcacattgctaataaagacatgcctgagacagggtaatgtataaaggcaagaggtttaattgacttacaacttcacatggctggggaggcctcacaatcatggcagaaggtgaatgaggagctaagtcatgtcttacatggtgacaggcaagagagagcatatgcaggagaacttccctttataaaaccatcagatttcatgaaacttattcaccatcacaagaacagcacgagaaagacctgcccccgtgattcagttacctcccaccaggtccctcccacgacacatgggaattatgggagctacaattcaagatgagatttgggtggggacacagccaaaccatacctttcttcccctggcacctcccaaatctcatgtcctcacattgcaaagccaataatggcttcccaacagtcccccaaagtcttaactcatttcatcattaactcaaaagtccacggtctaaagtctcatctgagacaaggcaagtcctttccacctatgagcctgtaaaatcaaaagcaagttagttacttcctagatacaatgaaggtacaggcattgggtaaatacagccattccaaatgggagaaattggccaatatggaggggctacaggctccatgcaagtccgaaatccagtggggcagtcagatcttaaagctacaaaatgatctccatgtctcacatccaggtcacgctgatgcaagaggtgggttcccatggtcttgggcagctccacccctgtggctttgcaggtacagcttccctcccagctgctttcacgggctggcgttgagtgtctgtggcttttccaggtacacagtgcaagctattggtggatctgccattttgggatctggaggatgatggccctcttctcacagctccactaggcagtgtcccagtggggactctggtaggggctccatacccacatttcgctcctgcactgccctagcagaggttctccatgacagccctgcctctgcagctaacttctgcctggacatccaggcgtttccacacatcctctgaaatctaggcggaggttcccaaatcacaattcttgacttctgcatacccacaggctcaacaccaggtggaagctgccaaggcttggggcttgcaccctctgaagccacagttggagctgtaccttggccccttttagccatgactggagaagctgggacacaggacaccaagtccctaggctgcacacagcaggagggccctggacctggcccaggaaaccatttctccctcctaggcctccaggcctgtgatgggaggggctgccttgaaagtctcttgacattcccaggagacattttccccattgtctttatgtttgtctaacgtttgtctcctcattacttatacaaatttctgcagctagcttgactttcttcctagaaaatgggtttttcttttctactgcaaattttccaaacttttatactctgcttcctcttgagtgctttgccacttagaaatttcttctgccagataccccaaatcatctctctcaagttcaaagttctaccattatctctagggcaaaaagccaccagtctgtttgctaaagcacagcaagagtcacctttgctccagttcccaagttcctcacctccatctgaaaccacgtcagcctggactttattgtccatatcactatcagcatttagattaaaggcattcaacaaactttcccacattttcctgtcttcttctgagccctccaaactcttccaacctctgcctgttacccaattccaaagttacttccacattcttgggtatctttacaagcagcacctcactataccagtgccaatttattagtcttttctcacactgctaatgaggagacatactggaaagtgggtaatttataaaagaaagaggcttaattgactcatagttccacatggctggggaggcctcacaatcatggtggaaggcgaatgagaagcaaagtcatgtcttacatggcaacaggcaaggagagcgtgtgcaggggaacgggcctttataaaacctttataaaaccatcagatctcatgagacttactatcacaagaacagcattggaaaaatccgcccccatgatttaattacctcccactgggtccctcccacaacacacgggaattatgggagctgcaattcaagatgaaattcgggtggggacacagccaaactatatcacctatgtagtggcaaatctttttttttgtttggttttgttttaataattggatatttcttttatatgaggctgtaacaacactttttgcttcatcttctctgtgtaaataacttaagctttttaatggatacagctaaaaatttggccttgttaaaggaggaaaaaaataggctgaatagtgggaagtgagcagaactgtgtttgcttttaggttaaaaaaagaaatgatttttctctgtacaacagagaaacatggcccagaaagtggaatggcatacagctgtttctttgtagttcttcagtcttcaagcatgggcttttgcttgtatcaaaatataagtgggttatgatgacctcctagaatccaagagaataaagcttgaaattggagtaactgatgttccccaaaccccagagtgagaatgtgcttttatttagcattttctcttcagcaaaatctgaagagtgcttgttacagagagcaaaacttttacttgatcttttgtcagaaagttaaagaattaaaaaaaggctgttttagatattggctttaaaactgttgttttatgttgttatgtcaagggtgatgccacacactgttgacatcaaatccaccaaaatctcacttaaaaacaatttagggccaggtgtggtggctcttgcgtgtaatcccagcattttgggaggctgaggcaggaggattgcttgatcccaggagtttaagaccagcctgggccacataggaagattctctctgtacacacacacacacacacacacacacacttagccaggaatggtggtgcacttgtaatctcagttacttgggaggctgaggcaggaggatcacttgagcccgggaggttgaagcttcagtgagctgtgattgtgccactgttttccagccggggtgacaaaatgagaccttgtctcaaaaaaaaaaaatttagaagtggaaaatttgtaagttttaataaaataccacttactttttagctctggtttggaacctgacttacagcaatagtagggagattaataaggttacctcttaaggcagtctctcaaatgaaaattgagtatagttatcttatttttagatttatagatgtctctaaaccttattttaaagtgagttcctgactactcttgtggcgtttattttatctttacaagcattggcagtaatggttgatttcacttctgattatgaagttagtaggaaataaagtacagggggtgtggggggtgtgtgtgtgtgtgtgcgtgtgtgtgtgtatgtatgtgtgtgtgcacattttccaggccccactgtcttgaagaggcttgattagggattagaatggtagtggctagagggcctcactaaggtttgttccataggtctcagagctcccttttttgtcgcctttgccctgctgccctgctcaacaacccctgcaaatgtaaggatgatggtgggggctgggagctggggtggccgctgccacatgtagtgctaaagaatcaacaaaacaggacagcaaaagactatgcaaatagtttagctttctcaaacaaggtcttcattgttcattctttttcatcctttggtagctagctgtccttcctactagtgttgactgtttgtcatgtactctctccaccggagtcaccagtaagaccagctgaactctgttgagagttttggagtaaaattctgattggacgtggttttttgtgctttttgtgatcggcagtgtttcagtagctcttagttcccggaacctcattctcctatcccgtcagcgaggtctcccttatttttgctgagatgcatggttaaccatttccccaggctcctccctagcacctgcagtatcttaaaaatggtacttttaacttccaggagcaatacatgaacacaagagtatagataaagataggcaagagtgtagataaagagagttgtgcagagacttcatctggtgcaagtctggccaaccttttcttagtgatttttatgcctgcccatgtaggccagtggttctcaagcttgttaaaacaagacctcacaccctcagagggcttgttaaaacagactgctgaccccacccacagagttctggttcagtaggtctgcggtgaggcctgagaatttgcatttttagcaagttcacaggtgatgctgatactgctggttcagggaccacatttgggaatgctatatagcatgggatttttttgtgtgtgccttttagaaaatcaaatgctgtcatgcttgtgtttctgtatttttcatcagctccatgtcatggagcactttctgtgctagtacatattgatcacttcattatttttaactgctacatagtgtacccacatataaatgtgccttaattctattaatggatacttgattctttccagtattttttgttaactattataaataaatcctgcattgaacatctttgtttattcctcctttatgcagctatgtttgtctagggtaatatggagaagtgaaattgatgaacatgtgcactttttgttctatttttgttttaatagataatgggaccatcactctatgatgctcaccacattaatgcccggccttaggtagtttgttttattctctgcctaagctgaggctaacctggagttgctaggaaaatcataaatgtgcttactagaccctttataaactgaacctgaaatgggctttgggctgctagccagtttttctaagtctttttgtagactaactaaaagcagtgatagtcaactgtttttttcccctaccagcacacctggtaaataagaattgcccttagcaacaatggctcacttaggtgaacttccaggggctatacatccaagtatatttttttgcacgacttcagtgctagacttttccaatctggatgttcttacctcatgttagattccgtgtatgtatagccaaatacagcattctttgtcccctctgccttctaaaccagtttgtcctgtttctgttctgcacagtgatgtgtgttaggtgagttgggctgtaggcagggcaagtgggtgttacgtcctagcattaccctttttaattttttggaattcataaattaaaattgggtgggggagagctcacactgagttgtctactccttgttttgccaagttattaaaatcaactaacaaaaagccaccatgtttttatagatatgagatttttaacactcctcctccccttccaaaaaatcaggaaaaacattatctcagaataaagggcattacttttaaatttagtttcaggaacactgtgggttttttccctcctcctttcatctcggacaagtgaaaatgctgctattgtctagagttgccctaggttgtagagaaactgagtcatttcttgaagaaaagatttgatgtctatattacatattcctaattagttccctattagtttgtcatactgctgatgatgttcctgtctaatagtaacttctggggcatgaagtgggcccggaatgtgcagtactcctgaaagaagaaaaattcttatgattcctacagtcacccattcccattcccggagcacctgctatgtgcccagcactgagctgagtcctggatacagagaagtaggggaaggtgttcttgcatttcggctgctccttcatagtctagcttcttcagtagcacataggcaactttcccgtgaaaatgtgttcgaccttttgtggtgcaactgccatgcccgctcaaagatcacctgccatcaaaatcttcacatagattcatcacttctggccacatgctaggattaaacaagattactgttatatctttgagccttgtgggagaatctgcttttcacttagctgttcatgcagggcagggtgaagcaaagaaatcctttctcttgtaaggaaactttgatatctcttacctacttctgtgcttctgctttgggatgtgaaaatactctactaagtggcaacaaaatttgcaccagtttttaacaccagtgcttcccagataaagagtgaccctccaggagttcttcagctgagcctgagttagttgctcattttgaacctcatgtggtgtgtagaaatgaattaaaaaataacccacagagtaactcattataatcttaatcctttccacacaaccaggatataagggcttattaggctttgaatagatactatgcttattaggtttttttttttggttgttataacttactggacaaggtgctacagggaatgagatgacctacaaatttagacaatccttgagtttggttagaatgcacaccgaataccatgtaaaaaatgcacacaaaaagccatgtcaaggagacagtccaacacctgtctgccccaaagaactggttgtggtctccctttctgggtgtatttcagtgactctgatagaaaaggtgtttttgaaggagggatgggtggctgtgagttgtgtgtgcctcccatgaacttccctgggaagaccactattcagaaacctaataaatatttaatgtaagaggaggcacctatctgttatctttcatagcgctgaagggcatgctgcagttgctatggagaggcaggtgctggctcagctgtgtgacaaagacaggccctcaggaacaggagcaggagcaaaaggtcatttaacctcagctggaagtgcctagttggttctgatgagtattgattagtttttttatgggctgtcccatattctaatatatgtaacatttttaattgttcagtgttttttaaggcactgttttattttgtcagaatttggcttctaattgcaaaatcctagccttgtatgttggtaatattaagatgtaatttatgtactaattggaatattgtgatattcttcatagtaggaaaaagaacaaaatattatgatatatgtaatattacaaaatattacacaaatttttcctgacagagattactttcatttgaagaaggtgaaagttctggttgattctgattataccttcaacatttttagaagctgattacagaatttgtcatataaaattaaaatttttgttgtataagaggtatcctttggggaaaaaatttaaattttagagtattttacatggatttcaccttacagattcatcaacaaacaaactaatgtgacttttatgattgtttaaaatgttaatttttatgtttcatgaacattacaagaacataaatggcatttttctgtaaagtgttttgcatatttgtctgctttgatgtttaatatggtggaatgtactaaaatcttaataaatgtttagcttcctgttgcaatggaactatcaaatcattagtaagtttttcattgtttctactttcttagttccctaagttagggttatgtgatactaagttctagaaatgataatttttgattgatcagttggtcgcttttaaaatgatggacattttgttaaactatgaagcttaaaaaaagagagaaatgaatccatggctcctgcacgtaaggaaggtgtagacaggtggtggatgctagcatatgagttagctacagtaagctattaatatatagggtggtgctgtgtataattagctcactgtgggtggcttcctgccaagttttaatgagttttggtcaaagagaaatgtatgtcccaaaggagccaaacttttaattggggttatacgtaagtctatcagtgaagttgagggttatgttttcaaccctggaccctcattcgggatttgtagcagtaaaggcaaataaagatgacttgactttgggtccttatgttagggtttagaccttctcattctggatacaacttctcgaagcctggctccagagaggggaaaagaagtgagtgatttgacaagcattgttcttggtggtatatacaaactcctagattgatcatatttcatcttttcagcagttgccttaataatttgtagtaattttcagatgggagatgtgagagtccatgaagtaggtactttcctcctagttcatatggttcatagtggagtcaagatccagaccccatctatttaattcccaagttcatgctttgtgaccatggtcaccagatacttaagacatggcagctgatttggagggtgttgctctgttgattggtgaactacctacttttacctcacttcccctgagtgtgtgcatccttacatgcacatgaggaaatacatgaatgtgtgtgcgaggtcctagctcttgctggattctgggcacaacagtcagcagtgtcgtcaagtcagagtttctatagattattcctccttccctattctcttttaatgggactgtaagggagagtgtaggggtaaggaagggaaggttgagttctgcccaggaccagtctgattgtgctttctttttgtgacagagcctcactccgttgcccagggtggagtacagtgacatgatctccactcacttcaacctccacctcctgggttcaagcaattcttgtgcctcagcctcctgagtagctgggactacagttgtgcggcacaacacctggctcatttttgtacttcaggctggtctcgaactcttggcctcccaaagtaatccaaagggattataggcatgagccactgtacccagcctgattgtaatttttgtcttcccctttttgctgacctgctttattttccagttgtggtccttgactagagacagcgtcttcacagttaagcctttattactgtggaccagcccaaccttaatttaatgtccaacaggatcacttcccagtttttcctgtacacaggtacggggtagatgagaatctctgatatgactaggctaactgctctccatgagaagatacagacccgatttgtgcctttgggagctcatggttagtatggaatgcaggcatatgagccttaattgcaacacatgacagaataacgtcactgttagagactgacccatgccatttaagagaaagaagtgatgctggtgagtgagattccaaagcattttcataaaagacaagccactttccttggatctcaacttttcagaattttgatagacctagggaagaacattccagatgaagatggtgtggctattatcttagtatctattgctacatattatcccaaaacttagcagcttaataaaatatttttttatttttatttttattgtttttttgagccagagtctggctctgtcgcccaggctggagtgcagtggtgcgatctcagctcactgcaacctctgcctcctgggttcaagtgattctcctgcctcagcttcccaagtagctgggacaacaggcccgcaccaccatgcccagctaatttttgtatttttagtagagacgggatttcaccatgttggccaggatggtctcgatctcctgaccttgtgttctgcccacctcagcctcccaaagtgctggcattacaggcgtgagcccccgcgcccagccacatttatatctcacagtttctgcaggtcagaaatctggggctggccaagaaagtggttctggctctgggtcttccatgaggtcgcagtagagttgttggctggggcatcagtcatctcagggctggaggatctgcttccaagcttacttgggtggtcattgacagcaggtgccagttcctcaccccagggacctctccataaggctgttcacaacgtggcttccctcagagcaaatgatgcaagagaaagagaacccaagagctgtattattctgttggtcacacagaccaaccctggtgccacgtggaaggggcctacccagaggtgtgaatgccagtgatattgggggtcatagagatgacccactgggtaatgagtaaggaaaggtacagggcgtctgtagctggaatttaggggattaggagtgatgtctgggaggtgaggctgatgtgtcgtgagttgcatggagtatgaatgtgatgtggaattaaccttcaaacagcttagtctagtagtggagttacattttgtatgtaactgtggaaagtgacacatgcacagagccacagatgatccacgtgttgctaacactgggtggtgtggttcatccatgcctcataatgtcatgattgatactctttctacacacacacacacacacacacacacacacacacgagttgtattgcccctgaaaatgctcctcttggtctgttcttcctgccggtatgacagaacttcctgagattgttgagtttagggttaaatcaaatctgaggtgacccactcgttagtttggtagtgtttccccatcgttttcctgttgctaagtggtgcaggagtagaagctggtgcaatagtttcctagagtgcggtgcagctaacccttttacgtacatcatattgtttagaatttgttaccaccttcaaccaattcatataaaaatagattacatgtgggagttgtatttgtttgtgtgtggtgtgcatccaagtcagtgttaattttaagtgagtgtcctgcactctgggtgtttttcgtagctacaaggaagccttaaccgttgttacttacaatggattacttttcaaaagttgtttaatctctttcaggtcattaatggcttggagactaataagcaaaaccattaaatactactttatgtctgaaaaaagagttaatgttcctggaaaaagcgagctgttttctttagttaacaaggtggagctggtgttcccagtggttccggttctaataagacttgatgagttggaaatgatgttattctggagacaactgtggagtaattagaattttacctcattttaattaaaagattctaactctaacctaccttcccaggcatttgggaaaggcacaggtaggtctccttgccagtgaggctccactactcacttgtggggttgacatcaggagaacccaggacttgggccttagtgaggtctcacgttctcaccactaaacaaagagaaagcatttatgcaggcatcgaaccagcgtctgtgtgtcacagctggactggtgctgaaaaaatcaccagggccttagcataaaacaaaggctgctttattatgttgagagcataaataggcttcttttcttttttcagtcagatatgaaattagagttgcttactgctaacatggagcctgctggattgagctgttttgctcacttctgccagataatcagaagagccgggtggggtcccctagctgggtgactgggagtcaggcatccatcccccgaacatcaggctccccatttgtaaatgtcttgtattcctgtcaagatggttaggaggattgaaaaacgccgttgtattttatttgattttgataatacacttaacatgagatctaacctcttaacaaatttttaagtgtataatgcagtattgttagctatagtgttcaagtgcattgggaggcgctatccaaatgcaaccccttccccgccctcacccccaccccccgtttattgctacttgttattttcatggttgtgctgaatttttccccaaggcaaatctttacctctgcccttgaagttgcatatgccccagagtgggtaattattaactgtattaatctggaccatatactgtacagtctttggataacctggacagtttataattttaaatgttttaaaagtttgcaagtctgaaactctgaaaaaattttttttttcataaaaatactagcctaggctgctgatggatgtgggtttctttttggggtatgaaaattagattgcggtgatgtttgcataactctgtgaatatactaaaaaccagtgaaccatactctttataaaaaaatagtggattttatagtatgcgaattatttctcaagctgctattagaaacaaaacactgtcctaattgttactgtaaaaatacccttattttctcccctccctgccagtgtcttaggcagagcagccattcagtaaatacaggtggctgagtgttgaataatatagttgaaataatccaagtggcacaaatagatgagagtggaagtgggggctgcagtgtcagttgtagaaatctcacgggaggcagactcatggggtggctgagacggtggctcctttgtcagtggaggcactggaggaagaagaccccactagcaggagaggctctgggtcggaggggctgccatgatcctggaaacaggtcatctggttggctcgtgtttgaaagttgagaatactaatattttatggtccaaattttggttaccttggccttgtaaatcaggaagccgtctgatgacaggatgagcctaaggtggggaggggaggatgcggtgagccacaggttctcaatgttcagagagccagtgtccttaaatagcgaggtgaagagctcaattaggaaccaaagccaaaaatgagctgaggcaagatggtagaacccaggcctggatctgagcagttgtcaaaagtctggttacaacatttgagagtgtggtgttcagctacctttttggattcagttttagttttttatttgcatattctttttctttttgataaagctctatgaggactatgttttcaactccctagatgcatatagtcctgtactcagatataatgtatctaatctcttcccagatttataattgcaaaccataagccactttgagttgtgttccagcacctgccgaaggagacgactaaatgatatgaaccccattttcctcctaagagggcattcaaattctcttcctcttggattttatgaaatcagatttcagttggaagattctgtcacttggcctcttattgtcaaacacaggtaccttttaacgcagacttctactgagaaataattagagacagggtctcatggtcaggcgcggtggctcatgcctgttatctcagcactttgggaggctgaggcgagcggatcacctgaggtcgggagttcaccaccagcctgaccaacatggagaaaccccatctctacaaaaaatacaaaattagccgggcgtggtggcgcatgtctgtaatcccagcaacttgggaggctgaggcaggagaattgcttgaacctgggaggcgaggttgcagtgagccaagatcgtgccattgcactccagcctgggcaacaagagtgaaactctgtctcaaaaaaaagaaaaaaaaaagaaaagagacggggtctcattctgtcgctcaggctggagtgcagtagcacaatcatgactcactgcagcattgaactcgtgggctcaagtgatcctcccgccttggcctcccaaagtgctggaattacaggccaccctaccttgctgaaatatttaaattctgaaggaccaaactatccccttctcaaagaacaatatgaactagcaccgttataaacttggtactgctgtaagagtcctactcctgagggcttccacccatcttattttcatacttatgaaaaataatacatgttcaaagcaaatgaatccaaacagtatgcaattaaaactcaaactctcttagcctagacccatttctcccagagcggctgttatgatcagcctctgggtgtccttccagaaatgtctaggcaggtaatgtatacaatcactttaaaagttcaaatgggaacatgtcatacacattattctgtactttgcttgttttaactgacacgtatcttggatattaaaaaaaaaatctaacatatagtttccattttttaagaaaaaagctttattgatatataatttgccataaataatcaccatatagtttaccttaaaattcacttgttttaaatgtacaattcagtgatttctagtaaacttacagagttgtgcagtgatcaccacaatctaattttagaatattttcatcaccctgtgtctatttacagccactccacatcccgtgcccgcaggcaaacacttatctatttagtttctatagattgattttattactctttttaatagcaacctgtggtccattttggaaaaatacaaacatgtatttaattgtgctttatccaagcacatttagcttttgctgatgttttattttgctgcctgcctactttaaaaaaaattggaaaagattgaaattttgtctttgagccatacttgttaagagtgataagggagttttagctgaagttgtttgtagattttccagtcattacctgtggaactaggagaagaattttggggcctggataattatttatatttgaatagaaactgcctgaggttgttcttgattagatgaaagccccagcatttattgtgtattttatggatgtgggtgaagtggaactaagtatttacacatgattggggtgaagggggatttattatttcagttttttgcctttgtctctacctaggaggattttaggagctgttgagtgttcagaagtatgtcttcggatatattctccatactgtttcttgggaccttttactgggttgtggattttgaccaagtgtttttttaagaagaacaaagtagtagaacagtatgagaccaaaatgtccttcatgttctaatggtgagcactgttttcttttttttttttttttttttttttttttgagacagagtctcgctctgtcgcccaggctggagtgcagtggcgtgatctcagctcactgcaagctctgcttcccgggttcctgccattctcctgcctcagcctcctgagtagctgggactacaggtgcccaccaccacgcccggctaattttttgtatttttagtagagatggggtttcaccgtgttagccaggatggtctcgatttcctgaccttatgatccacccgtctcggcttcccaaagtgctgggattacaggcgtgagccaccgcgcccggccattgttttcttaaatgtcaacttttgtttaaatgtgtgtgtgagtgtgcttgttttttttttaacctcaaagactgaaatttttttttttaattaattaatttattttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtgtgatattccccttcctgtgtccatgtgatctcattgttcacttcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttactattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgatttccacaatggttgaactagtttacagtgtgcttgttaagtagtaattatcagaaatgttggaaaaccagtgccttaagagtaagggtatattcaggcttcctctttgtcagagctctaactctcctggggggcaggtaggctggggcaggtagggtgagaagactcaggtagttcaccgagataaaactttgttgaggttggctggggaagtgagccagttgtcttgggaagtgggaggtgaaaatgaaactccctgtgtgaccacttttctctatcaaaaataataaattatttcaaatgttctaaataaggaggctttggatagattttagtcagcttgttagctattcaattctggcaacaaccgtgtgtacatctagactagggagacgtttacaattaaattcactgggtcttgtggttggaagtaacctgaagggatatctatgcaagtttccatcctgtgtgtgcatcccttctgtaatacctctgcctggcagttcagcatctgcacttgcgtacgtctcctggaagggaattcatgaactctcttgggatcccagttcttgtcagcttcttcatgttgaaaccctcaggcttcatatatctcagggtttggattggcattagttatctatcgctgtgtaacaaattacctcatcattaaggggcttaaggcaacaaatatttattatgtcaggaacaagtcaggagtcttggagcagctcatctggatggtgtggctcagggcctctcgtgagactgtggtcaagttgacagttggggctgtcgtcatttggaggctgaatggactaacggatccactttcaacacggctcctgcacctagttgctggcaggaggcctcagttcctactgtgtggacctccacttggagctgcctgagtgtcttcatgacacactctctctcggatcagaaaggagacattagtaatgccaaggatactcctttactcccttcacaagtgggcacagatatggtcctttttccaccagctctagaaagaaacatgcagagatgtttgaaggcaagaagacagtggcctgcatgacttggagcttttcttaattgtaagtcagagataataattaatgtcatgcctagttcagagaattattgtgtgactcaaatgagatgatgagcattaagacattggaaactttaggtactatatgaatgttttcttattggggcaaaccattttcctcttgtaaaggtgagcccagggacatgtctctcccccatctctatactatcagttctgatctttgaatgattgcagtgcccctcatagggttgggtaaggaccaaggcagagaatatgtagataatgcagcacagtacccggcacatagtaagcattcagttaacagctacaattacttaatggttttgaaatagatatgccaggcactaaagaaaattaattgataaatgaaataactactgctcctaagctgtggccgtggattagaatcaccgtgtctgccatgtcactgactctacagaatactgtatatggaaaaatggtttttattatttgttattttctatatttggatgacatttctgatctgaatttcaaccgtgacttctagtcctctgtatcttcttcttattctgacttgctacaatataaacttcatcctttaaagaaaaagtgaccctgttattcttccttggggtgttttgaatatcctccccctccttgcccagcttccctcaaatgtgccaacaatttttttcttttcttttctgtttttttttttttttagcatcagcggtaccatcaagttcctggactcttgaacttgatgaaatcgagatagtttctgtagggctccatttggaattgaggagcaggtgtggtctagacctaaggtccagtggtgggaggaatggaaagaagaaatggagccaaaggaaactgagggaaggattcatgtttctctggctcagtgagtgggtgggtcaaagaaataaaatgtttgtaattggttttaagcctgggcaactggagaaagtggtggtagtgttaataagagaccaggaggaacacaaagaggaaagaatatctggttttggagggaagaaggaaaattcagttttgattctgaatttgaggggggttggcatccaccagacagctaaacatggaatatggcccatgggtggtggtagcagtccttgctgctattcctggaacctctcagagggtcaatcacaggctgtcaccgtttgcctaagtggtatcctaagaaaatgtctgaagtggtccaggaagaggggccgataattattgagtaaaggtaaagggaacacacattattagactggtgcttttgaatgtcatatttattcttaatagcaactatatgagttatatgtgcatacctggttttacaaatgcaggaaaaaaggaccggagtgaccaggtaagctatccaaggttatgcagctaagaggtgttggagccaggatttgaactctacactcagttttcatcagtgaacagattttccttttacatcagcatcagaagcattatggctggctgaactgatagagaactagcaagtatggactcaaaagtggcatggggaccccttagtaattaattactgagggtaactaaactccaggtaaccttttgccccttcctttcttccagccattggaagaacgtcctcatgtggtacagtgtcaggcaggagacccatgtttctttctctgaatcaatagtgggtggcacagaacaacaaaaggacgtctgcttttagatcctgggcttccaaatcttctggcgccatcagctccccttccctcttggcacctctcctgtcctcaccctggtatgttgtaaacccaagaagtactattctctgggtccacctgcccataggatcctgaatcttcacacaaacaatagtagtcacaattctaacaaccagttctgaaacatttactatatactgaatgatttgcaaacatagaaaagttaattttcacggcaaccgaatgaaatagattttcggcctggcatggtggctcacacctgtaatcctagccctttggaagcctgaggtggatggatcacttgagtgcaagagtttgagaccagcctggacaacatggaaaaaccacgtctctaccaaaaaattaaaaaaattagctgggactacaggtcctggtatattgtaaacccaagaagtgctgttctctggggccaccagcctttgtattatgttggtgtggaggagggaggattggtatacagataaatttgcccataggctcctaaatcctcacacaaacagtagcaatcacaattttaacaacacaactttaacaggtgctacaggtgctacctgtagtcccagctatttgagaagctgaggtgggaggattgcatgagcccaggagattgagactgcagtgagccaagatcacaccacagcactctatcctaggcgataagagtgagaccctgtctccaaaaaaaaaaaaagaaagaaagaaaaatagatttttattatcctattctcattgatgaggaacttcaggttcagtgagttgagatttcaccatttcatacatctaatcagtaggagagttgggtttgcatccctagttcttctgacttgacagctgcgttcttaactaggatgctgaattgcgtcttcatagaaaatctgtctccaaaccaaaaccttttccacccacatctattaatagttttacgctattcagtatagatggctgccacgtggagcacctgtaaaggggtgtgtggctgtgagcggccactgagtatcttaaagtgtgtgagctcataggtattattgtagggtatctggtcctaaggtatcttggaagactaaatgtggccaaatttcaacaatgttggaatggaatgaagggtagaggaagtgaactgttagtagtggcccaggactcttgctacaaaagccaccaggcataactggttccacctataactgggaaattcagctggagtcttgccaaggagtagctagagtggagggattggaagacatactgatcttttgaagatacctggatacagttgataccagattagcacttaaaagggagtcaatattcctctgagtaccaattaatatttgagggtatataatatgctaggtgttttcctttgaaatatgtatacagtgattaataaagcagatttattagaataatagtttattaattcctagtagaagtataacaggcagatggaatcgttggactgactggtcagtttgtttcctttcaagtagcttagccattctggatatttcaaagagttgtctttgctgatttttttctcctgatctcaacaccagcctttcttcttggctctcctctctattctgaccacactggctctttaggtcaccttcctcaggaccaaagctttaaataccattcagtcactgactcctgaagctaaacctctacccctcaccccacccacattttaacaatttacggaagacactgtgtgaaaaattaccctatgcacttgagaaaggtctgggtaaattactttcttcctagattgttctctttaaaaatttgttttaagcatttgggttaaacagtaattttgtttgaatggtgaaaatagtttaaatacgttaaatgattcccctttttgttaacggagccctgaaatcaggtattttatttcccagcctttagttgatattgtagtgcattgaagactcttactgaacagaaaatgccaggatttatattcctggtgagttggattgagggaaggttggtcaccaaacagtccagctggtagctctgcatcttaatttctaagtcatgccgcagaatgttattttaagctatacacttatgaaatatattttctagtatcttgttgtgatttcttgactctgtcttgtccatctcaatttaagatccaatttaactaaaaattcctgctgtgggcaagaagagtgctctgggtggagggcacagcatatgaaatgtcctgaaggttaagtagctctttggaaaactgctcatcaaccagatggttaccatgtagaatatgatgggactggtaggaagaaatcagagggctaaaaaatctgctacatttaggagtaaacgtggtcctaagagcaatcggtccttaaaaccactgaaggattttaagccgtgtaatgacataatttgggttttgtctgcaaccagacattgcaaagtaagttagaagtttttaatggtggtttcatcaagcctgaaatactgacttctgtgattttgtctgtgtctgttccctttttcatcctttccaccccatgtctattccaaacttgcaaaactttccctccacctcctcttcatctcagcagatgctcttgtcttctctctctgagcaatctgagccaattcggtgtgacctcttgggcttcttgtcactttccttcttcagaatataaaactcgtgacctggctgacctcttatccaggatgatcatttagaaacaaaggagagtggccgggagcaacggcttacgcctgtaatcccagcactttgggaggccaaggccagtggatcatgaggtcaagagatagagaccatcctggccaacatggtgaaaccccgtctctactaaaaatacaaaaattagctgggtgtggtggcgtgcgcctgtagtcccagctactcaggaggctgaggcaggagaatcgcttgaacctgggaggtggaggtttcagtgagctgagatcgcgccactgcactccagcctgggtgatggagactccgtctcaaaaaaaaaaaaaaaaaagaaatgagagttaggatttgagagaagtcgggggaggatgccacggttctcctttctaattgctaaagtcagtgaaatcagctaaacaaactatggaacatacattgtggttctcagggaaatataaaacaacaacatgcaggtagaatacaagagcaaagaagagtgatgagcacttagctatggctcagctgacaaattccagtgctgacgttgctatccggccagcattctacgtcccgtgtagaaggatttgttgttcgtgtcaatgtcttagcagatttgtaatgcttgtatgggaattttaaatgtaaatttcatgagcatacaacttttaatataatcatgctgttaacttaatataaattttaatacaaattgtatgcctgtgtaaatatactattttataattaaacatttgttcaatactttgtgactggttgtgatttttaaaataatagcaattattttttaaaaattttaaaaagagtttatgttctgaggcaagcagatatgaatagtggggaacaaccaataattttttcactattaataaattcatgtatatctaatatataggagatgagaactaggaagtatcaagcttgaatcttgcttatccaccaaattcttgaaaataagtgaatgactatgtcaatcaaaatttatcttcaagttagaagacattcaagcaaacttcaaaggcttaatgttttttaaaaatcttgtaatttatatttttgtaaatagttgaaatgtaacattacagagaatgaaatcattctggtactaatctagcatttcttcctgaaaaaaaaaacccagatgtaaaaatgatcaagagaaatttagaaaacatgaaacaaatgaagaagtgaattctttaaaatttactgcaaattttgatggaaatggtaatactgtctgatacagtattacatcttaatatctaatattaccagtattagtatctgtctgatactgtttattaatttttttaatatttaacatttaaatttattttattttattttattttatttgagacagggccttgctcagttgcccaggctggagtgtggtggcgtgataatagctcacagcagccctgacctcgtgggctcaagcagtcttcccacctcagcctcctgagtagctgagaagtatgggtgtgtaccaccatgcccagcattttttttttttttttttgtagagacagggtctccttgtgttgctcaggctaggggtcttgaactcctgagctcaagcagtctttccacctcggcctcctaaagtgctgggattatacgcatgagccactgctcccggccaatgataaattattatctattcactcaagatagacagaaaaatagaatgtacttgaaatttttagtaaaatatcttacttattaaagagtttaccattatgaggtgatatgttgttttccttctatgaataaaagtaaaaatcagaataaaaatatacaaaaataaattttaaaaatatacaaaatgaacagatttcaagtgagataataaaggttgaaatggacattatgagataattgtttcttttgtttacttagtaatgtgataagacagtctatagtactgcggacagctggcaatttaagatagcctttgacattttcagcagctatctaattttcattagctgcttgttagaaaatgtaaaaaaaaaaacaaaacagaaatacaaaccaaaaccaagcagcacagaagagtacaaagtgaaaaacaaaaccattgctatctacttccctgatttttgagtcctatttttgagagagaaccactataatgttttagtatttacctttatattttttattatgtatctctgtgtgtgtgtgtgtgtgtgtgtgtgtgtgtgtgtgtgtgtgtgtgtgtgtttatttagaaatcacaagtgggacctgtatttgtcaggttctagattataggataattcctgtaaaaatctcaaagtttctgtttctttgcataataaaatttgaacacttgctggtctgatttgcagtgtctttatttgggtttttcttcttggcagtgctccattaaatggaaactcaggaacccaggatctgtccacatggtggctttactcccacctgtttggatgtgaaaaacagaattcgaattatagaattagagaaaaagaaccaagagctctatagccaggctgccatctttaccttttgagtttgtaagtaattagatttgtgaagatatgaacatcctgtcaattttttgtcattctgtcagtttcactctatagttaacattcatgcatttatacaatgattgtcaaattatcaaaatatacatgaacgtgaacgaagtgaagttataatacacaggaggatgataatccatcaaaaatattcaggccatcagtttggatgagagagctggagagtgttgaaatgtttcaagttgtatcaaaagattctttacatttatagttagctgatgagtcaattgattgtttgacagtggtttctaaacctgaatttcttttgtacaaaatttcttttaacatggtatctttctcttcttttttttttttgagacatcatcttgctccattgcccaggctctagaatacagtggcatgatctcagctccctgcagccttggcctcctgagctcaggtgatccttccacctcagccttctgagtaactgggaccacaggtgtatgccaccatgcctggctgtttaaaaaatttttttgtagagacagggtttctctatgttgctcaggctgggctcaagccaccctcccacctcaacctccaagtattgggttaaaggtatgagccattgtgccctgcctgatatgctattgtaaatgaaactgttgtaaataatttaaaatcaaaattataaacttttggctgggcgtggtggctcatgcttgtaatcccagcacatagggaggctgaggcgggtggatcacttgatgtcaggagttcaagaccagcccggtcaacgtggtgaaaccccatctttaccaaaaaatacaaaaattggctaggcatggtggcgtatgcttgtagtctcagctacttgggagcctgacgtgggagaattacttgaacccaggaggtggaggttgcagtgagccgaaattgcaccactgccctccagcctgggtaacagagtgagaccctgtctcaaaaaaaaaaaaaaaaaaaattataaacttttatcttcaaaagcaaaagcattgtttactgtttcagtcagagagaaatgatgcgtaattaaaatccatttgggatgaacagagaatgtttgcaaaaaaaaaaaaaacctcaatgagtatttcaaaatgaaaagaaaaataaaaaagcaaaaatatttttccctgtgaaagaaaagaataaaaccagaataagttatagaatttgagataatacattttcccccttgctttctcaaaatagtatgtaattcataatcttatgcttgaatacaaatttatgcttagtttttcagaaattaattggagcaaaatcaaaataaatgaaacaaaatatagatattaaataaagcaaagatcaaatatgcaggtgaattttacagactccataaatctgagtgtggacatttatacagactgcagcttatctgtgattgtgtcaccatattaatgctggcttcttatttccctgagtgaacatacaccccttgctgtgagcattcaggacagcctgttgagagtgctcacgtcctcctcacatactcacttaggccgtgtgtgatgattctggggtgggatttcataacaaaagtgttagagcctacagctgtcagtggttttatgtacaactttgttgcgttaccttagagactgacaaggtttaatagtttatctctagaaattgtattcttaggtagctgaattgtcatatttcctatttaaattttaatcacttaggagtctttaggaccttaaaattgggtgtgatgttgacactattgggttgacataatgaatgttaatgaattataaaaatactgtattttattgattctataatcaagacacatcctgtagtcagtggcatcttaggttgaatgaactgcagtagtctctctttttttttttaaatcaaaaggccaaattaattgtgaaaaatgttaacttaaaatttctcagaacttttggcttcttaattgccactggaaaaagaagtatcagtatcatcgccagctgtgcaaggcttgcatgtttgtttgtttgtttgttttttaatgggacagtgtctctctgtcactcaggctggagttcagtggcaggatcgtagctccctgtaacctcaaatgtgccaccacacctggctaactttagtttttgtagagagggggtctcgttattaatattttggttaggctagtctctccaactactggccttaagcagtccttccaccttgacctcccaaagtgctgggattatggcgtgagccactgtgcagggctgaggcttgcatcttcatatctgttggactctgtagtccttcatgctcttgctccttggctccctctttcttgaatctccactcttcccatcttgataaaccattacctctgagtctagtggtttcttaactcacttgtacattagaatcatcagggaagctttaaaaaaagaaactgatgctgactgggtgataatgatgtatcagtgtaggtttatcgattgtagcaaacattattgtggcatgggatgtcaatatgagtaagggaggttgtgcatatatggggacaggggctatatgggaactctctgtactttctgctcaattttgctgagaacctaaaatactctaaaaaagaaggtggtttttttgtttgtttgtttgtcttaatggtcaaatggtcctgggatcagaatacgtgctaagcatggcaaaaaagatgatcaacatcatttagatagtgctattcttaaaaaaaaattctttctcccctagagtgatgttatttttatgctagtgaaattcatataaacatacagctagcatatatcatctaatttaagacactatcaattgtaagccacactactaagatagaaaattgctaattaaactatgccatactgtgtgtgtatgtgtatgtgtaaacgtacgtatacacactactgatgtctaggtccagactaagaccattgcctttagtctatgaaacttgccaggctgggcagggtggctcacatctgtaatcccagcactttgggaggccgaggagggtggactgcttgagcccaggagttcgagactagcttgggcaacatggcaaaaccccatctctaatctccacaaaaaatacaaatattagccaggcacggtggtatgcactggtagtctcagctatttgggaagctgaggtaggaggatcacttgagcccgggaggtcgagattgcagtgagcaaagattgtgccagtgcactctagtctggatgacagagtgagaccctgtctaaaaaaaaaaaacaaaaagagagagagagaaacatgctgataaccccttctttggctacaggtccctctctagtattgcctaacatgttacctccctttttcctgcacagttctccaaagagggatgtgttctcagtcttcactttcttaccttttagtcatgttcagctcaggtaattaggcttttcctttgtgagtttcctgacatgctgtcgctgataatcaccagtaaccacctgcttgcctttccttccttactagacattctgttgcactggacgctgttgtccattccttttcttgaaactctatttccaaatctttccagatgttgaactctcccagtgtttttcatacctctttgaccagtaccaagaatgtagaaccaagactacattcttggtccatcctttatgacagtttccctgcctctctgtgccctccttcagagagcttatacattttcaagttttcagctacaattctgtgctcatgatttataagccgtttctttggttattcccgccagcatcagaatcttatttccaactgcccacgcagcacatctacttggctatcccataaacttgaccaagatggaattattagtagtatttcttttcatagagatgaggtcttactgtgttgccaggcttgtctccgactcctgggctcaagcaatccttctgccttggcctcccaactgttgggattacaggcacaagctgttgtgcccggctggaatatatttttctttaaacctacattctctttcttggtcggaggtaccatcgcccaccttgtcttgagagtcatttttccctttttttcagcctctacatacactcatttaataagacctacacattttattttgaatatttctcagcatttacattcccctctaagccaccagcatcctagctcaggacctcatcttcacatagattctgcagagccctcctgcctctgcttttggccctttcaaattggtcctccacagtcaccagagagactcatctaagatgcagacctgaactgtcacctctctaccttatcaccagcacttacctcctttcctcccacccactgtccttgtctcaagtcagctggtgcctttctgctcagaggacctcagtagtgctcctgagcatgcttgcagttccggctttcttcctactccatgccccactgctgacctgcttctgccacggcatgcccttgctggcctagaggcagacgtcagaattctcagcctagcagtgaaggtttcccaaactattgtctgtggaattgccatgtccttgttcattaccatgcattcagcctgaatcctgcttctgactgaacaccttcttccctctgtgtactccaactgtcactggatggtgccgtgcagttccaggctcttggtgtcctgaacaaagaattggacgtgacacacacaagtagcaaagcaagcagcaaaagtttattaagcactgtattacactcttggagagaggagagtggactgatctctgtgaaatgagatcagcatcagtttgatgtactttgggtatttgtatgtgtttttttgtctcttctcttcccaaggctgcctaatctttagccagactctgccatttaattgataggtggactgcttactttggcccttatgtgcttgtgtgttgcctccatcccataatatacagtccatatgcatgagctttaatgagctgattatcatatggggtcatgttaaggatactttttctctctgatgcgcatgcccatctctgaggagccagctatggggtctctttactcactttttaatcttgtttttgttttggctgctcagcttctgtctcttgtttcttactcagctacccattcaccttgcttctgctctctgcttttactcattctgccctttatccaacttccagttccctctgttttcctgcatcacagcttggtttgtcttactttctgttttgttttgagatgtgacgtgtcaccatagagaaagcccttatgtagtaagacctgattccttgttctcttgagagaacttttgtgagattttagctaaattaaataatttgattttacctttctcatctataaaatgacaataatgataaaacatcattgcacaggagtttttttttttcttttgaaggtgtaagtaagcaaagcaaaggggaagtagaaaaaaatgtgaagtagaaataatgataaacataatttctttattaattacataattataatttttgaaaaacccttttactgtgtcttattactactagctgtaggaactcagctggaaatcaatgaaaaaaccttgtaaatgaataaagaaagggataaagccagactggagccctggtttataaaccaggctacctgtggatgaaaggagataaaagaggaccatccgatgcaggttttgcgtcgtgaaggccacttggttaggcctgggcttggattgttttggaattaattccaggcatttgcactaagaatgtaatcacagtaggaactccctgtaacagatgtacagagtttagtgggaggtaattatattagattttccacgtggctcctgaggtttcaggggattagtttggatggtctgtttgggcttgactacttttacacaatgtatttgttagtttgctgtacggtattcatggggattaatggctgcattaagtaagagtaaccctaaaactctctgagagctcgttataaaaacattcagtgaaaattctgtctccatggccataatcttttaattgaattgaattatgtggcctcttatcctgcacggagaagggtcttgtcactttcatgtttactgggggctcctgtcacatcttgcctttgctggggctgtgaaagggcagcagttttgctgtgttcaccttaaataacccttagtgttaacatgattatttgttcttggtggaaaatgttagagtgttgacttttgacgtcttgataatgatcttggatatgttcacaaatttctgtgggtagaagaagggaaaaccaacataaataagtttgtatttcaggctgattttttctttttcctttttttttttttgagacagagtctcactctgtcgcccaggctggagtgcactggcgtgatctcagctcactgcaacctctgcctccctggttcaagctatcctcctgcctcagcctcccaagcagctgggactacaggcacatgccaccatgctcagctaattttttgaaattttattagagatgggggtttcaccatcttggcctggctggtctcgaactcctggcctcaggtgatctgctcacttcagcctcccaaagtgctgggattacaggcctgaaccaccccgtccagtctgattttttgttttaaatgacaaatgaatattatctctatgttataagacataaggcaactgaagaaagccttcttagtgtgaaatatttatcttagatattttttagccaaaatgattttagtaaacattctgtttatattgctaactgaagaaggtcaaatgacaatgttgataaaagtgcaagccatttcaaagattaaagcagcacttcacttctatgcatatattgtgttttagtcccatcgatagcttttacaggatcaacctgtcattcaatccatccattcttttctttttttttcttttcttttttttgaaacagagtcttgctctgtcgctcaggctggagtgccgtggcagctcactgcaacctctgtctcctggattcaagtgattctcgtgcctcaccctcctgagtagctgggattacagacgtgaaccaccatggccagctaatttttgcagtttcagtagagacagggttttgccgtgttggctaggctggtctgaactcctgacctcaggtgatccacctgcctcggcctcccacagtgttaggattacaggcatgagccaccgcgtccagcctattatttttttttagaaatattcatttaattccaattttgttgtgcttagataccatctactgaatccttatatatatacatggtacaaggtatgtaaacctctgtctgttataaatattttctctcaggctgtcacttgtcttttaacttgtgctattctatcataacagagttttaatagtatatagtcaaatttgtcagtctcttagtaacttttgagttttttatcccagagagatcccatcagtacccaaattattaatgtcctgtagtttttctaacattttaattgtgtatattttctaatgttttctgctatagctttttatttcatctggaatttctggcttgaattagggaaagatttatcttttctccactcatataaaatgtaagtattttcatacattaaattcctttatatttgtggatctatttctggacttgtttcaaatgttttgtttattcttatgccagtactgtgtggttttaaaggccatatattcttttaattttaaagaagcttatattttctttcacatggtgtgaaacaaattttacatgaacagcaaggtataaagtaaaaaattgaaatccctttttcttgaactcattcactatagtttcccttcccaaagtaaactactgttaaatttcttgactttttttcccccagaaaactgtccatgtactagcacatacacaaagccacgggtagaagtttacaatgggatagtatacacattattctttgctttgctttttaaaaaaataacatctttaagatataattctgataaccatacagctcattcaatctataattcattggtttttagtgtatccagatacttgtacaacatttaccacaattttagaacatcaacccaaaaggatactccttacccattagcagtcactcctcattcctctccccacttccttactcccagccctaggcaattactgatctactttctgtctataaatttgcctattttggatatgtcatataaatgggtttatacatatgtggtcttttgtgtctggcttctttcacgtcacatgatgttttcagggttcatccatggagtagcatctgtcattacttaatttccttattgctgaataatattcccttgtatacatgtaccatattttatttattcagtcatcagttgatggacatttgggttgtttttactttttaactactttgaatacttgtgtatatttgtgcatgtttttttgtacagacatattgttttcatttatcttagatatttacctaggagtgcaattatggggtaatacagtaatttctatatttaaccttttgaggaaatgctagacggttttctgaagtgactgtactgtgttacatacctgttaggagtgtatgaagattgttgtttctctggatcgtcaccaacacttattattgtcttcttgattataaccattctagtgggtgtgaagcatgaggtggttttgatttgcatctccctgatgtctaatgatgttggccatcactgtgtgtgctaattgaccatgtgtatgtcttctttggagaaatgatttattcagattctttgcacacttgaaaatttggttgtcttttcattattgaatggcaagagttctttttattttctagatacaatgccatcatcagatagatgattttacagtatttcctcacattctgtgggttgtcttttcacttcgttgacggtgtgcttgaagcataaaagattttaatgttgatgatgtccaatttatctatctttttttgtgcttttggtgtcctgtctaagaaaccattgcatgatccaatgtagagttatatctgtgttttcctctaagagttttatagtttaaacccttacatttaggtctttgattctaagtgtatggtttgaggtaggggtccagttttattcttttgcatgtggctatccattttccccagcaccatttaatgaaaagactatttttccatgtcagactgtcttggcaccttgtcagaaatcaattaaccttaactgtgaatgtctatttccgaactctgaattctattccattgacctatatgtctattcttatatctataacacattatcttgattactgtagtgttgtagtgaagtttgaaattagaaggcttgagtctgggttgggtgcggtggctcacacctgtaatcctggcactttgggaggctgaggtgggcggatcacgaggtcaggagatcgagaccatcctggctaacatggtgaaaccccatctctactaaaaatacaaaaaattagctaggagtggtggcacgcgcctgtagtcccagctactcgggaggctgaggcaggagaatcgcttgaacctgggaggtggaggttgcagtgagccaagattgcaccactacactccagcctgggcaatagagcaagactctgtctcaaaaaaaaaaaaaaaagaaagaaaaaaaaagaaagcatgagtcctctaagttgttctctctttcaagattgttttggctactctgggtccgttgaatttctgtgagaattttaggatcagcttgtcaatttttgtcaagaagtcagctgggattttgataggcattacactgaatctgtaaattgattgagaggtattgtcatctccacaatattaagtcttcagacccatgaatatggatgtcttcccatttttttagacttgccatttatttaaatgtatttaatttctttcagccatattttgtagttttcaaagtataaattctcttattaaatgtattcttttcaatgctgttgtaaatacaattttgtcttaatttcaattttaggttattcattgaaattgtatagatacgtgataagttttgtgaattgatcttataagcctgcaaagttgctgaactcatttatgagttctaatagttttttaatggattccttattattctatacatgagattatgttactgcaaatggaaattgttttactttttcatttccaaaacggatgccttttagtcctttttcttgcctaagtgtcctggctagaacctccagttcaatgttaaatagaagtgataagaacaaataccctttctgttcctggtcttaggggaaaaacattcggtctttgttaactaagatgttagctgcggttttccatagacaccctttatcaaactgaggaagttcctttacattcctagtttgttgagtgttttgatcataaagggtgatgaatcttgtcaaatgctttttctatgtctcttgcatctattttgatgatcatatgttttagtcctttatctattgatatgattacattgattgatttttggatgttaaaacaaacttacattcctgggataaattctacttgctcatactaaataaactttttttttttttttaacattcctagataatggtttgctagtattatgctgaggactttcgtgtctgtatttattagaaatactagtctgtcgttttcttgtgatatctttgtccgattttggtagcagggtaatactggcctcatagactgagctgcatagcatttcctcctcttctattttatgctgaaagtatttgtgaataattggtattcattcttctttaaatatttggtagaattcaccagtgaagccatctgggagtaggcctttgcatgtgggtggtttttgaatatctttgcttgttagaggtcttttcagattttctgtttattcttgagtcaatttcaggattttgtgtctttctaggaatttgtcatttcatctaagctaaccaatctgttggcacacagttggtcatagtattactttataatcctttttattctgtatggttggcaataatgattgctgttttaattcaggattttagttctaccttgctttttaatgctttatattttagagatctttttgtaaaaattgaattcatcttttagtgaccacatagtgttccataactaacctatttatggtcattaatgttatgaataatgccacagttaatatcttttgatatattgtagggtacttttggtgatagtgtgtttctgagggtaaattcttagcagttgatttgttaggtcaaagggatataatgttcaatattagtagatattgacaaattatcctttatagagtttgcactatttacatttatttttctatactatgatatcctttacttctttgtcttttattgggttatttattttaacaagtttttgttatattaagaagaaattagcctttgtcatatgtcttccaaatattttttccttgtttatagtttcttttgaccttgttgaacattttttgccatacggaagttttaaagttttgtgtggtcagatttatcctccatttccgttctggcttctggactggtatcactgccatgtatcacacggtattactgccatataaataggctctgttaggcttcaagaaacaagtgatggattttattgaattcatagagaataagaaaagtaggactagccacacagttaagtttatgttttggggatacagcagtcttccaggagttagtctgtaaggtctgccctctgcagggagcttgattgaaaatctagtagttggctgttcagagatgacattccattcctctcttgcctcccttccttctctctaggtgacattctactgttatggttctgctgccttttccgccgcttgtatgactcttgatctttcttgtttattgaagccttatagcttctgctctcttgctctgcttttcgtcatctctctgtaggtcattgtggcttctgtgcccattggtaagtactgactcttggtatctccattttagactcctgttcagaggagagatcagattggtttgtcaggtcactgttttttattcattgtagaccactgtagacgggcggagactttctgccaagcctgtcttcagtctgcagattggctgctctttgcactctccagtcggcctgggcttcaaaagtgggcctaagtggttgaatgtagggcagccctctgtgtttaaaaaagtcaaaaagcttaaaaaggtgcatgtggcagaaattttcaaaaaacaaaaggagcattataagcaacaggccccttccattgtctgacttgtaaaatgtgcaacgcaataggcagctattctttgtgtacagatgtacctcaaatcccagaccatcagggccctcagttagctagcgtcagtggaggggtacgactcagacacaattaaccacaacatatggaagcatggaagatggcacttggcagaaactaagccttaggagtggagcctgtcacgccactgaattcagggatgtgtttgaaacagacaccgtttcagagaccttggagagtagtttctcattcacaataggcatcacgttgatagataaagatattgtggtataggcaaggcagccagaaagggctacatcaacagaggcacaggggcaggaaagcaggaagtaaggaaatgtcaactcttggacttctgagtctgacttaggaaaaattaaggatggaaaggtcagttagggcctaattttggagtgtccagattccctgagagcgtgcttggattttatttgattagtagtggggagctattgaaagttttgagctggacaatgacattaattaactaattaatgcaacaaatatttatgtgtgtcaggcactgttctaggcattttggggtataacaatgagcaaaataaaccagaaaaaaaattcctgcttctaaaacttatgttttagttgaggaggcagtcaatattactatgtgtaataagtatatcatatagtatgctaggtaatatattctgttgaaaaaatttaaaaagtagggtagtggggaatgggtgtataggtggaggtttagggagaaaggcagagttgtgattttattttattttttgagatggagtctcactctgtcgcccaggctggagtgcagtggcacgatcttcactcactgcagtctccacttcctgggttcaagcaattcccccacctcagcctgctgagcagctacaggtatatactgccacacccagctaatttttgtatttttggtagagacggggttttaccatgttggccaggctggtcttgaactcctggcctcaagtgatctgcctgcttcaacttcccaaagtgctgggatcacaggtgtgagccaccatgcccggcctgtgattttatatatgcctcttatttttacttgacacataattgtatatatttattagatacagaatgatactttgatatcgggatacaatgtgtaatgatcaaatcagggtaattagcatattcttcaccacaaacatttatcatttctttgtgttgtgaacatttaacatcctctcttttagccttttgaggatatagaataagttatagtttctactctctacttccatgaggccacattttttttagctcccacatatgaatgagagcaggtgctttctgtgtctgacttgttttgcttatcataatgtcctccaggctcatccatattgctgtgaatgacaggatttcattcttttttatggcagcatagtattccattgtgtgtatatgccacattttcttcatctcttcatcttttgatggatgtttaggtttatttcatatcttagttattgtgaatagtgctgcagtaaacatggggattcaggtatcattttgaaatactgatttccattcctttggataaatagtagtagggttggtagatcatatggtcattctatttttagttttttgagaatcctccacactgttttccatagttactgtactaatttacagtctcacaaacagtgtatatgaattcccttttctctgcatcattgccagcacttgttttttttttttttctttttgacaatagccattctaactggggtgagatgatatttcatttcatagatgtgattttaaataggtggtcaaggtagggtttagtgaaaaggtgccagaagatagaacctgctgcaggttgagcatccctaatctgaaaatttgacatctgaaatgctccaaaatttaaaaggttttgagagctgacaccacaaatggagacttccacacctgaccttgtgacaggttgccgtcaaaacttggtttcatgcacaaaattattaaatatagtgtataagtttaccttcaggctatatgtataaggtgtatatgaaatataaatgaattttatgtttagacttggttcccatccccaatatatctcattaggtatatgcagatatttcaaacctgaaaaaatcggaaatctgaaatacttctgaccctaagcatttcagataagggatattcaacctgtagttcattagggagaatattatagaaagccaggtcgaatattgttgaatgggttggggggttgctgatgaagagtctggaggcaagaaaaccactgaagatttgtgtgaactgataagtcgcttcagtgttggaagtgaaatttttttccacttggtttatatttttctaccttagcaaagaagtccagcagttaactagcccaataaactctacattgtttttttagacttgcgagatacgatttctaaactattggtattctttactaccaagagtctagtgtttctttatttatggactactcataccagaatcacttgggggtactagttaaacatagagatgcctgggacctgccccaaatcttggaggaagagcaagatagtggccaagaacacaggctcaaggtaatcagtctgggttcaaatcctggatctgcccttacttgactgggtggtctcgagcaagatacttacttaccttttctgtgcctcagtttcgccatctgtaaaatgggaataatgataatatctacttcatagaattattgtgaggattaagtagattaatttatgtgaagtgctagagcactgcttatcacctggtacacacttagtgttagctacaattgtttgtattcaatcataatctctgaaggtgaggcaagtaatcttcaaattcaacagtcaccctgggtattttatttgtccttgtgctgtgggaaaaactgttattacttctggagccatggtgaattctgtgagtggtccacacatcaggtatggtgacttagttagaatatgagccaattaatgttttgatttcacacatacaatggtttatttagcaacaaatgccactgtttactgtacatattgcatgttaagcatattctgttgccattcacaacaaccctatgatgtaagtaaatatcactcagattttacaggtgagaaaactgaggcttacactgatgaaaactttccctaagtgacacagcctgtgagctgtgcagttgtcattgatccttggctctgcctgacccaagagtacttgttccttctacatcttctagttattcaacctttttatcttgcaaacatatatattttatagtcagatgcatttgtacaaattctttacaactattggataaaaacctcactgggcatgatttattaatggtaagctagttgcatcattctatatgatcaagatcttaaaaaattttgtctttgtaagtgtagagatataggaaaaaccaaagttcttttcccattctaacatagtcactcagtaccacacagaatgcttctgttaccagtacatgggggtttttccctacacactaaccaaacagttctgcagcagacatcagctctggtgtctcctctaattcaatttaattttgactctatctagaggtagtgtcagatcccactgcttgagagctcagtcccataagactgtcccccacttcagatgccaatcaaagtcagggcctccagaatatggaatttctgactgaccagtggttaaagaaaaacttaagcacttttaaaccatttatttttattttttatttttatttttagagacaggctcttgctctgtagcccaggctggagtacagtgatgatatcgtagctcactgcagcctcgaacttttgagctcaagtgatactaccacctcagcctcccaagtagttgaggttacatgtgcacatcacgatgccctgctaatttttatgtttttatttttcttagagacaaggtctcactatgttgcccaggctaatcttgaactcctggcctcaagtgatccttccacctcaccctcccaaagtgttggaattacaggcgtgagtccccacacccagccgaaacagcttgagcattcagcagttgatggatagggtagcagcagaccacaagggagtgtcactcctccaggaggggcaagaggggaagcttttataaagtatttgcagaagcaagacaaataaaccaattttgattgattagagtggaaagttcctagttagagattagttggtagtttctgattggtgcagtttctggttttaatttactgtttacattgggctttggtttgttcgattagggatttaaagtgacaagagctaccctaccctagtctaatggactctcaattggaatggttttttttaagtttcctcctttttttttttcatttatttatttatttattattattatactttaagttttagggtacatgtgcacaatgtgcaggttagttacatataagtttcctccttttggtcagcctctcatttataaacttggacgtaagtgccactctctgtcaccatcatggctaggttgtctttgtcttagtgtggaactcataaatcatgacaacaggctcaatgaaaaacaattccttttgttgtcaatctcattttttttctaatcacagtgagacaatctggtatgctgttgatgtttttgaatatacatttaagacccttgagagaatatagtgcaccaggaagattataatgatgactaccaggaggataatactgagagacttagcttcttagttaaagtccccacgaaccaaactaactaatatttctatggaagcaaaagaaaaacaaagcttaatgataagaacaaatcataaattcggtctctgagtccagagggtgattagtcaggaagatttctagatttgagctctaagcatattttcctggtttgcagtttgaatgcccctagttatggcagtgggcattttggtgaactccctgagtggtccacacatcaggcatgagggttgtcctctgaacttgtatcaggtatacatctccatcttgcagggtttcaggagcagagcagttcttgttcagagtgattccaagtcagaaaagtgggagaaaattggatggaggaacctagaagaactgaggattcagtgcaaactacaggtagataataaaacttgaaaacagttaatagggctgcagtctaataacaggtgtactattgtttctttctgaaacataattttctctctgtagtcatccttgtttctaccaaagataaatgggccaggcgcggtggctcacacctgtcatcccagcactttgggaggccaaggcgggtggatcacctgaggtcaggagttcgagaccagcctggccaacatggtgaaaccctgtctctactaaaaatacaaaaattagccaggcatggtggcaggtgcctgtaatcccagctactcaggaggttgaggcaggagaatcgcttgaacctgggaggcggaggttgcagtgagccgagattgcaccattgcactccagcttgggggacaagcttgagacttcgtctccaaaaataataataataatcagtgtaagactaatttgattgcataataaattttgtctcatcagacttggcctgattatgtaagtgcagtaagaatagtgattgaccgcacaagttctttttaaagtttgttttgctggaacctttgatagggaatcagattgaacttttaaaaaaacctcttaaatctaggaagccaaaccaaggcaaattttagacttcacctgcagtacctatatatttgggtgaattcttctcttctcgtaaggtcccccaaatatcttgaggttcctgggtctgctgggaactgatagcttttactcactcactgtgagactgggaacacttttagccaggcattctatgcacactgtcaaatatgacccttggtaatataaccaatgtttccaattgtgtcttgttataaagagaacagattctttttgaacttatgcaaatagttatattgccataaaaaaaatcttcacaagtagctttccaagttcccgaggatcaggtagagaggaaaagtaaatacttcaatctttattcacaaaagtatacttttccaaattgctgcaagcagtagatagcttaaaaggtaaaatgtttcttaaaactttaaagaaccagcaaaacttccacatataaagtcataaaaacattattttcatcagttattcagtcttatgtaattcttgttctgcatgatctcgggatagcagtttcacaaactcaccagtttctttattagcgttctgagaattcttacccactttcatggcattatcttaatttaaagttataagaaacctgtatatccagagtacttgtcagagttctttccgtgaatatctttgaagaagaagcaattttggactatagctgattgcaaatgcttttagagaaaaatcaaaacaataactgcctatggatgacaagacttaagatggccatagttaaattctaatgaggtttcattataataatgcaactgacaaaaaaatctggttattttctgtgacatacaacattttaacataataatcaagattatgactgtagacattttataaaacataatttcaaaaagttttaaacttttattccatttatatttaagtcactccttcttaaacaaatatacttgaattgctcatgaaaaatgtcatgagatattgaacagagttagccattgaaagagttcaggaaatgccactccaaaatttactgctttggaatattgattgctttgagccgaaagcatttgaaaaataacaaatgcagggaggggctttttgggactcctttgtctgcctaaagacaggtcctccaaagaaattcagctatcatccatgccttctcccacgccatcatcttaatgttatttaatttttcttgacaaatcaggcaggtatcacagttttttacttccatgactgacgtgcatcaagatcaagcaattcatttttactgcacattttcctcttaggttggatttatggttttatgatcttaaacatctagcagagccaacaccaatctgtctaaccagcaacccaggaaaaacttgagaattctgagaaactcccattttattttaccgacaatttaaaaactagctttatttaccacagacttatgtaaatcatgtgaacttattaaaaaaaaaacacacatttgggtcagtttctgcatttctgagagttttagaaataatttacatgcatgctcatttatccccaaaccaatttgaatagatctccattaaaggattttataaattggtttagtaataccatctgaaaatatcacatatgtgtgtgtatatatatagacacacacacacacaaacattcatacaaagacagacagaaggagataacgtctggtttgagtcacttattaaaagtagtccaaaggtccttcttggttgttggttgctccgcagttgctataattacaaggccattaatttggaaaccttttgtttctcatcttgctctgaggtcctcagctaacttacttaaccctgtagcttccttatccttttcctctctctctttcttgtttggtaatgttgtggggagactccatttacaaaaaggacagctaggattagctgaattgatgtaatgcttggaatgctgtaggaaaaacaaaaggtccaagtgggctttgaaattagtaacagattcatttttcttttgtctgcaggtctggtttagtgcaggtgggaaacactttaggaatggctttcaaaagcttatttatggccgggcatggtggctcacgcctgtaatcccagcactttgggaggctgaggtgggcggatcacgaggtcaggagatctagacaattctaggtaacatggtgaaaccccgtatctactaaaaatacaaaaaattagctgggtgtggtggcaggcgcctgtagtcccagctactcgggaggctgaggcaggagaatggtgtgaacccgggaggcagatcttgcagtgagctgagatcacgccactgccctccagcctgggcaacagagcgaaactccgtctcaaaaaaaaaaaaggttatttatgtttttttggggtttttttttgctttttgtggtttatatatgaaccaaattgggtctcatggccacagatatcatcttcagagtgatacccttctgccttttgcgtccattttggctttcctcatgtcctatccacatgagtttactgggtacaaaaaaaaaaaaatagaacgagtaagacctactatttgaggctggacacagtggctcatgtctgtaatcccagcactttgggaggccgaagcgggtgggtcatgaggtcaggagatcaagaccatcctggctaacacggtgaaaccccctctctactaaaactacaaaaaattagccgggtgtggtggcgtgcacctgtagtctcagctactctggaggctgaggcaggagaatggcgtgaacccgggaggcggagcctgcagtgagccaagatcgcaccactgcactccagcctggtgacagagcaagactctgtctcaaaataacaacaacaaccacaacaacaacaacaataaacctactgtttgatagcacaacagggtgactacagtcaacgataacttaattgtacatttaaaaataactaagaatataattggattgtcctttgtgttatacaaaggataaatgcttgaggggatggacaccccattcttcatgatgtgattattatgcattgcatgcctgtatcaaaacatctcatgtaccccataaatatatatacctactttgtacccaaaaaagctagaaaaatctaaaaacccacaaaaaaataggaaaaaaatccatgtttacctaggttgccaagttcagagcaaaacccattcatgaatagggcagacaaagcattttctctgccagacagggataccttttattattgctctgagattaagattttgatcaagacataagggtacatggcgaaaccccacctctactaaaaatacaaaagttagctgggcgtggtggtgagcacctataatcccagctacttgggaggctgaagctggggaattgcttaaatccgggaggcagaggttgcattgagccaagattgcaccgctgcactccagcctgggtgacggagccagactccatctcaaaaaaaaaaaaaaaaaaaagcagacctgggatgggtgtaatcctagcattttgggaggttgagacgggaggattgcttaagtccagaaggtttgtagcaggacgagccgcagacaaaacccctcagacactgagttaaagaaggaagggctttattcggctgagagcatcagcaagactcatggctcaaaaaccgagctccccaagtgagcaattcctgtccctcttaagggcttacaactctaagggggtccacatgagagggtcgtgatcgattgagcaagcagggggtacatgactgggggctgcatgtaccggtaattagaaaggaacagaacagaacaggacagggattttcacagtgcttttccatacaatgtctgtaatctatagataacataaccgattaggtcaggggtggatctttaactaccaggcccagggtgtggtgctgggctgtctgcctgtggatttcatttctgccttttagtttttacttctttctttggaggcagaaattgggcataagacaatatgaggggtggtctcttcccttaggttgagtctacagtgagctgtgttcatgcctctgcactccagtctaggtgacagagggagaccctatcacaaaaagaaatgaattaagtaaaaaattttcttttaaaaaatttttcttattttttatttttttgagacagtatcttactctgttgcccaggctggagtgcagtggcacatctcagctcactgcagcctcagcctcccaggttcaagtgattctcctacctcagccacccaagtagctgggattacaggtgtgcgccctcatgtctggctaatttttgtatttttagtggagatggggtttcgccacgttgcccaggctggtcttgagctcctgagctgaagtgatatgcctcccttggccttccaaaatgctgggattacaggtgtgagtcagcacgcccagcctaaaaatgttctattaaaaagaagcagacctggttaatctgagaacctaactataaatactcatttagttctttttccttcagggcatgcagataaacaagcaaaaaaaaaaaaaatcagcagactcagagtagacgagaggttagaaacctctacatgccagtaaaaaatacttctcatttctgttttttttgttgttgtttttttttttttaaatagagatggggtcttgctctgttcccccggctgatctcaaactcctcagcctcccagagtgctgaaattacaggtgtgagccaccgtgcttggcccttcccactttctgagatgttcaagatcgtgtgtgtacgtgtgtatgtaggtgaacaattttgtttaggtaaaaacttccactttgtagccactaaaattctaaattgcttttggtaagatttgcccattcttttagaagagcttaggttctgagatgctattatgagaagcacttgagactataacatccttctccccacacccccaaactgggaaggagctgggagaccaaagaataacttggataaatctagcttgacggctagatgagcttgttaggacttaacttcaggacactcctggatggtggctggacagctctagagatccacaccacctcccatttctaagctgcttttaagttaattttctggccctttgtcaattttgtgtggttttccttgatatgtccccagctatgccccaggatgtttaggttctcagggacacgtggtccttggctgggcgcagtggccttggttcactgcctagcttttggggttcaagcaatacacatacactcttaagtaacctggtaggggaccagtcacactatagatggagtcccagactctggatttaaataaactcattatttccagtcttcgtggaacctttcctagtggaggtcttttgcttaacccagtttggtttttgtctaacctagttggacacctgaagcctccctgcaaaacccagtcttgtttctgctgtgacttccaaacctagtctggagcagaaatgttaaaatgaacttggagaacttgacgctagtgttagaatgcacgtatctaagtctacttactggtgatgacctccaaatgtgcagggagtaagcacaaggggctctgtggggtaactgtatctgtttgcttgttgctcccagaggtcattatcatgtagtgtccattggatcccacttctgatatcagatctgataaaagaaaatcttaagcacatttacattttcagcagtttagttgagcattcagcagtttgtgaatggggtagcatcagaccacaaggggctagcactctgcccacaggggcaagaggggaaacttttataaagtatttgcagaagcaacacaaatgaaaccaattttgattggttagagtggaaagtttctagttagaggttagttggtgatttctgattggtgcagtttctagtttcagtttactgtttacattgggctttggtttgttcacacacgaatttaaagtgacagagctagtcagtcagactcaatcagaatttttttttaacattgcctgtaaattggggtttccatgactcacctccttgggtttgatcagtttgctggagagtggttcacagaactcagggaaacacttttctgatatttacccatttattaaaaaggatatgccagaggataaatatgcacagtttgatggaagaggtgcatagggcgaggtgtgggagaaggggcatggagcttccatgtctcctttgagcatgccgttctccaggaacgtccatgggttcagccatctggaagctcccagaactgttttgttgttgttgttgtttgtttgtggaaactttattacataggcatggttgattaaatcattggctgttggttaatcgattcaactgtaagcccctctcccctcccaacaagttgggagtgggactgaaatttccggccctctaatcacatggttggttcccctggccaccagaccccatcttgaggctatctaggaacccccagctactaattatctcattaatacgcaaagacactctgatcactctggagattccaaagattttaggagctctatgtcaggaaacggggacagaccaaatatatattttgcaatatcacaacacgatgttctaaaaggccttttctatttgcgaggtatttttctgctaccctctgtagccagcctccagcatggtttgtgatgatctggtcttcacactcgtgtagttgcctcccacatgttaccaggtttagtctgtgtgaccagtagaatatagcagaaatgatatgtcacttctaagataaaggacagtggcttccatctaggggtctctttctctgtcaaccactttctctggaaaaccagctgacatgtagtgatcaggtccataaagaggtcaacatcgagaggagaaaaaggctcctcagtagctacgtgaatgagcttgaaagtgagtgagcttggaagcaagcctttggagattacaaccctgcctgagggcttgcctgcaaccccaggggaaatccggagccagaaccactcagctaagctgctccctcatgcctgaccttcagaatctgtgagatggtaaatgttcaatgttttaagctgctgagttttggagtaatttgttttagataactaggacatgctgcaattcctattgtgagtcgagttgtactccttcattcccaatgccctggagcccctcagtgtgtgcacacaggcttagttgcatgcactctctttctctgtctgccttcctcctctgtttctctttctctttgcctctctctcacacacacaatttcacttggctgctgacacggtttgggtgtttgttccctccaaatctcatgttggaatgtgatactccccggtgttggaagtgtggcctcatgggaggtgtttgggtcatgggggggatccttcatgaatgactttgtgccctccccttggtaatgatcaagttctcacccggttggttcacacgagagctggctgtttcaaagaacctggtccctctcttgttccttctctcaccatgtgatgcgcctgccttcccttcaccttccactatgagtggaagcttcctgcgaccctcacagaagcagatgctggtgccatgcttctgtacagcctgcagaaccatgagccaaatataaacctattttctttataaattacccactctcagttattgctttttaataatgcaaacagattaacacagttgcttaattctttttttttttttttttttttttttttttgagctgggagtctcactctgtcgcccaggctggattgtagtgttgccgtttcagctcactgcaacctccacctcccgggttccagtgattctcctgcctcagcctcccgggtagctgggattataggcatgtgccaccacatctggctaatttttgtatttttagtagagacggggtttcaccatgttggtcaggctggtctcgaactcctaacctcaggcgatctgcccgcctcagcctcccaaagtgctgggattacaggcgtgagccaccgcgcccggccttaattctttattatgtttatctgttatctacattatttctcttcccatacatcttttcttctcttttaaatatgttgttgtctgggtccctgctgctaatacgttcaatagtaaatatctcactgtaacacttggtatggcaacactctgagctcaggaatgatgtaacggttaaatgtatgtgtggacttgactgtgccatggggtgcccagacatttggtcaaatattttgggtgtgtctgaggctgtttttggatgaaatcaacatttgaattggtagactgagtaaagcagattgacttctccgaatgtggatgggcctcatcctatcattgaaggcctgattggaacaaaatggctgggaaagagggaacctctctctgactgtcttccagctgggacattggtcttctcctgcctttggacccaggcttgaactagaatctaatgccacagtttcttctgggtctccagcttactaactgcaggtcttgggacctcttacttagcctccataattgtgagatatgagaaccctgactgtacaaatgacctaataaactttggctagctaggtgactggaaagagctgacttagtaagtaatttctgagatgccacctgctgaaaagtcctttatccagcagccagtatgaacctggtttcaggtagggtttttcagtgaggcagattctagtttctgttccgaaaacaattggtttttagagagaaatgctgaaggtgctgttgcctttttgcttctctttgtctgcttgttcataagcagcagagtacaatctgtaaaggggagtatgaatagtgtttctgtttttgtttaagagtaagaaattgccagagaaaataattagggcttggatcagcttatttaaagcaatcatcttcacactaagatattactttggtttatttcagagcttgtttctgtgtgtcactttgcccccttctgcaatttgtgccctttgattttcagttcttaaaatttggaggcgagatttccccagaggattatctttctaaatcaaatcctctttatcaagaatctaaatttaaaattgcgtgttttgataaacatgcaggttaaatgtttagaacactacttagagaagatgctggggcccatgcctgccttcttagaaatccacagaaaggaactagggctgccagtatttgttgtatcattgggccataataggtttgtcatcttgataggctgttttcaccaaatatttgccaagaaaagagactttaagaattaaatgtaggccttaaacttgttctacttctgcattcaatagatatctgtttctgtttcattttaaaaagatgttagaccagctgggcgcgctggcttacgcctgtaatcccagcactttgggaggctgaggtgggtggatcacttgaggtcaggtgttcaagaccagcctggccaacatggtaaaaccccgtctctactaaaaatacaaaaattagctgggcgtggtgtcacgctcctgtagtcccagctactcaggaggctgaggcaggagaatcacttgaacctgggaggcggaggttgcagtgagccgagatcacaccactgcacttcagcctgggtgacagagcgagacttcatctcaaaaaaaaaaaaaaaaaaagatgttagaccaccatccagttttgtgaacctccctcacctgtggtggaaggttctttgcagatggtaataccctcccatcatttgcagcatctctagcttggccagatattcaaaacattgtgttttttgtttgtttgtttgttttttcataaatgccaagaatttagctacagttggtcaggcgattgtctactttgcattaataatggcatttgatattataatagggccgttatttcctttattatgagcttagcctttccattggaactgctggaataccttgggagatattgtgggtttgattccagacagccataattaaagcaaatatagcaataaagcgactcacacacattttttggtttcccagtgtatgtaagagttatgtttacactatactgtagtcttttaaatgcacaataggcattatgtctaaaaaattgtgtatataccctcgcccccaaaacaaaacaaaacaaaacaaaattgtgcacttacctcagtttaaaaatactttattgccaagaaatgctaacggtcagtgagtcttcagtgagtcctaatgttttttgttgctggagggtcttgcctcaatgagaatggctgctgactgatcagggaggtagctgctgaaggttgagctggccgtggcaattgatgggctcttcctttcacaaaaaaatttctctgtagcatacaatgctgtttgatagcattttacccacagtagaacttctttcaaaactggagtcaaaactctcaaaccctgctgctgctttatcaactaagtttatgtaatattctaaattctttgttgttatttcaacagtgtttacggcatcttcaccaggagtagatttcatctttgctcatctataagaagcaactccttatcccttcaagtgttatcatgagattgcagctattcaatcacatatccaggctccacttgtaattctgtaatagttcccttgctatttctgccacatctgcagttatttcctccactgaagtcttaagcctctcagagtaatccatgaaggctggaatcaccctcttccaaactcctgttatgctatgttttaacctcctcccatgaaacatgaactttcttaatggcatctagaatggtgaatcctttccagaaggtttttaatgtactttgcccagacccacccgagcaatctctggcagattggccacagtagccttacaaaatggatttcttaaataataagacttgaaaataggaattactcattgatccatggtatgcagaatgtatgttgtattagcaggcatgaaaacaacattcatctccttgtacatctccatcggagctcttgatgactaggtgcattgtaaatgagcagtaatatttggaaaagaaatctttatctgagcagtagctctcaacagtgggctgaaaatattcagtaaaccatattataaacagatgggctgtcatccaggcgttgttattccatttctagagcacaggcagagtagatttatttagcatcattcttaagggctttagaacttttgaaatgataatgagcattggattcaacttaaggtcactggctacattagctcctaagaagagagtcagcctgtccattgaagcattgaagccaggcattgacttctcctctctaactttgcaagttctagagggcattttcttccaataaaaggctgtttcatttacatagacaatctgttgtttagtgtagctaccgttttagtttgttcttgcattgctgtaaagagctacctgagactgggtaatttataaagaaaaggtttaattggctcacagtttcacagaccgtacaggaagtatggctggggaggcctcaggaaacttagaatcatggtggaaggcaaaggggaagcagggacgtcttagatgggtggaacaggaggaagagagcaaagtggggaggtgttacacacttttaaacaatcagatctcttgagaactcactattgtgagaacagcaagggagaaatctgcccctatgatctaatcacctcccagcaggcccctcctccaacactggggattacaatttgacatgagatttggatgggaacacagatctaaaccatatcagctaccttcataaattatcttagctagatcttttggatagtttgctgcagcttccctatcagcacttgctgcttcaccttatacatttatgttatggagatggcttctttccttaatcctcatgaaccaacctctgctagcttcagacttcttctgcagcttcctcacctttcttagccttcatagaattgaagagaggtaggaccttgccctggattaggctttggcttgagggagtgttgagctggtttgaacttctatccagagcattcaaactttgtccatatcagcaataaggctgtttttgccctcttatcattcatgtgttcactggagtagcacttgtaatttcgaagcttcaagaactttttctttgcattcaaaacctggcaggtgcaggcggtctggtttttggcctacagagactattgacatgcctttctcgctaagcttaatcatttctagcttttgatttaaagtgaaagatgtgctactcttcctgtcatttgaacacctagaggccatcgtagggacattaattggcctaatttccatattgttgtgtctcatcaaatagggaggcctgaggagagggagagagatgagagaatggccagtttgtggaacagtcagagcacaaacatttatcgattgagtttgccatcctgtatgggtgtcgtttgtggcatcccaaaacaattacaatagtaacatcaaaggtcactgatcacagatgaccataacagatataataataatgaaaaagtttgaaataatgagagaattagcaaaatgtgatgcagagacacaaagtgagcatgtgctgctggaataatggcactaatagatagactttctggacacagtgttgccataaaccttcagtttgtaaaaaacatactgtgaagtgcaatgaagtggagtgcagtaaaacaggagtatgcctgtacatgtaaacatgctttctttggtgctacttcagatacttaggaagccttgaccatagtccaagcagatgagttttggtgcttgagtattttaccccaggcagactaggagaagtttgtgtgtgtgtgtgtgtgtgtgtgtgtttgtgtgtgtgtgtttgatagtctttatttattttgagacaagttcttgctcttgtcactcaggctggagtacattggcacaatcatggctcactgcagccttgaccacctgggcttaaacaatcctcccacttcaacctcttcagcaggtgggactgcaggtgcacaccaccatgcccaactaatttttgtatttttcatagagacgggtttttgtcatgttacccaggctggcctcaaattcctgagctcaagcaatatgcctgctttggcctcccaaagtgttgggcttggaggcgtgagccactgtgcctggccgatagtatgtatgtatgtatgtatgtagagatggagtctcactctgttgccaggctggagtgcagtgtcgcgatctcagctcactgaaacctccgcctcctgggttcaagcgattctcctgcctcagcctcctgagtagctgggaccacgggcgcatgccgctacactcagctaatttttgtatttttagtggagacagacggagtttcaccatgttggccaggatggtctcgatcttttgacctcatgatcctcccaccttggcctcccaagtgcttggattacaggcatgagccaccgcacccggcctagtctttgtattttagggcagttttgggtttacagaaaattgaacaagtagtgcagagttccttcacgcccctagtttcccttattattaacaccttaaattcatatggtacatttgttacatttggttaatgctgagacattattattaactaaagtctgtagtttttattagtgttgtccagttcaatggattttgacagatgcataatatgtagccaccattgcagtatcatacagaatactttcactgccctaaaaatcaccagcaccccaacctagtcattcctgcttgcctccccctcagcccttggtaaccattgatctttttactgtctccataattttgtcttttccagaatgtcacatagttgagatcttacagtattttggcttttcagattggcttttgtcaataatatgcatttaaagtttctttgtgttttttcacagcttgctagttcatttctttttagtgctgaataatattccactgtctggatgtaccacagtttattatccattcacctactgaatgacatcttggtggtttcttgtttttggtgatcatgaataaagccactatgaccattcactacagggttttgtgtggtcataagttttcagctcatttgggtaaatacctgggagtgcaattgaaggatctgtgatatattcttggtcccagcatctctcctcctgctgacaattaccctccttattgtgacaacctaaccaggcctgcctctcccagggcttcctcttcttcacttagagcattttctgaacaagtctggacacaaaggtcttgcttatattttcaggaaagagtatttaaaatacttcttaatcatggttccaacttatttcaactcttataattaagtgatcattttttttttaaattatggtagaatatgtgtatataagatataatttgtgattttaaccatttttaagtatacagttcagttgtattcatcatattcacatcattgtgtaaccatcaccactatctgtttccaaaactcttacctggggatatgatcattttaaaagaggaatttgaagaaatacatctgaagctatatttggcaatatgtttccatcagtaactcccaaaatctcagtggctattggcaacaatctttatgtctccctcatgttatatatacatacatatatatatatatatatatatatatatatatatatatatatatatatatatataaaattttcttttgtctagaacttagtcacatggccacatctaactgcaaaggagcctgggaggtgtagtctagctacctgcgtaagaataagaacaaattggcttggcgatttgttagcattcctggccatattaagtaagattattaaatcatacacattgttaacttgatctttcagagatgacatgacagtaattgtatggtttcatagatctggctgtgtttcaggagagcatttttccatcccatgctctctttccatctaaacgttaattatcttatccttttaacactgagagagcttcctggaataaataaaattatatgcctattttgataaatacctgtttgatagcgatgttttataaaactctgagaaaagtcaacaaggagccttcacagtgattaatacagcagttattatggtcagatgttaaaaaaaatctcatgtcttcagtcttgtgccaaaaggcaaagaaagttttgaagctttccacacactgatttggtttcaagataatgggctactattgagtttacatgtagcattggtcttctgctattgtctttataaaggaaagtatgtgaaatttggaattggaaatgtcatttcttaaccagagtagcaggttcagatggtgaagctatcacttttggcacaggactcttgtttcttaataaaatttaatgaaaaattgacaagatttgtgcagtgtatattttttttaatggttgacccactgaatgcatctaattagcttattacagtttaaaagcaagtttaactgcctaaatgtatgacttggtattttgatcttgtttgttaggtctcagcttgctgatgatagaagtttgtggtccaatattaattttaaataagtgcctactgttctctagaaactcccattcccttaaggaaaagtgtttcatatgagcctctcattgccaggaatagctgtgtaagcattgtggaagttttttccacattaaaatgtagtccaccagttcatttattccttttagggttgtgacagtcgcttgtgtttatgcacccctgtagagctgtctttaaactcattcagcaaattggaaacatttagcttggatgacacctctttaatcttccagtaatctcaccatagagaccactgtactctcaaatacattgttaatacttttagtaagaatggcctgctttcattctcttattactgagccattattctggactctgtttattattattattattattccagagtcgaaataattatcccgttgaaaagaccaagcatgtgcacaccctgttgtgacacagccggttttgtcctatctgaacttgcctgctttgtgaactgttagggtctcagaaaaacaaaaaacaaaatcttttatttttaacatttaattttttatagtttttatattttttaattgagacaaaatatatgtatataatttaccatctgtaccatttgaaatgtacacttccttggtaataaatatattctttattcccccttccacctttattccatcctttattcctacccccacccctgctcaactcctcctcttcccagcctctggcagtaatttaaagtgtgagtgacaatctcacctcttataattatgtgatctttttttttttttaaattgtggtagaatgtgtataacacggaatttgtgattttactctctcttcacgagatctacagtttttagctccacttgagtgagaacgtgtgacagttgtatttctgttcctagcttatttcacttaacataatgacctctagttccacccatgttgctgcaaatgacaagattcatttttttatggccaagtagtaataaattgtgtatatataccacaattttctttattcaactattaatgaatataggttgattccatatcattgctattgtgaatagtgcttcaataaacgcgcacgtgcaaatatccttgacatctgatttctttacatttgggcaaatacccagtagtaggattgctggatctattaatatgttaattctgtttttaattgttttgagaaatctccatactgtttttcacagtggctgtgctgggaagatgtgtcagtgggtggggggaggataaaacgaggttagttaatggttacaaacataccttagaaggaataagttctaatgttcgatagcagtgtaggatgaccatagttaacaacaatgtattgtagatttcaaaatagctagaaaagaggacttggaataatgccaacacacagaaatgacgaatactcgaggtgatagatgccccaaacccctaatttgatcattacacagtgtaagcatgtgatagagtatcatatttgtgcccccatatacatgtacacatatttgtatcaataagaaatatatacaaaaagccaaacctttttagctataaaatctgtctcttatgttcaaatgtatatagttagaaagtgctggagtcctgtaacatcagtattcagagtttactcaagctttcatcctcaggcaaacttagcagctgttatctaaagccagacttgcagcatcagaaatcacctggagcttgtccagaaagcaagagtcttgggctccaccccagactttctaactcagaatctgtagttccacaggctcccctggtggctctggtatgtaataaagttatttgagaagcactggctggagatcttttacctgagcctgtaatcatggaatcacccatcagtatgtggagtgaccataacatttcaactcaaactctatttctaaaatgaaaaaatctgtctattgtatctaattaagtatatgacaaatatcaagctctctttccactattttctggtgttctcatgatctgacaatgacagtggcaggaccatgtactgagatgaccgaagtgaaaatagtaatgctcttttgtgtattttttttttttttttttgagatggagtctctgtcgcccaggctggagcgcagtggcgcgatctcggctcactgcaagctccgcctcttgggttcaggccattctcctgcctcagcctcccaagtagctgggactacaggtgcccgccaccacgcccagctaatttttttgtaattttagtagagacggggtttcaccgtgttagccaagatggtcttgatctcctgaccttgtgatgcccgcctcagcctcccaaagtgctgggattacaggtgtgagccactgcgcccagcctcttttgtgtattttagaatccagtctgtgactccttgtgatagagaattcaggcattcttgagacttctcaacagattctgactttcccaggtacaggcttatccagacgacatgtttggagataggttgagagagggaatgacatcttatgcttattatatgtcactcttgctcttcagtatttgaaggaaacactgtgtgaagaacaaaaaccttctgtcctggctgctgacattaactcaattttagttattttgagagggcagaagaatattctaagtagactgttaggggttcctaacaagtgagaatttctttgcaagtcagtgggccaaataaacgatttctttaaaaatacaaatccattttatcacttaagagtatttacatttagttccaaataatttgcatatgcctgctaggttatgcctttttattctagagaagaggctccaaagaggatagtttttttttttttctttcttataatactgtgctataatagtcttttttcccccattgggatggaaaataaaggagaaaagaagtggcattcccatagggaatatttcctaagtttctaatgcaaagtttctaatctgaaaactgccacatatttttaaaagaatgccaacatgatttaatctagtttcattcagtttaggaactgaaatgcccctgggtgagggacagcatccctgaaccttccttggcccctggtctgccccgcccctccccatccccactgtgcttcctcttctgcattgtcttctttgctcttaaacacacacatttgaaaactttatttatttgttttttaaagaggtggcaccatcgtagctcactctagccttgaactcctgggctgaagtgatcccttctgacccagcctcctgagtaactggaactacaggtgtgcaccactgtgcctggctaatttttattttttattttttttgtagagccagggcctcgctttgttgcccatgctggccttgaactccaggcctcaagctatcctcctgcctcagcctcccagagttctgggattataggtgtgaaccaccatgcctggcctaaaatactttttaaaacttcttttcattcgcttcttccctttcctttcctccactgcctaccacttctgcttatctgacatctaccatcactctcactaaaacttcagtgcgagatcaccagaccccaagtcctgtggcttcttcttgcgtctctttagcatttgatcttatccagtttctctcctcccttgattcctgtgacattggtcactcaaggttttcttccagatgttttgcttcttgagagcaatggaattggaatcctaagttttaccactttctagctctgtgcctagggcaagacacttaactttgatgtgtctcagttttgttgtaagataagggtagggaaaaacttaccccataaaattgatgcaagtgcatagaagaatgtctggcacatagtaagggttccttaaggataagtcataattattgtcatcattaaaggtcattgcttgccctttttaggctctttggcctgcatgctgattgtaggtgttcactaatttttccactccttttcatagggcctctcttctcttcaaatttttttttgacgatctctgggtttcccacattttatatcttagcccctaactttttccctgaggatagaagtttaatttctaacctcaggctggccatttactccagaagtcttgtgagctctattaaccaaatctgccaaaatgcagctcattctcttatcacctaaagtctcttctctctgttcttcagtcctgcctctcttttgccaccatcttcattaatgcggtcactgtcctttacaactcctgctggggtatcacacgttggcttctcattgcccgtcacccaagtcctccagttgatctccagcatctgttgattgtctgttcatggtgtcatgcagtgtgtctttgctttgctgttcccgcttctgttccatgcagggcacatgccttttgtattagttggtttgggccgcaataacaataccatagaataggtggtttgaacaatggaaatttatattctcacgattctggaggctgaaagtccaagatcaaggtgctggtggcagggtagataggtttctggcatgggcttgcttcctggttgacagagagctgccaggcgcagtggttcacgcctgtaatcccagcactttgggaggccgaggcgggcggatcacgaggtcaggagatcgagaccatcctggctaatgcagtgaaaccccgtctctactaaaaatacaaaaaattagctatgtcctccctggccttttttctgtgaaaaaggccttttgcgtgagcatccctagtgtctcttcttactaggacagcagtcctattggattagggcctcaccctatgaccctgtttaatcttaattacctcctaaagaccccatctccaaatacagccatattgggagttagggcttcaacacatgaagctggggagacacaattcagtccagaacacccttggcgctgttgctgggtagctgtcctgacttccctctcccctcggcagtccagcttcagacaggggtgagaatgatctttctgacacgtggctttggcctcccattcctaattactcgacttggctccccacggcctagatgcagtgagaggaaaatgaccactgtagggtggcttccttcatttctcagttccttatgctcactcctctggaaattggagataacatgactaacctcgtgttattgagggattaaataaattctaatgaagaattgttgctttaatctgacgaaaaccaaattcctactctccagcctccattcgagttcttccatcaccttgttactccaagtgtgatcccatgtggttccagggccagcagcctcccatcaccaggatgcagactctgcatcacagcaagatccccagggccattagatgtgagggactggcttatccttactgcccggctctaggctacagccacaggatggagaggacagggacttggaggcacgtaccaggcttcaaactgcggctcctttacttgctagctctatgcccaaagacaggtttacaggaactgtccttgtcttgtttcccctctgaaaaatagggagaggcagaggtttacctcacagaggttttgaggattagctgagaaattttgtaaataagagagcatctacccttgtgattttaaattgaatttcatacttaaaatcaagtactttttatttggagtcaaggtttgtttattgtggcacagtgtcggggaatgaagaggtgtggggtgtggggtgttcattaacctctcagcctctctgccctctcaccctgtgcaacagggtccccactggtctccctctgggaagatgtgaccagcatgggatatgatggggagacttcttttctgtagaaggtaaaccaactgctgcttcggtggaaggtggagagagcccttccagctctcagaaggggcctggagccggtatgtgcctgtgtgtctgtggctggagcccagtcccattaggccctgcccccgtgattgctgtgagaggtggttgccacacactttctccacagcgccctcagggctgctgaatctaaggcagaggagttcttgttttttgtttgtttgttttttagcccttttcaaatttacagaaggattgcaagaataagaatagtgtaaatacctgctcctgtgttactttgctgaagataatggcttccagctccatccatgtccctgcaaaggacatgctcttgttcctttttatgactgcatagtattccatggtgtatatgtgccaacaacacaggtgtgggggagggagagcataaggaagaatagctaatgaatgctgggcttaagacctaggtgataggttgatttgtgcagcaaaccactatggcacacacttacttatgttacaagcctgcacatcctgcacatgtaccctggaacttaaaagttgatggggggaaaaaaaaaggacacctgcattctctactcagggtcactgttaacgtttagccccatccggttgaccagtctctctgtgtgtggatgtctgtacacatgcatactcttattttctgagcaatttgagaggaagttgcatatatcatggcgtctgcccctaaatacttcagtatatattgccattgcctaagaaaggcaatattctcaccacagttgtcaacgtcagtaaatttgattttttttttttttttttttttttttttttttgttgagacagcgtctcactcttgttgcccaggctgggatgcagtggcacgatctcagctcactgcaatctccgcttcccgggttcaagcaattcttgtgcctcagtcttctgagtaactgggactgcaggcacgtgcccccccaaccagctaatttttgtatttttagtagagacggggattcaccatattggccaggctggtctcgaactcttgatgtcaggtgatctgcctgccttggtctcccaaagtgccaggattacaggtgtgagccaccaagcccagccagtaaatttgaaattgatacaagacttttatctaatctgaggtcatattccagttttttcaatggacctagtaatgccagtctcctttaatgtggattttcacagtctttgtcctttatgacatcgatgtttttgaagaatgcagcccctcctcttttaaaaactagaaccttccggtcaggctcggtggctcacacctgtaatcccagcaccttgggggaccgaggcgggtggatcacgaggtcaggagatcgagaccatcctagccaatatggtgaaactccgtctctactaaaaatacaaaaattagctgggcgtggtggtgtgcgcttgtagtcccagctactcaggagactgaggttaggagaatcacttaaaccggggaggcggaggttgtggtgagtcaagatcacgacactgcactccagcctggcaacagagtgagagtccgtctcaaaaaaaaaaaaaaaaaaactaaaaaaaaaaaaaagcaaaaaaacccgaagcaacaacaaaaccccaacaaaaacttgttttggatttgtctgatgtttcctcatgattcgattcaggttctgcattccaagcctgaacactatgtaggtattcagagcggtccatctgcctctcactggggtatggccatctctatccttcagtcagggtggggcttttctccattatactgttactacacttgatctcagccaaaaggccaagaagtgatctccactcaatgtttttccttctggcagctagttaatctgtggagaggcactttaaacatcatttaaatatcatcttcttcctcaaaatttctcccgagctttagcatccagcgatgatttttgtctgaatctttacaaagatggtcagggtggcattcttctgtagttcttccttctctctatttattactttcttggactcttggattcctgtttttttcagtggtttataatccctgactgtccctaatttttttggcggcctgattgtcccatattggctagttggagccccttccagccagctgctgtatcaccatgacacgtctgcattccccaagtatctgcggcctgcctctcctggtggacagccacattgtctccctttgacgtgccctccaagtaaatattgtgtttcatagcttttaaatcagactgtcctttatatgtctttcaagtttgtggagaatttacactgacatatttgagtgatgagttaacaggcagacagaaacttaattttctttatagtcatttgtacctactaccatttccgtttgcaatgacatgagtcgtctccggttattaccctgcagtacatacgcactttactggctgcacctagttgacttctgaactgcccttgggctccctctgctggcatagtggtgcgtgagcacttttctggggtcatggaatggatttctctttctgcccattttctttcttttggtttgtggttttctctctcataaattattacacaaacatggaccatacaatacaaccttctttcaaacctgatttgtttgctaactgtatcagtacctttccatataaaattcataaatatttttatataattatgtcagtgtttccatatttttctattacctgaatgttctttttagcatttaaataatccatttttagtaggcatttgtattgcttttttccatttcaggtagcatctaaagtgaatgtcccttgcatgtatactattcatatgtgacttaataagtagagcttgctaaatgggtaggaacttacaggaaaaggggaaactctagtttgagaaaattgtctgggctaagtttaggatgtgttcaacaaacaggaaagtcaagtttggctaaagcatggttgagtaatagtgggaaatatggtcagaaagtaggtatgttaggactctttctactgaaatgatgaaattcaactccagccacaagtggagcagaacaaaattgtgtttgtttaataactgggaagcccagggtagctggaggcaggggcttagatgctgctgcgccatcccttacctgtctgtttctgtttctccttctgtcccttcccagtctcagcactgagtctcttgcccattggcctggtgagggaaggagctgccagccccacccaacagctcaggttacagagagagtcactttcttccattactcacagagtaaacatcaaggaaggccactgattgattgacagtgtctgggtcagatgtctatccttaggccagtccctgtgaacaaggggatggggtgtctgcgtggaccagatctgaagcacaggcccatgcctggggccagggggtgggaactatggacctctctccccactgagaaccccagggagcaggtgaggtgaaattcctctaggggaagaggggcaaaattgacaagatagcagatgtctaccatactgctgtggggcctggtccctcccagaaggaaaaacatagtaacaatagagtgggtctcaccctccacctgggtctcaagtagggtgtggatgaggacaatggaaatgaaggaaaggttagaaggcctgtggtaccggttggtagatagctcttcgtgctttctccatatggagtgagagtgcttggatgtgattccttcaaagtcaggtctaggagactcaggatgcctaatctagaggtaagaacattgtgaggaaagccagtgaattcagtcttgtgcatgctgactttgaagtacttttggaagagccaagtggaattatccacaggacaggaccaaatcttacctggttcttccccaggccgactagtccacaacaggaaataaaaagagttgccccgataccaaggtgtactagtccattctcacactgctatggggaaatacctgagactgggtaatttataaagggaaaaggtttaattgactcacagttctagatggctggggaggcttcaggaaacttacaatcatggcagaaggcaccacttcacagggtggcgggagagagaatgagtgcccagcgaagggagaagctccttataaaaccatctgttctccttataaagatctcttaataaaaccgtcagagaactatctcattcactatcaggagaagagcatgggggaaccgcccccatgattcagtttactccacctggtcccgcccttgacatgtgggtgttattacaatttaaggtgagatttgggtggggacacagagccaaaccatatcacaaggctttctcctccttgctgggattgtacccatagcctctttctgagtcctctctcttttagcctctttatgcctgcagtgcatccttataccatttctagagtcatctttataaaacttatactctccgtatgactcataaatcctgtttttttttttgcacagtatattaagtataaaatttgttaaagtctttaatggtctgcccccaagctacatttccattttgtatgtctttcagttcctttctactttgtatttggctgttgagttaactgaatttttgccattccattaacccatcccatgcttttcccacttctagatttcacttttcttgtaggctagaatgtcttgactgggatctgactggagataatgagaacaaaaactggttcaaagagccaggatgttgcataaaagtcctaagattgtatctaagcaggtaaaataaaaattttaggcaattacttaaatttgaaatgctcacatttattaataaggcatgtaacatctacatgagccatcatttgcttttttaattccacattgattaggagccaaaccttcagggcaggtatccggtagagcgccctggagaggccctggataggcacaggcgcctgtcagggggctcttcacatgctgtgtgctgctgctgggagaagagggggccagagactagggggcttctaagaagaggtggcatttctgcctcagtgttgaaggatgaataactttgacaggctggaaaaaggtgacatttcaggtagagcgtgtcacatggatgtaaataccaaaggtcaaggacatgggcttgagagatggtgagaaggatggaggtgactgtggcttgcattctatccgtatcactattaattaccttctaatgcctttggctctaggtggtggaacaagtaaagtaatggacaaatactttttctaccaatatttagtgaccaaatgcagagttatggagagggccagggacctcatgaaccatactctttctagtctagggacataactccaatgcctttcctgtcccagtaagaggccatggatttcaagaagccagacaatccattctttcagataatgataaaaaagaaaccatttattttatttctaagtatagaatgaaacatttatagttgcccaaattttggtaccttttaggagaaaaatacagatttttttgttgttaaaaataaacttaaaaaaaaaaaaaaaagacttaccatagtccgggcacggtggctcacacctgtaatccgagaactttgggaggccgaggcaggcggatcacctgaggtcaggagtttgagaccagcctggccaacatggcgaaaccccatctctactaaaaatacaaaaattagccgggcatagtgggtggtgggtgcctgtaatcccagctacttgggaggctgaggcaggagaatcacttgaacccagaaggtggaggttgcagtgagctgagattgtgccattgtactccagcctggtcacaagagcgaagctctgtatcgaaaacaaaacaaaaaaagacctactgtaaatagagtacaacatgagactaacaaaaataacaaataaaatcatccagcatatattctgtatttaaaaaaaaaaaatcacaagatgaatacagaccatcttggtgcatatgtattttatacactagacacatgctgatgtttttaatgcttaaaatatattaggtttcatacttgcttccaatccaaggagagtatatctgagctctttttttttagatttgaaaaccgccttttagattagattagaacactgcctttttttttgttatgcagtaacagatcattgcccacctgaaagcgagtcgcctttatttttacctccttagtagaaccagcaggagctgcaattgctgttgcttgagccaaggccacagtcagcatagaaaggttctgctaagagactgtgttaaaggaaataaatttggtgacttagttttgttttacaagctagctgtggcccagtccttctgcagggtgggtacgcaggtttattgcagctctgcagagccatggccttagacaaacaaagaaggtgtgggaatacccgggagctttccattcaaagtagattcttctcctttgagtgcatgtaactgaagcaccagctttctaaaaaaaaaaaaaaaaaaaaaaagagagagaaaagaaaagtcagtctgaagtttttgtgacactcagccagactccacattagataaagtaatcatggaaatacagctttatttttataccaagttgtgcttagaaagctgattgctaaaccaggaagcttggctttcagaattttactgtaatccagggtggaaaaaaagtatcactcagatggcatttgtgggagattactgactggtaatccctccttgtcctagaagattaagtctgccctggtgtagtcatggtcagctgatttttttatttatttattttaaataaattgtagtttcttgttgtaagtcagccagtgtctgatgtttgcctgaactgtttgtacctctgggccatattgcagaaccctgcccttctttgttgactgaggaaagctcgctccctgcccaggtttttcattgttgatcgaaattaacaccaggtggtgaatagagcccctcctaaggttgctcaggataaatcatttattaaataggtctgcttatcaggaggggcgtgaaggctcccaaaaggaaatgctggcacctgggcccagaagccagggcctctaactcctggggttgatttcttcagtgaagttgcaccctacaaagggaatatggccaaagcggcactcaactgaaggctgatatcaggcgattagacagccatgcattctgcgtttgtctggaatggattgtagagagatggacttatatgaggactaccagtccccgtttgattttgatgcaggagtgaacaaaagctatctctacttgtctcctagtggaaattcatctccacccggatcacctactcttcagaaatttggtaactactaattttgtaaagttaagtttgcttggaataaaacctagacataacttggggtttgcctggctttaaaattgttagtgtaaagatgtaccagggtggtgttgggttgtaactagctaataagctattctagattcaaagtacagagatagatggctcattaaatatttagaatatgtgtatacttagaagttagattttaaagttagtactatttatgcgatcactagacttctccattgatagatattccaagctcactttgagtttgttgagctggtaaataacaaaaaaggaggaatctgaagtccttggtttctagttgcttaggtaatttacgacaactttcccgatttttctctttagtaaaatgatggttaagcactgactcagttcaaggtcttgctaatgactgtcctgggttttgttatggaatattgagagcaacttacagaaattgctaggcaagagatttttttttttttaaagaaaaactagaaattgctgtacctttagaagcagttattccttcatacttaccagtatgagattgctttgaaggccaggagcaccatcagggaggcccttcctttattggcacaaggcagcagaaagccagaagcagcttagccatcctcccggctgggtccctcatctcatagccaatgctgggaactggttaaatgaccttctctgtaatttgccaaataagcaatcaggtttttccagaagttaattttttccttattaatgaagaacaggtcacattttgttcattttaagctgaaaaaatgggtaacctagaaaaaaacatggtaaaggtgacagcatgaaacttagttttaagtattttaggtttgtgtatttgccgacagtagggatgtgtgaagcagcattcctctcttggttgcacctggtagccatctttccccaaaagtggctgggatttccaggaacaggaaaatgttgaatataacagagaaggggtagagctggtctgtagaagttgggggcaggaggcagcagcttgatgtctgctgggggattctgattgccaggaaactttctccagtgctgaccttgccttgcccaagtggcccccctcagacctctgtaataaaggggcctgggctccccctttgcccagcccccttctaacttataaattttatgtataatttaataggggccacacagaatggggaagctagagcttgataatggactgaaactcaagtgacttgcgggggagggagggaacctttgagaagctggggctgtggttttgtgacttcaggtggaccttgatcggtgtgcaagcatccagattcccaggaagattgacactgcttgcttcttttagttcccttctacccttcttgtctcttggtttcacctcctttcattttccaagttatggtcatggctgccttgggatgttttctgtcaaaaccagggcagttgtagggttgggtgtacctctaggcagattctgaaagattatcttcacaattcctgttagctgttcgaaggaacctggggttgtgagatttaaaaaattattaaaaagcaaatgaataacagtaatgaaaaacaaactcatgtagctaggtttagtagtttgcattaattgaaagaaaagagggtgaacaagcattaaaacaagcagaaaccaccctcagcagtcatctgtaagaacacagtgattttaaaatggccaaataaaagtgggggcctggaagagtgattactcatctctgtgcccatgacccctcagggcataagaagtctgcacacctgtctgaacatcaaacatggttggtcgatggaatgaataatgtgtcctccgtgtgtttgcactctttgtatttctacgtagaagcttttaggaccaatacattatgaatccattaaaagttcttgtggcttttggccactatgtattttcttaatcaccagacaagtaatacagacaagaaggactgatataaaaaggaatcctacccagagaggttgggaatactgatttgaaaagagtgaaaaatatctctgatatttatccaaaatgccatcatggggcaaacgggaaagtaatgagattttatctatgggcaggatgttcctaagaagtaattaaagcgaaggttaggatgaggacagtggctgaaacaaaatgaagccttttattagggagttttaaactcctttgacacaaccaacccatattcagaaatgccttatacctccttacctgcaatcctcacaaatataagaatctatcaataactgaagcaaaattttatgaaccagaacttctccttactatatgtgatgtactctgacattttatactatttgatgccatttcttcttttaaagtgctcatctggttctgctaactggattttacaacccatagtgtgaaaacaccaatttataatagtttcagaatctggaacataagctttgtttgtctttttagttcacctctgtttccccaagcaccaagaatagtgcttgacattatatggctcaaaaactttgtggaatgcatgaatgaatgaatgacactggtaaggagtcgttcacactccagttcattttacggatgtgaagattgaggctgagagacatatgtgatgttctcaactcacaaagtttagttaggctaagataggactagcactcatctcttaattcttaagctagtggtttggttttttgttttttttagaccgcaacatctcagcctctctggtaatggatattatagaacagattaactattcaaggcttaagttctcctttggtcaagtgttttaccgtgggaataatttgttgatactttatacgccacttggatctcaacattctattccatctttgggctgaacattatgaggaccagggtctcacagctggggtcttttgttgcattatctcttccattctgtgaacacccttaaggataatatcccaaatgttatttacatagcacctatcttcctcttaagaattttttttttttttttttgagacagagtcttgctctgtcgcccaggctggagtgcagtggtgcaaccttggctcactgcaacctctgcttcccgggtttaagcgattcttctgcctcagcctcccaaatacctgggactataggtgcgcgtcaccacatcgtgctaatttttgtatttttagtagagacggggtttcaccatattggcgaggctggtcttgaactcctgacctcgtgatccgcctgcctcggcctcccaaagtgctgggattacaggcgtgagccactgggccgggccagaattttcttttttaaaaaaaacttttggctgggcgcagtggatcatgcctgtaatcccagcactttgggagtctgaggcgggcagatcacttgagctcatgagtttgtgaccagccatcatggtgaaaccccatctctaccaaaagtaaaagaattaatcgggcatggtggcacacgtctgtggtcccagctacttgggaggctgaggtaggaggattacttgagcccaggaggggattgcagtgagctgagatcacaccactgcactccagcctgggtgacagaatgagactccatctcaaaacaaacaaacaaaaaacccttttatttgaggttcaggggtgcatgtacaggcttcttatatgggtaaacatgtgtcataggggtttgatgtacagattctttcatcatccagatactaaacctgatacacagtagtgattttttttccctttttttgctcctcttcctcctcccaccctccaccctctggtaggccccagtgtcatttgttcccctctttgtgtccatgtgttctcatcattttgcccccacttataagtgacaaggtgccctgtttggttttctgttcctgtgttagtttgctaaggataatggcctccagctcatccatgttcttgcaaaggataggatcttgttcttttttatggctgcatagtgttccatggcatatatgtaccacattttctttattcagtctatcattgatgggcatttaggttgattccaccctttgctattgtgaatagtgctacaatgaacttacgcatgcatgtgtctttgtgatagaatggtttatattcctttgggtgtatacccagtaatgggattgctggggagaattttctaatgtacaggaagatgcagacttggcttatggcacctttggttatttctattgacttaaggaattatgagcaatggaaaaatctgacattttagtttaacacgatcatatttgatactctagaaagactgaaaaatcaaactgaaattccttagctcatagttcttttcattctgttttaccctttttgattttcactctgtgtcattctcacttctttttagagaagtggttaccacttcttaaaagtttttcatgattgcatcagtcttaaatagcaaacatggctgtggtttacaaaataaaaactggagtcaaattgaagagatgtagaatttccttattcctagagaggaaatttaaggatggaagagacttcctctctggggattctgagatttctgcatggctgacctttgtcactcttttctggaatgtcccagttactagttttatactcaattttggggcaggggagcagagcagtggggagaggagatggctctgaagtaattgactgaagattttttcttttaaaaaaaaatgaaagagatttaagggtccatttagaaatacctggaaggaccaagtaaagcatttgaaaatactgtgttttaccttgaggatcgtttcttctttgtccactctttctgtgaagtgaagctttgggaggtaaccttctgtcttgggtggggacattgaccactgttcagggtcctgctttcagagctgagtcccaggagcactttgcacccgatgtggctcccaagcgctcctttccctttttgtcttagtgcagcccctcccctcctgctctgtttcctttactctttaataacccagacattggccaggcgtggtggctcacgcctgtaatcccagcactttgggaggccgaggcaggcggatcatgaggtcaggagattgagaccatcctggccaacatggtgaaccctgtctctactaaaatacgaaaaattagccaggtatggtggtgggcgcctgtagtcccagctactcgggaggctgaggcaggagaattgcttgaacttgggaggcagagattgtagtgagccaagatcgcgccactgcactccagcctggtgacagaccaagactccatctcaaaaaataaaaaaaaataaaaaataacccagacattgtccccttacgcttgtgaggagcttgggtcttcccttaaatggagtggatcaagttttctcagtttttttcttccctgctaccttgactacaattacccaactcgttttccccctaaggttttactgttcttgccatgggcacacatgggaaaattccagccttaagaatctaaagttgtcacggcctgagctgctgcatccctctcttctgaaggcactcagtggcagacagcatcctcttagatgctccctcgccttaagtcagtggttctcaaccacagttttgccccactgtgggcatttgaccatgtttgtagatactcttttggttgttacaactgggtgtgggtgtggggctgctactgacatctggtgagtgggcctgagatgctacacaggaagatgcccagggcagtccctgccacagtcatccaccgcatgacgcccgtggtgccgtgcctgagaagcgctgccttaactggatgcttaatcttttgggtctcccgaagacaaccattgtggtgtggggacttgcaaatattcctcccacttctgggattttattacatccagaaacaacaaggcacagagaatgggagccccaggcacagacttaacatggggaaaaaacatcctgtgatctttctggatgttaccactaaagatactttgaattatatgtttaaatctctttttatgcctctaggtttaaaaagggggatgcatatttcctcttgtttgtgcttaaataaaacagtcatagatactgaagtttcttaccgcgactccggtcttaaagttattggtcctgctttgaagacttgtgtaggaaaggcctgtgcagctttattttccagagacgcttccagggctcaaatatatgttaacagattctttcttgggtaggcagtgttaacattcaggctaaatagcagatatcttagactccattttggcatctttttccctcctagttgaatttttttgggggcagctgacatattctttctgtgatatcatttttgtcccacctatgtaaccatggtacttttgactgcacactgttttcctgtaatatgaaggtaggtgacctgcccccaaaagtgacaatctttggacagattatgtatgagatggaagtcatatttctttaggaaagtgacatttcacatctgctttaaatagaaaaacctttctaggtaaaaacagtgaagtgagaatgcaatatataaaataaaaagctcgagataaaaggagagagaatgaagggagactgggttcttatctttccttctaacttgactgtataacttcctataatccatttatccacagtgttgacacgcatctgctgtgtgccagacactgtgcatcagagatcctgctaaggctaaagacacaggattggagcatgaaggccaagtattgcccagctgcagtctgtattctatacaatagactggaccgtaggttcttattcccagagccaagaactgtttctcagccaaggtcacggggtccaggggagatcccccaagagtaggagacacttttgacttatttaagctaatgggacctggaaatagggatggggtttcaggcagagaaaataatatgtgcaaagacacacgaaaaatagtgtgttttagagatagcagagatggctgtacaacattgtgaatataattgatgtcactgaatgacacacttagaaatggttaaagatgatacatttttgttgtatattctaccataataaaaaattaaatgggccaaaaagtatgggaggtacatttaaacaaaaattttttttgagttaatacctttatttctttccttctttctttctgtatttctttctttctcgctctcgctctgttgcccaggctggagtgcagtgggtgatctcggctcactgcagcctccacctcccaggttcaagtgattcttgtgcctcagcctcccaagtagatgggattacaggtgtgcgccaccacacctggccaatttttgtattttttagtagagttgaggtttcaccaggttggccaggctggtctcgaattcctggcttcaagtgatccacctgcctcggcctcccaaagtgcagggattacaggcatgagccaccatgcctggccaagtttatatatatatatatatgtgtgtgtgtgtgtatgtgtatatatatgtgtgtgtgtatatatgtatatatgtgtgtgtatatatatgtatatatgtgtgcgtatagatgtatatatgtgtgtatatacacacatatctatgtgtacatgtatatacacacatatctgtgtacatgtatatacacgcatatctatgtgtacatgtatatacacgcatatctatgtgtacatgtatatacacgcatatctatgtgtacatgtatatacacgcatatctatgtgtacatgtatatacacgcatatctatgtgtacatgtatatacacgcatatctatgtgtacatgtatatacacgcatatctatgtgtacatgtatatacacgcatatctatgtgtacatgtatatacacgcatatctatgtgtacatgtatatacacgcatatctatgtgtacatgtatatacacacatacacacacacacacacacacacacacacacatatatgttttttagatggagtctctctctgtcgccaggctggagtgtggtggcgcaatctcagctcactgcaacctctgcctcccgagttcaggagattctcctgcctcagcctcatgagtagttgggactacaggtgcacgccaccacgcccagctaatctttgtgtttttagttgagacgggtttcaccatgttggccaggatggtctcgatctcttgacctcttgatccgcctgcctgggtctcccaaagtgctgggattacaggcgtgagccaccgcgcccggcctacatttcttaaaaaacaaaaaaagcatgtgtttctggaggaactgcaggttggagggtatagtgggagtgttgtgctggtgagggcagtagcaggagatggggcaggtgctggggagtggggccagattgtccagagtgaggagctttgcaagaagctgggaagccatcaaaggacttaaggcacgggagtggcgtcgtcagatatgcactctagaaagctctttgttggggcaggttgaggaatatttgcagatgtcagagactggcaaggagcttaggggtaggaatctaagcaacacatagtgacagctcaaactaggcaggagggcaggattggaggcaaggagtgaagtggatgtccagagagtgagatggagccatgacgtctcagagaggtaggaagagaaaaaccaggagggaggagaggaatggagatttcagactgaagtgcaatgtcagatggccttggcgtggctagatgagggtagtgacccagaattgtccttagtggaagggaggtggaaggggcagccacaaggttgcagggggttgaagagtagtgggcagtgaggaagtgagacctgagagccaagactcagggaggacgaaaggagagagaagcaattgccaggacaagttatagggcatggaacctgggggaaacagcaaatccttgtgtgtacccattttttgcaggtaaggggcttggggctctttgaagataaatgtgattaaagaagatcaaccaactagtcaatggctgaatcagtgtttatgcccctttccatcggaattattctcctggggctgcggtagccattctgggtggcttatcacccggttctggaggttagaaatctgaaatgaaggcgttggcagggtcttgctccctgtgaaacgtgcagggcaatgaatccttgctgcctcctcgcttctggtgtttgcttgcagaccttggtgttccttgttctgtagtgatgtcaccccaatctctgcgtgttctctgtgctttgcgctctgtatcttcacataatctcttctctgagtctctgcgttcaaatttccttcttataaggacatgaaccattggattagagttcactaatccagtgtgacctcatcttaacttgattacatctgcagaaatcctgtttccaaataaagacacattcattgttgtcaggggttaggaaattgaagacatctttaaaggcagcagagttcaactcacaacaccatctaatttcaaagctcatcttgtcttttcctattcttgtaaaaatctgtcctcagttttctcatctttatataatgaagcatttgacttaaaccagggatccccaacgcccaggtggtggactggtacccatctgtggcctgttaggaaccagtgagtggcaggcgagtgagcattaccgcctgagctctgcctcctgtcagatcagtggtggcattagattctcataggagcatgaaccctattgtgaaccacacatgcgagggatctaggttgcacattgcttatgagaatctaatgcctgatgatctgaggtggaacagtttcctctcaaaatcatcaacccccaaccgccgtggaaaaattgtcttccatgaaaccagtccctggtgcaaaaaacactggggactgctgacttaaacgattcagaattctttcagatctaaaattgtatgacaatggccaaaaagcttttaatcaataatcttagaaagtcttgaagcacttggtcataattggaataaaagtcaaagacgaagaactagagggaagataaccatttaagtgggtgctccaaaggggggttggggctgcacccaagcagagagaggcgctcctcaaactcttatttttggcttaagtgtaggttctacatttttagtaaaaacgcttttgctgctttccccagttgaaatttgtgaaagtatgtggcaaatgggtggttatgcatgggaaagtaaagagagagctactttaattaaatctttaaagaataattcagttcagatgcaatattaacattgactgttctaggcactgtgagttctgagatggagagataaagtgacatcaggactttatagtctagaactagagatgtgttcaggactaagctcttaccggttcttggccactctgctctgcctttccctgctctgaccacactcgcacacacacatttccactttgtcttccgcacattattcacaaggactctgaagtcttgaagtgttgtatttcatcaaatccaagacaccacagattgtaagatgttactattattttttgtttcattaagtataaaatatgctaatagttaaactaaaaaaaaacctgctttatcataacttaagttttaaatcttttttaaaaattatttttagtagagatggggtttcaccacgttgcccaggctggtcttgaactcctggcctcaagtgatctgcctgtctctgcctcccaaagtgctgggattacaggtgtgtgtgagccaccatgcccagccccctaaaaatttttattaaaatttttgttgttgttgttttgagacagggtcttgctctgttgcccaggctggagtgcagtggcacgatcacagctcattcagcttcaacctcctaggcccaagcgatcctcccgccacagcctcctgagtagctgggactacaggtgcaggccactatacccggctaatggtttttgagtttttgtagagacaggatctcactttgttgcctaggctggtctcgaactcctgggctcaagtgatcctcccaccttggcctcccaaagtgctgggattacaggtatgaaccactgtgcctggccaaaatttttacatttattgaagttcttttttagatttattcagacgtttacactgatcataacactcctgtgcatattttctaaaataaaaaagaacatttcctaaaatgtcttcacacccataatctaacttatttgaattgctattcaacttggagtaatctatgtctattctattgatttattttcctcacataaaatgtctgtggtgcagcctttcttaagagacgtctgtaaccggacctggcattttctaagccattttgcaaattttgaagcatgtttgcaggtgataaccatgtcacaatgactggctgattaattgtacagtgcatctcaaagatgtaaaatgtaaaaagtatcttcagattgatgggatgtgtctctgcttgtcttctccatccttacccctgagacactagaactctcagctgggaatcagcgagatgcattgccctgccagtggactccagacccttcccaggggaggccacccaatacccagcttgctggaaggacttttccaaagacaagtctagacttgtcactcccccacctaaagctcttcagggatcctatggatggaactgaagacaggctgacaatctgtttgcacagctagatgaagagaactaaggcaatggctaaaatgttaataacctgatggaagaaattatcactcattttcagtcacttgtgtttgataatgttatctgtgactttcaaaccagggatccccacaggttcctagaccctcaggaaagtaaaacgtttctatggagaaagactaggccctgtttccttgtcctgccatgatcattgatgtttctctaagatgttcgtgatggagctgagtcgagagacagaaagacccaagtattaatcctgcctctgtaactctgggcaaattatatagccttagaggaccgcagtttcctggtggaaaaaaaatactcctctcggatggtggttatggggtgtttttatttttataagataacatgtagacttcccctcacagtggctggtgtagtagatgtcagtagatattaattgtattttccccaccatctttgtcttttaaaaacagctttccatcagattctgagaaaaaaaaaacaacattaaaattaatgaacaaataagttttggattatggttttcaataatctatacttttaaatgttcttattttccacctttcatgttgtgaatgagaaattaatcttttctcccaaaagccagactctattttcatattaaatcctataccattactgaacatacaagaaacaggatcatatctagacgaatatataaggcaaaatttggattcccaggtttggggaaactttagttggaattaatgaagactgcttttgatctagtctgccagattctttcactttttagggtcttattattgcttctagatacctttcaggtctgaccatcagcctcctacttttgtctttgttttcagatcagtgatgtgaagcatttgtttttacatcagaccgtctaggtttaaaatctgacctccaccaaagatttaggtgtgttaacctgggcaagttgcttaatgtctgtaagcttgaggttcctgatctgtaagtggtgacagggatccccacctcacagaagtgttgcacataagtatttaaaacacttaatttggacttgtctgtaaatggaatgcactctgtcatggtggctgtggttaataattttctcaaggcatgactgtgatgttttgctggtgattttggtatctaccattctgttcttccttggtgttctttaatttctaatttttttttccagactgcaccttttaattttaatgataatgatttgctgccacctacgggctaatgtggaaagagcagaacatgtcattaccaactttcttagatgctgaatataaaatctcaaggtcatcctggcagacttgaagccaactggacaacccgtcatcctcttttctgagagatttattttccttgatagcctagccgcatacttgaatagaaccagaatccccttggattctttttggaattgggcagtatacataaagcattgtgttagcagtcagatactgtatttctccccttgtttgagtagatttgcaaaacagtgtgtatcaaaaaagcatgaaagagtctttgctatttaagtaatggtttggtacctgagttttgcttgttttgttttggagatctgttgtagttggagaacctgggagttctgtacaaaacattaaaaataaaataacgtttaacaggtagctctgttatggttcttactgtgttgccttatatgattgttacttgaatgcttgactctcagtttcaatctcatacaactttcttcacataatctgacatagagggtagatttacaagcacacacagatgctgggaaatggtttctgacagtacatagtacagcacgttgttcacggtgtggtttggcaggagttggagtaagaggtgccaatgccagctagcaggagacgggtccagtaagggctacctgccaacctcaggggtcacactttgctttgaaaacagtaaggaatcaccaaaggattttaagctgaagagtgatacagtcagatttctattatagaaatattatttgggcagtctgttcacaaatattttagaggaagacctgcggaagcaattatgcattgagcttttctacttgctgattgtacctattaaatattttatattcagtcaagagcttaatcatattttttgccagtccgatttgtggtttttgaattttttgtgttacttttatgcctttaacagttctgtgctttccaggtaggcactattttggtgctgccatgctgatgattattattataattattaactgctattaatcagtgagtgtacagtagagcctgtaccaagtgcctttgtaacttgtacaccatgtacataagcatcatctcattgactcatgtaattctctaatgcttgctgcgacgctggctgcttgttccacagtgtggttattctccttcctttttcttctgtgtctgctccctggcgccttgcattgggcaggatgccacattgctgctgtggctgaactggcagttctcagaaatggtcctggggggtagcagggaacaactgcagtggctgtgatgctcactggcaggaagagcaggcagaggagtaaaccttcccctggtttctttgcaaaaaaaaaaaaaaaaaaatctgttgccagaggagactttgtaatcccaaatctgtaaactgaactgaagcctagggtaaggcagctgaggccaggaagggggtgacaaaaagcttagtcgtcaaataatatacaaatacaatatttttaaaaattaatgtaaaagaaaatcatgaataaaatatcacaattttaaataaagatgagattaccaatagtgctgttcatgcagagccattttggagtttgagacaaagtatcagcaatactgatccttcaatttaaaattttggcatttttgttcatcatgggttctttgaatttgatttttaaaaaatactgcattaagatatttatattgagtgttttagtggcctcttcaattttgcacccaaggttggggtgcctttctggcctcatcttagcctgtgggtgagggttgggcaggaaaagaggggagatctgaggggcagctgcctcctggtcactctccagttgttcttcctgacaggctccgttccaaggggaatgggtgcggtgtggttggtcttcagtagtgtagaatgtctctgtgtggctgttggtcatgtctctgaacatataccttagtattcttttataagggtatctggatgatatatatatatatagatagatagatatagatatatagatatagatatatatagatagatataatcatctatatcatcatatatatatatgatggcttgaagccaggagttcaagaccagcttgggcaacatagcgacaccctgtctctacctcctaaaacaaacaaacaaacaacaaaaaaagaacttacaagaagatgttttctgcctccactaatggaaagaaacagaataaaatttacttaggacatttagttcattcagtggttactcctttactgagtttatgaaatgttggctttgattaccacagcaagctgaagagatatgcaaactcctgccctgggttactgggaaggagctaaaatctttcatctaatttatactgatttacttttgcagcaatttaaagtctcagcaagatctcattttgggcccttcactcttctgccataactatattgtgactgagactatgaacagaagctaagagaatgctatattttctaaattcatattttggcagagtctacttggtagtttccggtggttagctcagattttcttttgtcctttgctgagaaagccaggtcatttgaatatccagagatgagatgtgtggatctactctaattggctttattctggctaggacagtggaggagcttaaatagggattttacttagattttgcactttaaaaaatggtttaaatccccaaccaggtctgctgagaacagacccagtccctgaggaaggagaagatgttgctgccacgatcagtgccacagagaccctctcggaagaggagcaggaagagctaagaagagaacttgcaaaggtaaagaaccattccttttgcaactttatttttgcacttaaaatgtactgtcatttgtgattctaaagtacatggtgatatgtttatagttagttccaggggagagaaagcatatgtgtttacttctccagcaggtcttgagtaggggagaggagatagaagagggtgacatcggttcgtttttatatgagaaaaaagtatatatgggtaaaatagatgtgaaaagtagagtgtgaagcaggaaatgaatgagaggagtagtagtgaatgtcttctaagggacttcactgacatctgatacacttgctcttcagtgcatcagtgactttgttctacccttggctgtgttgcagagatggccactttccaacttccttccgcctttccttccttccagctccctccttccctcccctcccttcccttccctaccctgccttccctcccctctctcccttccttccttcccctctctttcttccttcccctccctccctcccctccttcttccccttctggcttctcttttttctctttccgccccccctccccctccctccctctgccattcccccccattcctcctctcctttccctcccttcttacttttttctttcctaacttcttccatgaaattcatttaacataaaaattaaccattttattatattttatttttcgagatggagtctcgctctgttgcccaggctggagtgcagtggcacaatcttggctcattgcaacctctggctcctgggttcaagtgattctcctgcctcagcctcctgagtagctgggattacaggcgtctgccactgtgctcagctaatttttgtatttttagtagagatggatttcgccatgttggccaggctggtttcgaactcctgaccttaagtgatccacctgccttggtctcccaaagtgctgggattacaggcaaaaaaattaacgagtataattcagtaacatgtaacattcacagtgttgtgcagctgccacccctttcaagttccacacattttcttcacctccaaagagatccctgtattcattaagcattcaatcctgactactcccctccttcagcccctggcaatacctaatttgctttgtgactctatggatttaactgtcttctggttatttcatataaatggaatcatacaatatgtaaccttatgtatttgggttctttcccttcatgtttttgaggttgattcatggtgtagcacatatctgtgcttcattatgtttaatgactgaataatattccattacatgtatctattgtattttgtttatccatttatccattcatagacatttgggtgatttttcaccttttgactatggtgggtagtgagttaggaacattttatgaacaaatacttgcttgagtacctagtttcagttctttttcatatatgcctagatatggaattgcttcatcatgtggtagttccatgtttaatgttttaaaatttttttaactttttttttaagatacaaggtcttgctctattttgtgggttggtgattgtgcagtggcatgattatagctcactataatgttgaactcctgggccaagcaatcctcctgcctcagcctcctgagtagctgggactccaggtacatgccattatgcctggcaaattttttaatttttatttttcatagagatgagattttgctatgttgcccaagctggtttcaaactcctggcctcacgtgatcctcccacctcagcctcccaaagtgctgggattacagatgtgagccactgttcctggcccatgtttcaagtttttttgggaagcaccaaactgttttcacagtattaacaccatttaatattcccatcagcaatttccccacatccctggcaacatttgttattttctgtgttgttgattatagtagtcctagtgggtgtgaagtgatatctcattatggttttggtttgtgcttttggtgtgatatctaagaatccatttctaaatcctagatgataaagatttacccctatgtttttgtctaagacttttatagtgttggctcttaagatttaagcccttgatccattttgagttaattagcgtatatggttttggtagggatctaacttcattcttttgcatgtggctagttttccccagtgaatgctcgtggcatccttgttaaaaaagaaaaaaaatcagttaaccatagatgtataggtttatttctggactctggattcagattcattcatctatatgtcttttcttttgacagtatcacactattttgattactatagctttgtagtaagtttgaaatccagaaatatgcgttctttacctttttcttctttttaaaaattgttattcaaggttccttgcaattccatatgaatttcagaatctgcttttccacccacacaaaaatgctgttggcattttgatagggctcgcgttcagtttatagattgacttggtgagtattgccatcttaacaatattaagtcttccagtccatgaacatgaaatgtctttccatttatttagttcttattttactttagcaatgtacaaaacatttttctatgtacgagtcttatacttccttagttatatttattcctaagtgttttattcttgttgatgtgattgtaaatggattttttttaaattttcttttcaggtggtttattgctattatgtagaaacataactgaatattatatcttgatcttatattttgcagctttgttgaatttatgagctcaaatatatttaaaaaaatttttttgagacaggtattgctctgtcacccatgctagagtgcagtgatgtgatcatggctcggggcagccttgacctcccagctcaagtgatcctcctgcctcagcctcctgagtagctaggactacaggcgcttgccaccatctgcctggttaatttttttatttttcagtagaggtggggtcttgctatgtttctggactcaagtgatcctcctgccaaggcctctcaaagtgctgggattacaggcataagccaccacaaccactcttgaatagatttttttgtggattcttttttttttggggggggcggtgggggggaaggtatggagtttcactcttgttgcccaggctggaatgcaatggcatgatcttggctcactgcaacctccacctcccaggttcaagcgattgtcctgcctcagcctcccgagtagctgggattacacgaatgtgccactacgcccggctaattttgtatttttagtagagatggggtttctccatattggtcagctggttgtgaactcccaacctcaggtgttctgcctgcctcggcctcccaaagtgctgggattacaggcatgagccaccgcacctggccttttttgtggattctttaggattttctatatatgaaatcatgtcatctgtgattaaacatcgttttacttttcctttccaatttgaatgcctttaatttatttttcttgtctaactgctttggctaaactcttcagtacaatattgtgtaaaaatggtaaaaatgggtatccctgtctttttttctgatcttatggggaaagctttcagtctttaaccataagtatgatattagctgtcatttttttcacaaatgcacttgcgttgaggaagttctcttttattcctagttttagtgggttttttttttcatgaaagagtattggatttttatgaaatgctttttttttcacctattgaaatgattgtgtttttcccctttactatattaatgtggtatataacactggttgattttcatgtgttgaatcatccttgcattcctaggatatattccacttggtcatgttttataatccttttaatatgctgctggatattcataggagatatgggctgctgttttcttgtgatatcattctctggctttggtaaatagggtaatgctggcttcttagatgagttggaaagtgttctaccatcttctggttttttagaagagtttgaaaaggtttgtccattctttaaatgtttggtagaattaaccattgaagctatctacttttacacttttctttgggagatttttgatacttgttcaatctctttacttgttcagatttcttctattttgttgggtcagtttagtcatttgtatatttctatgcatttgtccatttactctagactatctagtatgttggtgtacaattgctcataatattcttttataatcctttctgtttctataaggttagttaatgtccccactttcatttgattttagttatttatgccttctctctcttttttttttttcggtcagtctagctataggtttgtcaatttcactcatctttttcttttcttttttttttttgagatggagtcttgctctgtcacccaggtggctggagtgcagtggcagcagtcttggcacactgcagcctctgcctccagggttcaagcaattcttgtacctcagcctccctggtagctgggactacaggcgtgcaccaccacgcctgactaatttttgtatttttagtagagacgaggtttcaccatgttggccaggctggtcttgaacttctttttttttgtttgttttgagatggagcctcactccgttgcccaggctggagtgcaatggtgcgatctcgtctcactgcaacctctgcctcccaggttcaagcgattctcctgcctcagcctcctgaatagctgggattacaggcacgtgccaccactcccagctaatttttgtatttttggtagagacggggtttcagtgtgttggcatgactggtctccaactcctcacctcaggtgatctgcccgccttggcctcccaaagtgctgggattacaggcgtgagccactgcgcctggctgtctttttcttttttttaacccttaatgcactgttgatctttttaaagaatgaattattgcttttattcattctctctattgtttcctcttgtccattttatctttactctaatatctaatctcttccttattcccttccttctcttagctttgggtgtagttttctattttttaaatttttctctaattccttaaggtgtagagttaggttattgagattttttttaatgtaggcatttataactatacatttcttactgacagttcttcaactgcatcccaaaagttttaatacactgtttttgttttccttcatttcaaggtgttttctaatttcctttgtgacttcttttttggcccattggttgtttaaaagtgtgtggtttgattattacatagttgtgaattttctggttttcctcttgtttttgatttccagtttcatggtggtggttggaaaaggtgctttgtatgactttaagtttattgagacttgttttgttgcctaacgtatactctgtcctggagaatgtttcatgtgcatttgagaacagtgtatttctactaatttggggtgagctgttctgtacatatatgtgttaggtccagttgatgtatggtattgttcaagtcgtctctatgatcttctgtctgtttgtactactcattttttcgcccaaagttttataaacaaggtggggatagaatgggtaaggcagatgggtgataaaccatttgtgtggttgtttttttgttttgttttgttttttgagacagagtttcactctgttgttgcccaggctggagtgtggtggcataatcttgactcactgcaacctctgcctcccaggttcaagcgattctcctgcctcagcctcctgagtagctgggactacaggcgtgtgccaccatgcccagctaatttctgtatttttagcagagatggggttttgtcatgtaggccaggctggtcttgaactcctgaactcaggtgatccacctgccttggcctcccaaagtcctgggattacaggcatgggccaccatgcccagccatatatttttatatttgtagagggcattagaatacagataaccttttcccacttaactgattttcaaaaacatttttatgccaatatactcttgtgcaacctcattttaaattgctgcgtagtccattttgaatttccgcaagctcatttttaatttatattatttataaacatttggattgtttccattttttgctattatgaataatagtttgatgaaaataccttcatgtaagtttttatgcacttctttaattagcgctttaggataaagtcctggaagtagcattatgcctgggtctaatggtttttaagagtatatagcaacatggccaaaatgctatccagcatatttcttacagtgttttgaaagagcattttttttcaaatccttgacagttctcagtattgttttattatcaacaaaataaaaataatagtaatagcacctaatgtctatagactacatgctgtgtgggaggcgttaaactgagctctttacatgcattatttcattaattattacaacagtcttacggggcaggtgctattatgattgatggaagaggaaacatagtctttatttaacaaatgaagttaccagctatatgatttgtaaatattttctcccattctgtggattttccttttcattttctttatagtcccttttaaaacatttttaaacttaaattttttatttaaaaaattttagattcagggggtacatgtgcgggtttgttacatggtaatgcctcatgatgttgaggtttgggcttctaatgatcctgttgcccaagtagtgaacatggtttttcagctctttcccccaactctccctctccacttctggaatccccagtgtttagtgttcccatctttgtgtctgtgtatacccaatgtttagctcccacttataagtcagaacatgtggtatttggttttccatttttgtgttaatttgattaggaagatggcctccagctgtatccatgttgcagcaaaggacatgattttgtactttttaggggctgcatagtattccatgatgtatatgtaccacattggacagtgggcaccggggttggtttcatgtctttgctattgtgaatagtgatgcaataaacatatgagtgcaggtgtttttttggtagaacaatttctatacccagtaatgggattgctgccattgaatggtagctctgtattaagttctttgagaagtatccaaattgtgttccacagtggctgaactttaggactgttatgaataatgccgctgtaagcaattgtgtacagctttttgtatggatgtgtgttttctttttattgttgcttgtttgttttttgagaagagtcttgctctgttgcccaggctggagtgtagtagcatgatctcagctcactgcaacctctgcctcctaggttgaagtgattctcctgcctcagcctcctgagtagctgggattataggcacaccaccaccatgcctggctaatttttgtgttttagtagtatggggtttcaccatgttagccaggctggtctcaaacccctgacctcaagtgatctgtccaccttggcctcccaaagtgctgggattacagccgtgagccattgcacccagcctggatgtgttttcaattctctttgttatatatacctaggagtggagttgctgggtcatatggtagctctatgtttaactttttgaggagctgtcaaactgctttgctgcccaacttcattttacattctcaccagctgtgtctgagggttccaatttctccacatccttgccaacacttattaatctctgttttttttaattgtaaccatcctaatgggtatgaagtggtatctccttgtggttttgatttgcatttctcaaattactaatgaatggtgttaagcatcttttcatgtgcttattggtcatttgtatatcttgggagaaatgtctatttaagtcctttgcccattttctaattggattgtctttttattgagttgtaagtttctttatatgttctagatactagactcttattaggtatgtaatttgccaatattttccccattctgttggttgtcttttactttcatgacagtgtcgtttgaagcacaacctgtaggcatcctccctttcccaacctctaacacccacaattttactctctacttagatgggttcagagttttttcttggcgtccacatgtgagtaagaacatgcagtatttatctttctgtgcctgatttattctgcttaacgtattgttctctaggctcatccatgttgctgcaaattacaggatttcattcttttttatggcagaattgtattccattgtgtataccacattttctttatccattcacctgttgatggacacttgggtattgtaaatagtgctgcaataaacgtgggggtgtaggtaccctttgatacactgatttcctttcctttggataagtaacccagtagtgggattgctggattatgtggtatttctattttaagtttttctgagaaacctccatactgtttttcatagtggctgtactaatttatattcccagcaacagtgtataagagtttcatcttctctggatccttgccagcatctgttattttttggttttttgataacaggcataataacaggtgtgaggtgatacctcattttgattttgatttgcatttccctgatgattagtgatgttgagcatttttaatatatttgttggccatttatatgtctcttctgagaaatgtctatttagatcctttgcccactttttaaatgggattgcttgtttgttttgttgttgaattgagttccttgtatattttggatattagtcccttgtcagatgaatagtttgcaaatgttctctcccattctacaggttatctcttcactctgttgatgatttccttgaatttagtcccatttgtctatttttgtttttgttgcctgtgtttctgaggtcttagccataaaatctttgtctagaccaatgccctgaagtgtttctcctatgttttcttctagtagttttatggttttgggtccttagtccattttgagttgatctttgtatatagtgatagacacatcagagattcttaatcatgctctttatgcttttaaagtcactctgttttacatgtatatattgaattaaggaatcgcagccatgatgtgctgggctaggtgtgttagcagcacaagctaaccaacaaaggtggggaatatactgtgttgtgcattgttcagaaagatttagagtggtttgtctttgcagctttcattagaggaagtgagtacctcagagaagtgctaaggggtgggaaacttaccatttaagtctattcttagaagtgtctgaagctttggagcctgaagtagagacagaggaagtgggaagcttaagagagtgtacatgagaattcagccagtaaactgagacgtgcattcagaaaacctagataggaattctggttcctacattatttgtttgatgactttgggcaaatcatttaatttacttaattttgaaccttattctttcctctttttttgtccttttcttctcgtattccacttcgtcaatgtacatcttaaaatgtgacttacaaaactgggtccagtacttgtgactctgacaagcacaggggattatttatttgttctgagggacctctgttccagttaatcttatctgagagtggtgttgtaggttctttttcttctttttttttttttcttggcagctgcatcacatttgatttatccttttctccgttgcactaattttctttgttttgtgttctctaaagacttaaacatctgtgaaaacatttgactgagcaatactctatgttatttttaaagggcatgttgtctttgaaatcatagaaataccgtgcaggttggggctgaaaatatggctttgcaacaagccaggagacgcatttctctgagggtcttgaatgttaatggatatactttagggacctagattttcaatttcctgggacctaaagtctcttccacatggtgtctatttctctctgaaataggcagtccacccttttccctgtttctgaaatagagagtctaccattttccctgttttcctggattagccttttgttctactctgtccattttttccttttcttcatagcttctgcttacagttttagattcctcaagcatatttaagctttccatacctctcataatctcactgtagcctacctatacctcaaggcttcttcaagttttttcagcttctacttgcaatgtcatctcacttctcaaactagattcctgagtgagagagacgaatagttgagcacctcttttcacactgggctcatccactggctcttgatgggtggctgtccatgggtcagggcccacctctaaccacctagtcaagtctgggcagtcagcatcaaggggttcacatgaaacccttgagagcagggatctcctgaggaggcggtttgatttattatggccatgactttgccagacacagggactgagtatatgtatccagtatatatactcatatcaaatatgcaaggagattggatttgggtttggcttggttgtgtgtgttttggtaggggatggagattattttgatttagtatacaaatacaagttttgtaggcattcagatagaaatgtctaggctgggaaggcagacccacaggtcgggagagtggatgttagagtgctttattaagtattatctgtgtagaaatttgagtcctaaacctacatgagatagctgagtaaggaagtatagggagagaggagaaggccaaaaacagcttaagatgggattataaagagctcccatggaggaggaaagagaactctacaggagagatcagcaagtaaccagtttactcaacaacattatacattgtttttagagagaaagataaatgattcaaaaaaatgtttaatgactggaattttggatgtagttctgtggtaataatcttaacttactgaatgacttttgctatattcttaccccaaaccccttcctcataggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcgtatgtttccttgatcatacactttccttgggagtgtaaaggacactgttgtgccttttgtctggagaggggaagaaaaagaggataaggatgcttcagcagcttttctttggacgacacggcaccctttttttctgattttcaagtgtgcctgcctttttttgtaacttcaatttttccagaccacttattctaaggaatagaaagaaagctagccagttggagaaataaaattcaaatcccataagtgttatgtattgacttgccacaaatatgtacattttgtcctttagtactcagaataacccagtaagaatgggtggcaagataaccctggataaggaaacaggctcagacaaattaagttttcatgtcacaaacctctcaaaatgtggagtgggaattcaaactcaggtctggagccagtctttattattattattaatgtatttttttaaccttgttgtgtaggtatcaaaagattctcaggtcgtagtctcagatatatgctcttggcagaggtcaatcccttaggctttttgtctttttgaccacacatgctatgatatagcattatcataatgcagttttgtttcccggcacaaggaggagcaagcttctagcagcagaaaccgaactgctctgtcttctgtattgagagccatctgcagagctggtgagcacagaagttgttttacaatttaactatcagaagtgaggccaactgcatttaacatgacagtacttgagtccccagtcttttggtccattttctacccatctaagttggcagtgggaaaacatacaggaaactattttttcaacagtattaccatgaaccatgtttttttattggtatttgatcttgacagggtaagtaaaaatgcctgagcattctttcccataatgtgggaattgttttggtaggtacgatattattttgttttttgttgttgttgttgtcatcatttttttgtttttgcttttctcttctctaatctccaggtagctgggaaggaggtggtaaattatagctttgcgtgatagcagataccacactagaataattttaagcattgcatattttacatactttgttgaaagtccatcatgtccgtatttggtagctctctaaagacatgcaaaaatttttagaaagtatgcccataaaatgtatttggataataaaatacaaatgggtcctacttacgccagctactaattgcttctggcccttttttaggaaatcaagttgacaaaggcatctgaggaatttgatttcatttttgttttgtttggattatgtgagaaaagaacaataggtatgagttctttcaggcctttgcttattttcatcttggtttgatgattatttttagcccttaccttgacttctttggccctgcctttataggactctgtctttctggctggactagggcactgcagaagattgtgcctgagcttagggttgagcatacgaagatgtggtgatgccgctctgctggttatgaaggattttagaagttctgaaaaatgttttctctttttgagagttctccagcaggtggtgaccactgcacttgaaacaattgatattagaaaagatgagctgacccttcttttgctctgtgtgtttataatttaatatagttacaagaagacatctgaaaccttatcccaggctggacagaaggcctcagctgctttttcgtctgttggctcagtcatcaccaaaaagctggaagatgtaaagtatgtcctcatttttccttgctcattaagtagctgacgcaaattaaaatgttattgttgttgcatctgtttcctgaccttggctctagttgatgctagctactcctgttagagtgagggagggcactccttcaaaccagtacctggaaggctcatctaaggtcttctaggcctagcattctaacatcaaatgatcatctgatgatcatttaaggttgttgaaaaattctggttgtgaacttctttgtctttttagttcttcatgatcatgcagggtaagtatgtctttggttgcaaatttgtgattgtgggcagagcctggtgtgttactaaggatgactacaggagcactgaagtgcacgcttcgattcagatttggcttcacgttctatatgtgacattttatatcatggtgtgattacaacatgctcatttgtgcactgttttattctaactggtaagctgtaactatgttcatgcttaggccaaaatcttgattttgagttgttgctttttttttttttcatttagattagtctgcagagttttccttgccatttttataaaaccacttcacagtgcttttgtgcccccccttcactcatgtggattaggatagtgatgaaaatgacaaatgtggtttaagtcagctgtgcttctgttggcatgcaagatttgtgtttaaaaaaaaatgctcagattgcatggcttcgtgttttgcatttgtggggaaagtgtatatcttacaaccagaatttcttggttgaatagatttggtcaatttatgtgttatactttacaccaaaagaacaaattcctcgctcattatatttagactgtcattgtctaagcataatgtaataaatatagctttcttgaactcttttgacaattatgtatgtatctattaggtgttcattttctctatgctgactgaattgtgtagcagtttagagcccagggaaaacattatatgtttaaaacttaggttatttaattgttttagatttatcagaacttctttcttttttaatgcttactctggcttcttacagattgcaagccttttcacattcctttaggtaaggagagtttgaaccatcactgcagtccagcagttgtataagaaaagtgtgctgagattagattaccatgctacgttggatgatcgtgtttgtccagtacataattttcttgcgtttagagtatctttttctctagtgcattcctaatttcaagggagggtttcttgtataccatgggtagttgataaattaaaagaagtatttgacactgtggttcaagggatatggaaatgattttgacatttcttttttacttttttctttggtaaaaagaagcagctttaccatggcatgcaaaattcctcccttttaatgtctgactttgtttgttttgatgcttttgtttctttggtacttttgtaaggatgttggaattcttcacctgggtttcattacacaattgtaacagactgcatatgtactgcctcctgatgttagtcttccatcttctattggttactctacctttttttttgttgttgtggtaaaatatacataaggtaaaatctgccactactctgcactttttaatacttgttttactagcttatagtttttatgattttattctttctttacacttgttatattctttatgtacacaaggcaacttcatggtttgaaaaagggaaaagaatattaagctaaaaaaagcacattaaaaagatgttagctcaaaccatgccttatagaaagagactttgtgatgttgaggaaacctttctctttcccaggcagactctttgattatctgattagttgttggaggaaactaaggtggaggaaagtctttagagtataagcaggaaggatgatatagtagtcttcatctctgttcctatggatgcagattattttcttaagcaatcactcatggtagtctagctgcttgcctttttaagtaagcaaacaggtacttaaagctcctatcttggtgacacttacccctggaagtcagagtaaattatagggatatataaactctaaatgttgaactatttaaagctaaaattatgcttaaaaaatcaagtaaccaatgataggtgattgtgtatcgttggcattcagttaaaaagtgctataagtaactgaatacagagccagtcacatcacccattctgctaacatttagagtgtctactgtggacaggttccatgggcataaccataaagaacgcatggcttttattagaatgaagcttaaaatcttagagtggagtaggggaagagtggggacttgggataagttaagaatggaagagccttatcagtactggttataaaatgttcgatgtgatgcaaacatcagtgtaagatataaaagtaagggctattgaggatgatgtttcttcagtacatatcactagacttttctatacctttaaagaatacctttctataccttaaagccatacctagatatggctcagtgtgtgctgtcttattaattcatcagcaacaaattatgttttgcaactgttttctagctcctttcacagtcactttgtccattttgtttaaaaaatataattaagattatgctgtaccattttcagtcttgtttttaataaatattaagtttttatgaatatttaattgcccatcagtatgtaggggttaaagtaaggtttttgattaaaatttggaaatgaaagaaatgagattatcttttgaaagttaaactttgtaattcttgcaaatcacaggttaggtaaaggcatttaaaaaaataatttcaaggccaagaagtcctgattgtgttctgatttaatgtgttgacacatataaagaaaacctacatcttttagattatgtgagtcacagaggcaaatattggccacgttccctcaagaactacccaaggaaagggagcttaggctgtagatttgagtgttacaattccagcaataagtccttttctcccatggaggtggatacagtaggctccttttgctaagtgctatgaagtaggtggttagtccttaatcccactcactgtttgttctaggtccattttacctggcaaacttatgccggtgattttactccttaatgtaattatggatatagaaggagaaaatgcagcagttttgccaacctgaatgtgttagactcagcaacagtttttattttacatagtcagttgataaatcagcacttgggatttagatatttgccttatgccttgattgaggggagggagatgtataaggaaatagagaagagagagagagagctgctcttgatgtcctgagaatgaggtgtggtggtagcaaggccaaggaggacgtggtcatgagtgctgtcctgggaggccctctggggcagcctgcttttccctcaggtgatatgcttatatttcccctctgtttgcatatgttctatgcctatgtgaaagtattgactcatgcctttagcattttgagggaaactttaaaagaaccttctcattgcagtcagtgccagggttaaacataaaattttagtgttattaaaagcatactataatattcagtagacacatttgtctcatatttttggtatatttaagaggaagtgctaattaattttgcctttatttccaaagaaaatttctcctttttaaatgtgtgtttcttcatgtgcccctgtagatatttatttggtttgggctcattaaagtcctgctagacaattcccttttgctgaaaacttccaccacttaatgggaaaagaaatgatctctttcctcgtgtcagaaaaagaatatcttttgattagaatttgaaacactttaatgaacttttctctgtttcatgcccatattcccaattttagttatcaaaattgtttattcatttattcattcattctttcactcaaaagtatttattgagtgctaactatgtgccaggcattgctgtagactataggggtggagctaaaaaccaaaataatgctgaaatttgaaagcttcaatgtgaaatttgaaagcttcaacgtgatatgcttatatttcccctcctgtttgcatattttctatgcatatgtgaaagtataatatacagtagatgctaattcatgtttcaattaaagcatgtgttataataataattaacatttataagcccagcgagacaatagtacctcagaagcagatgctattgtttttgatattacagatgaggaaactgagccatagagagattaagtgacttccccaaggttgcacagcaggtataagtggctgatggtcaggactggaaccgagcacacctagtcctggagcctgcactgtcctcctgggcctccccagagcagtggtggtttaagacagtgcccctctaggcactgtccagcactttgaacaatagctgctgtgatcaccaacatcaaaagattgtgtgagggcaaagtggaataatagtacatcaatagctgtgaaaagcatacgtggtatatagtaagcagtccaacatgttagccattaactttcccttctcctcctcccgctgctgctacttccttccttatcctccctctaccccctcctctcttattattattgagcatgaaagcatcagataactgttagaaacaaggaatattttttaaaaatcaattcagctgttttaaaaaaatgactttttcaaagtaagagtaaatgcagtgtgagattgaaaagtacttagtgagaatcagattatcctgattttttttttcagtgttttgaggagcccatgtttgcattcctagtttgattacagattaatgtatttgggggttacaaataagatgcaacatttttaacaaaatgtgccttatagatggtaaccgattcttacaacctatctattagagatgattctggtcccgtagcaacatgactttttacttttgaaggtttccatattacatttaagcttgaatgaaactgaaaatgatgagcaagttgaagctttgtgtaacttgccatagagaagccagaaatgaaagaacagccaccctatagttagattacaactagttaccaacaaaattgaatttcatctaactatggattatggggaggatccagcaaccagatagaattgaagctgatgtgtgctccttttcttcctactataaaatagctaccataaaagcagagagaccttgactttgactctgttaactgattttattctgtttaatgggtatatttatcttcaagtgtgatataatgcatacagaaaagtgctcaacaccaaattcatttcagtgatttttttcacaaaataaacagtctagtcacttccttgcctttccttatatattaccactgaaacatatttagtaggtacatgctaggtaaagtggtatagagcccaaccgatccactgctggaggaagtgatattgtacatgggttcttagggacagtgactagaattagctgtgaaattctgaaatttgcacttacttatccacctgtttccacattttgttgatactaccaaattcaatgtgtgggtccccgggacaaggaatttatcacatatttggccattaccttctttttcagcgatttctgccaaaatgaatgtcctaatgaagagttttgattattaggaacagaaagctatgtaacttttagctcacctaaaaagaagaatgtgttgcacaaatacaaagtttttttgtaattcaaggagagaaaagaaagcaaggccaggctccacccaaaccagctccatcaactgggaaattgaagtagcttctattattgaaaccaagaaacctattcctcttccatcctgctggattccctgcatgatcacctctcctgacctcatctgctctacctctctgtgtgcttatattcgattctttctttgggaactggtttcctctgtgttctgtcagctttcacctggtcccaccagatcctcttcaacatctaagtgtccagcagcttagtgtcctaattacaatatgctaggataagagtcttaattgtcttcactccttcatttttcatacattccaaacaatttgtaggccactgggaggttagcagtggtgggtggtgctccactgatccacctatcatatcagttatggtagaaggtggtttgtggcaatgtgactattccaggcagcttcagcagaagggtctgaggaagaacaggtgatacttagagttctggtgttgtaaatttagagattgggaccagcacactttgatagatccaaagtaggaaaagaattatcaaattcctcccagaatagattattatactcttataccctaggtattgaccaccattgtaggatagagagaatactgagttacatgcatcttttcctgttatgtaagacatcaagtacagaggtgtttaaatatttcattgataatcctgattacacagattgccagcatatttgacatatatcacaatcattctccatgttatcagatattaatgcaaaattagatttgaggacctacattgaagacacgttatcatttgtaccaaatgagtctttaagaaaaggaaatcataagcgcacaaaatatttaaatataactgagaattaataccttgaacctatacactttacccaaaggaaagtttatttaccaaagtcgtgccagtggtcaaactattataagcatagtaacaatattagcagaatacaatcattttacgagcctaggaatgaaggcactctcatctcatgaggtggtctttatgggagatggctaagagtaggtaaccttgaacctgagtggtcagtgaactgcattgtccttgagtgggcagttgcctccttgtcttactaagagcccttccctggccttgcttgtgtgtgtatgtgtgtatgtgtgtgtgtgcatgcttcatttttgaggggaggcgataaacactgaattagacccaagttctattcttgattctgctgtgacctacggtaactcatttaacacctatatgccttacagctccgggtgaaagcactttagttttcaaagtgctgtaaaaatgcaaggtggtattgttagctctagtaactcctgggaattaattggctcctgaataaaagtaaattatgttggaataactttgatcccctccacctcaaaaagtaggtaattcttcatggcgccaagagaataaagctcctggggagctaagttttgtcagcttttaataatgttgaagcaccactatactaaccttatttctatctctttttaatgctgcctcttagtatacgttccattcagcattcaattagcatgcctgctatgaggtaaagtatatttttatgaaatgtagttggtcttatgctttatttttctttatttagatgtttaacttgaactgttctgaattagggaactagaattccccttgaaacaagctgtgtgtttaacactctatcagttttcagctacacttcctctgatgttgggatgggtgcaagagatccgttaaatgttttgattttgtttttaaaaaaattatttctattttattttgtaaaacctttgtttcctgtctgaaatctgttcacaaagtgagcactacttgttaacaaaccttcttttgtcccgccacctctgtctgcattcgctttagttacattctccttttcttcatccttcccattttcacttcccccatcccactgtgacatttggagccaactatgatttaattctactatctgctttcattagcacttgcaagtgatattacctcacctaacctctctagagagttagaggatttttaacaatctgtgcttggcttaaacttaagtgtccatcaaaatcacttggagtgcttgtgaaaccgctgcttgctgggccccacctctagagcctctgatcctgtagagttggggtgggacctgaaaattggcattgcttatgacttcctgatagctgcagcagcagctggtctggggcccacactttgagagctgttggcttaactgttctgccatcaccaccgtgggaaggaagaaaccccttttcctttctttgcatttttcatcttggtagtaggaaggatattcaaggtcagttggataggataacagcattggaaaccctgtttccaaagcgcctttgtgagagacaaaggcgctatgatcctccttaattaatatggatagatgtgaatgtaacatggatgaatgaatgtcctgtgggctcagcgtgctctcctcatcctttgggacagagttgtgaagtaggcaaagccgtttctatgcttctcccccttctttttggtccctgctttcccagtctattatgctgctccctgatattgaacctcataagcttgtcccacttaggtgatgtgtgttcatgtagaaattctgccagggaagatgtgaatcaaaatagggattttagagcgtagtaccttaaccaaaattaaactgatctaatggtggcattttcttgtaccatgacaagttggttggggaagtgacagaattgctattttacccggcttcgttacctctccttacacacgtacttgaccatatctatattacttatgtctgagactggccctgttcatggaatcaaatgcatactcttaaaatattagatcagaaattgagaatcttacattataaatacttgtatgtacctgcacatatatggtacagattatatctgttcttttgccgattgagaataatgttgaagaggaatcaattatattttcaaactagttggattttttttcagtatttgtatttactatttgtttttcttttctctccatagaaactccccaacttttaaatcatttgaagaaaaggtcgaaaacttaaaggcaagtagagagatgaacagggtctttttgatacattgcctggtgtcttaattaactttgctgtgcgaaaatcattgacattaatatttctttctaaaaatatctaaagaatgtaaataactttactccttatgttactagtggacatttaaggtgttatgtacttaatatctttttagtgtatgctgtagtgtggcagcatgccacatgctgaaaggaaatgtacaatttacaaagaaatggcactttagaaatttgtgctgctttttgctttattcatttcaagtacctttgtaggtggacaaaatttaatataactttcttgtcaacaattaacaagaatataggaagcacaagaaagaaaacaaaaaattggtcctaccactcagacagtgatagatgtatgtgctattatgctgttacgctttaaaaaagaagtagccatacatcataatcattttcctgtatcagtaagtattctctttcaatattatgtgcaatggctgcttgtatattactttttttttttttgagatggagtctcactctgttgcccaggctggagtgcagtggcgtgatcttggctcactgcaacctccacttcctgggttcaagcgattctcctgcctcagcctcccgagtagctgggactacaggcgcgtgccaccacacccggctaattttttgtatttttagtagagatggggtttcactgtgtcagccagaatggtctccatctcctgacctcgtgatccgcccgcctcggcctcccaaagtgctgggattacaggtgtgagccaccatgcctggcctgtattaccttataatggatattatttgttcagtcctcaattgttggacattttttttattataatgatgccatgatgatcgtttatgattcactgtttttattttttgatttctttgattttagtggaggtgaacatttccccataataatgagctttattgatttgtaaattatattatctttgagattatattcaaagctataaaatcatcaactcttaggatcacaggcaacctcaaaagttgtctagttcccatctattcctcgaccctctctacggagtttgtataaaacccatattttcattacttcctaactctgataattataggggatatattttaaggattaaaactagtatcttaaatgtttttatatcagtcagtttaaaaactaatattcagtttagtctttcagaactttgagtcacgaaatgcatctttaaaagcagggtacatttattgaaataaaacactctacagtgatctggatctttttttaatttatttttttattatacttttaagttctgggatacatgtgcagaatgtgcaggcttgttacataggtatacacgtgccacggtggtttactgcacccatcaacctgtcatctacattaggtatttctcctaatgctatccctcccctaccatcccaccccctgacaggcgccttggtgtgtgatgtttggatcgttttttttcttgaacatacaaacgttagtacataccttttctgtttgtatgcagacatatgaatgttttttcagaagaggagttacactgtacacacacagtcctacagcttattcattcagccctcactagcagggtgctttgtgagccataaatgcagggacctgttctttttggtcactgatacttctcaaaggcttagaacagttcttggcacattgctcaatatgcatctgatgagtaacaatatatataagagtcattcttctatgtcatttcaagagacctgctttatttttcttagtgccaagtcatatatttgaaagcaaactgtagttgcaggaagtcaaggattactaaaattcagttctcaatattgttaggactgttatagcctttccttgaaatctgccccaagtgttaatttttgaaatggcaaattggaaaaccaggaatcttatgtgtttttgacattggacatgaggagaaacttccaggtcattcactatatactctcctgaatatatttagattctataaattgtaatgaagtctgctttaaaatatgactaggcaccattcagattaaaaagtgtaatttaaaaacatacaatatgttggctgggcgcagtggcttacacctgtaattccagcactttgtgaggccaaggcaggcagatcacttgagtccaggaatttgagaccagcctgggaaacatggcaaaaccctgtctctaccaaaaacgatagaaaaattagctgatgtgttggcatacacctgtagtcccacctactcgggaggctgaggtaggaagatcgcttgagcccgggaggcagagtgagcagcgattatgccactgcactccagcctgggtgacagagccagaccctgtctcaaaaaaaaaaaaaaaaaaaaaaaaaaaggatagcgtattaaacagataccccaagtatcctaaggaagctgtaaaattacatgctggggatataattttgttaaattacatttatatttaattaaacatgaggtccatttagattttgggttgattcattcatctgtgattactgagcatttgccatgtgccagtcaatcagtattaggcaccagagttaccacagtgagcaagagagacatggaccccttctgcaagatgcctagacaattaaatggccaatgaaactaaagtgaggtaagggttctgatgtgaaaagctgagggtgtgatgaggacaagtggcagaaagttcacctggcttggtggaagggaaggtcagagaagacctcttagaggactcagtaatgtccattgaggattttaggttgaagggaatgtttgaagtttgagggcccttttgaggaccaccaagaacttcactgtgctgtaggatattgagcaggaggtgaagctagagagatgtgtaggccacattgcagagtttgaacttggggcaatgggaagccattgaagggttttaaacaacccaagtggtgcattcttctgtaaatgttagagagatcagtggctgccctgcacatcaaaggggagaacgattggagacaggcagattagatggaaggacggagttgtactccaagccaaagatgatggagagtgaattaagttagtgcaatgggaccaagtctagagctatttagaagtgagaagtgacacggaaaaaaaaaaagattgattggatgtagaacaagttggataagaatccaggacaaccccaggtgtcaggctggggcagctaggtaggtgctattgccatataaagtgttaaaaaagaatagagaaggggctagttgtcgggggaaggagttcagttttagacatgttgaactgcaaggagatttgatactataattaaggaatgtgttttaataaatttaataaacaatgaacacacattattcgcatttcccaaacaatttggatggtagatcaaaaagaatgagagtgaaaataaggggtctgtgaccactcaattaagattgagctaagagcaaggtcaagttcaaacccactataagcttcttgcatccatggtcactgactgttttcttactgttagctgtcctgttggacagtgtaacagtgagagagcatatacagattagcattgaaaaggataaagtgacatgtgtaagggttttgaaaaagtattatacaaatgcaaggcagatatattgaaataaatgcttattggcaaaatttcaggccagataggttggagtagtgcttcacaaactataatgtgcacatgaacaactcagggattttgttcaagtgttgatttcaattctgtagctggagttgggtggggtagaaaggatatctgagatcctgcatttctaataagctcccaggtaatgttgagtctgtaggtccttgaaccacactttaagtattaaagggttagaaagcttatactgtaactgagaaaaaaacatatatttctttcccatgttgtattcaatatttcttgaatgagtgtagctaaatgagcaattcgatgcaatacaaaatgttatgcaagtgtagagacagacagttcactaggtactttaaaataatagaccttacaaagttttctagacagacttcctgtgaagaacaaggagcagggggaaaggggaaggggtagaatttaccaatctgaatatttcagcaagggagaatgcatgagttttactataaaaccacactgaacattgcaacaatactaaattccatacatatataataatcactgagctataaggttgctgatgtatttgttcttgaaagtgaattagagttactttatgcagaatcagctagttttatgtttcataatgtctttcccttttttgaacttttttttaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagtagtataggtctcaatatttattatgagaccagtggtctggaaacagcttgttgtaccgaatcaactggagtctatgcttaaaaaaaaaaaatttttttttaaccatccttaaattattgcttaatggtatcatattaacatattctaaataagggctttaaggcacaggctgttgaagcattttctcagaggagtggatctgtagaagtctgtctttctatagaaatattgtgcttactcaagtgttaaattattttttctatgaactagtctacttcttaaaattcaaacatattcttttgatcacattgtttcttgagcatcctgccctgctactaacttttcaacaaggcaaaatggagtaaagtggcaatttctttagatgagtgaaataccctcaagtctcttttctgcccaaaaagggaaaagtgatagaaatgggggtggcaagtggggtgagtggatgaaggtgggtattgggggtggctgtgaaagaaaataatggagaatcacttttctagacatctacctatacttaatctaagaaacaaagtaatctactgtaaagtactctgccccttgaaagaagtattaaaaagagtgaggatggatttagaaaaaaacatgaatttagaaatattcaaaatggtttttgtggcagattcaatattatgaattcacagatatttaaagaatgagaaacatagtaattagtagaaatgccagaaacagttcctggttcctcttgtgtttgacactaagaaaatagcaagagtgtgaaatctcagatacttatgaaatctcacagatgtaaggactcaagtgtagaagaaaatatccccttcttacaaaaagaaatgtcaatttatggagtttgtgggaaatagggcaagaattcttatgcttatgagagccaagtagtcagtggaagagagtagagctcaaaactggattatcaccttagcaacttagaatagtttgaaatagaaaaaaagtatttaatttggatctggatctgttaagatatgcacagtctattttttgtatagtattggaaaataaaaatgctataatttg

SEQ ID NO: 35951 - DNA, 136122 bp, Homo sapiens; identical to SEQ ID NO: 35950

SEQ ID NO: 35952 - DNA, 3090 bp, Homo sapiens
ggcggtggcgggggagcgcttcgtgggcagccggcgggctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctggtgagcgggcagagggcagggaggggagcggccggcctgggagcggagcctagggttccgaaggcgccatccccggacctaggaccggtgccagccctgactccgccgcccctctgcctccgccagggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcgggtcagtgctagcggcgggccagactgggaggctggggttgtaaaggggcccatgccctcctttctgatgtttggctgggccatgcaatggcgcgaataccctgatagtgtcatgtgcgattgtcactcagggcgctactgggctgagatctcggataccatcatctctggcaccttccaccagtggagagagggcaccaccaaaagtgaggtcttctacccaggtgggtaagaaggctctgtcagagaagtgggtcccttcacgcggggggtgcccacaattgcggggagcatggcatggaaaaggagtgtgttgggggggccctcctcatggttcccttcctccaccctcccataagccacaggtgattggttggggcagagctgagggactcttgctttcctctgtcaaggggaaacaaaacataacaacttcctattaaacatgtctgatttttatctgcccaggcacaattttgcccagacagtattccaacaactgttggggagacaatgggtaatcagaaatgctctcaataccccaaaagacaagacagacagttatctttttatttgtttgttttttgagatggagtcttgctcagtcgcccaggctggcgtgcagtggcgcgatctcggctcactgcaagctccgcttcccgggttcacgccattctcctgcctcagcctcccgagtagctgggactacaggcgcccgccaccacgcccggctaattttttttgtatttttagtagagacggggtttcaccataccagccaggatggtctcgatctcctgacctcgtgatccacccgcctcggcctcccaaagttctgggattacaggtgtgagccaccgcgcccggccgctcccctgccttttttttttttttttttttttaatagtgaaacaatttacttaagaaatagagcactggacttcccagtatatttgaggttgggtgtatgcatcgcaggcatggtggttgaacagctacacttttcagataaagcctcacaagtcctggaactacccctttcctagctacaagcccagcccaggtttagctaaatttctgcttgattcgagtgaggcttgggagtgcagacttccatacagtgggtccatggccaagcgaggtagccgtccatggcttctccaaagagaggacgtgggtcagatgatgccacagaacatttaggagtggccatctgggccagcccagtgaggtagggctttttgtttttctgaagctccctctccattccccacccctagttagtccatgggccagggaagcagcagccatggaagggcagggcagagctggcttttcacttgggtgctccctgtcccccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatagacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttccatc

SEQ ID NO: 35953 - DNA, 3824 bp, Homo sapiens
gcgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcaggtaagcagtggcctacgccgagggggaaccctttcgccaccatcctggcgtcctgtccttcaccgcaggagtgctcctggatcttagaatgagagccgggtttccctttcattcctcgcatccccagagtcatgtgttagagggatgccaaggaaccccacacagcccaccccctgccctcatccctagcggagcgcagaggaccgagcttttgttttggatggagagctctggagctgcgtgggtgggtggagggggagggcttgttttgatgagcggggctgcgccccccacctccagtaagacttgccttgccttgcttgccgcctgtccccaaggaaggaccgtgatccttggccgtggatgtcccggcagcccgggtttgggggcgcgcactagccgcggccatgggggtgctggcgggaatccctcgcccgcacagccgccgctgcggagcgctgcgagctgcagtggagggggattctccgtatttgcgtcagctgttgttgaaatgggctctgccactggtgcgggtccaggaacattgcaatgtgctgctatcaattattaactacctcgggagtcaatggtagccggcccggtctcttgcctggcagctcgggtcgtcctcgtcctccagtgattgctttccagtaaccaggcctcccgcttctctctctcctgccagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagtagctgcgattggg

SEQ ID NO: 35954 - DNA, 8087 bp, Homo sapiens; identical to SEQ ID NO: 35588

SEQ ID NO: 35955 - DNA, 30989 bp, Homo sapiens
gtggggtcgtatcccgcgggtggaggccggggtggcgccggccggggcgggggagcccaaaagaccggctgccgcctgctccccggaaaagggcactcgtctccgtgggtgtggcggagcgcgcggtgcatggtaagcggcgggccggggcgctggcgggggcggccggggatcaccgactgtaggcgggcctcccccacgcgggcgcgctgcgctccggaggacggcctcggggtcactcgcaccccgggtcccacctcctgctgccttcctgtccaggctccattagggctccctggatgtctgggctccgctgaccggtggggggcaagtccagtgttttgggccacagggcgggccaaatagcaggggcctgtagccccagggggccccagccctgctgcgttcattcattcagcccgcttttgcggacccgcccccagtctgcgtcagggacagacccctccgccctggatgagcccggcggggaagcttcgcgtagcagtttctgggaaacaggtaggatcaggccgctcggacaggactgagggtgtaaggacgattcaccctggcattggggtggtgtcccgaggagctcataggtggtcagggcggttctgcccgagctgacctgtgagccgcgaatgccctggaccgagggagggagagccccctaggtggacagactagactccttcagtggaaaacattcaacagccaggagagcgtggaagaggaaggagagatgggagggcccaggggagcgtggaagggagggtgtttttattataagtgcacctgtaagtgcaaagtgcaaaggaagcagccgccgggaagtgcctgggcagctctgggtgtccctccaggcacctgtattccagccttacctgcgcgaagccacacatcccacgtcacacaggatacggggaagtcagccatagcctgcaggcggggaatctgaaacctcgcgcaggagttccttgggagaggtggattacaaggactcttcctcccacccgctgtgcaagagccatgggcggccggtagtcatttttgaaggacctggcaagcactgtacaaatctcaaaattgctttttgtccccctccccttgccttggagagagtggctggctagtgtgtgtgtcgtctgcctcctgaaggttcgggtaaaggaccagggaggtgggcagccctttgtgtcaggagatctggaagcgcctcccctcccaccgcctcctgtgtaaaggaaacagcaggtggtgttgacgggcggttcacgcaccggtttttgccaaggagagaaaaacctactgaaacccaccaggaggatgagtggaagtttctaatgtgcttcattttttgatacagcgtgcatggcaggcatttgcattcatgacccttccgtgtacttgaactgaaaacctgaagaaactggccaacagattaggcagccatcaatccacatcagatggcccctgtatttccaagaggtgacctgccatccccatctagaaagccaaccaggggacagggtagctcctaccaccaacaacactgctctaccctcagattctcttctctgactcctgcctccacctgctggagggtggcctcagcaggagccacacctctctgtttgcctgtgtgcaccctacttcctacccctgccttccctcagtccccacccgctaccttccttacagcctcatcccaccctgtctctcctttaaagaacagactgagatggcattgttttcctcaaagagtctgtcagggagaacctgatcaacacattcacgctgtggtgttagtggttcccacagaaaccccatttcctctccggcaggtgtctcagccatgggcaaacaccttaacctagtggaatgaaattgctgtttagatctgggacacaggtacatggagatgacctgttccttggggagaggggatggtgaacatgattataagaactcttcttcccacccttgtgcaagagcaaggctgttcctggttctgtgctctctcagtactgtgttctagttggactcttgcttttgtcttcctgaacttggtgtgtaacttcagtaattatgtctatgtaaggtatgtctatgtatgtgagtgttttttggatctctaaagtcgtgataaagcacgttcaatttggggactgaagccagggactcttgtgtgctccaccacacactgactgcaatctcagacagttccgtttacacacattcccagggccttggtgctgtcttagggaaacccagggctgtgaggcaggctttgtggggtgctggacacagggcatggcacataaagggtttttttaaatgggtagacagtaaataaggagcaactttgcctctagatttaatataccacctgtgaatctgatcatgtagaatatggttcttagactaacataggacatgataagatttgattatgggccaggtgcggtgtctcacacctgtaatttcagcactttgggaggccgaggtgggcagatcatttgaggtcaggagttcgagaccagcctggccaacatggtgaaataccgtctgtactaaaaatacaaaaattagctgggcgtggtggtgcatgcctgtaatctcaggtacttgggaggctgaggcaggagaattgcttaacctgggaggcagaggttgcagtaagctgagattgtgctacttcactccagcctaggtgataggtgagagagtgagactctgtctcaaaaaaaaaaaagtcttgattacataaagaggattttattaaacgtattcacagttgtagggtgttactattgctttttgtcctcattattcatccctggagtgtttcagaactttctctagaaatattgtaatttaattaaacatttgatgattacttagaaacctgaaactttgggttatagtctgctaaggaagggagggctgttgtggtatgggaggtgctactttggaacggacattcctagtgccacgtctcttctcccagtctcagctgacgttgccttaatgtgcatcattcccagccccaagcctgtcacctctcatagggtccgtcctatttctggaccagccccaaacctgtcacctctcatagggcctgtcctgtttcccactgatgtcccgctggcatatcaaactcagcatgtcaaaaacctgatcactgctgcctcctgccaaatggccccttcccagatgacctgtttcagttcatggccatcacccagtcctgtggcatctatgatgcctgcatcttcctcctactgcccgttttccccctcagtacactgctgagccatcagcagacccccttcaacaggtgctggctgagcagctgctgggatctggttttgtgttgggtgctggaggttctgggatgggggctggtccctactcctggagtaggcgtcatctaaccagagccagaggggcctagaagaactgcacatgtcatgtgctgtggaaatggcagagcagccagcagcacaagggaggagctccgccagcacatttcagcaggaagaaccttagtcaggcatgatctgtctccttcgttgagagagtagggcgtgagtgtgatcagaattgtaaaacgttttgtatttgacacagtgggtgggccctgccctctttatccccatccctcaccccacagagtgccttaagtccgatacccacagaacttatttctgttacctgcctggcctagccattgaaggattttagaagttgccataaaatacacataacacaaaaattagcaacataatcctttttaaatgtacagttctgtggcattaagtacattcacaaccaccatcaccatccgtctccagaactttttcatgttccctgactgaaactctttacccaataagtcctcctcacccactgccctcagcacctgcccttctactctctgtctgtgtgatttgacagctctgtaactcatgtaagtggaatcctacaatatttgtctttttgtgactggcttatttcacttagtgaaatgcctttaaggctcatccatgttgtagcacatgtcagaatttacttcctttttaaaactgaataatatttcattcaaaattcagttcagctctaaattgaattttgtgtatccatctgtcgatggatgtttggattatttctctcctgtctgttgtgaataatgcttcagtgaatgtgagtgtgtagatatctctttaagatcctgatttcaactcttttagaagtgggattgctgaaccatatggtagttccagctttgattttcggaggaagctccatgctgttttccaaggcagctgcaccatctgactttcccaccagcagcgcacaagggttccagtttctccacatcctcactaatacttgttattttctgtttgtttgatagtggctgtcctaatatatgatgtgatagctcattgcaattttgcattttgctaacgattcatgatgttgagcctctttttgtatgctttttatctgttattttttaaacagattgctatttttgtggttgacttttaagagttctttatatattctaattattaacccctttcagagcagatgtactatttacctgttttctcctgttctgtaggttgtgttttcattttgttgattgtttcttttgctgggtagaagccatttagttaatgtaattccatttgtttatttttgcttttattgcctgtgcttttggtgtcgtatctaagaaatcattgccaaattctttattatttatcttggtggattttgtgttcaagaatttgtccatttcatctaggttatccagtttgtaggcatacagttgttcgtagtactctcttataatcatttttattctgtaaaataggtagtaatgtcccctctttcattccagattacagctatttgagtcttctttctttattccttagtcagtctagctaaaggtttgacagttttgttgatttttgaagaatcaaattttagtttcatttattttctctatttttctattctctatcctcctgtaatctttattattttcctcctccttttttacttttttcctcctccttttttcctcctcctttttctagctttatgtttagtttgttcttttactagttacttaaggtgtacagttaggttgtttgagccctttcttcttttctaaagcaagtgtttacagctgtacatttccctattggcactgtttttgctgcatcccataagttttggaaggttgtgtttttgttttcacttatctcaaggtattttctaattttcattatgacttcttctttgactcttcagttgtttaagattgggctgtgctgaatttccacataattgtgaattatccagttttccttctgctgttgatttctggtgtcaccccattgtgactggaaaagatgctttgtatggtttggattgtttaaaatgcattaaggcctgttttgtagcccaccgtctggcgttgcatgcagggcgctccgttacactcttgctctgtagtgtcgtttgagtcctctgtttctatattgatcttctgtctaatttttctgtccattattcaaagtgggacatttcagtctcctagtataataatattactattattgatagttgtctatttctcttcaattttatcagtgtctggttcatatatttaggggttttgatgtttactgtgtatatgtttataattgttttatattcctggtgaattgactattttatcatgatataatgtacttctttgtctcttgtgacagtttttgacttaaagtctcttttgtctgatattggtacagcaacccctgctctcctttggtcactctttgaattgactcttttccattcttttactttcagcccatatgtgttcttagatcaaaagtgagcttcttgtagatagaatatacagctgacctttgaacaacatgggttagggataccaacccctcacctgcagttgaaaatccaagtgtaacttcagtctagaatgcagtggtgtaatcatggcttactgcagccttgaactccaaggctcaagtgatcctcccacctcagcctccccaaggagcttgggactacaggcgcacaccaccatgtccagctaatttttttattttttgtagagacagtgtctccctatgctgcccaggctggtctcaaactcctgggctcaagatatcctctcgcctccgcctcccaaactagtagcctactgttgaagaagccttactgataacataaatagttgattaacacatagtttgtatgttatattactataaggtaagctaatgaacagaaaatgttattataataagaaatcataagaaagagaaaatgtatttgctatttattaagtggaagtggattatcataaaggtcttcatcttcattgtcttcatgttgagtaagctaaggaggaggtgaaagaggaaaggttgatcttgctgtctcagaggtggcaggagtggaagaaaatctggatataagtagacctgtgcagttcaaacccatgttgtttgagggtcagctgtagtcaggtcttgttttttaatctattctgtcaatctgtgtctcttgattaaggagttaatccatttatatttaaagtaattactcatagggaaggacttgtttttgatgttttgttatttatatatattttatagctttttttgtccttcattactaccttattttgtatttagttgattatttgtagtttccgtttttgattcccttctcagttccttttgtgtatatgctacagacatttccattgtggttacaaccatagggattacatacataacagcctgaagttatagcaatctattttaaattgatatcaacttaatttcagtcagacacagtaacctctcctttacaattccatctacccccactttgttattgatgtcacagattacatctatatatattgggtatgtacccattaacataaacctgtaattatttttatgcatatatcttttaaatcctgaagaaaatattaagtagtgttgcagaccaattgtacactaatactagtttctatatttgtccctccatttgcctttgctggaaatgtttgtattttcttacagcttttagctgctgtctagtgcccttttgttttaactttcaggactccctttagtagtctggtagggcagatctagtggcaatgaacacgcacatcttttattaatctggaagtgtcttaatttctccctcatttgtgaaggacagttttgctgaatgtagaattctctgttgacagatttttttgtttgtttgttttagcagtttgggggtatcttcccactgcctctggcctctgaggtttctgctaagacattggctaacagtgttattgaggattctttgtacatcatgagccattcttttgctgctttcaatattctgcctttgtctttacacagtttgattatattgtgtcttcatgttggtctctttgggtttatcttacgtggggtttactgagcttcttggatgtttatattcatgtctttagtcaaatttgggaggtttttagctattctttcttcacataatttctctgccccattctctcttctctttcttagatttccataatgtgcatggtgcacgtgagggaggcccctaagtccctgaggctctgctcactttcctcattctttttgttcctctgacttgatattttcaaatgtgctatgttgaagtttgctgattcttctaccgactcaaatccctctggtcagagttttcagttcagttttgtatttctcagctccacaatttctgtttgattcctttttataatttctcattttgttgtcatatgttattttcttgatttcttttcattctttatctgttttccttcagctcttttagcatatttaagacagtcatttttagtcttggtcaagtacatccagtgcctgcatttcttcagggatgggttctgccacttcattttcttcctctgaatgagctgtgttttcctgtttctttgtatgccgtgtgatttttttgctgaacattgggcatttgaaaaacagctccttgtcccagtctttgaagactaactctgtattgggaatggcccccaccaaatagcaggatctgcctaagtgtggggatcagctctggatgaaggccaaagtttcctctggtttcttctgaggatgcatcttccctgggcctgtgtatgtgtttttttcaatttccccatattcgtggctgtttcaaaatctcttactttcattatgaatactttcaagcttccctttggaatataccaagaaatgcatttggagtaacctttgtttttctatcattgtaaatttagattctggaattggggtttggtggtgtgatgtgttgctcacatgtggccagaactcctgctcctaaaaggactttgagatcaaggaacacatatttaatctcccctttatgccttggttttagttcctctttccaagttgaataaccaatttttcattgctgtttggtttaagttggtgctttgaagcttaatctcagtacccttaactctgaattatcgaattttgataaaaatgtgtgcccttattttttggtaagagaaagcaggtcttaatgtctgccggaacacaatttatttgccttgttggctccattaaacttttacaaagctttatatatatatatatatatcttactttctcaaagtctcccccagtccctccttgggcctcagatgttctactgtatttctcacctgtcattcttgccccaggtatgcgtggggctatagtcatcctacagctttgcctagcagtgcccataaccatttccctgacttcctatctgggctctgagctcagagtcaggtgaaacagagatctgttcctcaggcagcccaagacagattaggatgttgcagaaaggtccgctctgctccctccagttcaagggaaggaattgggaaccgggctgccgcattcatcaggtggtgccatgctggggaggcctggggcaggggtgagtgaaacacctcagagttcctgacatcctgaatgtggctgcttctgggctgggcattctcttggttgctgtagatcgttgcctgttttgcagagctcctatgcaatattttaaccagtctctagttgtttttagtgtttctctgtgggggaacaagggcctttgagcttcctcttttgccgtcttgctgtgtcctctccctgtttatggattttctacaggactctgttgtgtgtctggtgacgttatagaaggtgcgggggtagaggagcagcctcttccattctagagaagggcttggatgccatgctgggcagcagcagcacaagacaagctgagtccctgccctgggggctcatggcctagtggggagacacagacctacaggaatcaggtctatgaatactggtttcatcactgctggtggtgggtaaagggagctcagagagtgcgtgatggggcatgtgcaggttgggggcatccgggaagggggtggcagtgacatttcagtggaggtttcagaatgaagacacggtgccagtgtggtgggacaagtattctgggaatgcgtatcagtctgtgccaggggcctgaggcagggagaggctgagttctaggggcagaagaaggcactgttctcagagcactgtgggcaaggacgaaagaggagtgcgatgaagccacaggggccagcagggacaggggccggcagggacaggcccaggcagaggctgcaacatgatcctgagagctgtgggaagcccccgagtgtggtgggacccaggcccagaatagggctggggaggggctgcacgttggcacctgccaggagaggctttttgcagccctgcccgtggcagatgctcagggaagggtggtttttcctgtctcctgctccagtgtgggtggccaggccactggtgaggcctctcccctcggcacggggcactgtggcagtgcttgtcttacctctctgggcctgaggatatccagctgtggccacaggcgggacctcaggaaggaggggccaggaatggcctgctccccgtgctttgccccgcgggccctgtccttccgttctgctgtgcccaaacagcctcaggtagcgcaggtcgctgcgggcttgctcctttgactgctactgccccctcctcagcagtgcagccatgctgtccttggttccacagagatgtcacctcctgctgcccttctgtaaagcccgcatgtggcacgtgctttccctgcagcctgttctgagcacattgaatccccacagtcacgaggggctctccaatgagcagccccaccttgcagatgaaactggcccccttgaggggcatgttgcccactgtcacacgtagctgcgggcagagccggtgccacttccagcccggcatcctcctgatccctgctcccctaggagtggccactcaccaggaccgactgagagagtgagggagggacaggctgatggacgttccccaaggttgggggccctagagtcggcccacacttcttgtcctttgaagcctcaggttcccacatgctgcctcgcactggagcagccaatgaaacttgaacaaatgctttcattttgggtatatcgaaccaaaaacaatggcacccagtgaatttattttgctactctagtagaatttttgtaggctttggaagtacacagacattattttctccttggcaggaatgggctatgtgaatgaaaaaaggtatccgttatgaaacttccagaaaaacgagctacatttttcaggtttgtctggggctctcagtagttgcccaagggacggagtttaaacctttcgaaaagtaaattgcctgaatagaagtataactgaggattgaaagactgaatcagatacgcgcttctgttcccatgaacagtttgggaacaccatttacatgtggcttcttttacataaatcgccatgtgtcccaagctggtgggaccctcccttagaggagccagccactgtggtctgtgcaccaggtcagcagctgcaatgtgtgcgaccttgagcaggctgtcctgcctttataaacctcagttcctcttctgtaggatggggatcacaccttctggaataattatgaggctcaaatgaagcttctgattcctggggggaacacggagcagtttcaggttgaacattttgtccctgggcctggggacgtctgactctccttggatcctagcaccctaacgtgcttttcctgcctctccccccttcccaccagcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagaggtacccgcctctcatggcagggctctcgggatctcctcccctgtgctacagtgttggccgggtcccctgccacagactcacctgggagcttgtctaaatgcagtttcccagagatgctgacgctggtatgggctggggtccaagcatctgaatttcccgggagtcccagatcactcttacactagtgagtggtgaccatgctgaagggcagctgagaccttgaggtgtttggtggcctgtcccctccccacattcaccagcaggtcaggtggctaggaccatgatttaggccagtggttgtgtttggggctttgtggggagttcaggcaggaagtatccccagattcagtcccatgggagccagaaaatcaggaaagtcagataaataataaaggctcctgggcttgaccgggagctgccaggtgggccaagatggccaggggcaacagccgagaggggtctcagctggataagggagctggagcctgggcttcgttggctatgcttctagggtgggcctcaggccggggtgggcggcttctcttgaggggtccccctcgccacccggttcctctgctctccaaccaccctcttcccttggttccctgatgcccctctcgtgcccgtgaccctgaggttcgccctccatgtctctctagctgtagccagtgagagtttgcagcccctgtcaggcaggtcccctgggtgtcccatgctcttcttggctgacctggaacctgtggggtagacaccatcctggcattgcacggttctgctggtgctggacatttctagctgctgtctccaaagctgagtggtgtattttatttacttttgactccatctgcgttattttttaacttattacagtagtgaaatatttagatgccatatctgcttatctctaaaagtggcttcgaagcctgtaatcccagctatgtgggaggctaaggcaggagaatcgcttgaacctggtaggcggagtttgcagtgagccaagatcacaccattgcactgcagcctgggcaacaagagtgaaacttgatctcaaaaaatttttttttaagtggaactttttaaaaattaataattaaaaagtaaagcttcttcaaagctaagtgtgcaacagacatcagcctgcgatgcttttggagccatgtcccagggttttctctttggagagaaaagactttgcaaaaagttttgtccctgattttttctggtccagtcttcgcgtctgaatttagtatgcctccttattgtaagcacaagttcataccactcctaataatttaaaacactccattttttaaaatgaagaaaataccctaatcttgagaaccctttaataaattcatttcagaatcaaggaaatggtgttcctattttcagtttggagtcacttatcctattccgctgtttattgaattggcaagaattaactatgttaaaatttaacactgatgcagttgttttgtgtgtaaattatcttcagtaaagttggatttttattttttattttatttttattttttttgagacggagtctcgctctgctgcccaggctggagtacagtggtgcgatcttggctcactgcaacctccgcctcctgggttcaagcgattctcctgcctcagcctcctgagtagctgggactacagatgcccatcaccacacctggctactttttttttcttttttatttatttttatttaattttttttttttgagatggagtctcgctctgtcgcccaggctggagtgcagtggtgcaatctccgctcactgcaagctccgccccccgggttcatgccattctcctgcctcagcctcccgagtagctgggactacaggcgcccgccaccacgcccagctagtttttttgtatttttagtagagatggggtttcaccatattcgccaggatggtctcgaactcctgacctcgtgatctgctcaccttggcctcccaaagtgctgggattacaggcgtgagccaccgtgcctggccgtaaagttggattcttaaaaggtaaaatgcagggcacatagcttgcacctgtagtcccagctactcaggaggctgagatgggaggattgcttgagcccaaaagttcaagaccagcctgggcaacatagcaagagcccttctctttaaaaaaaaataattataataaatataatctttaaaaaataattataataaataataattttaaaaaaataattaattaagaagtaatgttctggccaagacattaggtattatactcatcttgttctgatgaacaaagagtcagaatttagacaaggaatagctgaagggcccctgccacttggggattggtctgtgttagtgtctgtctttaaaaagtgtggctagtcatgattgtatgtgttctcctgtgtgtattcatagttgtacccttttcaacatgttttccccttagaaactcccacgttaacccacgaaaccttcaaagcactgaagccaggtctttctgcctatgctgatgatgttgaaaaggtaaggatcctctcccgtgtctccctgttcaactgcagaatgtgttcaagccagttcttttcctttgaatgtggtaggctgtcttcacaaaggaagggggctttgacagtgctgcctgggcatttcatgccatttgggatggtcagaagagagaaggtgtgcagcgcgcgagcccagaggagaacgcgcccccacccggccccatcctctgactccaccgtgccagcgctcacttctccaacgtgggggtcccgaggtcttggtacaggtcagaagcacaaatcctgcaaacttacaaaaatcattatttgatagtttgcttattcaaatttttacgctaatttagtcttgtgaattttgcataatacatttttaattttttgttgtggtttctgatcgaagatagcaaacattgactgaaaaaaaaaaattagtgttggccaggcatggtggctcacacttgcaatcccagcactttgggaggctggggcaagaggatctcttgagcccaggagttgaagaccagcctgggcaacagagtgagaaccctatttctacaaaatttaaaaattagctaggcatggtggtacacacctgtcatcccagctacttgggagactgaggtgggaggatcacttgggcctgggaggtcaaggctacagtgagccatgattgtgccacaggtgacagagtgagaccttatatttaaagaaaaaagttaaaaacgtattacaggccaggcacagtggctcacgcctgtaatcccagcactttgggaggctgacgcgggtggatcacctgaggtcaggagttcgagaccaagctggtcaacatggtgaaaccttgtctctactaaaaatacaaaaattagccaggcatggtggcgcacgcctgaaattccagctactcaggaggctgaggcaggagaatcacttgaacatgggaagcagaggttgcagtaagctgagattgcgccactgtactccagcctgggggacagagtgagactctgaccccatccaaaagaaatgtattatgcaaaatccacaaaaccaaataaatcgaaatttaattaaaattgtcaaataatgatttatgtaagtttgtagcattgctacttctatctaaagtccttaaagcttacagctgcactaatacaggatgcctggttttctaccaaggcactcacaaaatgggctatggagagagttgtaacttccatttggttcaagcatttcttaagtcatgagctagtacattgctcttgtccacaaacgtgtcatggtctcagacaatgtagttcaagccttgctttcctgtagcttagttaaaaaagaaattgaaattagtgattctagagtgaccttacagttaaacctgattaaattagataaatttagaataagctcctaggatttttaaggccttacttgtttgagtaggtgacacacattcaagtgggacaaatgtccacgctccccagggtagtagcacagatgtccctcctactccaggctgcctcggaggcccacgtcctggctctcttagcatcctttgaggctggttgatgtgtatgtaaacagagtcatctgtattcttctccccatttttacttcacacccacggtggtgtccacaccgaggcctttggctttgctgctgagcaggataattagagagcgtttatgtcggcatgtgcagagcctccttagtttttttggctgaatgttattgcatggatgctgcacacttacctcatggaaccagtcctcttctgaaggacatttagataatgtccaatctttctctcttgacagtagaaaaaggctgcacctgacacatacttcattacccacacatgcaaggggcatcgctcagatgaagtctctattttttttccccgagatgaggtctctctctatcacccaggctggagtgcagtggcacaatcacagctcactgcaacctctgcctcccaggctcaaatgatcctgccacctcagcctcccaagtaaccgggaccatagatgcacaccgcaatgcccagctaatgtttaaatgttttgtagagatggacatcttgctgtgttgcccagggtggtcttgacctcctgggctcaagtaatcctgccacctcggcctcccaagatgaattactggagtggaatttctggataggaggaacgtgtttttcccttggacagatgcaacccacgtgtccccacagaatcacacctgtctacaacaaccagccacattcccagaccttcactttcatgcacacactgacataggaccttatccagccttgggttctggatccagcactctggcaggtgaagtggctcctcgttgtagttatcatggggtttagtgccaggagggaccccagaattgcctagtgccacacctttgcaatgtccagcggagctgaggcgcacctgagatcgcccgtgaggattggcacaggtctggatgtgggcttgggtcaccaggctgcagtagaacagcaggcttattctcctgacctgtcctccccctgccatgtttcacctggtccctgtgttcccacacacctgccagtaccacttgcatcactgtttcctgcagattttgaaaatcagaaaaaaaatatttatagaagcaaaggccagggatggtggctgacacctctaatcatagcactttgggaggctgaggcaggaaatggcttgaggccaggagttcaagaccaacatgggtaacacagagacacagcgtctctataagaagtttttttttgttttgatttgtttttttgggatggagtctcactctgtcacccaggctggagtgcagtggtgccatctcggctcactgcaagctccacctcctgggttcatgccattctcctgcctcagcctcccgagtagctgggactataggctcccaccaccacgcccggctaattttttgtatttttagtagaaacgtggtttcaccctgttagccaagatggtcttgatctcctgaccttgtgatccgcctgccttggcctcccaaagtgctgagattacaggcgtaagccaccgtgcccggccagaagtttttaaaaattagtcgggcatggtggctcacgcccttgtcccagctacttgggaggctgaggaaggaggatcacttgagcccaggaattcaaggctgcaaatgagctgtgatcaagccacttcactctagcctgggcaacacagtgagactctgtctccagaaaccaaaaaaacccaaaagggtggaagcagcacgtgtgaccctgtatgctgcacttgacagaccctgctttgctcttaccacgttcacagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgagcctggccattccccagtgccattagccagccctcaggggcaactgatgactgaaaacaactgctgtctcaccagtgccgcaccatcaggcaggacacagatgcttctgaagaaaagtttgcagcatcacttttaggtggagggatggtgggcagatgatgctttgttccttgtgacatttaaggttattcatgttttctggagtgaatctgtgttttataataaggaaagcaacttgattttagaagtgtactgtgggccgggcatggtggctcatgcctgtactcccagtaatctgggaggccaaggcgggcgaatcatttgagcccaggagttcaaggccagcctggccaacatagcaagaccccatctctaccaaaaacacaaaaattagctgggcattgtggcgcatgcctgtcatcccagttacttaggaagctgaggcgggaggatcgattgagcccaggaggtcaaagctgcactgaactgtgattatgccactgaactctagcctgggcagcagaacaagaccttgtctcaaaaaaataaataaaagcgcatggtgccttcaagggacttgatcctggtcagaagtttgtgtgtgctgagccccggtgctgcagctgaagcccgtttgttccccatggcagctgctcatcctgctcctggtccgatgctcagacgtgactgtcgaagggaccctgtggcctctcccagtcccagcacgtcagggccaatgtgtctccagctgcccagcattccgcagtgggtcctcctcaccctccgtgctgcctccactcatttacctgcaggaggagggcacagggcacgcctgtcagggtccctcacagggttggattgtgcacgcgtgcaggtggggtgtgcagaggtgctgaagcttctgtgggtagatcttgctgaaaggtgggcaaggaaataccccccgaggccagggccctggtgaaggtggccgtctgccttagagggcttccggctcctttatctcacatcccaaagcagggcagtgtttggagcccagcaggcccagtgtgccccagcttcccccagtctatgcagcccccagagcccttctaagccccagcgggcttaggacagggtctccagggcagcatgggcctcaacgagcccgggcggtggattaacttgcaatggattagagaggcctgaacacactcacagaacatggcaggtgcccctggggtttcgttactgcctgccaatagcatgatgcaaaacccttaaccataaattctaaaggatgaagaaagccggtctgagtgcagtggtatttacaactaattgatcacaaccagttacagattttttcgttcttctccacccacactgcttcacttgactagctagctagctaaataaataaatatattcattcattcattctaaaggatgaagtaacatctctctttacatttaggtgaaaaaagtatttaaagcatcgcctttccttgtaggggatgactgtgtttccatcatgaacggaacagatgaaggtaaatggctggaagcacctctgtacagtggggctgtgcagtgaggtgggtgggagcaatcctgctgcttctaaccatccgccacccctccccgccccatgtgggagcctcctcccccgtccgatgctcaagtaaagaatcatggctgttacagccccgttctgattcacaattgacatgtcacaaaaggatctttttggggtcagtgtcagagacagattatcatcttgaccaaccccaaacctggcatgaatgaagcttctaaaaacattgtgtttttagttttaagaacatttggagagaatctccagttgccaccacatttagaatgttgttgcgttgttaattctaagagacatttaaggttcctcactagctcctgataggtcttcagtatgaccttgagagtgagtgtgtatggaggaggaaggggagcactgggttctttttctgcttcttccaaaaagaggaggccagtaataaccagaggagagacgcagcatttggtgaagtactttaggattcagcatgctgtgtctcaggacagtcggccatagctgctggattcatttatgagaaatgctcctctctgccgatgatctgaaggctgggtgtagtgcggaagtgatccctttatgctccccagatctgcaaatagtcatttaacggtcctgtgtgttatgctttcagcatctcaagtgattaaaataatgcctgtgacactctcttgcaggcgtttcggcgtggatcaccatcaacttcctgacaggtgtgtgcacactgcatcacagaggctagccgatcacagacacctgcggagggctcgactgggcctttcgagagcaggagcctcatttctgctctttaagataacccctcagggtttggcagtgttgctgactgaccatagggtgttggggatgggtggggtcacccacctgtctcacaggtgtagatgctaggagtggggtgcttctctgcaggtctggggcatttttctcccagcacagcccctgccctgtcccctgcagaacatccaccaggacccccatcctctcatttctaagagaagtaacgaatcaaaccagtcatatcttccaatattgaatgtgatgtgaatgctattcaccttctaattggattcctctgctgtaggtggaacagggaacagaaacatctgtttttagaaacaagtgacaaggagtcatttttcttagtgcatgtggattttttgtccctttgctggaattatgggaaagagcagtgtttctgatgtacagacaaaaaaggaaagaagtttcctgtcaggtttgcccatttgccactttgggggatagaaatgttaggagatgggttgggagcctccgcctgagatgctctggggagtggagatgggctgatcagagcagggcccagctcttcctgggagctaagccagcggcctccctcccagctgatacggcagtttcagtatctcccctgaaggttcatgctgtcccatcaggatccaaattaaaccacagctggtggagccattactcttgtcccttagatatatagtgtacccttaaatggagatttgtcaatagctgagctacttctctgtcttttctttcccctgagggcctggctttcaccctggcttttctgctgttctcgcgatcttactaatgcccctgtgctgtttttgcttgctgtgctccaggcagcttgaaaactccaggagggagcagcgtgggcatgctggacttgggcggaggatccactcagatcgccttcctgccacgcgtggaggtaacaagccctgccgaccacagcgctctttccaccccgaggccacaccgccatgggggtgcagggtggggcctgctgaggtgctgcggggtggggtggggggtggggttggccaggtctctggacccctgcggtcatttcctcttctgagagctggactcactcacagatgatgcttctggcttggagttttaattccaccaggaaaaaagccaaaaacagaaatttggtctttagaggggtgataaattagggaataactggaaacgtttgggccagaggatatgaagtgctgcctctctccccttcagggttccgaaaggaacaagagcagaaagattttgtccagttcataggttgggaggaagcttccagccttttcaagataaatatcctaaaggagatgaaaacacttcccattgaggcacctgctgctttaaaaacagttccctcctcacccactcatcctcctgttatgggtagttttccatggaagggtgggctcataggtactgatatgatcgtcgtcatgtctgggccgtgtttgtcagcatgggagaggttgcctgtgggaacgaagcaccgttcttcactgggatattggctccttattgcctgctcctgtctcgcagccagcgacctagtgaacagctcatttaattggctgcacctgaccatcccctttctttcaaatgaattcagtgggtggaggagaattttctagaaagaccagcaggaaacatagttaccctcgttcttctccagggcaccctgcaggcctccccacccggctacctgacggcactgcggatgtttaacaggacctacaagctctattcctacaggtctgctttcgggaacaggcgtggggaggcgccatggggtgggtatgcagctcccagggcctcgcatggccctcttgaggtcatggatggcagatctgggaatccctgtgctgggaatccacccagacctctctctcctcctcctccttctcccgcctcctctgccctcctccttcatcctttaatgtgtctacagtatacgcacattcacccagacctctctctcctcctcctcctcccacctcctctggtccttctccttcatcctttatctatagtatacgcacattaacccagacctctctctcctcctcctcctcccgcctcctctgtcctcctccttcatcctttaatgtgtctacagtatacacacattaacccagacctctctctcctcctcctcctcccacctcctctgtcctcctccttcatcctttaatgtgtctacagtatacgcacattcacccagacctctctctcctcctcctcctcccgcctcctctgtccttctccttcatcctttaatgtgtctacagtatacgcacattcctccttgtgcacattcctccatgtgtgcttattctgctctactttggagaaggtttgagaagtgggagggaccatgggccacacaggagtgttccgggccacctattgccacgtgcagtcttcagtcgattcttgttataaagcaggagcatcccagactggtgtcgagtcggtcccactcaccacagtgtctgcagctcctggatgagctcctgccatatgataggccctcgtgtgttgaattaattagctaagtttcctcaactctacagaaacaggcttttagaaggagcagagaagctcactaactgccttgctgcaagctcccccttccccactcgggctgggtctcagaggtgagcctgccatgacctgtacctgccatggcagctgccctcactgaggtgtcattcccacagctacctcgggctcgggctgatgtcggcacgcctggcgatcctgggcggcgtggaggggcagcctggtgagtggacatgttgccccgggcccactttcacagcctctgccctccattctcagtgggaacgaggagcccctcgggagggcaccagcttggccctgcaggagaggtccctctgcccctcccaccccactgctgtcccgctgcatgctgggcacccagccaggccagggcatgcgagtggaggggtgtgctgcagatcttgttggtggcaccctgatggggcaggaacccagggtggtgttgtacctgtccaccttccaaggtatttctttctttattttgagacagtgtctcacttgctctgtcacccaggctggagtgcactagcatgatcccagctcactgcagcctctgcctgccgggttccagcaattttcatacctccgcctccccagtagctgggactacagatgtgtaccaccacgcccagctaatttttgtgtttttagtagagacggggtttcaccatgttggccagtatggtctcgaaatcctaccttcaaatgattgcctgccttggccttccaaagtgctgggattacaggcatgagccatgacacccagccccaagttattttttaaaagatgctgatgaaatcccttctgaagcactgagctgaaactgagggaaccagggaactgcacactcatcccctacattgggagctggctttagggatgtgaagacagaaccttgtacagacagcacaggagggctgtggggggtgctgggttcttgccgtcagggaaaggttttctctctcgctcatgattccagccttgcaagaacatccctcctcccttgctctgcgaagggtcatgaaatgtgggcttggcccttcctgagacatggagttgacctggggacacagcctgcatcagggccagggcctctgctccttataatgggcatcacagcgggcatggactcttaggagatctcaggattgccatggtctgcttcaggggctggggcacggccctgaggctggtggtgcctctcttccctgatggaactggccaggccacagaggccttcccaaggccttagtgtctgatgtgtgtatgaggcgctcaccagcacctacgtgtgctccagccaaatgcccttacctcagcccccagcgccccattggcccagcacccctgcccacttcttccgagggcctggtatctgacagggtaggatgttcaactggaattttcattctcctgtgcatgccctacttcagttctttctttcaaatcctggtgtttatcttcataatggtattccttttgttgcaaacaaaaaccatgtctatgtctcagaaacagctgcagcccttattctggggccaaaaaacacctattatttagccaatgagaaaaggcaggtacctctttgccctttgtggttcccagggagtcgtggctcagaccctgagtcctctcacacccagcagagcagcaagaaggtctcatggtctcctcgtcaggctgtacaaagtgcctgttttagacatttgggggctgtgaggacccaggagaatgagtctctgttttgttaccggttattgcgtaacagaccccccaagtagagtgaaagaacagcaaacagcagtcgcggctggaatctcacagcagaccacacaggctcatctgggcagcacctccgctggggtcctggggatctgtgcagctgcatgtggctgtggcagctgtctagaccctcccgctggggtcctggggttctgtgcaggtgcatgtggctgtggcagctgtctagacgccccctgctggggttctgggggtctgtgcaggtgcatatggctggggcagctgtctagactccctgctggggtcctgggggtctgtgcacatgcctgtggctgtggcagctgtctaaatcccccgctggggtcctgagggtctgtgcacgtgcctgtcgctgggcggctgtctagacctgggcgctcttccacatggcctcgccccagcagagcagcctgggacacttttgtggtggcttcaaaaaaggaaggctaccctgatgccaccatttcctgcccattccatcaaggaaagcaggtccaggccagagtccagggatgggaccagcacctttcggtgggacagcagcctgccatcctcgaaaggtgatactggggccagccctgggaccaatacgcttcctttgctggttttgagcccccagcttgtgtgtattggagcagcagattccattcaaggcatggtggcacctggtggcacttgttctggccctgccaccaacctaccagctactcacagcctcagtcacctataaaactgggtaatgatggctcccctcctaaaaggactgtcgtcacacttcactgaacagcccttggcccagtgcctggcacccggcgtgcccagggccgtgagctgggcatggtcctggtagcggtgtgcttcctggccaacgaggctttgctgccacttcccagggaggtgttgccttcccagtggacctggaagccactcagcttcccccatcctgtgtcaagccagggcctccgcgactcctagctcagccctagtccatggcggtgatataccttcctttctctttcctttttaatctctgtttcagctaaggatggaaaggagttggtcagcccttgcttgtctcccagtttcaaaggagagtgggaacacgcagaagtcacgtacagggtttcagggcagaaagcaggtacggggagggttgctgcctgttggtttctgcgggtgagagtggtggcctcctctcccccttgcctttcccacatcccatgggacgttccacgggaggctcctgacctctctttgaagagcctgtacctgccctggaagtgaaggtggtttggctgcaggggcctgtgtctgtgctgagagccagctccttccctctgcctctgttcaacattcccctgactgtcaccagaagcttcctcctgagggctgatttcctaacaggcctgcagggaggaaggactggaccagcttggggctgagatgcagggctgggactgggagcccaggcactctgtgctgtgctgggcgggaatagagggagggtctgcttccacccatcctgctcgaggctatggagcccgctggccctgggcaggctctagtgctctgcacccttgcagtttcttctgagagaaatgttcaaacgccattcccagactgggcactcggcatgaggggtgcatgccttcgcgaaccgttcaggtccttccaagtcaatcacccactggtgcgtgtaccggggggccgcatcaggcacagcaggactgcacagctgtgtcccacaggaggagccagacagtgaagctcatcgggaaagccttccaagagaaataacacggggcggggatctgagagggcgatcgcagctgtaactaggacagccaaggacggcctcgtggggtaacatgggatctaagacaggaggaggtttcaagaaactgcgcagatctgaagcagcagcaccccaggccgcacaagcagcacacaccggggccctctgtcagctgctgtgtttaatgaacgaggaggaggtggtgtggcttggtgggggacaccaggaggaaatgagatcgaagggttggagcatgggtctgtggaccgtgggaaccctggaagcactcggaaggatggggcctggtggaggaggactgggaaagccgggaagctgggtcaaggtgtggggtgtagaggcgccctcagatgtccacacggtccattggcctccggggtcctctgttcctgttctccctcaagccatgggagcttggcaagtgagctgggcctccacttccttatctatgacatagggagggtgcaggccccctgaggaggtgggactccgggctggcggagggggaatgtagggcagatggtcccaacaggccagaggccactggtgtcaggcatcagcagcttcctcctcagagtccaggtctgccgctgccttcgtgcccacggtcttcactccctgcgccgggaccaacaatgccctggctcctgagggctgcttttgacctgtgcggggagcagccccaacttggggtggggtcttacaggcttctggacctgccttttcctgacaattcaggtcagagtctcaagtcccctgggaggggccccaagcagctgtgaggcctgggtgctcggagcccactgaccgctagccttgtgcttgtccccagcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcataggtaagggggcccggatgggctgagcaggaaggtcggggcggcagggggcgggggtggagggcgtgtgctccccgaggcagagggctggtggcaggcaagcaaccctgttgtcacatccctgcaggaggccagaagcagatttgagaaggcgtctcatcctgagtaggaaaagatcagttctttgagcccttcagtaaaacctcgtggctggtgacttgctgttgattccagttcctgctggaaggcaggtcctgccttgcactggcccacgttgtctcagactcagccactctgccctaccctgcagccctggctacaggaggcctcctgtgacctgcaggtggctgccctgtacccatgggagggatcagctcactgaatgtggagtctctctgactcaccctgcacagcccaggaagccagattagggcggaaaaaggtattcagagtttgctgaggctagtggtggtcaggctgtgtgggaactctggagggggttgcagagtcactatcatggtgagatcatcagaatgtatggcctgtggtacggataagaacactactgttttaaataagctgacacggtgccggctctctgggccctgcagcctccggcgggtctctgtgctgacaaagctaccactgactgggcctgggtggaaggtgggtggtcaaggtggaaggccaccaataaaccacccctcagtgtatttttcaagaacttttttttttttttttttacatttaggaaactgataccagaatactgttgctgagctcagttctatggcttcaggaaacatttcaatttctctacttttatttttcttaacttaaaattttactcaatttggggtcctgggttcctggtgagctttctcgggggacactgcagggttgggttgtggggtgaccctctcagcccccaaacccaccccacaccacatcacccagaagccgtcctcagagcacgtgagtgccgcctacagctggagggcctgcctcagaagccagtcagtgccttggggctcttgggctggcgttccccgtgccagcctcacgtctcagtggcatcgccaacctcacagtgctcctgcagactgggtgttgtgtctcccacagatgcggagaagggaggcagcctggtggtgggggacttcgagatcgcagccaagtacggtgagtgatgctgcaggggccatctcagcaggggcaggcgccccgtgatgctcgtgacgcaggcgctggccctgactctcctgggtgtagcccctcctaaacaatggccacaggcaggggcctcggccccagctgagaaaggaccaccgtccttgtcccaccctcatggggtcgtgaggaactgggtccctcgattccacttcctcagatgccattttactgctactagggtaaccccaagagtgatttcccctgggatgtcccagtaagttcatgattgtcacacaacccttaagaagccaaggccctacagaatggagcctgggatgtggggtggagggctgtccccggggtcgcaggtgaccagcccagcagaccctgtgccacacactatgcctctccactgtctccttcacgcctggcccagcagccaagccttggtgaacatgtcctgctcttggttgcccttcccaatgtgtgggtccaaagagctcaaatttgtacatctttccagaaaaagtactacccttcccctcccccaaaagtggcttttttaaagcttttgtgtcattttcccatttgtgcccatggacactgggtatccacaactacagcaggaaaaggctttgagcagaatcccaggacagctcttggtggatttgtccttcctcaagagcaggagtggattgttctgagctggctttggtgttttctttccccagaaagcttaggttttatgcagcttgacacctgggagaggtgtccagggtcttagatgtagaaatgtggcttgggagacattggcccatgaccctaacaccaggcgtgcaaatccccttggagcccagacccagtggcagccggggttgccgcccacctgcctgtgctgtgcactgggtgccttctgcgctcagctgcggccttgtctgtgaatccggagtgcggagccagcgggtgcctgtagtgggtggaattggggtctgcacttgcccctccgcccccaggtgggagtcacctggagcgtgaagggacgtgtctcatccccagtgtgtcggaccctggagacacagccgcagagcagccccttctcatgcatggacctcacctacgtcagcctgctactccaggagttcggctttcccaggagcaaagtgctgaaggtaagggtgccctcaggtcacgccccagcccctttatggagtgaggggcctagaaccacttctccagttgctggggtcatgtcccccagcccatccctggcttccaaggagccacagcctcctgatgcacaaggctttcctgtctgtgtgatggtcccctctccctctctgtcttttcaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcaagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacaggggcttctccttc

SEQ ID NO: 35956 - DNA, 9504 bp, Homo sapiens
aagaaggaggccgcgcgagggctgacgaaccggaagaagaggaactgggcctgaaagggtaccggtgaccgctactgctgccggtgtttgcgtgtggcagggagccaggcctggcgagcggggtgtgtcgcgatgccggagctggcagtgcagaaggtggtggtccaccccctggtgctgctcagtgtggtggatcatttcaaccggtgagcgagcgccctatagctgggccggcggcgcagccgctgctgagtcacgggcacgctggagatggcgcggcggccgcggacgagctggggacgcagatagggcggctggtgacccttacttgttcacgagtccagaccagcgtcggctcacgatgccggagtcatccagcctcccgcccctgccccagccgccgccacttcggggccttggctgcctgttccgtttagcctgtttgttttacagagttccctttccgagttcgttttgccgaagttcgttttaccgaaatctggatgatgctgggggtcgggagatgcggctagctttagttggccctgacccccgcccccaagctcgtgtctgtcacttcgttttgaagttcgttttgccgaaatctggataaagccagggtggggcggaggcgggctagcttcatttggctctgacccccgaccccagggtcgtatcttcatttgactcagttgatttcactgaaatgtgaataatgcaaagtgactgatgtctggatgatgcttgggtggggcggagtgggctagctccatttagccccgccccaaggctatgtttatcttcgtttgaccgaattggtttcaccgaaatatggatgatgctggagtggggtgcagggtggctaccttcatttggccctgaccccggccccagggtcgtatttatgtttatcctcgtttaaccaagttgatttcaccgaaatgtgaatgatgcaaagtgaatgatgcctggatgatgccggagtggggctaagggggctagcttcaatttggccctgacccccgcccccagggtcgtatctatgtttgtcttcatttgaccgagttcctgttatcgaaatctggatgatgctcagcaccccgaagggcttcctggatcagctgtggttttaacccattaacatttttaaatgggaatctgattagactccgtctcaaaaaaaaaaatgtatatatagatgaggtttcagtttttatttaaaacacgaggccgagcatggtggctcacgcctgtaatcccagcattttgggaggctgagacgggaggatcgcttgagcccaggagttcgaagctgtcgtgagctgagatcatgccactgcactccagcctgggtgagagtgagaccctgtctccaaaaaaaaaaaaaaaaaaaagaccagttggagatttgaaccttaatgaataaggtaaggaaacatctcaaaggtcatctagtaagctcattgtttgagggtgtacatccaccacctcttggctttggagttgttcatcctgctagacctgttgcacatgtttctaagttttacaagattgttagttgaattggcaaatgtaaagacccagttcagagcatctgctataaagccattcttgcaaagtgtccattctcccgcaacttgctgtgtgcaactaattcagctggatccggaaaaggaccctcagcctaggatatgttggcttttctacaggagaggaattactatttttctcccatgggatactaggggcaggcactatttcagtgctattcaagcacttgttaagagcactagctttcaggctagcctggtagcacatgcctataatcctagcactttcggagaccgaggtgggcggattgcttgagcttaggagttcaagaccagcctgggccacatggtgaaaccccttctctaccaaaaaaaaaacaaaaaaacaaaaattagccaggtgtggtggtgtgtgcctggagtctcagctactcgggaggctgaagtgagaagatcacttgaatctgagaggtagaggctgcagtgagcgaagatcacaccactggactccagcctgggcaacagagtgagaccctgtctcaaaaacaaagaagagcactagcttctctatcaagtaagtgtagggttttaaaaaacacaaatggactttggtagaccaaaacaaaagcccacgagtatggaagtttcccttgaagttggaaattcaatttcccccttacccccccacccccaaaaatgagaggcaccagaaatacagaatcattaactttgtttgattcaaaccccaaacctagtaaccatttatagatttgccaactatatgctaagaaaaatactacagttaaaccaatgtgaaactagcagctgttaagaaaatgtaattaacagtggcttttgtctttccttagcatagggttgtatttctgtgtcacacatttgctagtggttaaaaaatacttcttgaagaccaaggaaatgagagtgtgtaagtgatgcacttgtaactccttaggagaaaatgactgaggaggtttgaaatggagataaaaattctcaagtaaaatctttctcattcagtcctcctctattcattcatttattttgagacagggtctgccgaggctggggtgcagtagcacaatctcagctcactgtagctagcctcaaactcgaccttctgagctcaagtagtccctgcacctcagtcccccagccccaagtagctgagactacaggcacatccccactatgcccggctaagttttgtattttttgtagacagggtttcgccatgttgcccacgctgcccatgctcgtctcaaactcctgagctcaagtgatctgcccacctcagcctctcgaagtgctgggattacaggcatgagccactgcatccggcctactccatcatctttattccaaaaaagatttcaggatgggaaaagtttaaaggtgaaggaaagctgcaaagaaaaagtaaagttaaatgtggtagcaaagcttaaatgtgttttcagactaagatctgggaagctttcattttcttcattttaaatttctgtgaagtttgaaattttcccaagcatgtattacttcacagtcaatgttaggtaaaaactgccagtgggtgtcagtaccaagtttatgaattaccccttatagttaatatcaacctaaccctattacattggtttagggagattagttcccaggtaaactaaattgtatctgtgccattgatatttcccattgagtatcttattgttgggttcatgtttctgtgcgagcctatccacactgaccatctgttttctcattcagaatcggcaaggttggaaaccagaagcgtgttgttggtgtgcttttggggtcatggcaaaagaaagtacttgatgtatcgaacagttttgcaggtaaaagacaaattttatgtttttccgagcatgattaaaatgtcagtttaccctttaaaaatataaacctttgttaccgcttttgactacaacccagagattgtcttaaaattgctgaagtatagaaaagagaacctgaagattgcacactagaccagacagtaaatattttaaacttgcaggccatgtggtctccactgcacctgctcctctctgccattatagtgcaagagctgctatagacaacatgtaaacaaacaaaagtggcagtattccagcaaacctctataaaaacaggcagctggcacagtttgtcagcccctgcactaaactgtttaaccacgcttcttataggtacagtaaggagagagatggggaactttacccctttatgtgaatccttacaagaacgtacccatgtattactttaatgattaaaggaacaacaataaagaagatgatactggatgacctctggagtagagatcactaactctagtgtctaaaatgaccagctagtcatgtcatttgccaaattgaaaaatatcaggaagtaactggacttctagaaaactgaaaagcatgtgtcttttttaaagggggcagcccctacctggctgtagctggtagttgccaggtattccagttttttaagagaagctggaagtctggatttttatgtgaattctcccagtttttggggcagctcaaaaaaaattttttaatactttgctgggcaagtgaaacacgtaagtgaatcagaactggcctaggggtcttcaattgtgacctgtgttctaggtttctatcaagcaccctaaactaactttttttttcctctttagttccttttgatgaagatgacaaagacgattctgtatggtttttagaccatgattatttggaaaacatgtatggaatgtttaagaaagtcaatggtatgtcttgatgttctaaggtgttacagcatagaattgaactgtgtgtatgggggtcttctgttcgcttttctttaacatcaagggccctttcacttagctacacttcagtaagactagtggtagtagaggaataaggtagaatacatgaaaaactagagtagcaatttaaggccaaataggcgacctgggtttgggtacaaggggaaataacctctcattgcggcagaaaagtgaagaactatccagtaaagtcagtcttccattagagttttagtaccaccagggtaaatatgtctggaattttcaaagaggtaaaggacataactactgatgttcttatcctttttgagggagttgtatagatcttcatgaaatagttaaagcctgctaatttttttccttcctagccagggaaagaatagttggctggtaccacacaggccctaaactacacaagaatgacattgccatcaacgaactcatgaaaagatactgtcctaattccgtaagtggtgtctatttttaaaactcttgaatgattttttttgccagccagctcaagtaagagcatcctgggaagaatttgagtagcaaatctgcttactgctttatctccataaacttctgttgatttgtagtgctctgtgaagtatactgtgacctaatatatttgataaataatagtttatacctgctaagtaccaggtgtatgagtttcgtaatcctctcggtaactgtatatcctctttacaaatgagaaaactgaggttcagaatggttaggaaggtctggtaaggggtgggactgggattgaaattttggctgtgttgactctaatgtccttgtgctaggcactgtactgcccctcagcttattaatgaaggggatcgaaaagcagaagaaatgatgagatcatttgaagcataaatgcatttttgctgaatattctggttcatttctaattgattacaagaaatagctttagtaattgtgagaagaatgcctgaaattaccccttttgtgctgggcgtgagatgacttgctaagatgtgtttctctgccaggtattggtcatcattgatgtgaagccgaaggacctagggctgcctacagaagcgtacatttcagtggaagaagtccatgatgtaagtcatcttgctatgaacctgggaggttagactgctacttattgggtgattagcttttttttttcaattttcaggtcaacaaatcctttgtctccgtaacaaaagaaggtagtttttttccctttgacttttttaatcaccacattttggaaatggagaggaacatagaaatctaaattccaaccaggcacagtggctcacccagtgctttgagaggccgaggtgggaggattgcctaagcctaggagttgaagaccagcctgggcaacatagcaagacacctacaaaaataaaaacattagccaggcatgatggtccatgcctgtattccaagctactcaggaggctgagacgggaatattgtttgagcccaggagttcaaggttacagtgagcaatgatcacaccactgcattccaacctgtgcgacagttgagacgctgtcccccaaaaaaccaagaaatccaaattccccttttacaaatgaaaagtttaagggatgaattacggtctccttttgaatttagatatgcagtatttatccttactttcagttttaagatttagaaaagggtattttaggatagctctgtgcaaatgttccttgcatcgagctctgtcttcctggggcttttctctttgcctggctaccagggagcttagagccaaatgtattgcctaattgcagtagggctttcatccctggttttgacccagttgtttttagtgaatttttctcctgcctctttagaaaaggaattgaggttgctcgtacacatgcaccccagtgaagcaaggtgtttttagtaggggataaaggggacatatgggtcatgttacaaggtgaagctcaagaagaattagtgcctgtaaaggttaccaagaaatcccacaacactgttaaaggttctgaccatcctggcatccaaagcaaagaggagaatgccccttgcaggattaacactatcctaaataaaataatcacggctaacttttatagtacttagtgtgagttgagtgactttcccaaggtcttggagctcgcctattacatacatggcagagccaaatttgaacccaggtagcctggctgtggagcctgtactcttaccactatgctgtccttcctcccttacagacagtttacagccttttgacaggagacgtacagcctcttctggcacaaggtctgagaaaagtatcttcgaagtcccttcaggatgtcactgggtgaccaccatgaaccatgtccccaatggatcctttgattaattcagaccaccagaaagccaactattctgattgcattggtttgggcactgtggaatcgtttgatccaagagacaaaaaagggctaaaagttttattttctggcatgaacttgcttcagtacagatattctgtatattgtccattctagaaagaactatatactttttttttttttaagacaatctcactctgttgctcaggttggagtgcagtggcgtgatctcgactcactgcaccctccacctcccaggttcaagtgattctcgttcctcagcctccagagtagctgggattacaggcgcccgccaccacacctggctagtttttgtatttttagtagagaggggttttcgccatgttgcccaggctggtctcgaattcttggcgtaccaaagtgctgagattacaggtccgtgcctggccaaagcggtatacttttaagaatcaacctgagacctccctgtgcgttcatgccaagtgtgggcttgagggaatttccagatttttctcaacgcacagtgccccagcagactgcatcactgagcagcaccacagtgatgttagctttgaaggctaagctttcaaagtaagccttacccacccttgccatagaaaattctcagtcatgcactcattaaatgagctgacttaaagcaaaagactcagggtgcgaaaaggaacacatgtcagttcgtttgtggaaaataaataattatagttaggcttcctctcccaggatggaactccaacctcgaaaacatttgaacacgtgaccagtgaaattggagcagaggaagctgaggaagttggagttgaacacttgttacggtgagaccctagtacagcatcaaaatcattcactgcccgagaggtcacacagtgtaaggaagaggtctgtgtcgggaatatggagacctggggtctcgtcctggccgtccactaacaagtctgccattctgagcaaatcacagtccctttccagacctttgttttattgtctgtaaattgaagtgtttgaactacatcaactgtaaaatgtcttgagttacaatttatgactttgtggatagcataccttgtctggaaactataatgttgactgacgggaagagaggtatgaaataaatgcaggcctgcactctccactaggtgtccttctcaacaaatgtagcccattttctggagagaatcttcatcttggagtagcttttgttttaaaatcctatatctattataatccttatttgaaaaaggttatagttttatcagtcaatgaggttccttctagttctaaaaattaccatcttagttaagcttctcaatattctggagatgcatgtagagaaaatgccatccttttaggaacaggaaagctgagagagacagcttcagtacaaggttacccagaaagttattggtagatctgaactgttgacctaagcaatttttttttccttaagtggaaatggttttattttagctcccttttataattgttttttgaaaaatgtcctgtgatgagaaagataaaatgtgttccaaatgataacgaaattaaggtaattgataacgaaatctttatcaaatggggaagtgacatttttcttttaaaaacttgcctcacccaacaaagctaggaattttcttagaatgtaagaacttgcctgataacatggtaccctgatgccttttcctgccctttttaactgtgggttattacagagatatcaaagacacgacggtgggcactctgtcccagcggatcacaaaccaggtccatggtttgaagggactgaactccaagcttctggatatcaggagctacctggaaaaagtcgccacaggcaagctgcccatcaaccaccagatcatctaccagctgcaggacgtcttcaacctgctgccagatgtcagcctgcaggagttcgtcaaggccttttacctgaagaccaatgaccagatggtggtagtgtacttggcctcgctgatccgttccgtggtcgccctgcacaacctcatcaacaacaagattgccaaccgggatgcagagaagaaagaagggcaggagaaagaagagagcaaaaaggataggaaagaggacaaggagaaagataaagataaggaaaagagtgatgtaaagaaagaggagaaaaaggagaaaaagtaaaacatgtattaaatagcttttttaatttgtaaattaaaatcttacaaactaaatcagtgtgctgctagagggttctttttcacttgacatgcttattagaaagctgacccaacaagagctctctgcctccggtcactcttgctgtggtgctacgtggaagtgaatggagactgatctcaaatctgaactgcagctttcgctgctgtgagttggggatatgatagtcagctcaggcttcagattgtatgagaaaaatgaagagaagtcaacaaatattttggtactcttcattcatttatctctaaaaccaggagttgaattttcctcatcttgaaagactcttggggtctgtttctggtattttacaaaattgctaagtggaatgcatgaattgcattatgttctctggtaacacgtagagttcagacccttctgaactctgttgataataccacaccatgttctggacccatagctctggcatcctcaggggttgtgatccagctccatatattgtttaccttcaaagatacaattaaatggcttgattttt

SEQ ID NO: 35957 - DNA, 26527 bp, Homo sapiens
ccacgctcccattttaccgaggtggatcctgaggcccagagtgggcaaagggcttgccaaggtcgcagagcgcgcagaggattagaaccctgacttccgtccagcacctgcggagttggagacgcccacaggaaacgcccacctgaccgggtgagtgagggggcgggcgagccggaggggtggagtttattcgcgccccgcctccgccaccagggcttgggggcggggccttcctgcaacctttgcggctccaacatggctccgcggctgtgcagcatctctgtgacggcgcggcggctgctggggggcccggggcctcgcgctggggacgttgcgtctgcagctgcggcgcggtgagagcccggccaggcagggatagacgcgcgcggggtggggtgcaggcgcgggggccagggactgggtcgtgggggaggggctgagactcctcgcttggaatctgggggttagaggcggggcaggatcaaggcctagggaggggtctgggcaaagaatgggggaggtgagaaagggatgggtagggtctttgtcctggttgggaccgggctgtgatggggacctgatgaaagatggtgagaagggcaggtactgggccctggagagtgggagagggcagaagacaggaggagtggcccattcccaggcgtagcttgtgatttaacacccactgggggcttctggtagtcagctcctccgtcgggaagttctgtgggaaagagatgatggcaggggagcagtgggggatccccaggggccatggctgcacagaccctttgttcctccacctcgaactgtacaggtggggaaacggacctgagagggaatgggagttgtccaaggtcaccctccctgctgtgccgtggcagcaccaggtctgggacccaggcctgccaatgcgccatgcactttgcacccaactggtggcctcctgggagtgggagtctggctgggccatgtgctctcagcctgggcttttgtttgggccctgctctgggctgagctagggcttggcctccctgactggccctgggcagcccctcactccttggtccccacagccctgtacttcccccatctctgcatatatgaccctgcacagttatgacttggtgcttgtctgtctctctcactagaccatgatctcatttttctctgtttccccagcctcccaccctcagagggctcaggactgtgtatggtcaaggaatatttaccaaagaagtgaggccacctgttccccctcccccaacctgtgaaaaggaagcaaccatccctcctgccctgcagcccaggaatgaagctgcaaagttctgatagtgcctgccatgagatgttacagcacagagcagtggggcttttggacagctgggaaagaggagtggcataagcgccccacctagactgcccaataattagggataaagctgacaccgtgggaaaagcctagagtttgcctggcactaacagatctaactcagactttgtaggtggggtgacctcaggactctttaagcctcgggttcctcatctgtaaaatgggagtaatcaggatgtatctcatagggttgttgaggattaaagatgctgtggttggtcgggtatggtggctcatgcctgtaatcccagcactttgggaggccgaggcaggcagatcacttgaggtcagcagttcaagaccagcttggcaacacggcgagatcctgtctctataaaaagtacaaaaatggccgggcgcggtggctcacgcctgtaatcccagcactttgggaggccgaggcggtggatcacgaggtcaggagatcgagaccatcctggctaacacggtgaaaccccatctctactaaaaatacaaaaaattagctgggcgcggtggcaggcgcctgtagtcccagctactcaggaggctgaggcaggagaatggcgtgaacccaggaggcggagcttgcagtgagccgagatcctgccactgcactccagcctgggcgacaagagtgagactctgtctcaaaaaaaaaaaaaaaaaaaaaaaagtacaaaaatttcaccatgttggtgaaaacgtgtctctactaaaaatacaattagctgggtgtgatggctcacccctgtaatcccagctactaggaagctgaggcaggagaatcaattgaacccgggagacagaggttgcagtgagccgagatcacgctactgcactccaacccgggtgacagagcgagactccgtctacaaaaaaaaaagattccgtggttgtgaagtgtctagcacttgacgaacatgcagtaagtgttgctccttaacccctagcctatgtttcaagcaatttctgcatgtgacccacataatgttgaggctcaaagggctctgggaagatcatcttttatgagccctttgttttccagataaaaatatcaagattggggaagggacagaatggattggtggtaaaaccatttgtgtggcaaacacccagaggctgtaaaaggagcatgggtctcagagtcagcctgctgcccctcactcagtgaccctggatgagttgctgaacctccgtcagcctcagtttccttttctgtaaagtggggatgttggtgttttcggcaggattgctatgaagccacttgaattaatgtttatcaagtccctcaaggactgtcttgcagttacttataccttaattccacattggatacctgagaacactctgtcctgctgcccctcaggctgccccatatctctccagagtcactagtagggccagcagcagcccttctggcctgtgaggtttgggggcaatgaggctgctggggtggggatggagtgtgggctttgaaatcagatggacctgggccaggcaccattgctcacgcctgtaatcccaacacttcggtaggccaaggtgggaggattgcttgaacccaggagtttgagaccagcctgggcaacatggcgagatcctgtctctataaaaaatacaaaaatttggccaggcacagtgggtcatgcctgtaatcccagcactttaggaggctgaggcgggtggatcacctgaggccaggagttcaagaccagcttggccaacatggtgaaaccccatctctactaaaaacacaaaaattagccaggccaggcctggtgactcccacctgtaatcctagcactttgggaggcccaggcaggcggatcatgaggtcaggtattcaagaccagcctggccaacatggtgaaaccccgtctttattaaaaatacaaaaattagctgggcatggtgtgtgcgcctgtaatcccagctactctggaggctgaggcaggagaatcgcttaaaccagggaggtggaggttgcagtgagctgagatcgcaccagtgcactccagcctgggtgatagagcaagactctgtctcaaaaaaaaaaaaaaaaaaaaattaggcatggtggtgtgttcctgtattcccagctattctggaggctgaggcaggagaatcgcttgaactggggagctggaggttgcagtgagccaagatcgcgccactgcactccagcctgggcaacagagggagactccgtatcaaaaaaacaaaacaaaacaaaacaaaacaaaaaaacatgccgggtgcgttggctcacacctgtaatcccagcactttgggaggccgaggcgggcagatcacctgaggtcaggagttcgacctggccaacgtggtgaaaccctgtctctactaaaaatacaaaaattagttgggcgtggtggcagatgcctgtaatcccagctacttgggagactgagacaggagaatcacttgaacccagggggcggaggttgcagtgagctgagatcgtaccattgcactccagcctggggaacaagagcgagacttcgtctcaagaaaaaaaaaaaaaattagccaggcatggtgacacatgtctatagtcccaactactccggaggctgaggcaggagaatcccttgaacctgggaggtggaagttgcagtgagccgagatcgtgccattgcactccagcctgggcaacagagtaagactccatctcaaacaacaacaaaaattagccagacgtggtggtgctcacctgtggtctcagctacttgggaggctgaagtgggaggatcatttgagtctgggagatagaggatgcagtgagccatgattgtgtcactgcactccagcctgggtgacagagtgagaccctgtctcgaaaaaagaaaaaaaaaatagaagaaaaaagaaagatgaagctgagctaggatcaaaacctggatttgtccagagcttgtgctcataagcactagttctgctgttggtgttaaggatggaaaggacccctgatccctgagtgaagtcactctgggtcaaggtctacctttttttttttttttgagacggagtctcattctgtcagccaggctggagtgcagtggcgcgatttcggctcactgcaacctctgccctctgagttcaagcgattctcctgcctcagcctcccaagtagctgggattacaggcgcctgccaccgcacccagctaattttttgtatttttagtacagacggggtttcaccatcttggccaggctggtcttgaactcctgaccttgtgatccacccgcctcggcttcccaaagtgctgggattacaggcgtgagccaccacgcccagcctaaggtctaccatttcttttgtttcatacttttcagctttcatcattttcatgcaagaatgtcttagctcctctttcattcatttctcaaacttggactgcattctcaccatgtgcccagcactgctccaagcataggggatacagcagggatacaacagaacagacaaggattctgccccgctagggctgcctccagtttagagactgacaataaacaaagcacataataagccaaaaagtatagtgtttttttttgtttttaatttttagtagagatgaggtcttgctatgtttcccaggctggtctcaaactcctgggttcggccgggcatggtggatcatgcctgtaatcccatcactttgggaggccaagtcaggcagatcacttgaggtcaggagttcgagaccagcctgaccaacatggtgaaaccccgtctctactaaaacatacaaaaattagccgggtgtggtagcacgcacctgtagtcccagctactcgggaggctgaggcaagagaatcgcttgaacccaggaggtggaggttgcagtgagctgagattacgccactgcactccagcctgggcaacagagtgaaactccatctcaaaaaaatacaaaaaaaaaaaaaggccaagtgtggtagctcatgtctgtaatcccagcactttgggaggctgaggcaggaggatcacctgaggtcaagagttcgagaccagcctggctaacatggtgaaaacccatctctactaaaaataaaaaattagctggatgtggtggcacatgcctgtagtcccagctacttgagaggctgaggctggagaattgcttgaacctgggaggcggaggttgcagtgagcccagatcacgccactgcactacagcctggacgacagactgagactccatctcaaacaaaacaaaaaaaaaaaaacaactcctgggttcaagcaatccttccctcttgcgtcagcctcccaaagtgctgggattataggcatgagccactgggctaatcctagtatagcgttttagaacgtgctctggaacaagatagagagcaggaagagagggcttggggaggtcaagggtaggagaacattgtaatttcactgagaaagtgacatttgtactcttgcagatgtacccttggggatgctggcttggagttcaaaccctcctctgagatctttgacaagctccttcttggattttacctgtagaaaacagctttagggatgggctccaccaccctgctcatttgacagatggggaaactgaggcccacaggcaggaaggattagagtagtgggaagagacgggagcccatcagagctcctgaagtttccagtgttccagcccctaatctctttcttcagggctggctatttgactgatatttatcttggtcagtgctgatgttaataaattactctgtctagtcctttctagagcaaaggtcttggttgataaatagtaggagctgctctcctcactgcccatctccctccaggggaagcagcccctctacattaaaaccaaaggtcaggtccctcagtgcccaacctgaggtggggattggctttcaaggaaagagcgctgggttcttaactctgccctctgattttctgtgcggccttgggcaagtcccttaaactctctgggcttctttccattttatcctcgcgagaatgggaatactaatagtaccaatactataagatcattgcatagaatcagtgagatcctgcaactgaaaagtacatcacagatccctggcttagagcctcccttattctggtccaaaaacttcacagaccgcactacccatctaatgataattgtctttttttttttttttttttgagacagagtttcgctcttgtagcccagtctggagtgcaatggcacgatctcagctcactgcaacctccgcctcccgggttcaagtgattctcctgcctcagcctcccgagtagctgggattacaggattgcaccaccatgcccagctaatttttgtatttttagtagagactgagtttcaccatgttggccaggctagcctcaaactcctgacctcaggcaatccgcccgcctcggcctcccaaagtgctgggattacaggcatgagccaccgcaccaggctgataattgtctttttgctaatgaagcagatgcatgtacaatgatcgagagagttcatgaattcagaaatgcttaacacactttaaaatctttataaaaaattacaatgaataaagaaaaatttagccatctcctattcctctttcccaggtaagcagtattaacagtttgggacaagtaatttattttcttttctttttctttctttttttttttttttttttttttttttttttgtgaagatggagtctcactctgtcatccaggctggcgtgcagtggcgtgatcttggctcactgcagcctccgcctcctggattcaagcagttctgcctcagtctctcgagtagctgggactacaggcacacatcaccactcctggctaatattttgtatctttttttaagtggaaatggggttttgccatgttgcccaggctagtcgtgaactcctgagctccagcaatctgcccgcctcagcctcccaaaatgctaggattacaggcatgagccaccatgcccagcctctttttttgttttgttttgttttgttttgttttttgagacagggtctgctctgttgcccaggctggagtgcagtggcccgatctcagcttgctgcaacctacgcctcctgggttcaagcgatcttcccacctcagcctcctgagtagctgggactacaggcgcacttgacactcgaccacacctggctaattttttttttttttgagacagagtttcactcttgttgcccaggctggagtgcaatggcctgatctcggcttactacaacctccacctcctgggttcaagcaattctcctgccccagcctcctgagtagctgggattacaggcatgcaccaccacgcctggctaattttgtatttttagtagagatggggtttctccatgttggtcaggctggtctcaaactcccgacctcaggtaatccacccgccttggcctcctaaagtgttgggattacaggcgtgagccaccgtacccagcaatttttttatttattgcagagacagggcttcagactcctgagctcaagtgatccgcctgcctcggcctcccagagtgctggaattataggcgtgagccaccatgcccggcccatttctcatttttatgcttatacaaacatatcaccactttggcccagcgcagtggctcatgcttgtaatcctagcactttgagaggccgaggcaggtggatcatgaggtcgagagatcgagaccatcctggccaacatagtaaaaccccgtctctactaaaaatacaaaaattagctgggcgtggtggcacacgtctgtagtcccagctacttgggaggctgaggcaggagaatcacttgaacccgggaggtggaggttgcagtgagtggagatcataccactttactccagcctggcgacagagcaagactccatctcaaatacaaacaaatgaacaaaacaaaacaaacatatcaccactttaagattatttttaaaaagaaattttttttttttttgagacatggtctctgtcacccaggctggagtgcagtggcctgatcatagttcattgtagccttgatttcctgggcttcatgcgatcctcctaagtctctcaagtggctgagactacaggcatgtgtcaccacacccggctaattattgtattttattttattttattttatttttttgagatagagtctcactctgttgcccaagctggagtacagtggcaagatcttggctcactgcagcctcaacctcccaggctcaagtgatcctaccacctcagcctcccaagtagtgggactacaggcacataccgtcatgcccagctaattttattttttgtagagacacggtctcacaagtttccccaggcttgtctcatggcctcaagcaatcctcctgcctcagcctcccaaagtgctgggattacaggcataagccagtcatatttattattttttttgtagagatggagtctcattttgttgcccaggctgatcttgaactcctgggctcaagtgatcctctgacctcagcctcccaaagtactgggattacaggcatttagccatcgtgcccagctgattttatccgtcccaatggctgctccatattttggaaaaaattgattgattttttatttgcaagacatttgtccttttttttttttttttttttgagatggattctcgctctgttgcccaggcgggagtgtgatggtgcgatcttggctcactgcaacctctgcctctcaggttcaagcaattctcctgcctcatgctcctgagtagctgggattacaggtgcacaccaccacgcctggctgatttttgtatttttagtagagacagggtttcgccatgctgggcaggctggtctcgaactcctgacctcaggtgatctgcctgccttggcctcccaaagtgctgggattgcaggcgtgagccatcacacccagcctaagacatttgtctaaccacataaaagtcttaaaaagggatagggcagccgagtatttgtattgtaaaaatacgaaaattacctggatgtggtggtacgcgcctgtaatctcagctactcaggaggctgaggcaggaaaattgcttgaacccgggaggccgaggttgcagtgagccgagatcgcaccactgcactccagcctgagcaacaagagcaagactctgtctcaaaaaaaaagaaaagaaaaaaagaaaagaaaggatagggcttcctgtgacctcacttggaaaaaacaaaagagaaaaaagaaaaaagggataaggcttgctgccactcagggatccctcttgccaggctccctggctaggaattgtctccattgggagacttccttttcaggcctggctgcaagctgcaccaaggctgtggagcgggaagattggtagtctcaaaataagcacccctgcctcctgctgggaccttgggtatgtgtttaggatgggagtgcagttctggtccagtaggagctggcagcagaccctccactgcccttaaccacagtgctcatgggcaaagcacataatcatattcattgatcattcattcattcattctcagtatcctatggagatgggcagagcaggtgttggctggatgagtgaatgcatcttgctttgcagtgccttttactccctctatctgccaaaccagtcctggggactgaccagctcatctcctcctctgtagagagtctgcccaggttgccagaagcagagttaaggctagttcacctgggctcttccagagacccctcctataattgtgtcccaaggcccatttctcctagtggactatgagctcctcaaggacaaagcttatttgtatttggctttccatgtgtggggtcagggtggggacatgggccaagtgcactgtgagagtgctggggaggacggtgagagcagtcttctcgttagaggggacagaacttgtacagaaagcacagagtagcagatcctggtgtgttcagggaagagcacacctggagagtgaggtgtacaggtgagggggcaggaggggaggctgacaagttaggttgggttgtcaagggctttgggcatgatgcaaggtggatttggggttgatcctcttggcgagaggctggagttatatgacccaagtagaggacctcttggaagggggatgaagtggaggcagggaggctagagagagaagtgggaggtggggctgcctctcctggcgtcctgaggctctgcaaagcttcaagaagccaactgggcagctggaatatctgtagaaaggagctggctccaatagcatttcacagtctggagctgccacaggactccgtggccctgttcccagaaatgtgggtcactggtctaggggagcaggacatccaagtggatggaattgctggggctcccccaacctccgcgcgtccccctcaactcctctgtcctgcagtttctattccaaggacaatgaaggcagctggttccgctccctctttgttcacaaagtggatccccggaaggatgcccactccaccctgctgtccaagaaggaaaccagcaacctctataagatccagtgtgagtggctgctgagctgaccaatttctgccctttcaggggctctgggggcctgtgaggctccaggaaggagatgggagggtctggaatgtcctcagctgtcctgggacccctggccttgatgggctcccctcaccccaagttcttccctgtgtacacaccctacctcacttcttgttctctgtcctctgttgcagttcacaatgtaaagcctgaatacctggatgcctacaacagcctcacgtgagcaccctgcatccatacatcccatcccctgcttgggtggggaacacactttcagcaaatttgcggaacatcctccaccctgttcttttctgtagaaatccaggagatgtagatttcttttatttctgcctttttctttctttctttctttctctctttctttttttttgagatggagttttgctctcgttgcccaggctggagtgcaatggcgcgatctcggctcactgcaacctctgcctcccaggtacaagcgattctcctgttccagcctcccaagtagctcggattacaggcatgcgccgctaagcatggctaatttttttgtatttagtagagacagggtttcaccatgttagtccggctggtcgcaaactcctgacctcaggtgatccacctgcctcggcctccgagtgctgggattacaggcatgtgccactgcgtttggccccattttctttctttcttttttttttttttaagagatggtctccaggaggcggaggttccagtgagccgagattgcgccattgcactccagcctgggcaacaagagcaaaactctgtctcacacacaaaaaagagagatgggatctcactttgcttcccaggctggtctcaaactactgggctcaagcaatcctcctgcctcagcctcccagtgttgggattacaggtgtgagccactgtgcccagccaggatgtaaatttcagtgtcggaagtcctgagggcctcttgcctagcttctgcattttagagatggagagtctgaggcccagccccagggtctgtttgaactgagtttgaacccttatctcagaggccctggtggctatgtgaaccctgcccctctctgcacctcccccacagggaggctgtgctgcccaagcttcacctggatgaggactacccatgctcactcgtgggcaactggaacacgtggtatggggagcaggaccaggcaggtaaggcgctcacctccctagtgccattgccactgcccagccctggcctccagcacctttcacacctggctgttctccactccctctccacaacagcacctggtggggctcttactaaaacctcatcacctcactcccctgctcaaatacctgtcctggctcccctgtgccctcaaggtgacccgtgaagcctgtgactccttcccggccctgcccccagcctcatggcaccaaatcctccatgcctcgctgtgctgtcccacccaggactcagttcctcagattgacagtttcactctttagttccagactactgctcattctctttcttctgccttaagcattatttcttgtttgcctgctttacctggatcactgtcttttattctttttttttccgagactgagtttcactcttgttgccccaggctggagtgcagtagtgcaatctcggctcactgcaacctccgcctccccagtttaagcaattctcttgtctcagcctcctgagtagctgggattacaggcatgtgccaccacgcccagctaattttgtatttttagtagagacgggatttcaccatgttggtcaggctggtcttgaactcctgatctcaggtgatccacctgcctcagcctcccaaagtgctgggattacaggtgtgagccaccgcacccggccttttttttttttttcttttttcttttttgagacagggtctcgctctgtcacccaggctggcagatagtggcacagtcttggctgactgcaacctccacctcctgagttgaagatattctcctgcctcagcttcccgagtagctgggattactggcctgtgccaccaggcctggctaattttgtatctttagtagagatggggtttcacatgttggtcaggctggtctcgaacttctgacctcaggtgatccacctgcctcggcctcccaaagtgctgggattacaggagtgagccaccactcccggccttttttttttttttttttttttttgagacagggtcttgctctgtcacacaggctggagtgcagtggcataatcttggctcactcgagcctcaatttcccaggctcaagcagtactcccacctcagcttcctgagtagctgggactataggtgcgctccaccatgctcggctaatttttgtgttttttggtagagacggggtttctccatgttgcccaggctggtcttgaattcctgaactcaaatgatcctacctcctcggcctcccaaagtgctaggattgtagacatgagccaccgtgcctggcctttcagttttattcatttttaaattttcatttatttatttatttttgaaaccaggtcttgttacccagtggggagtgcagtggtgtgatcacagctcacacagccttaacctcctgagcttaagcaatcctcctacctcagcctcctgagtagctgggaccacaggtgcatgccacaatgcccaactaatttattttaaattttttgtagagacgggatctccctatgttacccagggtggtctcaaactcccgggctcaagcgatccttccactttggcctcccaaagtgctgggagtacaggcatgagccacagtgcctggactattcacttttctattttggcatagatgtcacctcctcctggaaggctgccgagatttcctccacgcgggctgggtcaggcaccttccttagctctccaggcctcagtaattacctcctcacgccctgatcatgtacccctatagctgcctgtttagttgtctgtctccatatatgggtgaatccccaatatgcagcacatatttgtggaataaataggagttcttcttgtctgagctggtgtcttacagtcccaggggcacccctagcatgccccatcccagcctaatagacacatcaaagttggcaccagctataagaacccacacatgaatttggctgactcacagcatctcagccactcaaagggacctcaaattcagacccacactgtccaaaatgatagccactaaccacatgtagttatttatttatttatttttttgagatggagcctcgctctgtactgtcacccaggctggggtacagtggtgcaatcttggctcactgcaacctctgcctcctgggttcaagtgattctcctgcctcagcctcctgagtagctgaggttacaggcgtgtgccaccacacttggctaatttttgtatttttagtagaaacagggtttcaccatgttggtcaggctggtcttgaactcctgacctcatgatcctcccgcctgagcctcccaaagtgttgggattacaggcatcagccactgcgcctggcctatttatttatttttttgagacagcgtctcactctggtttcccaggctggactgcagtggtgcaatcacagctcactgcacccttgacctcccgggctcagatgattctctcacctcagcctcccaagtagctggaactacaggtgtgcaccaccacagccagctaattttttatatttttagtagagacagggtttcgctatgttgcccaggctggtcttgaactcctggactcaagcaatccgtcagccttggcctcctggactactgagattacaggtgtgagccactgcgccctggcctcacatgtagctattgaaatttatattagttaaaattacataaaatttaaagttcaagctgtgtgccaaggtgctcacctgtagtcctagctacttgggaggctgagttgggaggactgcttgagcccaggagttcgaggccgtgattgaataccatcacacctatgaatagccactgcactccagcctgggcaacacagtgaggaccctgtctctaaaaaagaaaaaattcaggactgaatatggtggcttatgcttataatcccagcagattaggaggctgaggtgggaggaacacttgaggccaggagtttgaaaccagcctgggcaacatagtgagactttgcttctataaagaaaatacatattaaaaaaaaaagaagaaaagattttaaaaagaaaaaattcagtttcttagtcatactagctacatttcaaatgctcactcatatacacacaggctcatgcagaaagtacttttggacagtactggtttagagtgtctgcatagcacagccataacagatggtcctctaaacttcccttgaacactcctagccatgaagagttcacttgtaagccaatctatttcatcctttgacagccctgataatcgtgtctttgaaaataatctgtgacctgcagatagataggtgtatctccttaatcaattatttggtttccgtaacagacattaacatattatttatgttttatttttattatttccatttagaaacagggtctcactatattgcccaggctggagttgaatttctgggctcgggcaatcctcctgagtagctgggactacaggcgtgtgccatcatacctggctagacactgatatgtggctaagggaataagagaaaagcaaattgccttcagtttcagccactacagctttcccattttaagcttgacttgatcagctccagcagtattccttgaattctcttaagcatttgctagttgtgaaatgaactctgagggatgggatcctgactttttcttttttttctttttcgagaccgagtctcactctgttgcccaggctggagtgcagtggcgtgatctcagctcactgcaacctctgcctcccggattcaagcaagttctcttgcctcaggctcccgagtagctgggactacaagtatgaaccaccatgcctggctaatttttgtatttttagtagagatggagtttcaccatcttggccaggctggtctcgaactcctgaccacagttgatccacctgcctcggcctcccaaagtgctgggattaaaggcgtgagccactgcccctggcctttttcttctttttatttttctgtttgggacagggtctcgctctgtcacccagtttggagtgcagtggcatgatcatagttcactgtaaccttgaactcctaggctcaggcgatcctctcacctcaacttctcgagtagctgggaccacagacatgcaccaccatgcctgggctagttgttttgttttgtttgtttgtttgttttgtagagatgaggtcttgctatgttgcccaggctgatctcagactcctgagctcaagtgctcctctcctgcctcagcctcccagagtgttgggattacaggcctgagccactgcgcctggctgatcctgactttttaaagcataccctacattttttgtaccttgaagttcagtccctcacatagtcagctgaatcatgttgagctgtacgctgggagtagggttcaagaatctacattttaataaacttgtaagaaccattgatccatctcctatggagagcaccacagttgttagacaattccttcttcttggctgggcgcggtggctcatgcctgtatcccagcactttgggaggctgaggcaggtgcatcacctgaggtcaggagttcaagaccagcctggctaacaaggtgaaaccctgtctctactaaaaatacaaaaattagctgggcgtggtggcatgcgcctgtaatcccagctacttgggaggcataggcaggacagtctcttaaatccaggaggtggatgttgcagtgagctgagatcacgccaccgcactccagcctgggtgacagaaaaataaagaaaattccttcctcttgccaatgatgctgtccttgtaacttttctccgttaatccgttttccacaggtcattcctggttttggtagatttctatccatacagtacttttgccatttcctttgggaaaaagacctttaaaccatagggtcaggccattttgcagatgggaaaatcaaggcacagatggagtcaaaaaacaggtgaaggtcaggctggggatggggatgggaagttacagagtctgagtttctagactgctggcagccagctgcccttagctctagcttgcctgtgtgatcccctggggaccttcctccgctgatgggcccagccatgctcccaggatggcaaaactgttcctttcttctcctccacaattaattaggtttctttgttactaggaattagattagtttcctggggtggccagcataccgcaaactgggtggcttaaaataacagaggtttatcctgtcacagttctggaggctggaagtcacaaatcaaggtgttgacagggctgtccttcctcctaaggccttaggggagaacccttccttgcctcttccagtttctggggattgctggaaactcttagtgttccttggcttgtagacttgtcattctaatctctgcctccctcgtcacatgctgttctctctgtgtgtctctgtcttcacatagtgttctcctgtgtccagatctcccacttctgataaggacactagtcactggactcagggctcacctagtataatctcatcttaggtcgattatacccacagagacctatttccaaataaggtcacattctgaggttctgggtgggcataaattttgaggggacattgttcaactcagtgcagataatatgatttttatttatttttatttttatttatttattttttgagacggagtcttgctcttttgcccaggctggagtgcagtggtgcgatctcagctcaccacaacctttgcatcccaggttgaagcgattctcttgcctcagcctcctgagtagctaggattacagatgtgcatcaccacgcccagctaatttttgttttagtagagatggggtttcgccaagttggtgaggctggtctcaaatttccgacttcagatgatccacctgcctcagcctcccaaagttgattatttatttacttgagacggagtctcaccctgccacccaggctggagtacactggcacaatcttgactcactgcaacctctacctcctgggttcaagcgattctcctgcctcagcctcccgagtaactgggattataggcatgtgccaccacacccaactaattttttttttttttttttaagatggagtctcgctctgttgtccaggctggagtgcagtggcatgatctcggctcactgcaagctctgcctcctgggttcatgccattctcctgcttcagcctcccgagtagctgggactataggtgcccgccaccacgcctggctaattttttgtatttttagtagagacggggtttcactgtgttagccaggatggtctcgatctcctgacctcgtgatccaccttcctcagcctcccaaagtgctgggattacaggcgtgagccaccgtgcccggcccaggatttttataaattctaacagtacaaagagttttccatgcaaagtaagcttccctcctgcccgaggccccacaggcctccattctgtgtcccaggggcatctactgtcaatctctttttttttgagacggagtttcgctcttgttgcccaggttggagtgcgatggcacaatcttggctcaccgccacctctgcctcccaggttcaagtgattctcctgcctcagcctcccaagtagctgggattacaggcatgcgccaccacacctggctaattttgtatttttagtagagatggggtttttccatgttggtcaggctggtctccacccacctcagccccgcaaaatgctgggattacaggtgtgagccactgcgcctggtctactgtcaatctcttaagtcgccattaagaggtgatgcataaattagcatctctggatgtccttgccacctcaacacatgaggtagcataccacacatcctcttctgttccttggttccttttttcaattcactgtcttggaatgttccatatcagcccatcagttctcccctgttcttttgttcagctgcccctctaaggcctggtggtcttccttatgcatgccactgcttccagggtacaggacacatctgatcttcttgttgctatttaaggaaggtggggtgggaacattattcccattttcaagatgagaacattgaggcctagagcagtccaaggctgctgggcagagctggagctcaaatccaggtctcctagacttgtgtctagggtcatcccctccccagcatggtcttccaccaaggcagagggaactcagggagtcttgctgctacagggaaccaggccaccccgcctcccccgtccccaccacttagccaaccttgaggaggtcatctgctgggggtcccagcagctcactgacctatacctctcacccccaacagtgcacctgtggcgattctcaggtggctacccagccctcatggactgcatgaacaagctcaaaaacaataaggtatgttagtgtccactcagcacacctctctggatgtgggatgcagcccagccctgttctggggactactctgctaccccatgaggcacactgtcaggatggagcgcacttcctggtagccatgcctttaccaccatgcccacaggagtacctggagttccgaagggagcggagccagatgctgctgtccaggagaaaccagctgctcctcgagttcagcttctggaatgagccacagcccagaatgggtcccaacatctatgagctgaggacatacaagctcaaggtgcctccctccgacagaccccctcctgccccccaatttccctgctgcaatgctgctttgcagctgccccaacacctagactggggcttctggcttctccctccctatgggctcagagcagagttgtatacacatgtgtgcaaacatgcacaccaggtgtgtgtcagggcctgcgaatgaggccaaatggccgctgcagcttgggaggtggggagacagggcagtttcccttccttgccaagctgtgatgctatgaatctgaggtgggggctcattcccatcatccctttggttctctttcagccaggaaccatgatcgagtgggggaacaactggtaagtggcagcaccaagactggggttgggggaggcgtaccctgctcacctgccccaccaaggcccctggtgggccaccttttccagggccatatcacagggaactctttaccttctgcccctcatggatctgggagaaggatccagccaggaggtgaggatctcctagaaggttgtgacccctccgttggtagaacaccccgccatcagtcctttctctcagcatcccggaggaccgtgggttccacctaggcccctcctgtgaagtgtggccaaggaatcagcctcagtaccctctgcaccagccctggcttctgccccatattattgtgccttctccagggctcgggccatcaagtaccggcaggagaaccaggaggcagtgggcggcttcttctcacagataggagagctctacgtggtgcaccatctctggggtaggttgaggaccttccaggagccttttgttagttctctttctctgtcatcactctctgtagccaatggggttgtattagtgtcctcatagaacttaatgttctagcaggagacactatcttagatgtaaagtcacaaaaagatcaatttcagattacaaataatatttatagaaaataggcaaggagtctgggagcggtggctcaagtgtataatcacgacactttgggaggccgaggtgggcaaatcacaaggtcaagagatcgagaccatcctggccaatatggtgaaaccccatctctactaaaaatacaaaaattagctgggcgtggtggcgcatgcctgtagtcccagatactcgggaggatgaggcaggagaatcagttgaacccgggaggtggaggttgcagtgagctgagatcacgccattgcactccagcctggcaacagagcgagactccgtctcaaaaaaaaagaagaaaaaaaaaaaaggcagggagagatgatggtgaaaaacataggggatctacattggtctaggtagacaaataatgcctctctgaggaagtaaaatgtaagctgagagctaaaggatgagaaggagccagctgtgaattgctaggcaaaagcattccaagtagacagagcagcacatgcaaaggccctgtggtggggaaaggccttcggggttttgaggtgtggcaaggaggccagtgtggagtgagtagggaagaatgtggggagatggaacaggagagggggaatgagttgggatttattgtaaatgcaatgagagactatttgtttcaaatagcagtgacacgacctgatttttgttctagtatgatttctctggctgctgtctgctttgttaagagtgcttggtaggcgagcaagagagaaagcagggcttcaggaagccattactctagttcaggcaggaggggatggggcagtgggatgctgagaagtccacagaagatttgttagtctagaggtggaaccaacaggacttgtggatgaattgtctgtgtggggcaagagaaggagaagggcattccagaagagctcccaggctcgtgcttgagctgctgtgtgtcatctcctgagtctgggaggtctagggaaggagcaagtcagtggggtcaggagcgtaattttggcccttggaattgttactttttttttttttctttgagacacagtcttgctctgtcacctaggctggagtgcagtagtgtgatctcagctcactgcaacctccgcttcccaagttcaagtgattctcgtgcctcacgctcctgagtagctgggattacaggcatgcagtaccatgcccaactaatttttctatttttagtacagagtttcgctatgttggccagactggcctcgaactcctggcctcaagcagtccaccagcctcggcctcccaaagtgctgggattataggcatgagccaccgcacctagccggaagtgttaacactaaaaatgctgacacaccaaagtagagatgtcaagtaggcagtagatggatataggagtctggagcccttgggagtgtttgcgactagaaatataaatgtaggcaatattaacatatgtactgattggatggatgattaaagcagacagtgtttgctaatagtctgagggaggcatctagggaggaggagacagcagtgcagggtttaggggacagtgggaagagggccctgtgctgggtaagggatccagtcctctgtgcctgaggaatgagcctgtgcctttctcacagcctataaagacctgcagtctcgggaggagactcgaaacgctgcctggaggaagagaggctgggatgaaaatgtctactatacaggtgagtgaagcctttggaggtcttctgctgagaaccctgtctgaggatggaatcctctctgcaaggagatctagtctttcttgattacctccagtgatggggaactcacttttaagacaatgagttaatgggtttctatccaagtggcacactccataggataccagcaggcctaggtgagtactctaggggatgataacatagccagggccacgcctctgcctaggagatgtggattagcaaacgcccattgtgaccttgggcacggttctttacctcgctgaggctgttccctcgtctgtaagatagtgatggtgatagtgcttctgtcagagggctataacggaagattctacaaactattttattattttatattttattttattttatttatttttgagacacagtctcactctgtcacccagggtggagtgcagtggcatgatcttggctcactgtagcctccgcctcccaggttcaagccattctcctgcctcagcctcccgagtagctgggattacaggcgtgtgtcaccatgtccagctaattttgtatttttagtagagacggggttttatcatgttggccaagctggtctcgaactcctgacctcaggtgatccgcctgcctcggcctcccaaagtgctgtgattacaggcatgagccaccacatctggcccacaaactcatttatgaaaagtgctttctccagtgtctgtcacaaaggaagcatgcaggaaatgtttttgaataaggtttttgtttttgtagagatgcagtcttactatgtcacccaggcaggtctcaaactcctgggctcaagcagtcctcccacctcagccttccaaagtgctgggatcataggcatgagctactgtgcccagccttgaacaagttttttgctcaaggtgtttgccactttgctaggaacctgaaaccacctagagtcagtgggtgttaattaagccctcactgtgtgccgggaactgtggtaggtaggtggttgaggggcacataaatgaacaagagcctgtccttgccattgagaagtttacagtgatcacttaccaggtggtatgagggagaatgtgtctgctgaaggagttagcaggagccttgctattcagtgtggtcccagctgggtatggtggctcacaactgaaatcctagtactttgggaggccaaggcaagaggatcacttgaggtcagtagtttaagaccagcctgggcaacatagggagaccccatctctacaaaacattttttaaaaattagcaggacgtggtgtttcccatctgtagtcccagctacttggaaggctgaggtgggaggatcacttgatcccaggagtttgaggctgcagggagccatgattgtgccattgcactccagcctgggcaacagtgagaccctatctcaaaaataaaaaataaaaataataaaaaacaagacaagcacagtggcttacacctgtaatcccagcactatgaagttgaggtatgtggatcaattgaggccaggagttggagaccagtctcggcaacatggtgaaacctcgtctctactaaaaataaaaaaaattagccaggcatggtaactcaagcctgtaatcccagctactcgggaggctgaggcacaagaatcacttgaacccaggaggcggaggttgcattgagccgagaacctgccactgcactccagcctggaagacagagtgagaccctgtctcaaaaaaaacaaaaaacaaaaaaaatcaagtgtggtcccaactgacagtattggcatcccctgggagcttgttaagaatgacaaatctcggctgggcgcagtggctcacgcctgtcatcccagcactttgggaggctgaggtgggcagatcacctgaggtcaggagttcaagaccagcctgaccaacatggagaaaccctgtctctactaaaaatacaaaattagccaggcatagtggcacatgcctgtaatcccagctactcgggaggctgaggcaggagaatcgcttgaaaccggaaggcagaggttgcagtgagccgagatagtgccattgcactccagcctgggcaacaagagtgaaattccatctcaaacaaagaaacaaacaagaataacaaatcgcaggcttcctgcaacctaccaaatcagaatctgcacattaacaagaactgccaagtgatttgtatgcacattaaagtttgaaaagctctgagctggaggaaagagtctaacctcctggatgacctggagctgaccttctctaggctgcaccctctctatctgtaaaacgaggcagttggtctaaatcagtgtttttcttttctttttttttgagacggagttttgctcttgttgcccaggctggagtgcaatggcctgatctcggctcacagcaacctctgactcccgggttcaagcgattctcctgcctcagcctcccgagtagctaggattacaagcatgtgccactacgcccggctaattttgtatttttagtagagagagggtttctccatgttggtcaggctagtctcgaactcctgacctcaggtgatccgcctgtcttggcctctctaagtgctgggattataggcacaagccaccatgcctggccaacagataactattaaaatttaagaaaatgttattctcatcaccaccaaagtcctgtcttatcccataatttgagggatctggtgctcttcatgggcccttccacgagggcaatgggacattcctgtcgcagcatctggggcctcctcctgcccactcaaaggccagcatgtgtgggtggggccaggggaggttgttggcttgcttgagccccctgtgtgacctctgccttctctctccgcagtccccctggtgcgacacatggagtctaggatcatgatccccttgaagatctcgcctctgcagtgatgctgcctacacctccacctccttccccttctccctcaggcaaccccgacagacagtggcactcctggtcctgctgtcttggttttgtcttggctctgggaggactctgaggggcagtgctcagttcagacaagggggaactgaaggctgacaagttctgaggattacagctctgcccaggccctttctactttccctgcctgcctccctccccctgctagaagtagtttctgatttccctgaatgaaagatagtgatcttttaggccttcatttatcttctaaaattcctcatctcaaggccaccagtccccagttatcacccttggaaatcctctgtttagcttagttgcacaaaaggtagtatgtccagtggctagaggtggggtgggaagagaggaggccaggccaggccctcaggaattccctggtttccactgggccacccacttgctggacagtctgagccaagtccctcctgctggagaaaagcctggaactgccaaaacaaaaaaacaaatacaaacaaacctcgtcaccacggtcaggaggaggttcagacattctgcccagaggggctggggaaagggatgggagccaggaaagatttaggggcaggagacagacacgtaacaggaactcggaaggtagaacttagaattcagaacttgggtttcaattgtagaatttggaatctggaatacagaattgggaagaagaacagagatgacaaaagaccacttgaagagaggttcctaatactagacagatggagagtggcttggctgtttccccctgcatattggggttgaaaacttaaatgtgtagttccagtccttctatgcagagtctctcctgccctccctccttcctgcaggcaaatatacaagctagaccctgttccctcaccctgtatcctgtctcccctaattgacattctatcagcccaaccctcattctgcagggccacctggtgtgtggaggtggcgggaggggtcagtgactctgggggtctcctcagtgacccccatacctcatcatgaacccttgggtagcttgattctgcctaccatccaggaaaacttgtgctggaattgctgatggaaacaattaaatatttactat

SEQ ID NO: 35958 - DNA, 5556 bp, Homo sapiens
gcgggctggcgtgcggcgccgttgcgggcgggagcggctgcaacgccggtgcctgaggagcgatgccgagggaaatcatcaccctacagttgggccagtgcggcaatcagagtgagcgaaactccggcccctcagctagccaggttccttagggtcaatgggatctcgctgtgggatcctggactccatctgtccttgccagaatcgtagttctctgaaaggcgagacatccctgacccagtgtccacttgcccaaccccgaggggccctcccctgcccagtccctggcgtacagtcctttcctcagacacgggagagtcctgcggcttgacttcttatccctggacgcaggcgcccagtcccccggctcctgattggaacctgcccggacctagatatcttctttctcccctgcccgccccttccccccagttgggttcgagttctggaaacagctgtgcgccgagcatggtatcagccccgagggcatcgtggaggagttcgccaccgagggcactgaccgcaaggacgtctttttctaccaggtgcccccagcgacttggccgggggcggcagttgcccaagggggcggaagggaagggagtggcctggtactgggaaccccgctgggcagtagggccaggcggctggcttgaggagggagggccggagggagccagagttgggaggacttcggacttgggccgccctagctgattgggccccctcctggactccccttgacaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccaggtcgtttcctattccctggcagggcccacaactcgctgggtagggacaggctctatgacgtcccgaagagagggaaaaccggatcagggatgtatgaatgctggagggagagacctggctgcagggagtggactatgtaatattgtcaagcgcctacactagctaatgcagtgtgccaggtcattctaagtgctttacatatattaatttttctaaatctcccaacaaccctagaagtaagtactacaggtccacagtcccttatctgcctttccaggatccagaaagccatgaaaccaaaggacatttcataactagtttatcagcaaaaacaaatttcaatgaagacaggctgttttatagtttcttttttttaatttttatttatttattttttttgagacggagtctcactctgtcgcccaggctggagtgcagtggcacgctctcagctcactgcaacctctgctgcccgggttcaagcgattctcctgcctcagcctcccgagtagctgggattacaggtgcttgccatcacgcctggctaatttttgtatttttagtagagacggggttttactgtgttagccagggtggtcttgatctcctgacctcgtgatccacctgcctcggcctcccaaagtgctgggattgcaggcgtgaaccgccatgcccggccctatagtttctatccaacttactgtcattagtgatgccttttattacagaaatactaatatatttgattaacgtgcttctgattaaataaaaattcccactggaattttatttaatatatagtatatataccataatacctttctaaaatctgaaatattttgaattccaaaacataactggccccaacactgttagataagggtatatggacctgtattattaccttcattgtacagatgaggaaactgaggcatagagcaattaaataagctgcccagagctacatagaagtagagttaatgggccaggcgtggtggctcacgcctgtaatcctagcactttgggaggccaaggcaggcagatcacctgaggtcaggagttcaagaccagcctagccaacatggtgaaactctgattctactaaaaatacaaaaaatagctgggcatggtggcatgcgcctataatcccagctactggggaggctgaggcaggagaatcgcttgaacccaggagacggaggttgccatgagccaagatcgcgccactgcactccagcctgggagaaagagagagactccatcgcaaaaaaaaatagagctaatgtatgaacccaggtagtctgggtgtagagtgctttcttgtaaccactgcaccgtactgcctctcaatgtagataaaagcaggtagctatgctccataaaaggacttctgggtgttataaggagaattgagggtggcttttctgaggtcagagacctcccatggttctgtcccactctgaccctcccctatgtctgtacagggagaaaagatccatgaggacatttttgacatcatagaccgggaggcagatggtagtgacagtctagaggtaagtgtcccaggaatgctggtaggagccgacatgggcaaggcttggcagcaccctctagaagcgacctgttaggaacaagacccactcatgtaccctttgcactggacagaagctatcaggccttgccagaaacaaggcagttgcctaagctgtataagtgaggggactggatgggaagcaagggctcgggaaaatgggagtcctaaaaaactatgagatgggtctagtttgacatcctgccactagatacctgtacactgactgccccttccccatgcagggctttgtgctgtgtcactccattgctggggggacaggctctggactgggttcctacctcttagaacggctgaatgacaggtaagtttgtgtttggggattaggaaaggtctccaacttggcttcctaaatgactaggggacccagcagatataactccatatttgctggaacaggaaagagttcttatattccctcctatagagaggaaaatgaagttacaatgactgagaaccccatcacactcccagtagtgggaactggagcctagaacctgagccctggatgaaagtcgagggagtgtggccaggtctcaatttggaagcccagagtctaagatgtctctgcccttccccctgtagggctacagacttccaaaagtcaaggctcccttctctactgatttgaccccaccccagtttcgccatcaagatttatctgcttctggacagttgttagggagcgccatgttcaccaggccttcggtctgttgccctgatcctttccccaacccccaccaggtatcctaagaagctggtgcagacatactcagtgtttcccaaccaggacgagatgagcgatgtggtggtccagccttacaattcactcctcacactcaagaggctgacgcagaatgcagactgtgtggtgagtcctggattctacctctcccaactctcaacaccccatacccactcgagtctattaaatcattttcatgtatttaaaaaaaatccattttagccaggtgcagtggctcatgactgtaatcccatcactttgggaggccaaggtcgttggatcgtttgagtttaggagttcgagaccagcctgggcaacatggcgaaaccccatctctactaaaaatacaaaaattagtcgggagtggtgatatgtgcagaaggatcacttgtgcctcagaggcaggggctgcagtgagctgagatcatgtcactgactgcactccagccggggtgacaaagtgaaaccctgtctcaaaaaacaagaacaaaaaaaaaaactgtttaaataattaagatgaaaagaaaaatttaaaaatccattttgagccctcctttgccctaggtcagtgcaaatctctttccagtgagtctttctggccatgaagctcaaaggaaattaagcttcagagcctagggtcaggcagagctcctgtttttcttatccccattgatctgtgatcctcttctgtccccccaggtggtgctggacaacacagccctgaaccggattgccacagaccgcctgcacatccagaacccatccttctcccagatcaaccagctggtgggcccccactcctggactcctttggacttgaagccctccttgttggagggtcatttggggaagggaggtcccacccaggctgaggcccataacatggcacgcctgtccccaggtgtctaccatcatgtcagccagcaccaccaccctgcgctaccctggctacatgaacaatgacctcatcggcctcatcgcctcgctcattcccaccccacggctccacttcctcatgaccggctacacccctctcactacggaccagtcagtaagagcagccttcagtgtcccaggccaggccggccctgggcccaacaggccctgtcctagcctttctctcttccccactgccccaggagctaccctttgtggaccccaaggcgcggcgctcagggactggcacagagtgggcgactttcttgctgacttgctctccaccctccctctgcctttggcttctgccaaagagaagccaaagggggactgtgccctgagcgctggccgggtccctgtctcactgtcctatcaggtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtaggggaggccccttcatcccacaccctggacctgcaggggtagaggagaggccacctccactgctcctatgcccaccccaggtccacaagagcttgcagaggatccgggaacgcaagttggccaacttcatcccgtggggccccgccagcatccaggtggccctgtcgaggaagtctccctacctgccctcggcccaccgggtcagcgggctcatgatggccaaccacaccagcatctcctcggtgagtctcaaagtttgcaccttttttccctgaatcagtttcctgactatacctcacctctctgcatctgctggccctgcttctagcttttttgctgtgggcatagcccagccttggttccccagctttctgggccacgttattctttgaagttctttgtaacccctgttttctgcacaccccaagctcttcgagagaacctgtcgccagtatgacaagctgcgtaagcgggaggccttcctggagcagttccgcaaggaggacatgttcaaggacaactttgatgagatggacacatccagggagattgtgcagcagctcatcgatgagtaccatgcggccacacggccagactacatctcctggggcacccaggagcagtgagtcccccaggacagggaccctcatctgccttactggttggcccaagccctgcctgactgaccaccccctcagagcacagatcagggacctcacgcatctctttctcatatacatggactctctgttggcctgcaaacacatttacttctcctcttatgagactatttatctttaataaagcactggatat

SEQ ID NO: 35959 - DNA, 223876 bp, Homo sapiens
gaggaggcaggcgcggctgccggcggctgggactgaagagggacgggtcccgcggcgagcgagctcctgaggtacggcgtcggggtaaggaggcgtgcggggctgcacgggccgggcgactggtcagtgtggggttgcaggggcggctcagatttttcctctggctgcagctgggaagctgattccgggcaggaagcggtggcgggacggtcccaccgggatggggggcggggagagggggcccggctttgggattttctgcggctccctctctcctttccttcccggtctctgcccgacccgattcttgcccgggggtccgggtcctgttgctccgggccggatcccggcttcgctgctccccgcggtccccctcttccctcttccgggggaccggggccgcgtcccggcggagccaggaaaggcgggggcacggggaggacgccgtcccccccggggtgccgtgggctcaggtcacgcgtccgggccccgtggagcaacagcgggaaaaatccggctccatcccccccgcggggagggggtcggccgcggcgtcgcccttcaggaggaaggttttaggaggggaagcgcgggccggccgcgcgcgtggggactgcgggaagccgggcgagggcggcgcgccagccccacgcgcggtgcgggtcgggcccgctgtaggctcgcgtccgcgcccccagctgccgcctgcgccgtctgggagctgcggagagggacgcgtgtttcgtgctccgatccttacaattcccacacccaggccatctcaccacagatggcttgttttttctcctcctgcgcctgggggccgagggttgggagcatttttaggtgagcagcggggaagggcgaggagaacctaaaggagcgcgacagggttgaagtcggcgtctggggacgccatccccaggcgcagacgctgcccccagcagcctgaggtctgtggtgggacatcagttatgcttctctagatcgctcacctcccctgaggtcaagtttttttttttatatatatgtataaataaaatgaggtttggtgagaagaactactgcctagagtctattattttggggaggggtctgcgtatggagccctccctacggacccgggtagtctttcattgaattgccccatcaacaccacagctgcccttaattttaagatccctgggtggatgggagagaaggtggaatctagaggagctgtggctatattttcgcttttctgaatcacatctttccccagtttcttgaacttcttgcctctgaaatggcatgtgtgtgccaggcgtcttgttcctcttgttactgttatttaagctgttttaaaaaaacgactttcgcggttttcccctcagtttttcagtctttatttcctcccccaccctacgtttttattgtttttttcaacggaatacattatttatctggtctctttataacgctgttgagaattagcatttcagttggtgttctgtcagatttcaccttggacttagcagttgagggaaactgagtcagtttctatgctgcaggggctaggatttagaattctcaagctttgaacaggtttcagtgggggaacgaatagtgcttaatcctattcagtttccctttgcaggctcattgctgtgagaaatcactgggtggctgttgcagccactgatgggggctgcattgcaatgcaatcttgaattgtgataagggccaactggctccatccgttaggctgtgagtttgacacaacttttgaagagctatgctgtgtcacctgtcagagctcgagtggtcattcttttaattcaatttaagaaccaccatcaaacttcagatatctattctttggaggttattggagaactgtacaagtggtaatggcttggaacaatggtgtggatttagcgctaatttaatcctatcctgtcttcctcacttcttgggcagaattcccactgaagtcagtagtggtcttgtgtgcagacagactgccgagaacaagaggctgctcatttagagtaacgggaagggacggtttctttccttttaaaacatccctctgtaagaaagacttagtcataacagttctttaatctttaaccactagtccaagtagttgagagcactttttgcaaaaaccttcgaaagaaaattcgtggatgaattgagccacgtccctcgaactcttcatatatctacgttgcatggtgatccttaaaaaagattaaaagtgattttaaaaaatcagttaaagctataatttcagtaaaatttttcctaacttttgtaaaaaatgtaaactgccagggagcattttgtagcaactaagtgtgtatatttcaaatctgaaatttaagtccaagtagaaagaagcaaatttaatttaggggatgaatctgaagagaggccaccaaaaaaataaccatctaaatataaaagaaggaagttcagatatctcttgctgtttttcaggagatagctttagggcagtttgctcactttcatacctgttcttaacgatttactgactgcctgggtccatcattagataatgctagcacttggaggtttccaaatgagttttgtgctgatctgagttgctgagctagttagatccttggcttcttaacgtaacattcttgtggcttaccctttccaaattactagttctaaggaattgagtttagaaaacctaaccagtgaccagaatgtaaaaataggtatttaaaaatcagaaccatgtccacgtgtactacccaaccacttgctttcaactaaaaatacttgcaaagatgacaaagcagtccacaaccaaaatatttattggtacaatttctctgtaattagtaatattgtacagttatgtttaacatcaggttctgccctgaatcacccctctcatattactgtggctggtgaactacaaaggttgtatctttgccatttcatttaggaatatagggtttatattttatatagcagaatgctaaatatttttgaaggttttgttttgtttctgtttctactctgtctctactaaaaatacaaaaattagccgggcatggtggcgcacgcctgtaatcccagctgaagacatgggcctttttctttcttttttgaactgaagtagcctgtttaaaagctatgtgtgggctttttattgaaaagtgtgaattgctactagttttataaggcaaataaacagtttatagggatcaataccactgagtcacattttgcatttctaaaatctgtgctgtttacttggagaaaacaaaagaaatgtgcctacctcctccatcccacctttatttagaaacatttccagtgggcttgtttttttcagattcagaattactgtacctaaccactgggtacccttacagatttcaaagcctgaagtaaatgtttatgctggctttcgtagtcagcaaataatagccaaaccctaattcactgctcttttatagaatcttggaatctcagggctgaaccgttaggagtcagcagatccactcttagccctagtctcttcctctcaacatgcaaacagttctaatgtctttggaatgtctgagcaaatagaagatttgtatgcgattctgtcaccaattctagacagaacatcctttgggatgccatgttttggcataaaccagcaacttgatattatgagatttgtatcatttctctgcgtgggcagtgccctagactaaaatctaaaatggagtcaatgcctgatgtcattaactatagggaaatggcctccaagttagctattagagttgtttaggaattatagctgggcgcgatggctcacgcctgtaatcccacctctttgggaggctgaggcgggtggatcatgaggtcaggagatcgagaccatcctggctaacacggtgaaaccccgtctctactaaaaatacagaaaattagccaggcgtggtggcaggcatctgtagtcccagctactcgggaggctgaggcaggagaatggcgtgaacccgggaggcagagcttgctgtgagcggagattgcgccactgcacgccagcctgggtgacagagccagactccatctcaaaaaaaaaaaaaaaaaagttataggtaagccaagaaggaaagaaataaataatctcagttatcatctagaaatgatttatagtttttgttgctgttgttgtttttattttgtttttgagacacagtttcactctgtcgttcaggctggagtgcagtgacgtgatcttggctcactgcaacctccgtcttcccagttcaagtaattctcgtgcttcagccttccaagtagctggaattacaggcgtgtgccaccatgcccggctaatttttgtatttttagtagagacagggtttcaccatgttgaccaggctgttcttgaactcctgacctcaagtgatccacccgacttggcctcccaaagtgttgggattacaggtgtgagccaccgcacccagccggtttatagttatagctaatagattttggtagctttttctataaagtatgtgtatgtgtgtgtatttcatatgagagagggaatattataggtatttgtgatgtgaagcacctactcattgtatttaataaatatttgatgaattaattcattgaacctttaatatattagaggtgaagaatctttagtgaagattctttgatagagttgacatagaaatgggtaatgtttcatgtagaaatatcatgtcggtaatgtttatttgcttttctaaccactgatattgtttctcctggttttgtggttggcttgggatctgtgttgtaagtttcttagaggcatgtttttcatgtctaggagagtagataggctatatatttccatggtgttgggatagtattaattttaattagaatttcagaggctttctgaattttcttattttaaagtgatgtctcttacttcttggcattggaatagatttcatgtgatctatgagtgcattcatactgcttctggatattttttcttcaaagattgcaattgagctaatttcatattctcagttatctttaaaatggaaacatgttttcacttcacagatacctctctgaattttgcatattttcactctaccttattagagccataaagtcaaaaagtacatagattgtctcccaaataatctggaataaattgaaggataagaacaatctttcctgagatctgacctgtatcttaaataaggttttgctttagatagccaagttgaaattttgcatagataactaagttcggcatcatggggatcattttagttctttccaggttaggaggcatggaaaggctcccaaagtggttttgtcactgttcatctatcggaccttattgcctaggtcaggtagggtagttcatgcatttaaatcaaatctttctgaagagaccagtttcctcttgctttgctcttagggcctcaccatcaaccttcatgaaagaattttcaaatacttaaaaacttatgttacccttcagttgcctttttccaggataattgtggttttaaaaagcttgtcatatagttctgattaccaactctgaagtcaccttttccaagcccttgtatttacgtttccagacctgctgatgagcttcagggctgggccattataacaacagtgctgaattcactcatatttttcagagtttcctacattctactgatatatgtacatatcccagtagcttgaagacataaaattaaaatgtgatttacactctgccataattctttgtttctttctctttttgtccagaagctacttgtttttcaccctagattcatttaccttgagggagattatttggttcagactcctgacctggggtggagagtggggttcttgggcctcatgggtgcataaactgcctgagactgtaagtgaggtattgtgttcccatgtgcatgcactcctgtgtgtgtgcagcatctctgtgtgtgtgtgcacaagtggatgagagagacaggttaagggagaaagagaactttaggagtggtttttgaaagggttttgggaaacagaaaagattgagaactgatgtttcagttcttattttcgagattagaagatggaagttttaagagtattttgtttttctctttttttttaattttttcaccctattgcacttttcatcatttattctcccctatctcccattgtacttctttccattcaattgaattcatttagttgacccccatttacctaactgtcaaggttaaactgaattctgatataatcctggccactcatattcttacctgtgaacttaatgaatgtgcatttatttccttacaaatttctttgatggaatattgattagaaggaatcagtaacatgtccactctatttgatgctggttagactgccacatatgccattgtgaccttgggcaaattatttctcaaagcctcgtttgctgtagtaaggggttaaaaatcatacctacctcagagttacatgaggattaaatgaactaatgcttataaaatgcttcatagagtgcctggcatctgtaaaaattgttaggttaagaagagacctagtgggttggttactggtgaatatgtggtaagcagattttttgcagtggtcaggaataattatctgtgtggaagtacagtctttgaaatgaaacagtaatttcctatggtgatcacaagttaaaaccactttttaacaatttcagtccagtatctataatgtttgagcttttagaaactcttgtcttaacttcattctttttgttaatttacaaaagagcatatatatgggaaaacagttgggatctagtttcaacagcacagggataatgtagtcttttttgttatgttgccagaggtaactgattataaatgtaaaattgtgtgcatatgttctaacttcttctctctataaccacagtaaacttgttgaaaaaagcctattagtgagtagaatttttgttgacaatgtttaaacctctgcatatggcattaaaatgtaacctttataaatctttgtgtgaaatatacctgcacacatattttccagcaacatcgtgttttaacttgttagttgccaacattaagaaatcaggtttcatataaatatccttattttaggctagaaaaattagatgatggtgtagcacttggtccactgggtccactgggtctattgtgtctattgcttctggtgctgtcacgcatcagctgctttgcttaacctgtccctgacgcacgcattttatgctcagttctagctttgttctaggttccattgtaagtaatcctgtaaggcctgaagctttgataatcaataaccatgtaaaaaaaaaataaggaagctaatggttttgcagcacagactacacaccaggtgctataattggtactttacatatgttaataaccctgcttcttttttgcagcaccatcttggagtagctggtgtgcttattttacggatgagaaactgaggcttaaaaattgaataaatggctcaagggcacccagcttgtgtatggctaaaacccttgttttttctgtgagttccagttattgcttttaattgttcgatgttattactcagtagaagttgaagttttttgcaatttgttggcatctgcagtatctaacttttataaaagacaggattgctttcctgactgggttcgcccatgtagttttttgtgtaaaggtatgattatgaagcagacctgagtactacttttagttgtgtgattcttgaatcatgctggaacagggagtacccttcatcttgtttttcagactagagacatttaaagtaatgtttctagcctgatttttcaatattagaaaaatataccagaggataaaacacatcagaataaaatgtggctctcccccgacctttagtttctgcctttcctgtggttttgcactttttgctttcatttaaagtgcaaatggcattctccagggtgctttatatgatttagaaagtcaggtagtactgcagggattatgaaaaaaagcagcagaccagtgccctagctcccttcttgacagatttctgctcccctgaggcaactacttgttggaggccaaaagaatgagggtcatgatcaactcagtataccactggaggttatatgagtaagcagcaaactgtttttcataaatgcagaatgttggcaaactgacagactgcgtatgccacccagaaggaatgctgaaggcagtcatgcccaaagcacagtgtttcttgtgattaggtacatctgaagcctgttagtaacaatatgaacctgtgatcaattaagcagctgaccaatccttacctccttctccctgctcttgttacccaataaatatgaagggctgtggaagctcaggggctgcctttgctcactagaagcagggagctcttttcttcttcccctggcccttcctttaaaacagttccttttgtttttttgttatttccatgtttgtcccttccttcagtctcgtaatgacggtctcaagtagtaacagtagtaactgttgtagtgaaggtctcaagtagtaactgtggcaatgtgccacaagtggcgcccgaacagggactatcagtgacaaacagagacctgaagagacctgaagggacctgaggaggcctacagggacacatagagataagtagggataaatagagatagagacagatagggaaagatagggacttgcaccaacttggaggaactaacagggaccgtagagacagacagggacagacagggatagataaagactagcaaatactagcagagactagcaaagactagcagagaccagcagaagctagcagaaacttgcagggacagacagggacagatagagacagggtcctatagggacttgaatgaggaagttctgctggaacagaaaaaactaaaaccaaccagacaaatgagaaaccccgttacaagtctgcttgacaacataaggagatgaacaaactgtgtgggtgccctcaaggtgtgtgcgaccatggaatggaagactggagagatccatggattctagctacaggccttgttcccctaatacgagccatgagccagttgaatctgaatgcgaagatggaatgaggaccgaccggagtcacactgacatcaaccctcatgacatggggatagatcaagaaaaccacacaggaagctgagacactgttagtgtcagggtcaggcaaagacccctgactccatgtttgtggccatgctggccatggtttcctgtgcctcccgttgtaagatcagctggaccaccaactggcaattaagggctgcacagcctgtagttgcctttctcaattaattaaaaaacaaaaagggagaaacgttggaggtcgaaagaatgagggttatgatcaactcagtataccactggaggctatatgagtaagcaacaaaatgtttctcataaatgtagaatgttggcaaactgacaaactgtgtatgccacccagaaggaatgctgaaggcagtcacgccccaagtgcagtgtttcttgtgattaggtacatctgaagcctgttagtaacaatatgaacctgcgatcagttaagcagctgaccagttgctacctcctcctccctgttcttgttacccaataaatacgaagggctgtggagctcaggggggctgcctttgctgactagaagcagggagcttttcttcccctggcctttcctttaaaacagtttctttttttttttttttttttttttttatcatttccatgttcgtcccttcgtcccgtctcctaatgagggtctcaagtagtaacagtagtaactgttgtagtgatggtctcaagtagtaaccgtgacagtctgccacaactactttcactagttttggttttattttctggtgttttgtctctaaataacatgattttcttgtttcttgattttttttttaaagtttcagaatatttttatgttttattatttgttaaaatttacttgctgggcacggtgattcatgcctgtaatcccagcactttgggaggccgaggcgggcagatcacctgaggtcaggagtttgagaccagcctagccaacatggtgaaaccccatctctactaaaaatacaaaattagccaggcgtggtggtgcatgcctgtaatcccagctgctcaggaggcggagacaaggagaatcgcttgaacccaggaggtggaagtttcagtgagccaagatcgcaccatagcactccagcctgggcaacaagagcgaaactcctcaaaaaaaaaaatttatatttttgtgtgtagatagttgttcaaattgatgtttctgtagggggtgaggttagcagggcgagtggggcagagaagcactagaaaagcctattctgccaccttgctgaggtctgcttactcctgtttcttgatttttacattttaaatgtaatacctgtttgactttctacctctagttagcttccttactaactccctcttcccattttctcctctcttccaatttccaacttatatatacaaaagctaagtcatgtaaagtgctttgattacatgtactttcttttacaactttatgttttatcctgaagttatcctgatccttatccttttccttattcgttttctttgcacccatccttggttcagctttaaactatgttagaaactgtgaaattcttgccagtaggatcaaacatgatataatcttttggttccgttttctttttttgttaaagctatccttcctggctgggccctccatcatcctggactggttttatttctagaattgctatataactgtgtgcagggaattccttcgcctctttttctgggctctatatttctatcttggttcattgacaaaaagttaggagtttatccatgaacttgtaaccagaactgtttttggatcttggccattaaaatcaacatcagtggctgggtgcagtggctcatgcctgtaatcttagcacttcgggaggctgaggcagttggattgcctgaggtcaggagtttgagaccagcctggccaacatggcaaaaccccatctgtactaaaaatataaaaatcagctgggtgtggtggtgggcgcctgtagtcccagctacttggcaggctgaggcaggagaattgcttgaacccaggaggtggaggttgcagtgagccgagatcatgccactgcactccagcctgggtgacagagtaagactccgtctcaaaaaaaaaaagaaaaaaaaaatcaacacagcacaggctacatcctaatttccttaatgaagacttctagtatttgcccaaaaaagtgtaaatggcaggtgagtttcttgaggcttgcatgtcttaaaatgtctttctccactctcagtttggttgctcttatagtttggttgtatatagaattctgttagtgattaccttcccttcaaattttgaaggcatcttttgaagccatttgaaggatgctctttctctcacctcagtcctcaaagatatctggaacctccaattcttcaggctctcagggcttttccaacaatcaacttgtttctcgtaggccccccaccaaaacagtaacagttttctgcttcctctgctctgctaagtcagttactttgtacatctgctttccatcttctaaaattttgttgacatatctgctggcctgacccctcccattgttgctgttgtgtgtgtgtgtgtgtgtgttttttttttttttgctttacttttgtgaatttgttccttgtaagaaaacttttctcacttcattttagtgtggttgtgggaggaaacagaaattagctcatgttaaatatattggattttggaatttaaattgattaaaaacaaaattccacaagattgccacggtactcacatttggtaaggactgcagccataataaaattatacttgtttccccatgccagctgctgggttgaacttcatttatatagagggaggtagaaaagtcaggtgattgagtgaacatctagggtgcctgggagtggatgactgatatgttattggtcaagaagctacttcctaggaaaagttcagtaaatgtattatatttttttcctgtggtctttcaaggagttcattataaactcttagaaatattatatacttgaactagacttaacaatacatactcaccaaatttgtttttgttatgtatcagaggtgacagcattagtttagatttattgagtatcttggtttgtctgtctttagacagacatattgttgtcacacatatacttgaatattctttggaccaggcacgatggctcatgcctgtaatcccagcactttgggaggccaaggcggacagatcatttaagctcaggaattcaagaccagcctgggcaacatggggaaaccccatctctattaaataaataaaagaatattgtttgaatatgatttggggattagagtaagttttgaacatatgcaggttctgttaaatattgtaagggtgaaaatttcattactaggtgggacataattagggatttacattaatgtgaaggtatggatgttagggattttcgagtgtgggttttagggatggtaaaacaaaaaggaaggttctgaatattgtagtgagtcagtagtgactgtgaggtctgaggaaatgacaggatgatctaatgcctgttatgtgatcagtgttagttaagttggttgcccagtgggttttagagatttagacattcaaatctattatgcattaatatagaagatgttgcagggaataaataaggaaagtatttccccagagtatgttggtatactaaatgatttgagtctttcatttttttttggagacagagtctcgctctgttgcccaggctggggtgcaatggcgcaatcttggctcactgcaacctctgcctcccgggttcaagcgattttcctgccttagcctcctgagtagctgagattacaggtgcccgccaccacgcccagctaatttttgtgtttttagtagagatggggttttgccatgttggccaggctggtctcaaactcctgacctcaggtgatctgccctccttgacctcccaaagtgctgggattacaggtgtgagccaccgcacccggtccccatttgatttttaaaacaattttgtaccacgggtctgacaagtaagaagagcgaagagtttaaacttaaccaaagtcctggagcagttactaatggagcttcaggcacagccaaggtctcttgtgtccagagttgttccctctatactgtgcacttttgccagttgaagttttcttggaaaactcaggaagtctgccaagttttgtagctaaagagatgtcctgtagcttttatatatttgtgtcttgagccctgaaggtagacagagctcagtcttccaaaaatagttcaataaatgtgtcaacattttgaaatactactgaaaaaacaagtaaaagtcctatgggattattggaaaatgatgccaaatgcctccacaagtatttgaaaagcaaatgtggcagtggttatacgctagacaatggttcatattcagccttcgcttttggggaccatttttattatgataatcttttactgtttcccagtactctgtttagttgcttctagactctggtagaaaagctactaagtgtctacactctggtagaaaagctactaaatgaacatcttctttggaaaattttctttaatccacttctcttaaagagaaaaaggaaaactttttttccttaataaagtgggtgaaagttgtgtatgggaaaggtcagaatgtcaagtactgagttgggtctgtccactgcaaagaaatcaaatttatccatgaacttgtaactagaactgtttctggatcttggccattgaaatcaacatcagtaaagcctacatcttaatttccttaatgccaagattgtctgttttaaattatacacatatgggaatgtgaatacattcgtcttcccccacctccctctgcccgaaaacaggaggaaaataaaggtacgttgaagatattctaaacttttgcagctctgcaatgaagagctgtggatgtgggctgcatatgtggtgcagatgtggctcctaccaattgaggtcattttaccttcatcttcagtgctgcaagcttaaatcgaaagagggtagattctagaatagtctatagatctatgatttatgtgttacttgctctgtgtagaacacataatagcagtgaaggataatgtggcatttttttaaggacttttttttttctggttaggttttttaaagccatgtttggttaggtttttttaaagccatgtagtatctgattatcgaagtgtttttggaagaaagaatgtaccattatcagttacagaaaagtgttcttcttttttaaactttttactatggaaaattttcaatatattcagaagtagagaatagtagtataatgaacctcgcgtatcctcgcctggcttcaacagttaccagtcacatgaccagtcttgtttcatctgtatttccctttgactccctgacccactctcatctttattttgaagcaaactccagacatcatataattttatttgtgaataagtgagattcccctgctccccttttcttggcatgtacttcttggtctcccaaataaagctcatatttattacggattttgtggaataacagaaaatagatcatttgtgacatactgttgtgatgtttttggaataaatatctgaatattgttttagtcagtaaaagcagtttcacctaaatgtagcattgtggacatagagaatgctttaaccagtgctaaaaacaaggaacataaaacaaaaaatacaacaaaaaccccaacaatttctaaaccaaatctgaactgatattcaaattctagtatgttctcaaggtaatgttaaagttgatgttgtataattttttttcctatgaatcctgcttatgtttatgttagattttattgtttttagatttttcttttctttttttctttttttttttttttttttgagacagagtcttgctctgtcgcccaggcctgaggtacagtggcgcgatctcggctcactgcaacctctgccccacagattcaagcagttctctgcctcagcctcctgagtagctgggattacatgtacccgccactatgcctggcttatttttgtatttttagtagagacagggtttcaccatcttggccaggctgattttgaactcctgacctcgtgatccacctgccttggcctcccaagtgctgggattacaggcatgagccaccgcgcccagccgatttttcttttttcttttcttcctcccaccctgccttctttcttcccttcttttgcctaacgtagtttagaggcaatatgttggaactagaccaagcaaaatattcttttttagctgactgaattttaatgggactatacagttataaaaatcaaagcaacctgtttgtatatggttctgtctggcagtatcgaggggaaggtacatgccttaaacattgatgatacactaatttagaaatcgttgtgtaaattgttggcattatagctgtagctgacaatcacttaatggtcgaagtgcttttcctaaataacaggcaggatttttatgttggagatagtttattttatatattaatttgtactttcaattaagatgtaattatttaatataatttccttgcaaagacattgaattataaaatattgataacaataagcaccatgttttgagtacttaatatatgtcagacactgttctataggcacttttatttttaaatattttttttagagatggggtcttgctgtgttgtctgggccggagtacactgggtactcacagatgtgatcattgcatactacagccttgaactcctgggctcaagtgatccttctgtctcagtttcctgagtacctgggactagaggtgtgtgccaccatgctggttatctataagcacttttacatttatttatttatttaattcttgtagtaactctttgtggtaggtactattatcctaagtatcctataagaaaactgaggcactgcagtttgaagtaacttgctcagggtcactcagccaattaatggtggagcagcggtttgaacccaggctgtctagttccagagcctatagccataactactgtcttatattatccctaagaatatgtaaacgacgtcaaaccccgatcctatttgcattcccctccccacgggtaactatcttgaatcagagccaatactacactattgcattagggtataatttaatcattaggggatagttttcatgcagaaactagaaagcactgatgagattctactcatgttcctttaccagctttagttataaaggggaagcgggaaaatggaagcacgtagaggataaggtgataacctccaccttaccatcttccttcttcccccttaaaaaagaaatggaatgttgagtctatctggaatgttgacaggttaaaaaggagctgttgaagcctgtcgttcacagtagcatcgaaaggtgaaaatttgtctccacttgagtaccttgaaatggcaggtgtgttattggaatattgggctattgttggtcagtactgctgagtatagacttttgtaggtgtttatcctgaatctgtagtgaccggaatttcaacaaatgaggtatttaatactgttttttcccttttgtttctgaaaggagcagaggatagaaagacaattgttctagcctcaagtcccagtacactcattagttaagtgtgacggtggtcaagtgatgttgctttgtgtgtctgttttctcttaggtggttcaggtaccctgaaataaatcctaacttatatgtctgttgctcattcatctctgtgtgtggagaaagtgatttaaagtgtcctttctttaagaaggaaagagccagggcatagtggctcgtatctgtaatcctagcactttgggaggctgaggcaggaggattgcttcagtcaggaggttgagactggcctgggcaacatagtgaaaccatgtctctactaaaaaaaaaaaaaaaaaaaaaattagcttcggagactgaggcgggaggatcccttgaactccagagatggaggctacagtgagctatgatcttgccactgcactccagccttggtgacagagtcacacactatctcaaaaaaaaaaaaaaaagagagaaagaaaaatataggcgtagatcttggcaaaacatttgataaagttttcatggtatctttatatctttataaacaactttggaaaaaatctcttgtggtttttgttactgaaattttaaccttggtcatctcctatgcaagatatttttgccagtgatttttaatggtaacaaacaaggattgcttatcagatatacagatttcacagaagtttatagggaaaccgagtaagctgttcctagattgtcttattagctacaaaatgggctgaaataaataacatgaaatttgttgggatgtcattgaaagtctttgagtctctcctgacatgttttggctctttgttctccttttccttctgttctttgcagacttcttttcctctgactatcctttcaattttcctgtttcccagggttctgtccttagcctttgattcgtagccctaatttttatcacccaagactttacctattttaatctgttaactcatatctctctccaggctaagtctttctcttgagttctgcatttcagtgacttagaagaatctctgccagcatctcatcatttttaaatgaatatttaaatattaaatattcatattaaatgaatatttaaatatgaaatattttgtgtaaaatgtgggctgtaatggattattttgcattgacttagaatatttagatacctcattttaaggggtacatagtatgcactaatagatatttgttcaataaagacgagtggaaaccatgtccatgaagggttactgggatgttgagatgaggagaaactatagcacctgaagaactagccgtagaaataactgaagggataaaacttactggggggcaacttgttgagagctggtgtttgagcactgcctttctgattttgtttttgacaaaatctgctggaagaaatatattttacatcttgaccctttattcagtatggatgtgtgtatatgtatatatatgtatgaataacagaaacaagtttcacaaattagttcttaaccttactgtgtattgtgctctgagattttcttttctacttaataataataaaattccagtcaatagtccacaaacttaatttcacaactcaccagtggactgtcactgcaacttgaaaaattctttttccatggataaaactaagaaatttggagaagggaagttttctgcctggtagcagaggaactttttaacagttggagaaggctgatgatggaatggggctgccttggaatggagtgctttcccaaggcttgaaggacccaggcaacaggctgttggaaggtgggaggaagattcactgggtgggagatggagctttgtgaccaccggggtatcttccaagctaaagattttatgattcccattttatgacttgctgaaattttaagatgattaaagttatttgaagatgaaaaagattctgaattttgtttaccacgattctacttttttgtcaaaaatgtctcaattgttttagaaattaatttttaaattaaaaagttttaagaattttgtatgctaactgtatttccattattaacttacttccatttccattatttcaatttttttttaaacaaaaaagcattattggctgggtgctgtggctcatgcctgtgatcccagcgctttgggaggctgatgccagaggatcacttcggcccaggagtttgagaccagccggggcaacatggtgaaactccatctctacaaaaaatacaaagtaaacttagttaggcatggtgaccagtgcctgtggtcccagctacttgggaggctaaggtgggagaatctcctgagctcaggaggtcaaggctgcagtgagtggtgatttcactactgcactccaacctggacagcagagtgagaccctgtctcaaaaaaaaaaaaaaaaaaaagcattatttagaaagttttaaatatatacaaaactaaactgaatagcatattgattccccgttcctttcccaccattcagctttaacatctgtcagctcatggctggctttcttttatctgtctctctattcacttcacttcttactatattatttggaagcaattcccaggcatgtcatcattccatctacatatacttcactacgtatctataaaagatgagactctttagaataccattataataactaaataaattaacagcaaatccttaatgtcatcacatattcactgtgttcagatttccatttgtctttgtttctttcatagtctcttatttgaatcaggatccaagttaggtacatacattgcgattgtgataggtctcttcaaatctctttaatctattggttctgtccctttctttcttttatatttccttgcaatttttgttgttgttgaagaaattgggttgtcctatatccttcctgcaatttctgtttttctgattccatccctatgtagtttaacctgtgccttcatcctatgaattggtagtacatgcagaggcttttcatcatcttctggttcagttttttttgttgttgttaatacttcattggttttgttatttcttaaaaccactcaaagagtatacctaaatactaaatgtaaggatgtttggatttatttatttatttatttatctttattttttaagacagagtcttactctgtcacccaggctggagtgcagcggcgagattttggctcactgcaacctctgcatcccgggttcaagcgattctgctgcctcagcctcctaagtagctggaattacaggagtgtgccactacacccagctaatttttttgtattcttagtagagacagggttttgccatgtttaccaggctggtcttgaactcctgacctcaagtaatctgcctgcctcggcctctcaaactgttgggattacaggcctgagccaccttgcccagcctcggatttcttacttggttcttcatttttaaaatcagcctaagccaaattccccataaaaacagatggaaccacttagaaatttgggaagataataatcctctgcaaacaccacatccaaatacagattacacaagaatttctactccagcttcatttccaaaaaagaaagggagaaagcagctgtcttagtaatttccatgtaccacaaaccaggttttccgttcaagtgagacattttacagtaaaatcagtcttgatttttctagcacaatgatggaaactttttggttttgctagttagatttcttacccagtaagcaagtatccttagtgactctttttttccccctcttcttccttgacagttagaagtagaaggataaaagtgagaagatgtgaaatcagaaagcaaccaatttatgtgggaaattaaataaatgtgttctatagtgatcctttgaaggattttgtaatcatttgtttttactacttattgtggaaatttttctatgtataaataaagagggcagaataataccatccatttcctcaccaccttgtttttcccctaatgtttagtgcattaagagatggggatgaagtcacactgctattcactggaatcttctttattatttcatttgttgtatcaggcttgtagtgtaggttttacatctttttctttcttttgttaatgctagtaaatcttttgctagtttttattttaaggtcttttggctggtactcattttgctaggtattagatgaagattctatgatgaggtgaagatgctgggattaggggtcattccctgcattcttactgagtttctttttaaaaaaatactttttataatggaggtgtatgcaaacatagagtagaataatgaatccccacgtacccgccttccaactaattactcccatatggccagttttcatctgtggaccttccaaacccatgttccccattccatgctggattgtcttaaagcacagtttatcacttcattcactctttttaaaataggtctgtgatgagtaagcattaaacaaaatgaaaaccacaatactgttgttacatctaaaaaacttactttcttaaattatcaaatattcaatgtgtgttcatatttatccagttgtttcataaatgcttctatagttaaagttagaatccagataagatctatattatgtttggtttatatgtctcttgaacacagtatcttaatatgtactttgtttctcttctttttctttcagtttatttgttgaaactgtgttgttttttctatattcaattgatttgttgaaactctattgtttgctctatagagtttcccacattctggaatttgttgattgcatccctgcctgtggtgctgtttagtatgtttctcccttctgaatttcctataaattggtagtagatctggggcttactcagattcaagattaattgggagttaggagtatagaatccttcctagttatcagtgtatatttcttactgcttcctatcaagtgatacaatataggattagttttctttttggcatgaagattgatcagtgagctcaggtgtttctagctggactgatccatccatcagtctgatgggaaaagcttgatttcccattaagcttttttgcctaatggtttttaacagccatcggtgattattgcctagatacattatttccttacattaactttttcccatatgttttttcctgaagtaatttaaattatgaaacatcacatttcagccctaacttttttgttatgtatttgtaaaaaacatggacagtttcccgtttaaccagcacactattatatcagttgacagtagttctctaatattttctaatatctgtgctatgttaaagtctctccagtcattcccgtgatgtcttgtatagtgtgtttggcaaactgggatcctgccaaggattgcatttaattatggttatgtcacttaagtcacttacaatctaaaatagttcttctccttcctttttcattcccttttcatgacggtgaactgttggagagatgcaagatgttacaggtcttggagaatctttgtttttcttggttggcttaattgtttctatgtgagggtatttaattcattcgtctaaactctgtattttctgtaagtagaatttagatctaaattcttgattagattcagaacaaacatttttggtaagggtattttcatagccaattttgtatggtttacattgcttcatatcaggcaccacataatgcagttatctcactattagtgaagctaagattgagtaaggtgatgacagatctccctgttgtaaaattatagttttccctttgatactggcatataatctgggaggagtgagatgttggtaccatacaaatagttagttccttgacgtctttgacataatagtgttagtatccattggtgattttacctgaatcagttatctctttgggaatagcaaaatggtgataaaatgggatttttaaagaattgtggtaaaatacacatacctaaaattaaccattttagccttttttatgtggagacagagtctcgttctgttgcccaggctggagtgcagtggcgcaatcccggctcactgcaacctctgccttctggtttcaagcgattctcatgcctcagcctcccaagcagctgggattacaggtgcgcacctccacgcctgactaattcattgtatttttagtagagatggggtttcgccatgttggccaggctggtctcgaatccctggcctcaggtgatctgcctgccttggccacccaaagtgctggaattgcaggtgtgagccactgcacccggccaccatcttggccatttttaagtatatagtttagtaggggtaaacccattcacattgttgtgcaaccagtctctagaactcttgcaacgttaacactctataccctaaaatggaatttttaagttttattatttcttcaatttcattaggttgcaattttctgagcaaaatagctttccctcattaatgtgggctatttgattactgtgaaatacagccttttatttgaaatgcaggataaatacttaattttcccctttatcaaatttcagaataagctcttggtataatagttacctcaagttttttttttttggttgtgtttctctttttgagtatcatttttgacttaaggatttttatatattcagtgtttcagtcaattacaggcattctttttgatgttcagattgtcccaactttggccatcctcttcaaactggctcctgtatccttttgacacaaccttgtcaggccttggaagcaaggagtatgtttatttaaaggcaataatatttcttttggggaataacatcaaatctccattgaccgtggcacagaaagcatttacattataggaaagtgctacagagcacggtgaaaccttgatactgaggccctaattcagcaaatggaaaaacagggtaaagttagatgatctctaaggcctctggtctgtgatcttttactacctataaaactgtttcgctatttggttatttttggaacaaaatatttcaagggtttgcgtgttgttaaattttgtgttaaacagcatcttcattactttcttcctattctgatagtttcctgggccatggattaaaggattggaaatttggaaatgtaggagttcccacgtattttacagttacaaagtccatacccagaggaagtgagaaggggtttgcgtcctaacctttgccttttattccaacataacatagctaaacattctgttgagagaaggtcaaccttgtaatgctggatcaataagctgctgtcttgtttcctgcagacagctttatttcctctggtttgggtaaacagatgaggtttcatcgagagtttaaatgtataactgaatttgtgaagaaccgttttctaatggaataacataatacttatatcatgtttctaagcctctgggaagtcactgtctgacacttaaaaaaaaatgttggttttgtaaattgacttttcttttcttaatgtagagtttaatgtggaaaatggtcactcttttcagttttgtaagttttttccccagaataaatgtggctcagttttatccttatgctcccagtagtcactatcatgactcttttgttaggcattaaatacgaattgccagtttgaaatactttgaacacttactgaatgttgggcagcagtacaaataatacagctgcataccatattaataaaaacaaaatgctgtgccttgaaaaaccatttcttctctaagaatgaaagaagtattatggaattctgtgtttatttaccagtgacttacattttggagtaaataaaaggttatactgtattttagttaaaagtattccttttcagtgttaggaggcatggttgatttgtgaaataactttacaagattatttttataactataagtagaccattacttatttttaaagaaccagcatttaaaaaatgtgtgaaattgctttaactgtgaatactgttatatctagtaaataaagttattctatgaattttccagatggtgatagcaactagaataatttgattcatcatttctgtctcattcatgatattaatgaattgtgaataagtacaattaaaatctgcactggattgtcccatataagactctacaggcttggtgtttcttaaatgagaaatatcagtatatatttttagagaagtagttattttctgcatcactgtatgaaggatttaaggcattgaatagggaataactatgataaattgcttaaaattttattatattgcttaaattgcttatatttcttttttattttgaaggtacctggccttcaaaacaaatcaagctgaaatacattaaaaataaaaagaaatataaaaatgaagatccacatacgtgtttattgatactgtttatgtgtatttttgtatgtatatacacaagaaacatttttaaaggacataatgcttgataaatctctcttttctgaaatgtctactgtaaatttttgcagattttttccaccttgaatataatccttaaatgttttaggtttttagggctgggtgcgatggctcatgcctgtaatcctagcagttttggaggctgagctgtgcaaatcacttgagctcaagagtttgagaccagcttggccaagatggtgaaaccctgtcactacaaaaatgagaaaaactagtcaggcgtggtgacgcatgcctgttgtcccagctactctggaggctgaggcaggagaatcgcttgagcccaggaagtggaggttgcagtgagccaaggttgcaccagtgcacaccagcctgtgcaacagagtgagacttcatcttaaaaaaaaaaaaaaaaaaaaattttaggttttcaaagtataaagatgaataacatttttgaaaaaaaaattaccataattatagctgagactaattttttcagttttattttcttaaagcattttataagcatttatatgctttagagccactttttttcaaaccctgggccctgtgtaagtgagtcatatcatctaaggcacagctcatatgtcagcttttctaagtcttttctaactcccacaagtagcgttaatacctctgtcttttgtggcacttaccaggttggattttgaaatccttaaaatgtcagttttctccgcttatataaatttttccagggcagcagccctaatttattcatgtattcccaatgatcggcatatactaagcttagcgttctgtagatgcttgtggaatgatgaaaaccggtaaatgaaatgaaagttgtaataaagttcagattgtttaatagtttgcttgttttggaataagcaaatacattagctgcctttggcaatatttttattgtacagaaatttctgaagtgctaatcgtaatgtgaattggcttatagttgaatttgagacagattcttcaatggagaaggtggaggagatcagctcacaacttctgctttgcaacctaagagcgacttacccaaccatacctctttcctgcccctctcagtggaaaagatggccttgtttcagtctgtgcataagtacgcttatcctggctgtgccctagaattctgtctcatcacttctggcctattctcagatgtcctattagttaacccataactgtttttttctcctttgtttaggcaatggtattcaaccctggcttgtacaatagaaacatttggggatcttaaaaaaaacctgggcctcaatccagataaattgtatcagaatcttagaatcatagttggaggagataaaagttattttatgaaggaattgagacctagagactttaggggacttttctaagctaatgcttctaattagtttaaaaacttgaggcaagaactgtggttgccattcccatcccattgtcccagaatcattgaatcccattcgtttgatttctccttggttttcatcctcttactcttccttttcccagtttattctactctttatgctgtttttttattacatccgtcttctgctctttaagatgctattattgttttattatgccactctcttgctcagtaacctctagtagctcctttctacctatggtggaggtaaaaatgagcagttcatgttttctcctcccttttcccccattggatcttatgctgtagctaggggatcgtttcctgacttctatacagctatatatttttgagaattttacaacattccataaactgtacctggaattccttcctcctttcactttgcctacctggttcctacaccaaataacagaatgttagctctggaagattataatcatcctttaagtcagtttttgaaattacaaatagaaaaattgagaccctgaaattttaaatgattccccactgcccatcacccaggtcacaaagcaaattagcctcagatccaggttataactaatgtctctctgttcacttttcactttgaagatgtaactgagatttgaccgtttctctcaaaccttctctaatcaacttagagggtctattctggcctccaaactttggtgccattttttaaatcatgggagcatttgtgctttctcttgtagtaataattagcagtgacattgctaacctctcacttctgaactctggactgttaagcatattgcttatctcatttaacctcacaagcacacatagatattgttatccacattatagaagtaaggaagctgaaatttagagaggtaaagtcttaaagggtcaaagtttacatttgaatccaggtctatctggtcacagaactggactcaataccctgtattgtaatcttttacacagaaagtttgaaatgtaaggctctggataacaataaataggtcactaaatgtctttaaattttctactacatcatcccagaagagctcagtaaatatttattgacttcagttggaaagatcataacttttgactgcatcttgaaggtaaaggtgttggtgtatgtcagggaaggaagcagaagaggagatgggaagtacaagagtaggactacatttaggctctagatctaggaagaaggcaaaggtgtggaggtgattgaagtttctttggaatgatatggacagcagaggttcataactgttctcatttgctggtggtaacccaatattacatattgattcacctgtaagagtttgcgatagcatctcagttgccattgtcattgctggctttgctcactgttgtatttggcatttccttccttaagtagtcctgaaactgtctcacaacaagagtattaacaaatacctttccgtgtaagattggttgttttagccaacagaggtctcggatgcttttcttaggtaggatcttgaactttgtcttcttaactaagagctcccaaactggtagcatgcttaagctgtgcaagtcattttcttgtggatgtgggatgtgtgaatgattgtccttttgtagtcaggcagttaggtgtgaagaatcttttctcccttcttctgcgtgttaggaaagtgaaacccttaagctgtttaagtatattgattttgcatttttctaggatttaagtttagtcttgtttgttcttttgaactaacccctgtaggatattgtgccagcttaattctttagtgatcacaggaatatgggaatgaacccaaccttcagatagattcaggagttgtagggtgatctttcaagtatagttttcaggacatttcaataaccttttttaaaatgaatgccattacttgaaagcgaggataagtgacatgttcaagccaaactaagtgtaggaagagcaccagtctagggataagagacctgagttgttctagtccttattttgttataaccagttgtatgattttggaaaagtaattttgagtttaattttcttcatttctttttttgacacagggtctcaatttgttgcccaggctggagtggagtggcgccatcttggctcactgtagccccggctaattttcgcactttttgtagatacgaggtttcaccatgctgcccagactgatctcgaattcctgggctcaggcaatgtgcttgccttggcttcccaaatttctgggattacaggcgtatgacactacacctgaccaatttttgtcatttctaaacttttaatgagttggattatattatactgtcccccccaacccccaatatgtttattggtctcagaccccaaattcagtttgtttctcgtagataggaaaccatagttaacattccctttgtgtggttaagaaaataggtctctagtgtcaacttgcagtagtattacaccttgtagtatgttcagaaactggcatgctgactttatggttctccatattcattagatgttttaacagtcataagctctttctatgcttatgtcttcaagtaattgttggtgatgatagatttagcccttcagtttcattttttattgtggtaaaatacatataaagatatattaaaaactatacaaaaatatgtaaaaaatttgccattttaaccatttgtaaatgtgcagctcagaagcatgaagtatgttcacaatgctgtgcaaccatcaccactgtctatttccagaactttttcatcatcacaaacacagactctgtacccgttaaacagtaactcctcttcctttttccttgcagccccaggtaacttttattttactttctgtttatatgaatttgcctattctcagtacttcataaaagtggaatcatacaatatttgtctttctttatctggcttatttcacttagcatagtgttttcaaaattcattcatgttgtagcatgtgtcagaattttattcctttttaaggctgaatgatatttcattgtatgtatatgtcttacttatccattcatctattgttggacatttttgtttctaccttttgtctattgtgaataatgctgttatgaacattggtgcacaaatatctatttgggtccctgctttcacttcttttgagtgcatacctatgtgtggaattgctaggtcatatggtaattcttaaatttgtggggaacaaacagacaattctacaagggatgtgccattcattctatattcctgccagcaactcataagggttttatttcctctacctccttgcctatacttgttttgctccttccttccttccttctttccttctccctccctcccttctttctttctctctctcctgtctttctttgtctttctctgtctctttttttcttttttaaatcatagccatcctggccaggcacagtggctcacgcatgtaatcctagcactttgggaggccgaggcagatgaatcacgaggtcaggagttcaagaccagccttgccaagatggtgaaaccctgtctctactaaaactacaaaaattagccaggtgtggtggcaagcgcctgtaatcccagctactcgggaggctgaggcaggagaattgcttgaatccgggtgacagaggttgcagtaagctgagattgtgccactgcactcccaaagtgctgggatttcccagagtgctgggatttcaagcgtgagccaccgtgcccagccttaaatttttttttgttattgttagtctttgatttttaaatgtaacattgaataaagaggtaccattatgaggttagtacacttaacttcagcattggtatatataaaattgttaccttatggttattattttggcaggactggtagataagaatacatcctctttcatacagtttttaacaaataataattcttttgtgacttgagagattaagagctgtagtaaacagaatttttttctgttacttttctgtaaagttccaggctcgagtccttgggcaagctaacctagcaagtgagcatacgttgtaatatcctgggatgatggtcactctgcctcactactggttcttgagattaaagtataaatctgaaagtgctttgtgaactgaataatgccaatttttattttttactttggcccactgagatactgtgaccttctgtgcaagcgagtttttaatcatgagggaaaaaagtgaaggtttatgtagcacttgtctttaaaagaaccaaaattatttcatttattccctttacattctcgggagctgaaagaagataaatgctactgcattttagggatgaaaaaactgaaggaaggatgaaacccttgtatttttccatagctttgtaaaccactataccagtccctcttcaagcaagactttattgtgctggctagggctgtctctgtggttcttgacatggtaatatataggaatattatatatgatatatgagactatatgggactataactgatgtaagcttggtttatgagcttatctgataagcatttctttgagtagttttctcttcaaatgtgtttttagggatattttctcagggttgaagccattttgaaatttgctgtatagtttaaacaaatgccttgcttcctctcccttttataccctcttcactttggagtaagtgtagctatgctctcttcaagaaagagtttcatggcatttaaagaggaaaatattatcttctgccaatgttaacattaacatagcatttctttttctaatttttttctagttctcatttgtgtacatcgataaatgccgccttcagaattggagaaaggttgagatagaaaacatatattatcagagcttcatggtcaaaagattcattttatagtgacaattactatctcacaggttggattatttgtttcttttggttgtaaatgtttacaattctactgaattttcagctagtgtgcttataagttattttcttttttgtgtggcaattcatatgacagaagaattgaatgaggaaattaggaagttttgaactgtcacatttgctaggagttggatttaatttattattagtaaaatttccagttaaataagataattctaatatttataggttactgtgtattctttcagcatgctccttggtacaaaactattcaattgaatttactaactatatatgattatcttggagccttttttggtactctatcagctgtttctatggtaattttttgttcattgttatcacttatagcttactctattatggctttttaaaaaaaaaatctctgtatattttcttatccttacttgtttgcttacttttctaaccattagtctaaattgacatttaggtaaatttgcttttaagttgaatacttaagccaatgattcagtcattttgtcttttctggggtgggtagtgcctactagacatttaattgtgctgcattttaatatttcttaccattcattataaactttttttttttagacaggctctccctccgttgcccagactggagtgcagtggcaccattttggctcattgcatccttaacctcttgggctcaggcgatccccccaccttagcctcctgagtagctgggactactggtgcgtgccactgccatgccttgctaatttttgtaccttttttttttttttctgtagagatgggattttgccatgttgctcgggctggtcctcgagctcctgagctcaagcgatctgcctgccttggcctcccaaagtgctgggattacaggcgtgagacacaccatgccctgcctctcaatacactatttaatacatcagaccctttggtacctctaggcagaggaccgcaattaatttatgagcagctgttgctgtatacatgtaattatgtttgactacaaatgcatctttacaaaatgggcctagtggaatcataatataaatggttcagattaacttaattcagattaagaaaattgtttcatactgaggtaagcgattgaaaaattgtctatttaaaaatgcagtgcattttaaagagttactatttgaggatctaaaatatacagagaaggctgcatattttactttgatcttattaccatccaaaagaaagcttacatagaaatgatttgtcactttctgctttctgaagaagatatatgagtcttttagccaggtcctggctatttagtcagttgagaaatactttcattaaaaacctattggtagaaatttgccagtttattgagcacttgctcaagtagttgcttttctgagaggcagtggtgagaccaggatgttccagccccaaggagggccctgtagcccatctcagcctggccatgtcgtgctatgagaggttcctctatccattggtcaaggaagggatcaggccctgcagtcacactgcctttgcctcttgccgactttattcttgagcgagtcacttggcagagcctctggtttctcttagggttgctgtaagcatagagcacggggtcctggtagggagcagataacagtagggccctgaaccatttgttaaagtcattgaggaactgcgaacagtggttctgaatagtttttagtgtgtgtgaaactgtgattgaaactgtacatgtgtggaaagccacaatccaattgtgcaggctggggtgctgcataaaaaaaaaaaaaagaaaaaaagagaaaaatcctcccttgaggattccattgttggataaagggctcagaacaatcagatcttgctttgggctttcaggtattgtggcaccaacagctgtattctgttaaagatcaactttcaactgtttgatagcagttaaatgtcactggaatgtttaggcaattgctttgtaatttgacaggcatctctaagtttttccgaagtaaatgtattaaatctgagtcagcctttgacatgtaaatcacattcaggattccatgggcgttgaggtgggagaatgaacttttaatttctggaattaatttggcagtttaaaaatagagctgtgatagttctaatgttgaatcctttctgcgtgtttaaaaaattatttctatagaatgaaattgtagaatgtaagtatagcttctgaaaggacagttattaatgtgctatttagccaggtggttttcagaatttgactagtggaattaagcatgctttttttttttttttttttttttaaacaaatgctgaagtagggtgggtgtgatattttcaggtttttgcaaaaccctaaactgttatgcttttcagtcctaagcaaaacagaaaaaaacatcagtattcccttgatgcttttcccaagtatagcccactaaaggaggaagttgtaaggagacaaagtcttgtatttccttaccagaattttgggaagtagagagatgttagggaggaaaatacccatgcaaatatgaaatattcaagatttttttccctttagcattctctgtccattgttaccactgatgagttatactgagtggaagatgggaaggttgaaacgtttgctatttgatagaagcaattgatctcctagagagaattgtggtagctttgcagaattctttgtaaccctctaaagccaagttgatcagtcattttggtgtacccttagtaatctggctattcaaaaatgcaacaagggttttatagcatttgtatgtatacatggagataaaaggaatgaagacatggcaagtgtagattattttagagtgagaaatgttgctttagataattattacttagagcatttgagtcacctagttacccaagtatgattggaggtcaataatgaagtgaaaaacatgtatatataaatacatacttatctgtggtaggtaatgtaccctgaagaattttccatgaaactggttttatgcgatattaatacatatttagataatttggtatatgatttagagactgtatgatctttttttcttgtgatgatgggaacaaaaatcttgtgttgtttgagggctacttcagtgaggtatgtgtacttagacaatgtagtattatagtgttcaaagtatggaatcagatttaatgatttatcatatatgtaattaacattttctcttttaaaataataaaacagctagagtcaacttttcatatagtctagtatgtcccgagcaccagacattgggatatttttagttcattgctttattccttggagagcaaaattgttgcactaagggatgacccaatccattcgtgacaaataaatagaacatggccaggtaggctcagaaggggaaatgagttctgtaccagcctagaaaactgctttgtgcccatcatgaaaggcttgtttggcatatactcttctaagtggcctaataatcattttgtccactccagaaatagtattttaaaacacgttaattcttagaaggtgtcggtaatcctgatgttgctctagattggtagtgttagttggtgaattgacatcatctttttactgatagtggtaatgaggggtagattgacttcatgtattataactgctaacttttaaactcagatatctaattttaaaacatgttgaaaccttgctttctgtttactggtatttgctttttgtcaggtcttttgaaatgatctcggcagacaccaaataagtatattatatgttggatatttgaattttgcttaggcacttatgagagaagttataatgtaaaattttcattttgccttccttgggaatagttcaagtccttgcagtttggttttaatttttaaaatttttaaaaactttaaatttttgtgggtatgtagttggtgtatatgtttatggggtacatgagatgtttttataggcatgcaatgtgaaataatcacatcatggagaatggggtatccattccttcaagcatttattctctgtgttataaaagtttcatataaacttttcagaatgatgccagccctattgctatgacggttggctcctggtgccactattaatcattggctgcattaagcattggccttgtatctttttggcaaacatttgagtctctgcaggtttgtgaggtaatggataattgttggacttgctaggcaacagcccgctgagacccaatctgttgtgttccagggggagctataacagctatgttggggcctgtccctgtggaaaggagcttatttgccttattgtcagcttttattgtattaaaatacacacttggatgtgggtgatgcacatttagatgtgagtctaacttgtaaggcttgctgttatgacttgagtatatttcagatttaatagaatcagttatacctgatggttctggcttgcagaaagaaaagacaaaaaaacaaacaaaaaaaccaataactccaaacccagccctgatacagatagaaaatttaactttttaaatatttagttatcaaataatttccatttattaggaaaaatgtgttttttccaatgtattttgcctgctcaatctcttacgtagtaagtatttggaatgagggctgtaaaagtcataagcattcttgtacttgagcttatttagtaagtcagacaaatgagttatgtagataaaacaatgacagagtaagttttagaccagtaacatgtattacatgcattgaggtacctaaaggaatatgtagtaagggaagaagtctgggaaacattgatgaatggggctagaaaaggcgagggaagagaagagtggaggtgagatgaatgcagaggggccatcttgcacataccgtagagggctgtatggctttccatacagactagaggagttaaaatttcatctgcaggccagagggattccgttgtagctgttaaggtgtggtatggtgaaagtagcattgaaacaaatgaatagcatttgcagagatgtccagtatggtttgtgcgaaaggcctaaactggtggtgtataccaggaaagatgggtttattggtacaaagtgactaccctcataaagtgacatttactttgttcagttctctttagcccagagtttgagcctctgctttagatacacagattcagtcttgtcagcgtcttgttaatagggcttaggaaagctgaaccattcctttcctgctctcccccaagcaagaaaaacaaaaactgaaaacccaactcccacaaacaaataatgagcctttagaggagatgggagggtatgaattagaatgccaataaatacacacatcatcttgtctactgtgtgtgttctgcttgttggccacatggcacattgtcagatggtgtattatgggggttgaatcagaactggaaggttggttataatgataaagcttatgagcaattccttgttatttcttgtatctgttatctgtttgttcctgggctaggtgcttcctcttgttcatacagcttcaataaaatgaatctagtccctgcccttgcctgtccactcaataaggctattcttgctagaagggactaagttcctaaattccttctgtctttcctcattgctggctggccactcttcagatttacaaatgtataaaaagtctttttaataatttcaatcatagtatctttagcctcagtgacctgggggctgtttggtattttttttaggtgactttgaacggctttgctttgatccactttgtgatgacttttgtatactcttaaaggataatcttacatttagatttcattttgcccctgtgtactgcatacaatttgaagtggaccaagattgctggcagggaagtaaatcaggaagtcagctcatgggttcagcttctgactgtgagcttgctttgctgcttgtacggtatttccatactttagggggtttggagtagagagtttgctataggaacaaagacagggatcaatctaccaacctttgcaaggaatagatgacagacactaatgaggacaaatgtgttttaaagaaaggatggagtcagaggcaactctggagtgaaagcccaagggggagtcagttttgtgggaagatgattaatttttgacagagccacagtagatcatccaagtggagatgactataggccagtggtttggtgtggtttgatactgtgactttgccgattgatcaaggccagaaatgtacatttgggcagtgtaatatgaaataatcgctgtctgatctcgatcaaatctgttattttttctgagcatctttaaaacaagtctataaaaaaggcaacaattcatgccgtaagttccttaggatgttggtttcatgattaataataaaatagctagcactattgtggtattatgctaagtacttttggatgtagtatctcatttagccttcaaaacaagttaggaattggattcatttgtcccagtcataccgggggggaaacaggccttagaaaggcacctacagtcaccattaccaagagtggtcttggaacttgtgggtatctggctgctattcttaactactacactgcatttcccctcagataatttatataaaagcaatctaaaaagcataggcttaaaaaaaaaaccctgaaataagcagagtagagtgaggcctccaatgagaagatggtgggctgaactgagttttggaatgatacccatagaatgaagaatagagaggaagaagactgttcttaggagaataaagggaattaagggaagaatggctttgaatccaaataaaagtgtattaaagagaagatttaatgttaaacatcagctgaggatataaggagagggtaggaaccaaaaattctagaagctaacctttttttattctcaggtatcagttcctcagagaaggctctaaggttagttgggacagggtagtctacgatctgtgactacccagtgtttagtataacacctagtgcgtcgtatgtgcttggcatttgttaagtaagggaattatgttagtagacatctgggagataacttgagtaagacacggtcggtccttgcgctcaaagagctcttggtgcagtcagggaatttgattgttaaagcataaataaattactgtgtgctggtgaatagctcttgtggttgatatggtgctttggcttgtgctcctcatttctgtcatagaatggcttatgacatgccattctacgacagagatgcttagttttgggaacctcttgcagctggaaggcttagccgtgccacacctcttccttggcctggatacaagaccccttatactgaacacacctctttcctggcagctctgccacactcttaaccataaacccaacacacgagtgatatcaaatgactcatttacttcttcagcatgccatattgtttcatcacacatgggcttttgtatatttgttcctccctctgcctgctttctcttctcctcacctgtcaaccttctgctgatcttcagagtttagttaaaaaaaaaagtgttcattctgctgagtttttggcctgccctcacccttacagcatttggcttctccttcctttgtgattctgcctctgttgtagacctagagctctgtaaaattatgtgtttccatgtccatctttcacagtgactgcagggctttgtccactttcctccttttttttccagtgttcagcctaatgcctgagtcatagggggagtatccaatacacagatcctgaatgagtgaaataataatggctgactgtctctcagaaaatgacagttttctccaatatttgttttaaaaaaggtttatttatttgatatgggaaaaaagagttaaatactcctatagacatagagttcttttcaggaaagggatatatctatatatctatatatctatatatctatatatctatatatagatatatagatatatatacacacacacacacacgcacacatttttttttcttcttctgtttttgagacgaagtctcactctgttgcccaggctggagtgcagtggcacgatcttggctcactgcaacctctgcctcctgagttcaagcgattctcctgcctcagcctcctgaatagctgggattacaggtgtgtgcaccaccatgcccggctaatttttgtatttttagtagagacagggtttccccatgttggtcaggctggtctcgaacttctgaccttgtgatccacccgcctcggcctcccaaagtgctgggattacaggcgtgagccaccgtgcccagcctatatttttatctactgaaatctttggcttactaaatagtagatggaattaattttggagggaagatgaaggacaacacaggaaaataaataagaaataataggaaataaattaggccgttgacatcctaagaagtctttataaacgtttagggtagcagatgaaataataaagtctttaaatattgcatttattacatagtagtcacatacacatgtgaaaatagcaatatatcattatatggaaggaatactttgcattattttatgaaactttatgtaaaattgtgtaaaacttatctaacgtagttttttaggacatactatattcattttcttttatattgtttgagattcaatactttttactaatttattcaacaaacatatattgatgccaagcaatattgtaggtaacggaaataaggtggtttacaaaacagacaaaaattcctgcccttgtggaaatcgtcttctagagttgagtctggtatgatgatgtcacaagaattttatccagaaacatgtttgattacttaatatctacgatgtctccaagaggttagtgttacagaattccatttaaaaaatatttttaaaaggcttatatacaatggtattatttacagtttgaaaggaaataataacctaggagcactagcactggatgatgatgatgatgacactgtttttatgatagcagcgagcacagtttacttacctggcacagtgatataactagagtgctttgattcatttgaaccccacacttaattttgacataggtgctatcagttattttccttttacagttgaggaaaccaaggcaaggagattaaatgacttggacagcagataaatatggagccaggatttgaactcaagcctgttagtaatttattattcaaaataaagcaatggagagatttttccctttaataagagactttgtgaagatttgaatataaagctggtggagggttatctatatataggagatagatagctcctatagataactaggagtagaaagaatgtagtagaaagaatgcagtgtcacgttaccatgtgacaggagtagcagggcttcccaatctccaggccatggactgcacagcaggaggtaaggggtaggtggccattacctcctgaactctgcctcttgtcagtggcattagagtctcataggagcatgaaccctattgtgaactgcacatgtgagggatctaggttgcgtactccttatgaaaatctaatgcctgatgatcagtaacggtctcccatcacccccgtgatgggactgcctagttgtaggaaaacaagtccaggggtcccactgattctacattatggtgagttgtgtaattatttcattatatattacaatgtaataataatagaattaaagtgcacaataaatgtaatgcacttgaagcatcccaaaaccatcccccggccctggtctgtgaaaaaattatcttccacgaaaccagtccctggtaccaaaaaggttgggactgccggcttatagtgtggtaattatgagcactactggagcttgactgtctgggttcgtccttaccaactaggtgccttagtttcatctataaaatgggagtaagaatagtttttacttcatagggtttttgtaaggattaaattagtatatacaacagaatggtgcatgggaagtgttagctaatgctcttgctattattgtttgtattactttttttttttcccagacggaatctcactcttgttgcccaggcaggagtgcaatggtgcgatcttggctcactgcaacctctgcctcccgggttcaagggattctcctgcctcaggctcctgagtagctgggattacaggcacctgccaccacgcctgcctaattttttgtttattgccatttttaaataggattccctttttcctgagggtttttattttgaaaaagttgccatattttggggtgtataccttgcttgcttccctgattcatttttttgttttgtatcaactgggaggttttggccagcattttgttcagagggtagtggtgtgcagttctttaagtttatgtgggtttttaaatgttttccattaattctcgtttgctatacctgctaatagttagagccatcagtaggtgttgtaacctaggaagtccggcagtcttgaaatgatgtttgttgaaatgatattcttctgcatgagctccttctgtggaaagatcacagcactaactaaactcccatgaagtgataagaaagggagaggtcagagtgaacttaagaattgttccaagcctagtgtggtggctcatgcctgtaatcccagtgctgtgggaggccaaggcagaaggatcacttgaggctaggagtttgagaccagcttgggaaataaaacaagaccctgtctctacaaaaaaagttaaaaaaaaaaaattagcctggtggggtggcacatgcctgtagttccagctccttgggaggctgaggcgggaggatcgcttgagcccaggaattcaaggctttagtaagctataatcatgctactgcattccagcctgggtgacagaacaagactctgtctcttaacaacaaaaaattgttccaagagcattactggcacaatgagtgctgaagagctgaagagccgaagactcatgggaaacccccctcagtgaactgagcaactttgatggaaatcatcagtaatggcttggttgaccccatctaaagaatgagccaaaattattgattggcatctctcaccaaataaactttagatatctagcatgaaaaatcaatccatcagtcttttcactgtcatttcattcaactgtgaataactccagtgatgggaatatcttgaaatgtgtggaagcagtagatagagggaatcactttgggtcaaggaggatgtaaaaggtagacttgcagatgatttagaacatattaacagtgagaacactacatagcaaaacttgagagaggctgcagaaactgatatgagatgcttagctttaaattacagacatattaaatgaaaaaaatgtaaaggagctcagccttatatttaagacaatagaaaaaacaccaataatttatgtacataaatatgagggagttaatgatatgaacaaatattgtatgaaaaaaagcgaaaatgcaaagtgctaattcttgggcagggtgggagaaggcaaatcacccaataaaggataaccctttaacattttatctaagaaaaaagaaggaagagaaaaatatttaccatctcagattagaagacaatataaatatatacatctatgttaatacttttgaaaataccagcaaaatagaaacatatgttttcctccagaaaaacagaaaaccttggaaattagtaaccatgtttccatggttattagactaaaaaatagtggttgttggacctagactatgggaaagtgttttcatactgccatggaggagaaactcccacactgttccagaaaatagaaatatattaaagcattcttgaatttttaagctaacataaccctggtaacagtactgaccagaacagtgaaaacaggaaaactacaggtaaatgtcacccataaatatatgtaatgccccagtaaaacagaaaaaaaatctattatacatagtatattaactgtaattcattttagaaatgaagaaataatatacaatttcacacttctttaaagaattgattgttaactaaaaggaaaacataaaatagttttgctagataaagcattttatgaaattccaatattcattcaggaaaatgctaactaatttaggaatgcagtataattctctaccatgctaaataatgtctttgaaaataaaatccaacattatacttagcaatatgataatagcacagatttcttaagttcaagatacaaaattactacttttagtcatttatatagttgttgaaatttggcagtacaatatgacaagaatagaaatgatcataaatattggaaaggaggaatcaaaattattctttgcagtttatataatatactgtgtgcaaaacttaagtgagtctagggataaccaactagaaaatttatgtaaagaagatcaagatcatatttccagtttctaaaaatgcaaaactctgtttcctaggaacaaatctaacaaaatatgtaaaatctttatggataaatcttgaaacattgaaggatgtgaaagaagggctggataaatggagaaatgttcattgtccacaaatgggaatgcttgatattgtaaagataacagttttccccaaataaatgggtaatttcagtgaaaattcacgcatatcccaagtagggtttttatgggtcagccagtcctaaagttaatatgcaaatgagcatgtgttgaagaatagtcaaaataattttgaagaacaagttgggaagattttgtccctaccacatatcaaggctgttgaaactattgtggcaaggatagagaattacaccagtaaacctgatttgaacggatacaagcctagaaacttaatataaacgaatataacgaagcttgttacactataggagcagtgttataaatcagtagggaaaggtaaactattaaataaatggggtaaacatccactgattggtctatataaaaaaaattcattccctacttcataccatatacaaaatgcattatagatgtatttatggatgcattacatttagacttaaaggcaagaagccaatctttaaaatatttagcagtaaatataagcattgttgatgagttggcggggaggggacacacagaacatcataaagaaaaggattcagaaatttgattctattaaaataaacttccatacgaaaaaattaccacagtgaaaagaaaaggttcacattggtgtcatacatttgtaaggcatgtttgaaaaacattgctagctgcctacctcgcctgttcccctttctttaccaacacaaccctgattttgtgcccatttagaaatagctgtctcatctgatgtcctttagaggtctcagtggtggccaatgagatgtgagcttaggatttctgagaaagttttactccttgaatatggggtccggtctttcttcccccacccttgaagtggacataatgtttagagctgcggcagctgtcttgcagaggtgaaaatgaggctagtgttaaagacggcagagcaggagggcaaaaggaggctagtttcttgatgacatccttgactgtgtacaacagccatggcttgcttactcctgtacttgtagtcagaatgtacttgggtctgttctagctaggcctttaggtagccttggccaagtggcaatcctgttgaaaatagcctatatgctacaaggattaaaaatctagattatatgaaaaactgttacaaattaataagaaaaaggcagataacctagtagcaaaatagagcataattgtacacaatgcagagaaatggaaactcaaatggccaataaccctgagtctcactagtagttaggcaaatgtaagttaaaatggagatgttttaataaccatcataatatgagtataaaaataccagtgttggggaagattcattgttggtgagagcctaagttggcataaccatcttggagaacagtttggcagtgtaaaactgaccataccatactagctagcaattgcactaggtatgaactcttgagattcctgtacctgtaggtgaagggaaactcagaaggcatgcttattgacacattgataatagcaaaactttggaaccaacctatccttcaattaggaaaaataaagtatattttataatgaagtactgtataggagttaaaatgagtgagctgcatatgaactacatagagctacatatattaacataatgtactaaaatacaaaaaaactgtgaatatggtgagaatttatataaaatatgaaaacaataatgaaactatgtgaagtactgttatcatccattgagagatgtgcaaactctgataaatgatttctactcatcagtgaattttctggaagcctaaaaattgatttttaaaatccagccaatgttagtttgttttattcccaacaaggttttacttgctgggatactgaaaccactgagctgctcctagtccagtggtataatgttaaaatgtaaaacactttgcaaaacatgtttatgtatatttttatttaagtattctaataactttatgagataatatgacaggtaggatttttattgtaactcaaattaagtgatggtagttggacttgaacttaccatttccgatgcctagtttagttctttttataatagtttcatagtgtttttccaacacacaatttaatgtctaggtatacttcatttatgcagcagatttattgctgaaaaagtcatgtgcaaataagtgtttagaacaagtgttattttaaatgtaactatagtggctttctaatttaagagacccagtggtgagtctcttaaagtaaataatggcttactaatttattgccaggttttttttttgtgtgcgaatatagtagtgctttttttttttcttttagagacagagagtctccctatgtcacccaggctggagttcagtggcatgatctcagctcactgcaacctctgcctcccgggctccagtgattctcgtgcctcagcctcccgagtagctgggattacaggcacatgccatcaccttagtatgtacaggaatcatcctgggaatttatgaaaaacacagattttctgacccccttgtttctctctgttattatgttggtttgttaagggctgtgagtttttcccattcattttggtattctctacagtgaccagcctggtggagtgtgtgtgtgtgtgtgtgtgtgtgtgtgtgtgtgtgtgtgtgtttccttattaaatgcttaataaatatttgcaggatgatttcaggaagagctttccagaagcgaatacctgaacaaaatgaatactgtgttaattgtggatggagaatactagaaataattcaatgctgtttctagtgtgtgctgaaattggttttcagttaagctgttaagcattatttttgaaacattctttttactggaaagatcatttaaaaacatgattattttaaaattccacagaataattttgctggaaaaggtataacagaaaataactgaatggaaaaaaatcacgttgtttcaaacaattatcccaagccagcttggaagttacagttctcttctcatagaagatttctttagccacaagctactgggaattgttcagcccattggcagctacacagaacattgcccttttcaccctgtccagcacacaaacctagacgattcatagctggaacctatcttcaagaaagtgatggctttattgaagccaaatgtccagactttttcatttagacacatgaaggaccttcagtgcttttgccatataaaagtgaaccacagagacattcttaaaaacaacacccggaagcaaataaaacacctgaacttactgtgtgcaaattacagatgcagacatagcctatttggcagtaagtacatctctctgtctagctcactctatccctcttcagtactagctgtgtgctttttaatatagtaactgtacaataaatattagttgaatgtaggtggaagtaggatgagaatgaacagaaatcagtgaccaattctgtatttttcatctcttttgttttttagaagagtccagttttgttttaagatgagtgttctaatagggtgaatttaaaaatgtaacagtagtaaagagattccttaattgctcatttagtttgatttgaagtaaatcttccccaggctgaagttttctactgtgggccaggaaacccatgtttaaactgtgaactcgagtgctttatcttcttatgccagacctctggataacgttggcctagttgttctgttgttgtttacttattcgaaagttattcttgtgaagatgtggaccattaactcaagaaatctctgtttttactttttggtgattgtcttacaggctattttatgatagtggtgaacagcacacaaaactccttcagaccctcccaagtgagtttccaacacagactctttcttcttgctctttccacagatgctttctcataagtagtatcgattacagatgtactttgatgatgctgataagctgataaacaataatgtgaaatctctttgatattctgttttgtttatggagatgaaagatagcctggtttaccaacattttcttaaggcaagcagggaatgaaagcatgtttacagttggttcctgctccactgtgcagtttatttaagttggaaaaattacctaaaataacaagatgtgccttttgtacctagatataggcaagcaggtctctttacctaccagacacccaaacattttcctttgaatttctattttgaattccttggtttgctttccggatttcttccctgtgtaatctataggatttattatgctggaataatttaaattcagaaaagaagttctgaatttgagcatattttacattagtgtttatgttggactctgactgaaaaatactcttttatcttctcttgaatcaaagtgtaatgggtcttgtgtaattgaatcgaggttcctttgcttattgtttttgtgtatggggtttttggacagtttctgaaattgtacccttttggagaggttgcctttgcgtcattgttggaacttgtttgcagttgcaagtcatttttggagacagaaaacgtcccttggaaaatattgtgctgatttttctttttacacaatctatgaattgtggagcttgggtcacagattgaattttggcattcaactctcccaggacagggtagtatccagcttcattttgtgagtgattacagatgcctttttaccatttggacttccttgtgttctaaataaatgaccagtctgtgaaattttaagccaaatgggatacaaagggattcctggtttttaaagggtcatctttaattttgcatttaaaaggcagcattggcttcatttttagaaattaaatacgttatagctgttgcataatttaccacctcctaccctcacctccccttaaataactgaaggagaaaaatgtgggttgattttgtatacttgaataagaaatgtgagaagaacttcggcttcatcctgtgacttgctcagatgtctttatgtgatccatagtattgtagaaaaacctcagattcaaatgaaagatatggtgagtgagtgggctgcctgagttttttttttttttttaatcacacctattttaactatttatttgaaacatggcaagttgagaatagtgggacaccaaggcacaattaagcatcaggaaatagcttcacgtgttgcccattgcatcctggacgatttggatataaaacagaaacagctgtgattccgaatgtcctataaatttcaaatgttggtgtggcacactttatgagctgatttaataaataactttgcccgtatgtctttggtgacttgctttcaattttctttacaaaaatgcaaaatatatggggccctttcttaatgctaaatgaaaaattgtgtgcatttggctctataaagcaaagtagccttgagatatgggcttgcctagaaattgactacatttttgtgggagaacgggtgaaaagggcagtttcctgtgttgctgccaaaaggtctgaacaatctgtagtagcttgtggctggaaaacaacttctgtgaggcaaaaacagcaactctaaactggctctggatatgtgtgagaaaatactcttttttctacttgattattaggcttcatagaaaatttcttttataaagtgaatttttaatctcaaccccttgaaaatggtattttagctgatttggataaaagtctggggaaatatatttggagtgagtgcaagtgggaaataatgtgatacttaaaaaaaaagtagcatttatattttgcttttattatagccatgtgcttggttggtaatccatgtttttctcctgcctttagagtgaagtaaattttggcatcttaggcatgtattttacaggattgggtcttatatatatatatttttttttttctttagttaactgattagaagtgtgttttcttcttagttcctcttgggcaatgtcttccattttgtagtaaaaacatgtttacaaaataatatgtgtaactactggtaattgccatttattagtacttacagtgtgccaggcactgtgctcatgttcttacattggttacaccttttacttctctggataggggaaatagcttagagagggtgtcatgtagttagaagatagttggaaccgggatttggagtcctgtctatgtgttgctaattattattaatacaaaatagttactattacaaatgttcattttgtagaatcaaatcagttaaagaagattcttgtagaatgggcttggatatgtggaatgaagatagagttggtttgacttggttttaatgtttttactaaactctttctttgttgcacttccgccatgcctgagcacctgtgtacctaatcatttaatgtaattttgtggtctcagttagcaattagcatcacatacactcaatcatgtttttatttaaatgctgcagactttgctttgctttactttgttggacttaattttcattttttttccctcttctattggggatatctattggcttttcattaaaatgcaggcagtagaccaatatggcataatctttttctcatctcaatattttgtcctattcatcaacatcagtttcttcttcattgtatagttaataagtagcctgatgttcatcatctagtatggtggttcccagcccaggtgatgttccgtaggggacattttttatttccacaacttgaaggtgtgctagtggtatctagtatgtggtagcccgccatgctgctaaacatcctacagttcacagggacagctcctcacaataaaatgttggtagtgcggaggttgagaaaccctgacttagctaacacagggcccaggctaaatctaatccgttagaagctctgacttcatgagattttttttcataacaaaacaactcagtagtaactagggaagctccccccgcccccatctagagtctccctcagttgcccagcctggagtgcagtgactcagtctcggctcactgcagactctgcctcctgggttaaagtgattctcatgcctcagcctcccgagtagctgggactacaggtgcgtgccaccacgcccagctaatttttgtatttttagtagagatggggtattgccatgttggccaggctggtcttgaactcctgacctcaagtgagccacctgccttggtctcccaaagtgctggattataggcttgagccactgtgcttggcctggaaagttgttctcttctagaggtggaggaagaggatatccatctgttttctcacccagtcctaacttagcacccatttactgtacactggattctctttcacttgcttcctgtcttcacccctacttaggggaggtcaccctttaaactgttacctgccattctattagccacggtagtcgactgcctattaagagtggtacctgaactaccttggcttggggtgggagagaagccaaagaatgaaaggaatacccatcaaagatatatttcacttaagacagttttggcttgaatgaaggtcctagtctgcctctcagaattatactgagtaccagagaatgcagttgtgattaagacataagtttgaagtacatgtctatagagtcaagtgttgatttgtaaatagaaagccgaaatacaatggttacatggaattttcagaagatcttgaagaaacttctcagttaatatctacaaaatatccaccttgttagtggaaaaatggactgatttattacctcagaagttcttgggcctaccgtttgtaattttgactaaatttgaaaagttgaaaagagcaacttgtagtggtcttttatgcttgatgcctttgcaggtacttgggaatctgtacctcctttcttccctccatcctttatgaatggctccagttttatcctacttcatcctctattcttatgctactttgcatatggctttctgtagatagttctcagaatggattgtgattatgcacttactccctgtgtcccttactaggctatgaggtcctggcacagtgctgattacataatagccagtcgctaaattttgagtgaatgaatggtagaggagaaaaagaagcaaacatcttagcagtcttaacactggatcagggaaaatggtctgtaggctgatgaaaagtcagggtgctgaggaggctcttgagtaagtgaaggtaggaattgttgccttagcttgatcatcttggtgctgtgcacgttcctttttgatgctggaggtctggatgagtgaggctaggaggctggcaggctagtgtgtggtcttggctatatctgcaggtccaggaggtgttaatgtttttcacctgaggttgctccaagctgaagaatgatctgcctatttgctggtatatggatttacacactcaaatctgatgtttttaaaaaattgatgatttaattctggccaggtgcagtggctcacgcctgtaattccagcacattgggaggctgaggtgggaggatcacttgaggtcaggagttcgagaccagcctggccaacatggtgaaaccccgtctctactaaaaatacaaaaattagctgggcatggtggtgtgtacccataatcccagctacttgggaggctgagacacgagaattacctgaacccaggaggcagaggttgcagtgagccgagattgcaccactgtactccagcctgggtgacagtgtgaaactgcgtttcaaaaaaaaaaaaaaaattaattaattctttatttctatcaggaagaaaggagttgcaaagcaatagaaatggcccttgatgtccagcagtgattgtacaatgacagcactcttgtagcacctggaattctgggcagtgcttcttactctgtctttgggcagacatgcttccttagccttcacttctactggcccttgaatttgaagaaacacagctccattttactctggggtttatatgcttatgtgcattagtgttaccattagtgacttgggttagaataaatagtaactctataatgtaaatgttttgtttttgttgaattacatgaaagcattaattagacacttgaattcaatctagagataattgtgggaaaagctgtttctttcagcgaaaggcccactaacagagcattggtgcttatcacttgtggccatgtcactggacttgtccctggcaaattgaacatgcctgattgcacagatgtttgcatggttgaacaaattatatttggacaataaactgttaggcccatcagtgattacggtggcagaacatagttgcatatggactgatttggtaagagaattaagagagaatattaccaaacattttcataaaaggggagaaaacaaaagcactctctgaaagtaaattttcctgtatttaatggttatgtggccttcaacttattaatattactggggcagatttaccttttttttctaaatgactagtttggttttttttttttggtgggggtgggtgacagtttgttaaacagagtttagatttttcctattggaggatagctgtggttggattatggctgggaatatgggaacatccagttaccagtgttacatctttttaagtctataatttttttttgctttatgtacaggtgtgaaatatgtacaggtacgaaataagtttctaagagcctgggagtgtggattgagtagggaattctcataggatttctgagaattgctaagggtctgtgtattagtctgttctcatgctgctatgaacaaatacccgagactgggtaatttataaggaaaagaggtttaattgactcacaattccacatggctggggaggcctcaggaagcttacaatcatggtggaaggcagctcttcacagggcagcaggagagtgaatgagtgccgactgaagggggaaagccccttataaaaccatcagacctcgtgagaactcactatcacaagaacagcttggggaactgcccctgtgattcacttaactccacctggccccacccttgacacatagggattattacaattcaaggtgagattggagtggggacacagaggcaaaccatataattccaacctggtccctcccaaatctcatatcctcacatttcaaaacacagtcatgtccttccaacaatcccccaaagtcttaactcattccagcattaatttcaaagtccaagtccaaagtcttatctgagacaaggcaaatcccttcggcctatgagcctgtaaaatcaaaagcaagttagttaatcctagataaaatgggggtacaggcattgggtatttaccattccaaacgggagaaatgaccaaaacaaaggggctacaggccccacctaagtttgaaatccaatagggcagtaattaaactttaaagttccaaaacgatctcctttgactccatgtctcacatccagatcatgatgcaagagttgggctcccatggccttgggaagttccacccctgtggctttgcagggtacagccccactcccggctgctttcatgggcttgcattgagtgtctgtggcttttccagggacaaggtgcaagctgttggtgaatctaccgttctggggtctggaggacagtggctgtcttctcacagcttcaccatgcagtgccccagaggggactctgtgtggggttccaaccctatatttcccttccgcactgccctagcagaggttctttctgagagctcgacttctgcagcaaacttctgcctagacatccaggtgtttccatacatcctctgaaatctaggtggaagttcccaaacctcaatttttaacttctgcgcgcccgcagggtcaacaccacgtggatgccaccaaggcttggggcttgcacctctgaagcaatggcctgagctgtaccttggccccttttagccaccacagctggagctgaagcagctgggatgcagggcacatgtccagaggctgcacagagcaggggaccctgggcccagcccacaaaaccatttttccctcctaggcctctgggcctgtgacgggaagcacctgctgtgaaggtctctcacataccctggagacatttttcccattgtcttgggattaacatttggctccttgttgctcatgcaaatttctgcagccagcttgaatttctccccagaaaattggtttttcttttttattgcattgtcaggctgcaaattttccaaactttaatgctctgcttcccttttaaacataaattcaaattttaaaccacctctttgtgaacacatacaactgaatgctttcagaataatccaggtcacatcttgaatgctttgctgcctggaaatttcttccaccagataccctaaataatctctcttaagttcaaagttccacagatctctagggcaggggcaaaatgtcaccagtctctttgctaaagcatagaaacagtgacctttacttcagttcccaacacattcctcatctccatctgagaccacctcagcttggacttcattgtcccatattactatcagcattttggtctaagccattcaacaagtctctaggaggttccagactttctcacattttcctatcttcttctgagtcctcctaactgttccaacctctgcctgttacccatttccaaagttccttccacattttcggttatctttacagcggcaccccactcccggtaccaatttactgtattagttcatttgcatgctgctataaagagatacccaagactgggtaatttttaaaaaaaagaagtttaattgactcacagttccatttggctggggaagcctcaggaaacaaagttacggtggaagacacctcctcacagggcggcaggagagagaatgagtgctgagcgaagggggaagccccttataaaactacaatatcttatgagaactcactgtcacgagaacagaatcggggaaactgcccacctggtcctacccttgacacatggggattattactattcaaggtgagatctgagtggggacacagagccaaaccatatccgtctgcttaaagtttgtggctgtggatttaaattgagaaaagttactgtggctattttcatttggctgcttgggtgcacatctgaagtaaggccaaggtaaatgtaaccataaatagggcgagtgtgttggaggtagggaggggcaaaggagttaagatgtgattggggcccatgggatccaagctgcttaaggaagggagtgaagactggggcactgggaaggtggtatgggcacaggatcctcagggttagagaattgttggagaagagggattgagctggaaagatagatattcagaggtcggggtgcatgaaattgagataattgtagagtaataggtctagggcaggatttttcaaaacctagtattagagagtcatgaccagcatttttaaaaaatgctaaaaaatctaactcatggaacttgtaatgaatcttttttttttttttgagatagagtctcagtccgtcacccagtcgggttcagtggtgcgatctcggctcactgcaacctctgcctcctgggttcaagcgattctcctgccttagcctcctgagtagctggaaatacaggcgcgcaccaccacacttggctaaattttttgtttgtttgtttttagtagagacggggttttgtcgtgttgactaggctcgtctcgagctcctgacctcaaatgatctgcctgcctcggcctcccaaagtgttgggattacaggcgtgagccaccgtgcccagccttaagtgaacttaaaaagaagttcgtcgggtgcggtggctcatgcctgtaatcccagcactttgggaggcagaggcaggcagatcatttgaggtcaggagttcgagaccagcctggccaacctggtgaaaccttgtctctactaaaaaatacaaaattaccctagtgtggtggtgggtgcctgtaatcccagctactcaggaggctgaggcatgagaatcgcttgaacctgggaggcagaggttgcagtgagccgagatcgagccagtgcacttcagcgtggttgacagagcgaaactccatctcaaaaaaaagaacaaacaaaagaaaacctaacacacaacaagaaggacttctttttgggaaaggaaagaaataaggaaggagaggaaagagatgcaccttttttttctggctgaggctatctgctgtcagggagaaggctttttgagtggaagggttggggctggatttagcatgaactcctccccaagcttagccttgagtcttgatcagagtgatcacatagtcatttaaaaatgttgttttcattaaaactgggtgtgtttactgtgtatttgtgaactgcgttgggatgtaaatatttccctctgggtcacagttggaaaaaattgaaagccagttcttggtgcatgaccgtgggaatgggtaactgagatagtgagaaaaaacaggattactgagatttgccttttaagtaggaatgcatacacactcgcatagtcttctgccctgtgccttatagaagggagcaggaatatgggtaataactaagaaatgtttacatttggaatacattatacatgtgaaggcttggctttagattctggctccccccaacactcccctttccactgactttaaacattctagagtggtggggaaaagcatggcccagaggtattggttgaacttctggctccacacagatagctccagcttcattgtcagactgggaaaaatagattagacaaatgtcaggttctagggcatctctaagatcttgtgagtctgtaaaagctgtgcaatgaggagaggggactttggatgtgctttgggtcacagggagagagctttctgggacatagctatgttgttgcctataaaccacatcaccagcagtagataattgaaaactgactactttttagaggtttttgaaggttaaaaaaaaaaaaaaactctgtaaaagatcaagtaagcaccgtcttgggaattgcaagatagaagttgcagcttcttcctttttctgttgtcttgactactttaaatgtatctatattagcattgacgtctgagtgtgtttttgcctttgcctttggaatgtaagtaaaaacagacaaacatatttaggcttttcttatccatttcttgattgttatgaatagtaaaatcttgatagaaagttgcaaagctttatgttgctttcttgactgaatttggaaggtgaagagtctagttcctgtttgtacatgaccgtcctggacagatgctggcagtgggaagcaggagggctacattcggtggctactaaaaaggaagggaaaggtgaccagggagttgtgtagtggggagttgggtgatttgggcagaggcttaaatttctgtagcccttcacccctagtctgttggagttcagagttcacaccccatctcctttacaggcacctcatttctgggtgggcttcttgctggaggagtggtgggggtaaggattctgcattgcactgtctggtgtgaatggagggtgcacttcttcctctggagagcacatgtgtgctagtcggaactccttactgcatgctttccttagaagtgttgttaggatttgtggttttcaagtactttcaggtgtgttaataggttaattgaccttcctttggtaggcctagggaattaatactccctttaatgactgtttctgtgaagagagaaaatgataacagtagctaacatatattggtgtttactttatgtcaagaaactgttattctacctgctttgttttagatttccttaacctcattttacagattgaggattggagcttacacccccaggttcacttttgtcattccctgtcggtcttactcccccactgtgcccaccccttcttcaatcaagccttcactccatctgttgttgggagtatgtatagttcttttttcaagctggtgactcaaaatcaggcttttggaatacaacctatcatgaagcagggactgtctatagataggcaggcagaacaagtcgttcacaggcctgccagatattaaataaaggtttagagctgtaaagtttggccttccaaggatgatccttgacaatatttgatgctatgttctataaaaagtttaaagctgataagttgtaagtacagggcttcctaagcagagccagtcaaatatgagtgtgttttatgttcaacagcgttgggtgggctcagagattcaagctgcaagctgcattccagggacagttcagacccatggctggtaatgacatcacctccacaggtgccaaattattctcctctttttttccgatataacctgcccatgcttttgaaaaaaggaaaaagaaaatgtttaagtactactgggagattttgttgtgaaaataagtatgaaatccaattctgggcatgtgtgtagaagtagggagatgacaatatgatggtttttgaaaaccatacagttccagaaattccagttttaggttacttgcgttcagtcactcccaagaggtttttgtgaggaggggtggggatggagaaagggattttagactagatgagaaaagtagtagtggaaaaacaaaactgtggttttgccctttctcttttccccctaattgaagactgggcttacagtgtttctaagacaactctgattggcagtgtatttcgaagaggctgaagagctctgattgaaaatgtcaagcttggattcaaaggattggatctttttatatgtttattgactacaattggaaatagagatcataaataataaaatgagacctggcctcatttccaccttcactgttaaaattatatcgtttttatctttgtatgctacattcatggcttatggaataaatctttaagtaaacacatatttttgtacatttcacaaagtgaggctcgtattctggttttgttgtcatttttcactcagtgttattttgtgtactctttgcagtgccaagtgatttttttttaaatgtagaattttataactaagtgacacttaaaaagagataactaatccctcctgctttaattttactgattaggaaatttagtaaagtgaaatcaaataacttgcttaaaactactattattttcatagctggaattagaattggttccacctattccagaacatttttcactataccattctgcctgttttactttatctactgggaaaagtttataaagtattgttttcctgtaggatgacttaaaagatcattgaccccgagggttaaatccatctaactgtaacgttgagtgaaaaattgagaccacccaaacacagctgtttagttaatttggcccaagcgattggaagaagtttgaaaaccattatgatgtggctggattgttgccattttagggttgtttgatgtgaacctgaaagaaatagaggttaaaaacacacagtcatatctgaagtatttctcttccaccatattaaaactaataaatccattaaccttttaaaatgattttgccaaagtaactatcatctcacatgccagattccttttactctggaatgtattcacttcattttgctgaattcctgtaggaattcgtagctgtgtaattcctttagcaattgctcatacacagacttacggcatttattctaatgtcaccttgaaatttgacctgtttattaatgttaactttccatgaggttgtctgtgttagcggtctaggttatcagctcctcagggacaaggctgttgtattgccattccccttctttcttctctctcccctccactttccctcgactccatagtgctagcagagggccttgtacgttctcagtattattgctaggactggtgaaaaacgttctgagtgcatttggggctaatttgaggacaaggtctcttctctgtgtgagtttatagttgtgctggcactggtgatcgaaggaatgcctctgaaaaaaaagcaagtctggcatgattggcacactttgaatcaacaggtagttaaagttctttttgaggcagtaatcatggcttcagactcacctttatttgcatttgactttagtctaaatctagacaaatctatatgtgacggctcaggtgaatttggtgagatgagaaggaatgtctgaaaaatagatgattgagaatcattagtttttgttttgcttggaaatattcttccacagaaatctttagaatattaaatttggcatcctaaagacttatggacaattttgtgcatttctcggctttctttatcttgagggaagaattgaagctggcatgggggcaatggagaaatttagttttgaaagtctaaggagagcagggaaaaaaggaagtaactttcgttgctaggatctacttataggtagggaaagaaggacaggaagaaagaatggaaagagatcaagaaataagggggataaacagccaaatattagggtgggattaattctgaatgtcattttgcaaagttggttatacttttcgttcttttccaggaggttttcaaacgcatggggtgggtggggaaactccggtagagatgacagcttaagtgttggagaaagatgacggaaactgtcctgagtgactagatagagtaggaagaaacagaactaaaaaaataaattcttttttttctggcagcactctgcgcttcttataatgctgtacttaacttgttctctagtgttgtaccaaaaagtttgttccatgtaatataaagaatctctgttttgactgactgcttgcctgcacatgcttgttcgcgctcacgtgctctctttctctttcccttgccctctctcttgctctctctcagctgcttgtctcagagtaggcattggagctctccctgtccctcaacttgttcaccatggaagtgtcaggacgtagacgtgactgattctatgagcttcatggagaagcagccacatcactttatagtctaagcacacttgagtgatagcatgtacgcactcatttacgctctcttctcttaaaataaaagagaagtgtctagttgtatagttggaatatacttggcagaaagtttcttgtgttgctagagcgggatctcatttctctttagtctttgtttattattcattatatttaagtaataatggagctgcactccagatcatttggaattatttttcatctgtttttgtttggctctggaaaaaaagaagtgaaataatttgggaattcatttcatgattggaaaagcaatgctgcttcctaaggatatttatgtttacctttgggctctattatcagtctcattatctcctgacccagggctgggcccctctgacttaagcactaggactggattgtgtcagcactgtacttaaggcgtttatcctaatccaggcgtccttggattgcacggtgccagcaagcaaggtggtaacagtgatcacagcctgggctgcaggtgtgagttctgaggagatctatggtttacccagcgaatttattactgataaatgtgagtcgatttttccttgggatgctccgttgtggggcaagtggtatttctgttttttactgtgttattctcctcaaacggaaggaatacctgtgaattttgtttcatagggtgccattaacccgttgatgtatggttcagatttggatttttggtagttgcgttggtcagatttcctgggagacagcttgtatttttcttcctaaaagttatgtgtaaccattacaaattatatttgagggggtgcagaagaaaacaataagagcggatttcttgttttatgcctcagttgtgagctttcctggataggcacccttcgcttttccaggcattctgtgttcctattttctgctgtgattttaacaccaacttgaacagtgaaggaagaagatcctccctacccagtctagtaaaggttatacacagatgagagattatagtgatgcctgtattttttttttttaaaaagccactattccacatctttatacggtatttacatctataggaaattggaaggtcaacagtgagatgtgcattgggaaaacaaagataacaagaggaaagtatatttggcaaaagtgagctccatttgagaaaacactgaggggtaaattcattcagaaatgtgagcttatcacctaattaatttcagctcattgcctggttgatttaacatgtttatgcaaatgagaaatacctggcaactattttttgccaggaggttaggtttctgcctttgctcaggatattctaaaaagctgatctttcagtcagttagctcagtctaaaatttctttgattctctaatatctgcataataaagggttggctaagttattttcttgggtcccttccagatctaaaattaatatgattcaggaggattgtatacccctcccaaattaattttagcatgttttctggagacatttctagtttcttcttgcttttcttagaatttgatacctttttgaagctagtgacccagtaggccaatcttaatccatgagaagcaatcatgcagggtgaagatagtaaataccatgcttcccccattttcttgaaaggaatcttaaaagacgacatgagatttcttactacaaatgtgccgaaataatatttgttccagtagagtgctgtttgacttaatattacaataactttattgaatcattaagatggttatcttggataatagaaaagtaagattataatgcctagaatggtttgaaaacttaggcatgctggatttttcttattgtttctttctgcccaacatatattaagtagaactttgtgcaaaagggtatggttggttgctgtggtgcatacagaaataagtaagacagacttgcttggtaaggtggataagatgggcgcattgggcctagagtgtagaaaagtgctgagctctgaaagaggggtaggggacactaggggatctgggagagagaagaacagcattgagctggggtaggcagggaagtctggcaaagtcatagcctggtaactggactctacggtggtgctcgtcattatgggcattctacttggttggctgtcttttgagaagaggcttgaggattgagcctggagacagtggctcttacctccagaatgatagctttcatcctgggcagaactgagtagaaaggctggaaaaggagagtcaggccagagtgtggaggactctattcgaggtagaagaattgctttctgggtttgctttcctctctcagtggagtcactgaggtttcctgtacaggtgaatgatatgatcagaactggagttcaggaagattagttgggtagcagtgtcctgggattcaaagtaggattgacaatttatgaaacaaatagtcatagggagaaaaatttacctgttgctaacttatttactggttttatttactgtaatcagagtctactgtttgtaactatggctgaagttgttttttcacaatatagaaatcatcaaatagtttttcagagtactgtccactgaagataactaagcacatacacctcagataaagtgaggaataatcagtttagtatcctgattatcatctttccccatccagtctattcagatatgctatttattttgtaattaatcctaactctcatcattccttctcttcgtttttttcctaaggcattcttaagctactcttttaacagtgttttgcaagtgttacttggttgatcttgggtgggtgtatcccaatttcccctacacccccaattcattaagcaactagctccatttttgtatggtgttataggaaagttcttgtcccatttttgaaaagaatttgtccttaatccatgtgaaaattatttgattttcatagtcttggaattcaaaagatcttggaaagaaagtcaaagtctcatagctagtaagtgaaggagttggaattgaaactcagatctgtctgatgctgagctatgttatatctctaagactcaatttccttacttataaaatggagtcattggtagtacatttctcatagagtggtcgtgagaaattaaatgaaatgatacacatagattgcttatcataatactgttattgcttgtttataaactaccttttaacaggaattatagaaatacagtgcttatgaatcaaattaattcagttgataagtaaggttattttgtgattttttttagttataattttatttgcaaacttaacagttgcaataactcgatttttaaaacattaggtgctcttatatacaataatgagtgaaacttgtgtccaatagtttcttttaattcttccctacagactgtcattctccatgtttagctctgttttgtgttaattttcactgccttttcccccctgaaatgcaatagtcctgtagtgtcctactggaaacattgttctctttgttagggctaaagaagtgcctttgtcactcctttgagacattctgcagatgccattttgcagtcctgaaaaacacgtccctgtccgccttgtgctgtgttaaattgtgcgtgtattgtgcttgatattttaatgaagtcgtagagaaaatttgacagtaacagttgtcatataacaaagaaaggctctttcttgatctaatgtagatatgtgttccctgatcccttcgtagctctgtgtggtctgaaagtagatcccccctgcacttagatgtgacctcagatggttgatgctttttgactaccttcataggaaactgttaaaacaacttctgagcaggaactcttaagtcttttgttgatgtgcattgctttttaaagacctcttaatttacatgatcttaatagcgttttaagtggcaagtacactctctaatttgctaagtggctttaatccttgtatgaagaactgagggaaaaatctcctgggaaattgctgtgataaaatccaggaaattcctttcattcttttaaatccagttcaaatctaacttaaagaaaagtcctctaatgtaacagtgtctgaaagcttctcagagtccagtgatttcttgtgtatagtgccaagctcaaagaggaatagtatgaatgtacctctgtgtttttggtaaatctataccacatggcacaataccaatttattataactttgctgggacttagttatcctgttttgtactgcccttaaaactgttaaggagtatagagttaaagggagaaaaccctacatttttccattttaatggactttatttaaatttttgaaaattataacacatgttcagtgcagaaaacttggtaacagaaaaatgcaaataaagcaaaatttccaggtacccacatttcaggaataattaccgttaccattttggttgaacatttccagtctcttgtctgtgaatatgttcacataggttaaagcaacagcattatccttttaaattcacttgttttccctttgcaaaatagggtgatgcattgccacaaattcttaaggtagtagaacttaattttggaagtgttaatctatagggcattcattcattcattcattagatggactcatttgaaagttcacagtttgtagaaagtgtgtacatttattgcctacagaagatgtgcatcagaaagacataggctagtcattttggatgttttccaggatcatataagtgtaacaagtctatattataactcttaagaaggctttgaaacaagtaaagatcagatcacataagccctgacccgtcctggaggggccagctcactgatttccaacaagagctgatctgtgctggcctgactcctgtcatctggggcagaggtacacaggggttccagtgtttgtttatgtctgggcatcagttgggcttgttttatagaatgattccaagctcttggtcatgccattccatctgtgtcttttaaagataaatacacaattggtataggacagatcctgttacagtaaactttatggcagaaaccaactctttatatggatgttcttttgtaactaaggggtataagtgagaggaaaccctccaaggagactcagatactggggccagtccctctccaaagaagagacagagtatctctggctcccttattactctgaggtccagtgggaagaatatttacttatgatatacagataatagaacaggaaaaacaagtttccttatctattcataactgtgctattgaatttatatgttccaatatggttaacctggaattttaggggacagtgggaggagatagaaaaggattgggaaggaggatatgacagcgttccaaaatatggctgaactcaaactgcttgaacagagctagtgtaaatcatgggagtgaggctgaccataggaggaggaaaggatcaggcagatcatgacaaagggaaagttagctatggcagctaagttaatttttatgagtgctacatttcacattttggttcagatatatactatgtactatgaaccccgaatatctgagacaggtctcagtcaatttagaaagcttgttttgccaaggttgaagacctgcacccatgacgcagccccaggaggtcctgaagacatgtgcccgtggtggtcagagcacagtttggttttatacattttattttattattatttttgagacagggtctcactctgtcacccaggctggagtggtttcaccatattggccaggctggactcgaattcctgacctcaggtgatctgcctgcctaggcctcccagagtgctgggattacaggcatgagccactgtgcctggcctgttttttttgtttgtttttttgagacggagtctcgcttagtcgcccaggctggagtgctgtggtgcgatctcggctcactgcaagctccgcctcccaggttcatgccattctcctcctcagcctcccgagtagctgggactacaggcgcccatcaccacacctggctaattttttgtatttttggtagagatggggttccaccgtgttagccaggatggtcttgatctcctgacctcgtgatccacccgccttggcctcccaaagtgctgggattacaggtgtgagccaccacgcctggccggcctgttttatgtattttagagagacctaagacatcagtcaacatatgtaggatgaatataggttctgtctggaaaggtggggtgggacaacttgaagcaaaggcgggagaactcagcggggagggggcttcctggtcataggtagataagagacaaatggttgcattcttttgagtttctgattagcctctccaaaggaggcaatcggatacgcttttatctcagtgagcagaggcgtgactttaaaaagaacgggagtcaggtttgccctaagcaattcccagcttgacttttcctttgagcttactgatttgggggccccaagatttatgtttttcacagtacctatacttttctatatgtttaagtataatatataaacatgtatatatcctttcagtgagtgtagtcatagatatgtgcttgtctgtcatacttcagcttttataggtacaactgcagacacagtccttttgtcgcctggggcagaccatgcaaagtccagttgacctgttgcatctggaggccctgtcttttctcatagaatgcagtctgcaggggctgttcattcctctggttccatttctatctagcctatgtgtcagtggtgagtcccagcgttaggttttccccaggacacactctgccctgccctctcctgttgcacagccatatcccaattctgtaggtcattagttgtgtggctcatgggtagatgatcaggtaagtgagaacagtggtttttctgggtctcagcttgtccttgaagtgtgattcctgatcagatctaaccgcccctggttccttcatgcactacgttacagctcagggtcatcttggaaaaggggctacattactcttagcccattttagtctttcacattcttagcatcctgcttactctgccagtggattttgctggagtggtagactccctgctgggttggtttgccatctactagatgtctctttcacagccttgtgatttgtgaatgtgtgtaccataaactcacaaataacttcatgacgtttctcccaaccccaagttttattcccggtatactgtggcttaaagtcggtaacagagctattgttaggttaggtcatatactgcctatttttaaccttatacctggaagcttgggttggtttttaaacatttttcatccgagccaagggtaaccctgatggtggcaggtaggccaatatattttttaaaattaatactggggcaacctactctgctttaccttttctataaccaaatagataggaatgaaagattctccccagggcctgaaagcttaagggaatgaataactcctccctcctcacgcccagttccaaggagcaaggtcacttgcgccagcagccggtgtcagcaagatagcagaagcaggaagagagctggccggaagacacataccccctgaagatcgagagggaggccgtctgggtactacctagcagttacatcagactgagacacttcctgtttacagcagactataaaacccctgccccatcctctttggtgctgacgccattttaagcctcagcccacctgcacccaggcgctcattaaaacagtgtgttgctacacaccgccttgtgttgtttgttggcacgctctcagggtttgaaccgatacaagagccttgcagagacaattataagtacctgtgttttagaaatatatgttgggtttcctagaaaattacctaatttccctgggacaaggaagcctcatttcatatttctcttatctatagccactagatgtcatttctgggtccaataatgatcttgtatttctctctgtgcggtaacacctggtggtatatatacctttttggggtatttattgtaaaggtgactaggatcaaatatttaattgtaatagtgaattttgttgttgccaattaaattcattatgcttaccactgtaaaataacacaaagattgagaaaactgatttaaggagctatctttggtatttgtttttccttattatgaaataaatttgtgcccagtcttagtgtgtgccaggctagggattcaaaggtgagtaagaagactgagctgctgagttcacagtaagacagactgatactaagaattggaattggggctgggtgcggtggctcatgcctgtaatcccagcactttgggaggctggaagctgaggcaggtgtatcaagaggtcaagaccgtcctggccaatatggtgaaaccccatctctactaaaaataacaaaaattagctgggcgtggtggccctgtagtgccagctgcttgggaggctgaggcaggagaattgcttgaacctgggaggcgtaggttgcagtgagctgagatggcgccactgcattccagcctggcgactgagcgaggctctgtctcaaaaaaaaaaaaagaatttgaattggtaatttcagcagtagaaatacatacagagaaaggacaacaaagcgagtccccatagagaggaaaggatgaggaatgatggctgtattgagttcattttctgtttgttttactgggatttggtttgtagctgtacaccacttaatgaattaggtgcaattattgattaactcataaaatgttccattgactacctaccacaagcctaagttattagggtatggggggtatggatgtaagattgctggctttcccctagggatttgattacttgagtggcagccagtcaacagcaatttagtggtaaggagaaggatgctggtgataggaatttgaccagcaaaactgtagatacataaatttttcatactgaaccattttgcttaatatttaacagaatcttttcataatcttatcacactcacacatatcaaatgtgtgagtgtgaatcttttcgcaaatcaccctcttaataattactgaagaaacgtgttgagtcaatgaatatatcttttgtgtaagaatagatttttacaaattggtatttactcaacatgtgtgtaatttgctactggctgtccttccatagaaagattttcttttttttcttttttttcttcccctaattgaaacttccaggaagtatcactctcctaggatttctatccaagtacttttctgaagccaacgggtgggtgtatgtttagatccaagagaaacaaattataaccatggatgtgaacttttcacagtcttctcaaaataaaagcttgaaaaaatatttttttatatttttcttctacaaagaccaaatctccttctgaagaggaataaagcaaagacaacatgttaagcacatatgcatcttcatgttgttgacaccttccctaaaattagcggaacacctcaaaatgtttattatttttggccatgattttaaactttaaaaaccagtacaaagatgtagctatatcaagtccaacagagctgaacggtaaaaaaataaaaaaagaagtagatacgtagtggagttcaagtaatattggacattgctgttttaacgaatgtgttttgagtgtgaaggaacaaaatactgtaggattagatttatgagggtaagccaagtaaaatgtggatgcccagtagtaagacctttctactgtatcaaacatgaattagacatgttgaaagcctcttaaatttattaaataagaatatgattgggaaagggtgaaggctctgtaaactgtaaagcccctgtaaatgtctccttggtatactacactgattggtttcttaagctacttagcacccatatgactaccattgtgttttgtgtgtgtggaagaggacatagctgtgggggtacacattactaacatggcagatgggggcagtggaaatcagggtagaaaaggagtatgacagacgcaaaattgacattttaagttcagaactactggtgtttccaagtcatggccttgaaccaagattgtactgtttggtaagtggctcatgcctgtaatcttagcactttgggaggctgaagctggcggatcacgaggttacgagattgagaccatcctggataacatggtgaaactccgtctctactaaaaatacaaaaaaacattagccaggcttggtggcatgcgcctgtagtcccagctacttgggaggctgaggcaggagaattgcttgaaccctggaggtggaggttgcagtgagccaagatcatgccactgcactccagcctgggcggcagagcgagactccacctcaaaaaaaaaaaaaaaaattacctgtatagttaataaggttataagcacctttagaacatttaattatatgtcctcggcatagtataccaaccatactcattcgtattattatgagatctttgtctagacttttacagactatccttcactcttgcactaaacaaagcactttatttttgctgtttagggttatctctttattttacaatcaaagttaattctgtatatcacaatttgctgcttcgtaccatctctcttttcccatatttttatctttaaaataggtttcttgtacatagactggaattgattctttctttttaaaccagcctgacaatctctgccttttaatttgtgtcttgagaccatttacatttaattattgatatatttgagtaccatcttgctatgtgttatgtatttctcccatctagtcttcgtttctttttctcttttacaggcttcctctagatatgtttttctctgacttcattttgtctttccactattggctttttttttttgagacagagtcttgctttgttacccaggctggagtgcaatggtgtgatcttggctcactgcaacctctgcctcccaggttccagcgattctcttgcctcagcctcctgtgtagctggacctgcagtcatgtaccaccacactcggccaatttttgcattttcagtagaggcagggtttcgccattttagccaggctggtcttaaactcctgacctcaggtgatccacctgccttggcctcccaaagtgcagggattacaggtgtgagccactgtgccctgctgatccactattgtgttttattagttatatgtctttatgttgttgttacccagtctaaattgaactcattagcttgcctccaaaagagcctagtccttccttgttaactatttcagtgaatggctttactgtcccatttctaattgttctttctttagctttcccttgctctcttaattcccaaatgtctttggccatgtgtcttaccattctactaactgaatatttcttgaatttatccacttcgttccactgacactttccctattcagatactgtaacttgcataaagatgagctcactcagggcctagttttaattttgataacgaagaaaacacagatcccaacattgacaaataattgacaaaccatttaagtttttagtctctagagaagcagaaggtttcgttataacagcaaaacttaagaaaaattatcttcatcaacttaccttttttgattcttcgtcacagtatagagcagacctcaaacgctctcccttaaaccagtttctctcccaccaaatatcaactctcccgcagttcttttagcagctattttttttttctactcagcccattccataatacatcagtcaagctgtgttcaaaattgagattataaaggcatacttctctttgagggagagagagcagaggctgtgactacctatttgtcaaccttatattttattttaaacattatacagccttgtggagcttgtaacctgataggggagaaaggcaagtagagagtcaattggggagaatagaggttgttcagaagagtatgtattaggtgtgtgtacctaaggcagttatcacatgtgtccacaattgtctggcacttaatgggctatcaatagttatttgctgaatgagtgaatgttcaatgaatgatctgatattgggcttcctgtccttcattctttgtttgtttgtttgtttttgagacagagtctcactttatctcccaggctggagtgcagtggcgtgatcttggctcactgcaacctctgcctcctgggttcaagcaattctcccacctcagcctgctgagtagctgggactacaggcatgcaccaccatgcccagcttatttttggatttttagtagagatagggtttcaccatgttggctaggctggtcttgaactcctgacctcaggtgatccgcctgcctcggcctcccaaagtgctgggattacaggcatgagtcactgtgcccagcctcctttccttcattcttagcacttatcttgcctgttgagctgatttgtagctagtgttgtagcaggtagattagtttaccactgagatttccctccaaatattttttcattaggcacatggagatgactgtaccttcttaagaaggtagacttggtctaccatgtttagttcttagagcaccttgatgctattcttgttatgcagacttttacatatttacagccccttcggatgccctgctgtagtctcccccgccacccctcaggaaagcctggctttaaggtgcttttcctctatttttgtattactaaaacttttcaggaatagtcacttgtttggaaaaaagttttgagattaatactagtagcaaatgataggatcagggttaatctctcatacctctggggtgacccctaagttgtcatctttactcttgatttctgtaatcttttctaagaatttaggtgttacatcacttcaaactcagtatgcctgaaagttccagaatcttgcagtcttcttgtcttctggccttgaatcttggcattattttttagttattcttctttatctgctatttagacttcaactcctatggattattttctctaaaatgtgtttaatacctattctttatttgttattttgactggtacttccacctgagcctatttttatttatttatttttgagacagggtcttgctctgtcactccagctggagtgcagtagcccagtcagggctcactgcagcttccacctcctgggtgcaagcaacttttccacctcagcctcctgagtagctgggaccacaggcatgtaccaccaacactcagctaatttttaattttttttgtagagatagggatctcaccatgttgcccaggctggtcttgaacccctgggctcaagcagtcctcctgcttagggctcccaaagtattgggattataggtgtgagccactgcacctagcccacctgagcctatttaccttgctgtctgcattctccctgtttctactgactacctttcccaattttagcctcctaaatttttcttctcagaacaacattcattcattcattcattcattcattcattcattcatttatgagacagagtcttgctctgttgcccaggctggagttctgtggcacgatctcggcttactgcagcctctgcctcccgggttcaagtgattctcctgcctcagcctccggagtagctgggactacaggtgcatgctaccacacccggctaatttttgtatttttagtagagacagggtttcaccatgttgggcagactggtcttgaactccagcaatcaagtgatccacctgtcttggcctcccaaagggctgggattacaggcatgagccaccacgcttgaccctcagaacaacatttagtgttcatcctgcttggccacagtaggcccaggagattggaacccacgtatactactggtgggaatgtaagtgcagtcatgttggaaagtagtctggtgtgtcctcagaaacttaacatagagtaattattcgatccagcagttctgctcataagtatatgcccagcagaaatgaaaacgtatgaccacacaataaattatacacggatgttcatagtggctattcatactaaccaaaaggcagacacaacccaaatatccatcaattgatgaatggataaacaccctctgatatagccatagaatttaatattattggggcatacagatgaaggaagtactgatatgttacaacatgtatgaaccttgaaaacataagtgaaagaaaccagacacaaaaggccacatacaagaatccatttatgtaaaatgtccaggatcgggaaatttatagaaacagaaagtagattagtgattgctgggggtactggggtgtgacagctggagtatgaggtttcttttttctttaatgagatcaaaatcatataacataaaatttattattttacccattttaaaatatacagttcagtggtttttattacatttgaaatgttcaaccattactactatctcagaacatgagccgggtgtggtggcacgtgcctataatctcagctactcgggaggctgaggcaggagaatcgcttgaacctgggaggtggaggttgcagtgagccaagatcgtgccactgcactccagcctcctgggcaacagagcaagactccatctcaaaaaaaaaaaaagaaaaaaatcctatacctcttaagttgtcacttcctactcttcactttccctagaaccttctgaatctgctacaccattttacattcctgccagcaatgcataaggattcaaattctccaaatccttgccaacagttcttttttttttcttttttaaatattgctatcctggtgggtttgaagtggtatatgaatgtgattttgatttccactttctaatgactaatgatgtttaatatcttttcatgttatgattggccatttgtatatcttccttggagaaatgttactcctagtttattgagtatttttattgtgaaaaggatgctggcttttgtcaaatgctttttctgtgtctattgaggtgatcatgtgggttcccctgcttggtttctattaatatggtttattggttcattttcttttgttacactactcttgtatttctggaataaatcccacttgcccacgacatatgatcccttaatatcctgctggatttggtttgccagtattttgccaaggatttttgcccgtatgtttatagggatgttggtctgtagtttacttttcttgtggtggttttttttggcttttgtatcaggccctatagaatgggttaggaagggtttcttttcggggtgataaatatggtctaaaattgtttgtggtgctggttgtacacctctgtgactatactcaaaactatttaattgtacacctataatgggtgacttgtatatctccaagctgctaccaaaaaagcaaaacaaaagaaaaacatcttcaaggagcttctcacctatattctttagcccaaggttctttttctgttcttcaaagccctcagcactctttctagctgtcatatttcagcattacctctgatttatctttgtgtataattctgatccagtgacagtggtcatttcactgcccaggtcaccaactcctactcacaatgacacaggattcttttcctggtcactttgcaagctggggaccttcagctggcgatgtcccatctggacctcacttggccatgctacctgctgcaggagacgtcacattcacttggcccttccaggtcgaatctagcttatgcactggttcccgagttcttgtcccacgcactggttcccgagttcttgtcgcgcacccaagaagaatgaggtgcactgacagttgaagagtgagctaggcagggagttttactgagtgaagaaaacagctttcagtggagaggagatgcgggatggtcctactacttgaaggtgggaaagtccccccccaaatgtggctgagtccagggcttttatgggctcagagtgggggaggagcaggccaaaggtagtattggaaaagacaacattcaattggttaaaaagcattattcagaaagaatcagtcaggaaagggtgggcaaacaggaacagaagatctcactctgggttgtgcgtttcattcaggaccagcagtcctggtctttcagctttcaggctggtttttttggcttgaaggtgagggttcactggggatctgtctaggcatttggctgcctcctgtcactatcaccaagatcttcgagagcatattgtccattcttcatcttcaccctgccttagggctgttcccatctctcttgaaggttcttgtccctttttcctaccaatggcaattcattctccctttcagagttttattcaagtttcttctatttaccattctagccaatagtaatctcttggtcccaagcccgtaaatctgttgattatgttgtttcagttaaaaaatagaaaggataagtgtgatctagaatgtatgtattttcttaaggagacagtgggacagaatatttgaaactagagctgttctgggaaacctggtatatgtgttggtagtcctttaggcatctttttaaaaatgcatttacagttacctcgagtttatagagaaagcttttcatttggacttctctgatctccccaaatacagtcatgtgatacataacaacattttggtcaacaacagaccacatataggatggaggtcccataagattctagtggaggtgaataattcctattatctggtgacattgttcccatggtaatgtcatagcacaatgcattactcacatgtttgtggtgatgttggtgttaacaaacctactgtacagccaatcacataaagatctagcacatacagttaggtacagtacataatacttgataatgatagatgattatgttactggtttatgtatttactatactttttatcattattttagggtatacttcttctacttacaaaaaacaaactttaactgtaaaatagcctcagacatgtccttcagcaggtatttgagaagaaagcattgttatcatgggagatgacagctccatgttattgcccctgcggaccttctaaaagcacaagatatggaggtggaagacagtgatagtgatgattctgaccctgtatgggcctatgctagtatgtgtgtttttatcttagtttttaacaaaagagtttaaaaatagaaaaaggcttatagaatagggatataaagaaagaatatttttgtacagctgtacaatatgtttgcattttaagctaagtgttacaagagtaaaaaagctttaaaaaatgcaagtttataaagtaaaaagacagctaaggttaattcattgaataaaaatattaaaaaaaatttatgtggcctaagtgtacagtgtttataaaatctgtagtcaggctgggcatggtatcccatgccagtaatctcagcactttgagaggcctaggcaggaggattgcttgaacccaggagcttgagaccagcctgcacaacatggtgcaatcccatctctacaaaaaataaaaaaaatcagcagggcaggtggtgtgtgcctgtagtcccagctacttgggaggctgaggtgggaggatcactggagcccgggaagttgaggctgcagtgagccatgatcacaccactgtactgcagcctgggtgaactttcaggtgaactcaagactctgtctcaaaaaaaaaaaaaaaaagtctatagtagtgtacaagtgtatagtaacatgccgtaaaaatttgtaggctagaagtaatagactatgccatctagcctagatgtgtagtaggctataccatgtacgttgtaagtacactctgtgatgctggcacaaggatgaaatcaccaatcaccttaaggatacatttctcaaaaacatgatcctcattgacacattactgtagttctcagtgttctgaagaaaggcatatactgatatatctagccagtaacattaaatgccaggcaagcctctgttgatacgtatatgtgtgtttggaagatagaaacatctgcaactttcatttgcggttcctggtttctcttatgaaatctttttgagaactttatggtactagagtggaaacagttgaataaagtcctgatgattatagtaaagtccgtgggcaaatgtgagacaccggaatgtgaggctgtttacctaaaggctgctttttgtagttgaggctatataagcatcatggtgtgatgtcaagaatttatctcacataaactagaattggatttacacatggttgttaggcggttgagccagaatccaaattcaggtttgtctaactccaggactgttgattaaccactgtatgatttttgcattttatgcttattaagggaagttatttaatttctccgagcctcattttctttgactacaaaatgaacttgataatatgtgccttacagagatgtttcaaagcataaatatgtttgtaaagcatttagcagaaagctttctcaccaggtagataggtcttttattattagtaaaatattttcttcaaaacaatgactccaacaaaaaatggtttttgaaagaaagtctgaaacttctgcagagaacgttgcataattcttggaatattgagttctttacgttttgacacaaagttttcatgtccgtttctctagaatttagataatgttccaagtaagtcatttgttggtcattactttatttccccctatttttttatttgttattctgaatgaattgctgtcaaaaaggtaacagaattataccctgtctgtcattaacttcccttccaaagaattggagaatatctgacacttgtggttaactgcaactgttatatatttaagccttaggttttgaagtttatagaatgaggtttagaaaggctgattttttgtagttgttgttggaagccataatagaaataaactagagaagtggttattggttttcatcttggctgcagaagaagtatttgttggtgttgctatagaaacatagtcaaaactacagtattgaaagcatcacaaaataaagcattgatttggtttcctaaattgtgtttcttgtttcggagttattcctaattgacttaaaaatgcttttttttttttttaattcttagctgtcataaatatccagatataagtttaaatgaaataaagctcaaaataaatcagtgttctgaatatgaatgctaatcatcaaaacttttaaaatcactattattccttagtagtttgaaaacataattctgttataataaattcaaatttcctgctggtgatggtgataaatagtaattttaaaaatgtatatctttatatattttagcataattttggttcagttagggattttgcataatgaaaaccacatatacttttttctccaaattttatttatatttttattttacaaatttaaatggacatgctattttagcttttttaataaagctacaatttggatcagtagaagacagttccactaaacagtttgtagggaaaaatagctctgcttctggcttttatagactctcttgctcaaaggaagaactgctattgagtcagttacaacttcagtggaagatgtcttgcagctgtgcctttttggttttgttccagagatagtatttgtgtgcactgtcagaatgtcttaaaggcccaccctggaaaggattcaaccctataaaaggagttttgttttataacctttcacatattcttatggagttctggtggtgatggtggtcttcattatcttgtcttttaaactggcattttattgagacacaggcttcacagtttgagaataggagctacagttgtaggtattgtatctaataaaataaatttagtcaagcccttggcacacactatgatgaaaacaaaacacccctccccaaactttgcaatttcagtgaattatttttaacaacttttctgcctctgtactgataaggagattggcactcatttgattattctcctgggtaacttatttaatagatattgatttacaaatcaagttactatgtaagaagagtttaaaacaccaatgacttctcatattgaaaattgttcggcctgttttaagccatatgtttatataaatgctaggagaattatcattgaatatattctgggtggttgaccatattttctccaaaatttccccctttctccttagtttttttcctttacattgttaaaattacagtaaatttattttaaagattttaattggtttttatttgccattcaagactggagcaacacctcattctataaaatagaatgaatgtccgataagctgaacagaggaagttgcttttatagacagaaaagagctgacggaagcagaaacagagaacaaaagcatgttggttgtttcaaagtgacttttcttatagtgttaaaacagaggggacttccttatcatgcctacccctttggattggttgttgtgaattcctttcttcctttttaaacaactgccccgtttcagagtttagtttgattacctagctccattctggtgtggtatggtctgctggagcctagtgcaggaggctagtccaaaacaatggcctcctataaatttcatttaacaaaatgctccaaagttgttagatccaccccacccctgcccctcccccaatctttctagcttccttaaaccccttcctctcccagccgatgtctatttcccattactgttctctttggcctgtggggtcaggatgttcctcctgctattgaaggttaaactcttctctgtggttttgatccttttcctccatcttttttgaactacatgccattcattttcctttctttctactttgtgtgttgaacctctcctctctatctctcccaccgaaagactgcaccaaacaaaaacagcctaaacatacatctcccctgaatcctagactttttgtagttattacttgccttttcttcattgctaaacttcagatattaatttacacttacctctttccctcccctcttctgatattttatctgtagccattagatttttcttctcctagccactgaacttgctctttgaggttagtagccatcttatgacccttttaacccttattgttccctgaagcaatctgcccttgcccctgttggtcatgcctccccgttagactcttctttctcgtcagtagtttcttgttttcctttctcttaatgctgatccttcttagcctccttgataggttctttggtctctctgcctggagatttttgatgagcatttatcctactgcttgttttctctacagtttcatctacctctgataccattgattggctgagcagttccacatttcagtctggaaaccaggctctgtcattcagacacataccttcaaccatcttcggatttccacctggatgtcacacattttcagcccagatgtattcaaagtggaagcttttccttccttcctttctgtttcttactttgtttggaagtctctttctaacttcatggtaccactatctaacctttgactcacaggaacttgggagctttatttttcattactcccacaatccaattaattatcaagtcccattcattttatccattaaatatttattgataccatctcttcatttgcattcttattgcttctatcttagtctcctggatccctggaacatcatcttaaccagtttcctttttttttttttttttttttgacagagtctcgctccatcatccaggctggagtgcagtggcacaatcttggctcactgcagcctccacctcctgggttcaagcaattctcatgtctcagcctcccaagtagctgggattacaggcgtgtgccactttttttgtatttttaggctaatttttatatttttaggagagatggggttttgctatgttggccaggctggtctcaaacttccgacctcaagtggtcaacccaccacagcctcccaaagtgctggggtgacaggcatgaaacaccacacccggccagtcagtttcctttcattgtgtcagttggtctcatgtggctgccaaagtcatcttccagaaatacaaagttaatagcattttcttattgcctgcagaatagagtaaaaacatctgagcttagcatattgatcatgcattatttgggtgttgcttcccttgtcctgtctcctccactccccacccctgtgttccaggcacttgaagttctcagtgttctctacaatgcatttatctttcatgattctgtgtccttcacttactgttcccacggtgaagagtgtgcttctacccacttataataagcccagtaagctccttcttatccttcaaggtcaggtcaagtgtcacctcgggaagcattcttccttcatcaagtctgttaagtgctaaattgtttatgcttccattatagctcttattccctttgtagttagctatttaaatgccctgctctcacactgctggagccacattttatacaggtctgtgtcctcagcagctatcagcaagcacaaagcaattcctcatggaatgaatggatctttacaaaacccaaaagtacagtattaaaatcaagatttcatgggcagaggtaatggtgagtataatggcttgatattagatattttttatttattgttttgagtaggtgtggttgtggattgagaacatcttggcacttgtggttaggattttctaattcaaatttagagagttaggttttgaaagtgaagcgacagagctgtagtctcaaattatggagagctaataaagttatgaaggactggaagtacactgggttctcaacaagtggccacaccattgcagatcatgtatcaggcagaaggaggatagtgagacaggtgaagtgaggagagggccccagattggggctgtacctccccaccacactctgggtttgtagctgggcattgcttattacaatacaccttaatgtttccccagcttgccctggtagaagcagcattcaactttatacaacatgttttttgataaaagctttgtgtttacacgtttgatgtttatatggttctagcagagcctcttggaatggtggtggctgttttaaagtaaaggagagaaaagaaagaagggaaattataggggatgggttaggtagggatagaattttccttctacaaattgagaaagaaatagatacattggattggtaggaaattattatacattaatgtttgctttttaaaaataaagttaaaccataatgataccttccaccacttttaggggaaaaggcgtagatgaaccttttgaccatggaaattctgtgtttaacagtaaattgcattcatttagtgttttgcactttaccagtagctattatgattcttttttgatctttaaaacaatcccattatataggtaggttagcagctgctacttttatgttatacgtgtagctaactggcaacatgggagcatatctcaagctgtttgaggacgtttgatgttccttaaggttaagaagagtagataatttcttgacaattgcccttttatttttggagacttagaattttgggggaggagggaggttatggcatttttcatgagtacagaagttggagcagagctggggagcattgtagatctcttggattcctagtcttagggctgttttgtttcttctggcccttggacaacaatgaagggtctctattctttttttcttttttctctccttaacagtgtgtctccccttctcatccaggcaggacagtttgctacaggaaaaggcattgagattattagtaagaatctgacatctatcctggtgagatcttgctactgatttgctatgtaaataatctaactgctgggccttagatttcccatctaattaaaggcaagaggtagaggtacatgaacattgagatccttttagctctgaactactttgattctttacaaattccattttgctcagtcatatgtagagtattatacagctgctagcaagattgttgtttctgctttgtatgtagtggactttgtggtaggtgcttttgttttatttctttcatccctaaggcaaggtgggtgtcattatgaccgagtggtagcatctgctccttcaaagtgtgagagaagaatgatcttataattgtaagctttataacgctttctttgaccacccaaaggaggtgaccatttcctttgtgcccttcttgtacctctcttacagcccttatcacatatggtgtaatgatttgtttatgtgtctgacttgcctgctagactgtaaatgtccagtagattcttgtgggcaagaactttccctaggtctttagggcctagaccagtgtctggtgtaaagcaggaatgcagcacatatttcttagacataaaatagaatgaaaataatacagtttaatgtacctgctggattactatacttgtctgattgtgtaatttaaaaagtggtgcttttgacttttgtagttaattaaaagcagacaagaaggatttgttaagagttttatcctaatactttttagatgcttccttggttcaaaacagtaactttttgattagagattctcagccaccactcttttattcttttgtccattttcctccttctgtacctgcttccactttctctctataccccttgtaaaaatctggggtcatgcagtatctttctttcctagagtcccataaatctacagtacttttcaacattacatcttaaaaatgtaattgtttttaatgtaattgaacatatgagtctaacattgctaagatgtctggtagggaagaaactttgcaggtgacgcatgtgcagttgtatacattattctggtttagagcctgagagaagttaaactgtggtatgtggtcaaagaagaacttgcacattagagccaaggtgctagtgaaaaaaattagtttttctgcctacatcagatatgtcagtatcaatgatcctatgaaatgtggaccatttttaaaaacgttaaaaaaattttatagaccgactgggaagttcattcatattgaagagtcatgaaactcctgtccatgtttgttcaggaagtaatcttgcatgacgattggtagatgggaagattggattccctgtacaatcagaataaaaaaaaagagttttgttttgttttgttttgtttttgagacggagtcttgctttgttgcccaggctggagtgcaatggtgcaatcttggttcactgcaacctccacctcccaggctcaagtgattctcctgcctcagcctcccgactagctgggattacaggcacatgccaccgcgcccagctaatttttttttgtatttttagtagagacggggttttaccatgttggccaggatggtcttgaactcctgacctcaggtgatccacccaccttggcctcccaaagtgctgggattacaggcgtgagctaccacgcctggccagaggttttttacaaaatttcttctgagtactttttaggttattttagtttttttccagaaaattgtgttgtctggttcttttcttagtaggatagatgataatcactttacagatgggggctagatgagcagaagtgagataaccaaaaggaattcttcttcctcattgtcttttctgtgatattgataactgtactttctgcctagagtttgtgtctcttaaggtttttgagccatgagtgactcatcagattattgggttctctgtatcttactcattctttgtcctcataaagtaggaggtaggatgatttttaaaagtcaaattatgatactgggtttaagataaaattctgtgtctacacaaactcacatacacaaatgtagggaaagtgttcccctcctaaccttaaccaacttccttgaatattttaaaattaacttttggaggataaacctaatttcctgttttaatgaaataatgagacattgtcgaaacatgaccttttttggtcttctcaaaatacatgtaatagatataaattcatataataacaatgtttgaatattaagacatttgtagatgtttcctatatattttgtgtactcaaatgtatttaaatcatattggaaataagtaaatgacactggacgtgctttgtgtacttctctgctaataacccatcaagtaacctcacatgttatttcacctctctgggttcacttgacttatctggaaaacaagagtgttaaaacggctgccttgccagcctggccaatatggtgaaaccccgtctctcctaaaaataacaaaaattagccaggtgtggtggcgggcacctgtagtcccaggtactcgggaggctgaggcaggagaatcgcttgaactcgggagcctgaggcagaagaatcacttgaacctgggaggcagaggttgtagtgaactgagatcgcgccactgtactccagcctgggagtcagagcaagactccatctcaaaaaaaaaaaaaaaaaaaaaaaaaagaaaagaaaagaaaaaagaggctgccttagtggaaaagtctattggctttgagggcagaccaaattgatgtgaattttggctctaccactcataagtgggtatatgagtttgagattcaatttctctaggttctaatagtctaatttttaaattcactctattaatagttctctttcaaaatcatagtgccacaaaactcattctctctgaattctcccaacgtttttttgaacaatgagattcacaggtctcctgagtaggatcttttgaagccagggaggagctgagcagtagcattgggttccatagctaagaagtaggcatcttagctcgtgctgccataataaaataccatagactgggtgacttacacaacaggtacttatttctcacagttactctaagttgtagaatttctggtaagggctcttctttgcttactgacaactgccttctactgtgcccttcatggtagagagagaatgagagactgcacaagttctctggtgcttctttttatgagtacactgatttcatcatgagggccccaccctcatgaccttatctaaacctatctcccaaagctcctacctccatcacattgtgggttagatttaacataggaattttagggtgatgcaattcagtttatagcagtaggagagtaagagagtaagagaagagagcaggagacacaggggtgttaagaaatgcgtaggatggaccagaagatctaccactgttgaattcatagggcccagtgctgctataggttagaagttttcacatttctggattacatggagttacaaatttcagaaaaaaggttgaaagtgtgaaccctgaatacctgacgacatgtgcccatggtggtcagagcacagtttggttttatacattttagggagacaggaaacatcagtcaacatatgtaagatgaacattgatttgatctagaaaggcagtggggagggggcttcctggtcacaggtagataagagacaaatggttgcattcttctgagtttctgattagcctctccaaaagaggcaatcggatatgcatttatctcagtgagcagaggggtgactttgaatagaaaggaaggaggcaggtttgccctaagcagttcctagcttgacttttccctttagcttagtgacttgggggcctcaagatttattttcctttcacaaaggcaatatttttccaagttaagtatattgtaacaaatttacagttacactagcagtatttattaaaaaacacatttaacataaaaaggtgggaagaacttaatctgcataagggatgatgctctgaattgaataaaattggctctactaaaaaactcaccaaattgcccctttgtgaaccaatgaaaactttatgatgggtagtaaaatttacttccactatgtagaatgacttaaaaaaaaaaaaagttttgtgtctgcccattttgacaaagatgaatatctcttcagaggtgccatggaaacttttaccaaaataaaatttttaaaaaagtgaaaaagtgaagaagagaagtgaagacttccatcaagtcttcccattaagcaaaccttactttttaaaattttttattttttttgagatggagccactcaggctggagtgcaatggcacgatctcggctcactgcaacctccgcctcccgggttcaagcgattcttctgcctcagactcccgagtagctgggattacaggcgtgcgccaccacacccggctgttttttttttttttttttttttttttgtatctttagtagagatggggtttcaccatggtggccaggctggtttcgaatccctgacctcgtgatccacccaccttggcctcacaaagtgctgggattacattacaggcgtgagccaccacgcctggctgcaaaccttactttttctgctagttggtactggtgacatcttgtttatctgttaataaatatctaaagcattttctttgcgatttacaagagacccattaaagactttgctgtaggtgaatgtgaacagataattactactgctttgcaggagagtaacacagtagttgggtaaagctgtagaaatgcacaagtgcacttatagtctatctgagtcctgaattgtcaaggcaaatatgtgtgttgggaaaaaaaaaaacccagaatttaaattgtggaaatgtaaagggtggttggtactgtagagttaaggaacattagttatttctcagattgtgctgagctgaatcttagaattgacacattttcttttagtgactttacatttatgttgcttccatatttctttagagtcatatgataggtggatgtagtattatcttatttttagtcatttctcctttttttttttttttttttttttgagatggagtctcattctgctgcccaggctggagtgcaatggcgcaatcttggcttactgcaacctccacctcctgagttcaagcaattctcctgcctcagcctcctgagtagctgggaccacaggcatgcgctacgacaccctgccaatttttgtatttttagtagaaatggggttttgccatgttggccaggctggtctagaactcttgatctcaagtgattcgtccacatcggcctcacaaaattctggtgttacaggcatgagctactggacctggccatttttagtcatgtctcaatttaggattgaaatatgaaacaaggatttaacagctttatagctacatcacggtaactatactatctaggttaaaatgcacctccatttttatgtacaggttgaatgaatagacattcttgtataaatgagttgaaatgaatattttattttttaatgttgaaatatggatgatatatttgcagtttttctatatctgaaagtttgtctatagtaatttatagataaaaatgagtaggctgtacagtaggcctccccttattcatagttttgctttctgcagttcagttacctgcagtcatctgtggtctgaaaatattacatggaaaattccagaaacaagcgattcataagttttcagttgcaaaccatttttagtagcatgatgaaataatcacactctctgctccatcctgtgcaggatgtgaattatccatttgcccagtggctccatgttgtagaagcagccacttgtcagttacttagtagccggcttggtgatcagactgactatcgtgatatcacagtgcttgtgttcaaatcacccttattctacgtaataaaagtacaagaatagtgatagtggccatttgaatatgtcaaagagaagccatcaggtgcttccgttaagtgaaaaggggaaagttcttaaggaaaaggaaaaaaatcgcatgctgaggttgctaagatctatggtaagaacctaatcttcaacctgtgaaattgtgaaaaaagaaaaataaatttgtgctagtttggctgtcgcacctcaaactgcaaaagttatggccacagtgcataagtgcttagttaggatgtaacagggtggccggacgcggtggctcacacctgtaatcccaacattttgggaggccaaggcagaatgatcacttgagtcctggagttggagatcagcctggtctgtaacatagtgagactctatctctacaaaaacgtaaaaaaatcagctgggcgtggcagtgcatgcctgtggtcccagctacttgagaggctggggtgggagtgggaggattgtttgagcccaggaggtcgaggctgcagtgagccatgagtgtgccactgcactccagcctgggtgacagggtgagaccctgtctctgaaaataagtaagaaaatttaaaaagtacaaggcattaaatttgtgggtggaagacatgaacagaagaaacacattccaattgatgagttgggtttggtactgtcaatggtttcaggcatttactgggcttctttccccgaggataagggggactactttatgttgtgtacatatacttttggtgtctattctgggatgaattaaaatgacaaaaataaaaacaaagttgcaggatggagactcaaagcaaagcaaaagtcataaccaggaaaactaaatgagaaaaaatctcaggatagaagaattttataaaaattatagaattacagttgtgtcattaaaactggtttctatgccgaaggttcttcattcagtgggtaaaacaggcagcaggaagctgacttttttctttgacccatgtgcattttctagctgaggaatgaagtgacttggaaccaaactgggcttttctactgagcatgtccctctccagcagggtctggcttgggtggagccagtcttgctcgttaagcttttggacgctggatttccatcagctttccacagttttccaatgacaggaaatagcagacagcgggcttgatgtgcttaaaagctgcgtatgtatttcaaggggggcgattattaggacatttttgttgcagtggttgggttttgtgatacatgcttgtttgtttctgcttgtggaggaagtttgctattgaaagtgtgactagtcaggggactgaaaattaggaaaatactaatgtacagagtagatggaatctgggtacgtacactgtttcgcaagggaatatgttgtgatatttgaactaagccctgtgaaaaatacatttttccattgggccgagtttagttttagatgacttgtttgcatttttctaggcaaatgttgacttttgtcaggctatctttaacatgatagctttttcaggtttgacctatgagaataatgaagctagttggtttcttttatatgcttgtctggttgtttcacaattttttcagtggtatgacataatactgtacaaaatcagtatgatattatttctggaagcacagtgaggactatgtaaggttaatagtgtgcagttactttctttttagcatcttaaagagtaataactttcaatttacttataaagtgcttcattttcaccctaacttgtttgattaaaagaagttgtactgtagctatcagagatttgagttcacagtttttagctaataatctgtagattattagccattaacagttaccaaagtctggttattggtttgatattgtcacaccctaagtaaatactgatagaataagaataggtatcaacatcttcttttattactgaatatttaattggttgtcacattgaataaatgtgaaaatgcatattgcccagattctgacatccagacttgggaaaaaatcttcttgcgtgttctttatataatctaacagtctagcagtctttaaaaagatccttgcttcattgcgacttactgacaaaatgaaaaacagggccactgtaattagcagatgacctctgcgattccttttttattgttgacactgttagggatgctctatatcactgaagtatttatggtattttgaggggggtacatgtgtacttgggaagtttaagttttccatttttttttttgtcacaaggaagaattgtctcttcaaattatttgcaacgtgggtgtgggtgctgaataaatgataactgttgaggtgatgctgatgacctggacagccaatcatcccccacatctgctttgtagtgttcctgtacggatgatataatatattggtgatctatagtttagtatcatagcaggatcacaaggaaagttacattggaaaggtaaattttaaactttgacgttggttttgcttgcattttttggtggactccagacgttgaatgcctgacatattctccagcatgattctctaccaaatcacttttgcaaatgttgaacttcaagaattttacctctaaaaaaacaaatacatttcactgaagtaaaaacgtattctagccaccaccacctaaaaatagttatttgaagttcttgctaagtagttctgaactaagtgaatcctcggagtagaaatacttaactttaaaaaaaaaaaaaaaaggttttatagcactccaaatggcatgtctgtaattccattgtagttacagcttttcccgccgagggaaagttgctcttatcaagccaggcttggagggtccataatttggatactctctggcaccttctgctgatcagccagtggactggggccaacatttggatatgcttgcttaagctagaagtgtcattcagtttatagtcttagtttttagaatatatgctatgtattggtagaactctttagtagtgctataattacttaaaatggcagaagaactaacggccaaaatttaaaaagtgaattatatttttttatgaggtttaggtatttatgcctgttgactacagcattccaaagcttatagagaagaggatttgaaagtatgagatcagtgtaggctccagcttggtggacttgtcatagtgtgggggagttgattgactttgacaagcttttgtcttatgacctattaaaatgcagcgtctgcagcctgtgcgtttatcctgtgcagttaaccttggtggatttgtcgtttgcttatttgggaaatgcctcttgtaccactactgttatttttttgagtttgattcacacagaaatagtattagactggttgttgattactgttggataccaagtgggcacgagttttatgatggggctgaggagccattttatgcataagatagttgtggggtgagcttaggaaaaatagactcgctggcatctgtcatgatcatgggagtttgttggtattggccgtgctctggtttgagcttggttatgatgtcactggaataaactgcacgttagcatttttttttctatagagcattaataggggggtggcccaaataaatgttccctaaatactaggaacatcacaaaagatatttatcaggaagccactggatgcaaacactgtgctaggaacatgtagttgttttatctgcacaaaagctttaccctcttcatatgaatatagtagcagatgggcagggaagaggtgtggacaggaaactgatgacaagcttgtgctttcaggccaattttattcctgcttttccctgtgaggaggaagctgctgaaagagattggggaatgtttatgtatgaccagcttagacatttaataggactcttcccattctgtttactctgcctttaaaaaaaaatgtccccaactttcagagaactctatttccaagtgccccattcccagccctccagcagagaatacgaataatctttttacgctgcctgcatatgcaccggtattattgttagcaaaagccagttgtttgtttcaagtccacactgaggaaaaaaggataaaaaacaagcaacgttttctcaggaactgtaattgactcttgaacaacatgagcccacactgcataggtccacttatatgtgagtttttttttcagtaaatctaatcagccctccatataggcaacttctgtatctgcaaccaaattcaggttgaaaataactgtgtttgtagggtgctaaacttggatatagatggctgacttttcctgtccacaggttcggtaaggctgacagcaggacttgagtatgtgtggatttgggtatctgtggaccaatcccccacagatactgagggacaactgtatttttttaaatgaagaactgatacacttcttaaaaaaaatgttgctgcactaaaagcttgggtgttgagcttaaactacttaggggaacaatctagattgggggtaagtggtgggtttgtgaaatatactgaagtgaaggctggcagaaatcagattctttgaggatatagaaacagtcttaaccttcatacgctaggaaatccaaagcttaggccatcttaatgctactgctgagctggagtcgatgttcatttgtgtggctagagctgtgtgacaaggcaaattggcatcgtggcttgtgggagtcatattggcacgtgttgtctccaaggaagctggctaaccaagctgggttcacttaatgcataaatattgttctcctagtaaagtacttaagtgtttaagtttatgaaaacttctgttcattaaaaacattgtctcccatatctgtacctcggcagtcatctacccagcaccaccctccattccccataatcactgttgttactctcttgcattcttccccagtttctttactcatttaaaggaaaatgtgtgtgtgtatgtgtgcatattcacatatgcatattcgcatcctttatttgtgtatctcccacacgctttgctttcaacctataagatgtgatgtctgtataaggtatcctatccatataaagtgacctatcacttataccgtctgaatcttgctgtttgtacttaacaatgtacttaataattggagttattatcccaagtggggcggcagcctttctcatcttttctctttacagttgcatagtattttgttgtatgaatgtgtggtataagaccccctgttgatggacatggatcctgagcttttacagtgttgtagtgagtcacctttacataattattttacatatgcacagatatatctgtaggataccttaccacaagcttgtccaacctgtggcctgcaggccgcaggaggcccaggaaagctttgaatcctgcccaacacaaatttgtaaactttcttagatcattattagattttttttttgcaattttttttttaaagctcatcagctattgttagtgtattttatgtgtggcccaagacattcttcttcttccattgtggcccagggaagccacaagattggacacccctgcattaccacaagcaggattactagtttaaagtgtggacacatttggaattttgaaagctattggcaaattgacttccactgggcccataccagtttattcttctgctagcaattgtttgagaatgcctgcattcccatagtcttgctcaatgagtgcatgattaaacttttggatgtctccattctgaatttttagtttcatttcttttactaagagtgtgacaagtacctcttcatatgtttatgtgccacttgtgtttctttctttctttttttttttttttttgataactgtttatccattggccactttccccaccattggaccgatgatttaaattggcctagccaaaaatttaaaaataaaatttgttttttatttttttgatgttgaggcaacttacaccagacttgttttattgggcttttttattcaagttacttgaattcagatagagaccaaataaaattgagaaggagaattagtcctctccaaaaatcatgtaatgactattttgtatgttatgagtgtttaaccagtatttcctatgaaggaccattcattgtgtgatttcctgaagagataacaagaaaatcgtggctgcttttcaaactagtagtaatttttaaatctaaattaccaagatttatgaattggttacaagttgtttgactatgaatgctaatcttattacctatgtctcccactatactgagagcaggattctttcatctgtattactggtgcctggtgcatatgctttgagagtactcaataaacacttgtcttgaaagaaggggataagatactgaccccactcacatcctgatggtcactaaaattcatgaggggtggtccattagaacatgctgctaatgattataaagccccaaaaggtagtggtaattatcagtttcacttttcagcaaatcattaactgtcgggcatcatgctaggtgcaagttatatagtagtgaagtcgttttgggattgaaggcagtgttgtacaaggtctttagagctggacggcctgggtttgaattctggcacttctctttattggttatatggctttgaccaacccatctatcctctttttaccttcttcatctgtaacatgagaataatttcagttccttcctagaagagttgagaaggttcgagttgctgcatgccatgtttctagagcagtgtttaacaaatagctgatattatcatgattatttctgttgtgattactgttattactaccattattattattattattattttagtaaacaaatatagttattttcttggcagaatctctatgtgatgacagtagctgatcatttattatgaatttattatgtgccaggcactttatgtattatagcatctaatctaatgcttagaatcaaccagtgagtacattttgtatccttttttttttttgcttatgaggaagctgaaactcagcaaggctaaaataacttgtctgcggttacatggctaataagcagagctgaaattctaatcctgttttatttcacagtcttcatctccaagccaccaggctattttattcagacataggtaacttctcacagaaagaatatagcttcaggctgggcgcagtggttcatgcctgtaatcccagcattttgggagactgaggcgggtggatcacttgaggtcaggagtttgagaccagccaggccaacatggtgaaaccccatctctactaaaaatacaaaaattagccgggcatggtggcatgcacctgtaatcccagctacttgggaggctgaggcaggagagtcgcttgaacccggcaggcggagattgcagtgagctgatatcatgccatggcacttcagccctgggcgacagagggagacttcgtgtgaaaaaaaaaaaaggaaaagaaaagaaagaatatagcttcagctttgattattacacagaattgggcctctacctgagagaaggaattagagcagatgcagttcaccaagatttctgaccatacaactcagtgtgcataattgattgatgagaactcagcagggttctggatgtctctagataatctctgctagtgtgtgttgttggattgccagtattacaaggtttatatgcattatggttatgtgaataaaaatacccaatattagagtccttcatgatttatatatggcctctggttgtttagctttaacttcaggaaatcgtatctatttccaagattgccttagttgctggtggagaatgctttgcctggcacaggtctttttcttgtctccatccttagtgacagcagtaggggctttctttcaacaaagaagattgttaccttgattgttattgcaactggatgttattgaaaattatgccttagttttcatatacccctgtctccaacatatgaagaaagggactcatatgttgataaagtaagattttttttggtttcattcttatttagagttgttagagtaaagaattagtgatttatctcactaatattaactcaagtattaggtttttaaaaattgaacatcatttggaaaaaatggaatactttgacaaccatagctcttagttatgagggttgtaaaatgcagtgggagtaataatgacccaagatctatatgtactctcagtttcttaatccttattttctaatgctctcctcagaatatgcagaagtcaacatcaagatgtttttgactacaagtaactgaatccctggctcattgagccagagaggagtatgtgatttcacaaacaggaagctccagcacaggactgggccatgtgtggcgcgatcaaggagctggtcctcttctctgtgattctcttgccagtgtcctttgttgtgtgtcagtgtgtcatcaggcttattcttctctgtggattcaagatgacaacagcatttaacagagttatgtatacaatgttcagagacagcagaaggggcctcctcttcctctggctctttttagagggagagatccttttccagaagcccaccagtggacttcgtgcatattttcttgccaaggggtgggagactaccatgattgccctagaccaatagaagctacccttgaggccaatctggagctagcctctattgaaacacatgtggaaggggggaaagtggaacaaaatttaggttctattaaaaaggagaaagagtggaagaaatatatctgaatgtcacctgatcccatctagacttgaactagggaagattgtagttcatatgttttgtatgtgtgggtttaatttaaaccggatattagtttacatctttatagtaatagctctgtctaataggtcccttatccttttaaaaataaataaacaagtgatatagtgggttataaaggtaactagggtgagcagcattggattacttgttcatcctccccatatagataatatgaactaacaaatagtccctttggaatgtatttatacttacttgaatatgaagtatggtattttctagaccatctgacacttaagaaacataaacctgtgagggtaaggacttacttgcactctgctctaagtctgcctgtttttgttattccttcttcctctccagatatttcttcttccttgttccccttcccaccccacttcctccttcccctctgccccacctctcctgcctcttccccttctccttttaaatgatgaatatatttgagaagcatcacctctttatttcccaagtagagttaggtggctgctgaatcatttctacatttgttttttttccctcacgtttgatggcatcaaatagtgcattattaaaagaccttctctttcaatagctataggcccttcggggaggtgaacatacaagcacgtgattgtgggtatcagcaggatgctctacatatcctctacccacaagcagatgaaaactagttttatccgatgtagaaaatggccagaactgtctacacattgccaatatgttttaagttcaatggttatttgttgcaaagttttgttgttttctcaaagctcaaatgaaagcctccctccatcctcttgctaccatttttgaagcttagaaatacataccttcccattttgtgaatcttggatccttacaaaatgggttgagctctcttggtagaaattaaagactctcatattgcttgtgatctcagcaaagaatgggagctactcagctggcagcagcacctaccctgttccctgctcaggggttttgttaacagtaaggtcccagtttcctcaatgttttaaggaaacatctgaacccaagaattagcatgaaccccttgcttgaagttgtttgtgtgtttgtgaggttgtgtatctgctttgctttgcttgctgtagtattctgattaagggccaatgttttaagtagcatgatgttatatggttggcagttcagcctagtgatagagatagcacattagaatttacctccttttttaaacgttggaaaaaaaagaatgggtttatgtaacacagctccttacctaaccagtactgatcctctattgatgatggttttctgcttcattgcatgttaaatgatgcatgctttttctcatgaagctgtcacaatgacgaacacttttatcaacccagatggagcatgccaacatggtaattgtgtcaaaaccacatgcttgtctaatgggcgggctgttcacagcagtgttctttttagttgatgataagtagaaagatcattacttaatgtattatataactatactaatgatggattttgggtaattataattaaatattagtcaatgagcattgccagagtttgggaaaccttagttccagttttggcttgcccatctgactttaccatctcaggcaaatctcctggtctttctgatcctcagtttggttgttgataaaataaagtgaggatattagactagatgattgaacaatactcatttagtaagtacttaatagatacctattatgtgccagtctagatgctgggaacatagcagtatataaaagagagatcccagccctcatggagttttcattttagtgggaatgtcagcattccactacaagagttctcattttcatgggtgatagagtttaaaggcttatccacatatgaaagaaactcagggttataggcatgataattagggtgagtggatgtactgtaatcatgttttcttgatggtggtaatttgttcaagaagccattttatcaacaaagaaggtagtgttttgttttgagctctgttgaactcttgaaactgtttcaagaatatgttgagtaatgatccaattagtcttttccattgttttctgtcttgtaacttccatttggatgggtgacactgatcatcacttttgaggctcttaacccttatgggtgttgtgaatacagtggtgattgaggatgacttcgtgaggcttaaccatatggttttgtcggtgctcttcctgtctgtatttgtactttgtcttcagtgtctgtcaaccagctcagttatgattacatggtcaagcaataacgtacaaatgggattttctttgttatttaaattcatctataaatttcttacttttaagagagaatattttgaataaatctgagaatacatttatgttatttcatagtcattttcactaactggcaggaaccttctttgagtactaggccaaggactctgtggttgagtaggtcattcgtgcataatggagctgtgattgcattatgaagtgtgtgtgagggaaggtatacacagctgtgtggttctccattagtggctttggataagtgactactgtttattatttgtaaaacagggataatacatactttgtagaatattttgagaaacagattatgggcactgtgtcagacagtaaacagtgagtggaaacccttatgattaaaatataaacaactattaatgcttttaacataatagtggaaactcaagttttatatttcactgcttctaaaatattttggccaaaaatcagccttagttgattggttcccagactatttctcacagccaaagtaattagagagctgccaatttatcttggttagcttagacaagtatggggcattttggttttaattttaccaggacatttattcagctctcagaatgtaattagagagcatatactagaaatacactttggttatttcatgattaaagtaaataatattgtccacttaaatagtacatgggaaatggtatgttaaagaaggaaaaaaggttttctgtgcaatatggagccagtttacctgtcctcgggtcttgctggaagacatacttttgaatttcagatgcctgagaatgagaagcagcaaagaatatgtgggtataatagttaactattccctcttacgtagcattgctgtcagggatattactgtctcctgatctccctgcctcactacatatttcttctggccctcatgccttttcttctgcctcaccttatatgttgatggtgataagagctcttttaaggatcctctcagtttaagctaccctttttctctaggtgatgtatccccatgtgatgacaacatccaaaccctatctctagtgtgtatctagtctccaatcaaaacctgtgtgtcttggggtcatctagacatctccacaacctctcaatcacaatgaattcaaaattgaattatatgtgtcagccagacccacttttacaggtgttccccatttccatgaatggttctaccatcaccctagtcttccttgacctgggccttttccttagctctttcctctctttgactttctatattcagcccggacatcaagtcatatccactctacctctttaccattagattaatttcttgttctttaccctactgtttctgctgtagtatatatagaccatcgtcttctcaggtctggatcaaccagagatcagatcaacccaatctcctggatgtctttctgcttcagtcttttctttcatcctgtgctttacagccaggttgcgctaagtgaaatgagaatcttattacatttctcctctacttcaagtacttatgtaacttctcattgcttttcaaataacccccacattgcctttaaaataacacaaaatcttttatgttttggcttctgccttcctttcttacttcattattaccagttcagcttccgcctgtcctgtcttcactcataagcccccacttcacttgtacagtggattattgttctgtgcctgtggtttccttttttatgaggaatgttctcatgtttccacacaactccctatgcctgacacataccttccattctggctattttgtctgaataatgagtacccatttaaaaaataaactcaaatgtcaacttctgcagaaacgcctgcctggtgaccctcttcttctcctaacctggcttaagtcctttgcttttttttttttttttttttgttgttgttgttgttttgagacagggtcttgttttgtcgcctagactggagtgcagtgacacaatctcggctcactgcaacctctgcctcctgagttcaagctattctcttgcctcagccttccgagtagctgggattacagagacgtgccaccacgctcagctaagttttgtatttttagtagagatggggtttcgccatgttggccaggatggtctcgaactcctgacctcaagtggtccaccctcctcgacctcccaaagtgctgggattacaggcatgagccactgcacctggcctagtcctgtgttttttgtgcaacatgctattgacttaatgtatgcttatttgtagccctcactcccttagctcctcaaaggttgtctttattcatgtgcccatgaacttaccacatcgtagaagccattatataggtgaattgacttgactgtttttgtggttgcatattagatgtgaaaaacatttttaagttatttttattgagaaaatttacatatcacaaaattcacccttttaaagtatacaatccagtggttttggatatattcgtaaggttgccagggggcgacggggaatgcagagtgactactaatgggcacaggatttctttttggagtgatgaaaatgctctagaattagtggtggtggttgtaccactttgtgagtatactcaaaatcactaactgtatactttaagagggtgaaatttatggtacatgaattatatcttaataaagctttaaaacaagtgtacttttttttttgacttattcaagtttgtaccacttaaaaagttaacacaattttttttttttttaagagatggggtctcactctgtttctcaggctggcctcagactcctgggctcaagcatgtttcttgtctcagactcccaagtagctgtgactacaggaataaccatgtccgtctcttaagtttttaccacctttgaagatagctgggacactactcgttgtccagggtgccaggactctgggcacttattattggcaagggaggggagagcgaatgtgatcggctatctccgcaggccccgcctgttgttctttatgtcagcgtgctgtaacactttaaaagtccctctttgcttatgtaaaatttagttattttcagaatttatttaaattttgttctaattagttatgataagaacaatcgtcagatgcattttttccacctcataatgtcctcatttggtttggattatggcccttaaatatttttcttatatatagaaagaaaagtgtgattatggttgggtgggatggaggttcggagttttgattagaatttgagtaccttttccaagattaacttttgcattggaacagtgatggtgaattacgggatttaatattggaacacagaataatacatttttgttattttaccttcttggctgttacacaccatacacttaaaactgttttttctaatacctaacattttgatagattttgggtttaatgtatgaaattgtagtgaaatgtgtctcattgctttctagcactgttgataacatcttcctgttacagaataaagaataccaagtacagataaaagtaatttttcttaaaaaacttggattttagatatcaattattgtttataacaagttgaaaccaaataaaagtaatccctgtttcttgagttcttgatgattttaagttctagctatatggaactcagaacacacagagttctattgtgatgctagttttgggtctgtgatgctgatagagaattctaaaagttcgagcaacagtctccattttgtcttgtgcttttgaatcttctttcttgatgtgctttctccctgtcatctgttactcttcttctcatctttccttaccatgcccctcgcaaccaaactaaatttgagagaacttacaaaatgacattttatgatttttgttttgattacagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcaggtatgtttgggaataattgcctggaaatgaaaacctgatagcgtaaccacataataaaaagggtttgtttgttttggatcatttccagatttcttgtactgagatactgctttagcttaatgtatacggaatgggtcttagattggtctaccatagcctttccctgttactccttgaaaaaaaagtcccctatatataccaattactaaaaaattcatgtctgtaacctgtttaggtgaggtagatactccgagccctgccatctcttttttaaacagaatgctcttttatgcctctttaagttttcactggacagtaagtagtagatttgtgtgtgcgcattttagttgcctaacaaagcctaggttttgccatggtataagattttaattggaaatgttattatttgagatgatacttaaattgtagttgctgggatgtagtttctttgattcatttaatgccaaataaccaacttggcaaaatgagaattttggccatgaaaagaggatgaggggaaatatcctttctattggaattttcaagtctttaaaaatctgaaagttacagtgtttaaagtaacgatcctaattcttatgaaagattttccttttagtatgttgtcatctgcaaggtggttgactatagtatgaatttatttttttttcctcaacagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggaggtgagatagggagctgagtgagagctagcttgatatgtggattgtggcatggcatgatgaatagatttttgtgttttattaagttcctgtaagccagttgattacagttttgcactaaaaaaaatacattgaagtgggtcatcatttctgtcacaaatatttcatgaccttgggataagcagggatgctattctgccagtctgcactagccgtgtttactggttcgtgtgttaatgactgggtgttaaatatttggaatattgcttttggctagaagatgtttttcttgaggaaaaatgatagcactaggctgacatttcagaataaagaagtttcagcagtaaacttagccccaagtgttttatcctgagacagatactggcttaacatctaatttatttactttcatttaattaaaaaacatctatgatttgcaaaacatacagttcattagcgctggtgctgacagaagtcactttaatcttttaacgcatctagtaccttataattttatgtcaatcagaagagtttgttgctttccacaaattatttacgtaacgtatactaatagctaatgtttgctgaagaactgtgtgaagtgctttgaatggattatcttgtttaatggattatcttgttttattgattaagaatcaataaaggtagatattatcattgctattttcagtgttacatgttacaacggggaacttagggcttagagaagttaaattccttgcccaaagttttagggctgggtgcggtggctcaagcctgtaatcccagcactttgggaggccaaggcgggcggatcacgaggtcaggagatccagaccatcctggctaacatggtgaaaccctgtctctactaaaaatacaaaaaaattagccaggcgtagtggcgggcgccagtattcccagctactggggaggctgaggcaggagaatggcgtgaacccgggaggcggagcttgtggtgagctgagattgcgccactgcactccagcctgggcgacagagcgagactccgtctcaaaaaaaaaaaaaaaaaaaaaaaaaaaaaagaaagaaaaggactagcaaaagaggattaaaaatccttgtcttagttgtcttagtttttgctgttgtaacaaaataccgtcaactgggtaatttaaaaacaacatgaatttattgcccacagctctggaggctaggaagtcccagatcaaggcaccagaaaatttggtgtctggtgaggggcttgatctctgcttccaggatggcccctcctttctggatcttcacatggtggaaaggccaagtgctgtgtcctcacctgatggaaggacaaggcagctcccttcaacctcagttacaggggcactaatcccagtcatgaaggcagagtgattaagtcatttcctaaagacgccacctcttttttgttttttttttaatactttaagttctagggtacatgtgcacaatgtgcaggtttgttacatatgtatacatgcgccgtgttggtgtgctgcacccattaactcatcatttaaattaagtatatctcctaatgctatccctcccccatctgcgcaccccatgataggccccagtgtgtgatgttccccttcctgtgtccaagtgttctcattgttcaattcccacctgtgagtgagaacacgtaagacaccacctcttaatgccaccaccatagggattaggtttcagcgtgaattttggagggaagcattgagaccatggcagtccttaaagctttcttttcttctcctgctctttttaacactttgtttgccctttcctgagactccctttctatcccagggagagaggagaggtcttagggataggagtaagagaccataaagaaagggacagaatggttttttgaacttgattacattatatttgattgcatgtcccttgtctttcctacctatcctagaaattaggggatgtagatttttgagaaccaacttgatgttaatgtgaccttaagtcatttgctcaacctctgtagacctcagtttcttcatctgtagaatatagaattatttagatcatctagaatgcccttttatttctgaagttctttatatcactaaaccacaagactgaccaacgtactttatggtttaaatctatctttgttctcttttttaaaaaaaatcataaaatattttaaaaatacaaaaatataaaaataatagaggagacagttgtgtatccagcacaaaaatttctatcatttgttaccattttgccatgtgttttagattttttttttttgagatggagtcttgctctgtggcccaggctggagtgcagtggcacgatctcggctcactgcatcctctgactttctggttcaagcgattcttctgcctcagcgtcctgtgtagctgggattacaggcatgagccaccacacccagctaatttttgtatttttagtagagacggggttccaccatggccaggatggtctcgatcacctgacctcgtgatccgcccaccttggcctcccaagtgctgggattacagtgttttagatctttaacaaaatagaacatttaagacattgccaaagtctcattctcatcttttccttcttgtcctgcatgtatctttttgtgatatataaatctattcatttagactgttgtatagtatttctttgactaaactagtttattcccctcctgagtcacagtttctttgtatactataagaaatagttctttagtgaacattttaagacatgtttccttgtgtaagagtttcttcagggtagatacctagtggcggaattgctagattgatggaatccagttttacttcttcagtttccccagatattgccaaaataataaatgaaattgataaaattgaccatttacatttcaaccagcaaccattaagtttgattttgccacattgtcatcggtgattcttgttaccagacttattaatttggaccaatcaaatgtatgtgaaataccttctcagtattttaacttgcatttgtttgatcactgtcagctttcactaggttatgttgcagtagccaaaaaatctgcaaatcttcacgacttttaataaaaatggtttatttcttgctcatgttacatgtgcttggtgggtttgttatggctcttttccacaccatctttatttctgatcaagactgaaagaatagcctctacctgggatatgctggtttcatgataaagggaagagaaaacatggtagaaccatactacagttcttgaatcttctgcttggaagtggtatatattactttaactcacatttcattggccaattaagtctcatggccaaggctgataacagtatagtgggcaagtatgatcctctcatgggaaggatactcaaaaccatgaaaacagtactacagcttatattaggctggtgcaaaagtaattgcagtttttgccattaaaattaatgaggctggccgggcacagtgggtcatgcctgtaatcctagcactttgggaggctgaggcaggcggacctgaggtcaggggctcgagaccaacctgaccaacatgatgaaactccatctttaccaaaaatacaaaaattttagccgggcgtggtggtgagtgcctataatcccagctactggggagactgaggcaggagaatcacttgactccatggggcagaggttgcagtgagccaaggttgcgccactgtacttcagcctgggcgacagagtgagacttttgtctcaaaaaaaaaaaaaaaaaaaaaaaaaaaaagtactgaggctgagcatcttttttctcctcccctccccccctccccctcctttttttttggagacagttgctctgtcacccaagctggagtgcagtggcatgatcttggctcactgaaacctccacctcctgggttcaagcaattttcctgcctcagcctcccaagtagctgggattacagatgcatgccaccatgcctggctaatttttgtatttttggtagagacggggtttcaccacattggccaggctggtctcaaactcctcaccatctttttatgttttatttaggtttatatgatcactctgaaatttttaaaaataaatattatttctcagattaaggactttctcccctagtttctagacttactcatgagtaggtggtgaattttatcaaatgtattttttgcatcaactaagaggatcatgtatttttctaacccgctaatgttgtaatctacattattttctactgttaaaccatctgaatttctaatgtaaacttggtagtgatgattctgcattcattttgtattatttttatttaggacttttgcatatattgcctttaattttcttttatcgaattgtcttcctcagattttgttatctgggttgtattctatcctcataaagttgcttcccttttaccattacctagaaaagccttggataaattactgttggtctatttttggtgatctggtagaacttgactttaaaactgtcttggatggtagcctttttgggagaagagtggaagtggaaggtagtttttgttttttttaaatcgttgattcaaatttttaaatttttttttcccgagttagttacagcaattaatatttttggtagagattgtccatttcatctaatttgacaaatttattggcatgaaggttttcataatattcttgttttgtgcatttgatttttatttcttatttctagtgtcgtttgcctttttaaaattattcttactatagatttaccattatatattttttcccaaaggaaacaacttggttttatcatttctattgtatcttctctattttgtaacatttcatctcgttttgctctttttctttgggataactgtgctttttctaatttcttaacacttaaaacattgctttcatagctctaattttcccttgaagtacctctgattgattgtacaaatttgaaatacagttgacccttgaacaaggagggagttaggggtaccagccttctgcacagttgaaattttacatataactcttgactgcccccacatgtaactactaataatcagtctcctgttgcctggagcctttccaataacgtaaacagtcaacacaattttgtgtgttgtattatatactgtattcttaacaataaggtagagaaaagatgttcttaaaaaataagaaggagagaaaatatatttactattcattaagtggaagtggattatcattaaggtctccattctaattgtcttcatattgcctgaggaagaggaggaggaagaggagggactggtcttgctgtctgtttcttggtggaagaaaatctaggtgtaagtggatccatgcagttcagacctgtgttgttcaagagtcaactatatagtgctttcattaccattcagttttaattttctcgtcctatcccatttgggtctcccctctcctccactctcctcccctcccctcctcttccctcctcttcccttccctgtcccttttcttcttttttcaacaggatctctctctgttgcccagactggagtgcagtggcagtccctcttcttgcctcagcctccagaatatatggggctacagatatatgccaccatgcctagcttatctttaaattccttttatagagatgaagtcttgctttgttgcccaggtaggtctcaattactgggctcaagcaattctccctccttggcctcccaaggtgctgggattacaggcatgagccactgtctctggccccattatgtatcatttttgaccactggattttttataggtgtgatttaaaatttccaaaagtgtgtgcatttgtgtttatgtatgcatgttttgtgggaagagagaatttttttgtttgttcatatttccagttttatgttacagcgtggtcagaatgtggtctaaataatagagattcttaaatttattaagactttgaaatatatagtcaatttttataagggttctttttgaatttggaaagcatgatcttcttattgttgataccggtttctaggtctgtccacttggtcagacaattatgtgggtcatgttatctatctctattaattgtttaactgcttagtttatcagttaataagagaggtgtgttcaaacctttccttgtaattgttgatttgataatttctcttggtattcctgtaagtttatgctttacaaaatttgaggctagattgttagatgcacacatgtgcagaattatatattcgtggatagccctttctttttttaccatcatataataccttgaaatttattttatttgatatttatgttattgtactagctttattttagttagaatttctcatgactctcttctgccttttatctcctgaccttttttttgcgtttaaacattgtatccttatgtctttgagatgactttttaatcacatttgagaattctgtctttaaactggtaaatttagaccatttatttttagtactactgagattagtgactctattttgccatttaattttggattgtctatttttcttcgtttacttgaatttgcttttttcccttttactgctgctcttttagaaattaagtatattacagacacacttgagttaataaagtctaatgctaatcactatgcctactcgcctctttccccatcttatttagtatgcatttcgtagatctcggatctcgttttggaatgatacaaaaacaacaatttcttatctgtgtaactagtccttctatgatctactacctgtagggaatcaacttactgtgttgcctgaagcagagttgagatagtatccaaagcgaaaagcagcagtttagtcttctaattcaccaagatttaaattgggaaagcataggagtcttcatttttatgactgtattaatttatagttagagtatcttttcatttaatagatgattacttaatattgccattataagaatgaactttggaggacaagacatgatgaaataagcttaaaaacagcatttgtgttgagtaatcctttctttttcttttgagttcatagcaaaatggagtttgaatagattttagtgatgctatcccacagcagatcttatgtaccagcagttcacttgaattctaagctgtgactttacatctcaacataggccataattcatcaatatcctaatagctattataacaatgcagaagttataaattatattccccattttattgcattttccttttatacaagttttcctcttattttgattttcccgttgcttgcttagtatcattagtttgggtctgttactcatcagacctgttcttgtttcctcctcaggagtggagcccagagtacagccatcatggggttgagcaggctaatgtttcccaattccagtgttgaccttaggcagattggatgatatgctgatgctgcttatcggtggttctgtatctctacaccggaaatcaccgtctgaggactatttggggaagtagatatgggaaactgtagctattaatgaacttttgagcactcaaggaaggagaatagaatatgggaaagaaatacttgtatttggtttgagagaatagatttgtttccatctgtttactctcagcaaatattgtatttctttatggctcttcagaggactgtagttattgtttgttctttttctttctatatgtacatgtgtctaattttcaattaaaccttgatataacatgcccactgaagaagacctaattgtcttcacttagggtgtttacaacaatggagagaagccactcaaagcatgggctgtgcaggaagtcatgaggtgatagcttggcttacagggatcttatagagagtagggtgaggttctaaaaggcctcaaatgccaggatgagaagattaaaactgatccatagcaaaaaggagctgcttagtaatggaccagaggttgtaaagtcattggtatacaggacctagcaaagtcaagggcgctgtttagattttggaacattgtagctagctatatggctgcagtaatttaaggggctggggggggggtcttctttattcagtgcattgcttatgatgcacatcagtggtctctatagataatttttttttgtgatgcgattagaacattgggtatgttaggcactttcctgttcttgttacctatcagtacctttggtcaacaaaagtaccccctttaaaccatttaatgtgaatattgctatatcaatggaataatttttttaaaatcaaaaaacataattcatgggggcatttttgtttgacatctgaacatcatctctgcttcctagcttactcactctatataattaatatattctgtataatctatattaacatgttgttatatatttatatgtattttatgtgtctatatccccatgtatctgttcatatcccttctttctcccctcatcctctactttttatggcttcctgtttccacattgtttttcctgtgggctatcaacctattctttatctcctaaacttcaggaattagataaagacaactgtccaaggaaccaatacagtactgtttttaaaaacaaatcgccatctttgaaatttgtgttcttttaaggaaagagggcatttgctaatattaagtggataaaaaatttttatgccacacagaattttctggattccccaaggctggaaataataaatgaacataaacattgagtaacagtgcatttttaaatgatgattatagttaagttaaaaaaaatactatggaaatggcccaactttaatgttatttttggcttatgtaacaataggtttattgctaagccatgcgttaattttgacctgaggcctaggctctctttgtgcatttgttccaaatctttgtggtaggtactgtttcattgttgtcactgataattacaatttacattctatactaatttatcatctattgatagtcaactgagatctcaaaaatttttcgaaaaaactttgaagattttttaatgaagaaactttataacttgatttttttggaaatgtttttatctcattgagatatttaaatggtatgtgccaaccttctttggttccagagttaaattgtagagaatttttgggtgtctcttggatcctgcatgtttacttcagggacttgactctagcactctttatgatgttgctgctaaggtcatttacatactcagtgtgttaaaacagcagagctctttcctctaagcgggggaaaaaaacaataaggtttagttgaagccatggatataaagtcaggcgatctatgtttacttttctttttactctttgggtatcttgggggagtcacttcctctcttctattctcagattgcaaagagaatgaaaatatttgcttcctccatttctagaattgagctggttttactacaactgataagtcggtatatgtgttttaaagtttgcaaataagtgtgaaagttcctgcaagactttggaagcttgagtgaatgtgcattctgagttagagttgctcacattttcctctggcatctcaaagttgttcccacatgttgattttgtctgagaatcaagggcattgtttctgcctacacaggaatgtcagtaccgttttttcttagttatgaataaggctaacaatgtaggctctcttcatcagtgttctgttgataaaagtatttctcagagagcagaatgtgtcgaggtctttttgcctttcttgtgttgagttcgggtctcggaaatccaatttgctatcattactttgagtgtgttttatttgcttgtttgtttattgttgtttcttttcaccctccaaggtggtatttcagacctatagtactgacacttactaagtttactagttaaacagtttcaactatctacatatttgtagaggatctggaagttatggcactctataagattccataaaaatagtggcagatttatatgtcattttgggaactaggaataatttaatgggcatgtattatgtgcaatttaaaattccagtgacattggtcaaggtggcatgtctttatccttttagcttaaaacaggatttagggtggtaattctattcaaaacttaatttgtatttactaaatgggaaaagactgccgtgccatgtaagtgatagaatattttggtccagcttgaagaacacaaggagctcacagcagcagagcctggcctcataatcaagtcactccttagctggacctcggcccccctccctcctccactcttggtcacgtataacctcaggctatcttttgacctctgttaccacttgattttctgagtcttcccttgtgtcaagttggtcctctaatcagacatatgctgagttgcctggccttccttccagtttctgaccctaccaactccacattttgctttccccatcacatgattcctgcctatcttagtttccaactcaaatccagctctcagaatgttcttttcttccttggaacttgtttgcaccattagtttggcaattaagcatgcactgccttgtgaaagactctcttgtattgctgtgttgaacaactgctaaactcttgtattgtttgatttttctcatgctgatgttgtttcttcacctggtttattattagtttctctggaaaaataactttcttctctctccccatagagtcttaacggaggactttgcctaaaatacttctcatagaaagtaattttgatttatttccctgtactttcttgtacatttataaagtttttatctttctatccaagataaatgatagcatttgtttatttatgttcctaagtcttctctccatcccctctaattagaaaacaaagatttgggcatttgtgtgtgtgtgtgtgtgtgtgtgtgtgtgtgtgtatgtgtgtgtatgtacgtatatatatataatccacccaccctcatcattgcgactgctgtccattattgccctgcttttcagatgcttggaaacagcagaccgacttgttatataaatacttcaaaggcttattgtaaatgaaaactattatgtttctacaaaagattgtgaaactctaggcatgagagccatatagaagttactatggtgtgaccctggccctttaggagctcacattcacagctcagagggaattgcaggctcccggaagctctgttctttcacttctgttggagctgctatcagaccaggttgtttgctggctgggcgtaggctgggcttgaagatactataattcttattctttgtcccttgttttctaataatgcctcctcttctcttgaggaaactaaagaatgataggccattttatttctcagcattcgaggaattctttcacatgctttttttcttctctgtcttctccacatttggtttcaaaaccaggggattactttgtttgcccctgcatcactggtattttaaaagcattaaacttgaaagtaatttctaactgtgagcagccatcctgacatacttttgaagaaactgtccacctcttgctggataggcatgctacacactggcagccatgccaactccttggtgatttaccacttagtaagtttttaccctcatcagagggtggtagtagaacaggaactagatctttgaattatttctctgttttggaatgaaaattacttcagggtcgagtaaggttagaaatgttgggaaaagttattttcagaataaaatttatgctttaaaatcagtttggacacatttttgttactttaaaatatgtactcacgccagttagaatggcgatcattaaaaagtcaggagacaacagatgctggagaggatgtggagaaataggaacgcttttacactgttggtgggagcatgaattagttcaaccattgtggaagacagtgtggaagatccttaaggatctagaaccagaaataccatttgacccagcaatcccattactgggtatatacccaaaggattatcaatcattctaccaaaaagacacatgcacatgtatgtttattgcagcactattcacagtagcaaagacttggaaccaacccaaatgcccatcaatgatagactggataaagaaaatgtggcacatatacaccgtagaatactatgcagccataaaaaagcatcagttcgtgtcctttgcagggacatggatgaagctggaaaccatcattctcagcaaaacaggaacagaaaaccaaacaccgcatgttctcactcataagtgggagttgaacaatgagaacacatggacacagagaggggaacatcacacaccagggcctgtcaggtggtggaagctaggggagggatagcattaggagaaatacctaatgtagatgacaggttaatgggtgcagcaaaccaccatggcacatgtatacctatgtaacaaacctgcacgttctgcacacatatcccagaacttaaaagtataatttaaaaaaatatatgtaggcagtaaaatttaaaaaatctttgccagagttcatcaaatgaagggatgtaatctaattacactctctcatgcaacaacaattatcagtatcttttgttaaatccactgtgtttagaatcattctgtcatcattactgttttatttctagtctttgatttcttttctattgcttcctgttcttctgaacaaatttaagatgatgttactgacatagtttttgtttttcagctatcaggaaattttaccaattatttgctttcctcatcctacctccaccttcccagctgccaggcatgatatgggggacagggatttgagaatcttgtctccacctgtgaatgttgtttaatttatcacacaaaagctggaattaggtgcattctattcatccattcccttagcaggagcacatactctgtggccaagtggaaacatggacagaatttatcattagtatttatagcactataacataatatgccagcatttggagcttaaagggattgaatgcggtataacataataaaatacagtctgtaaaaatccgtggattattcagaaaaatagttttatgatgcaaggtggctaaattattaaagcactgacataaatgatctgtcagtttgctatttaaatatttatttaattatgctctacaatggagttatacatcaactctgaactgtgttagaaaaattatgattaggagtattaatttatcttttattttgttttgactcttatattctggagaggcacctgagggcacaagctccattctgtctagtaatcaaactacatctcataagtgtacttcatttgcagaatatgccattttagcctgttttgagattaagcctgattttgtgcatcagtctggttatttgcacagagaggaaacttaatctgagtgttaccaccatctacttgttgtattcactgacatctccttccagatttctgtcagcaacaatttcaagtgaatcaaataggactgctctgataagctattcttccgtagcacagaaagcctgtatgaatcaaatgtcaaaattcattctaggcaaatagtttacagagaatgtgctagcctacagaagtttgctgctcatggtttttgaaataagttttcatggaaatatggtgcttagcaacttttatgaaagatacttaaaaaaatttggtgtgcgcttctggctagaagttcgatactagcctctttattatctaacagttatagtcaattctccgtcttttaaaagagattataattcattagagacttaagctaagtcttgctgtttaaagtgagtagtagaaaaagttggacaaaaatcctgggttttcatttttaaaaaattaatgacagggttgctagtctccctttgtgatggtatataatttttaagaaaaatgagaagttaaggaagtcatattttcacactattttacaaatttcctctcaaaatagtatttatttaaatatatcctatgtgttcagaaataatttttatccccagatattgatttggttcctacttgagctgagaagataaaaagaaaagtatgaagtatcatttttccttttatttatgaattttactttcagagataagctttacatataagacagtaatagcaggtgtttatacacacacacacttatatccacatacataaacatatgagtcaaattgataaagtattgtttatagttctgaaaagtaatacaaaagcacagaagtgccaagttactataggctggagtcggtatgcatgtcttcactgaggagaaacttttggatttcaaagaatgatatatttagggctgagcacgctggcttatgcttgtaatcccaggactttgggaggccgaggcgggcagatcacacttgaggtcaggaatttgagactaacctggccaatgtgatgaaaccccatctctactaaaaatacaaaaattaactgagcatggtgagggggcacctgtagtctcagctacttgggaggctgaggcacaagaattgcttgaacccaggaggtagagtctacagtgaaccaggatcatgccactgcagtgcagcctgggcgacagagtgagactccatctcccaaaagaaaaaaaaaaaagatatatttaggaaaaactcagctataccctaacctaacctattacatttttcattttaaaactgcttaaatagtagcatccaagcaaaaattgggggttacaagaaagaaaaggttttaatatatccttgcgtatcaaggatgacataaaaaaaatgtaccagaaacatttgttcagggcaaaccactttcctggctttacagggctagtgttgccatttttgatccaggctttctttggcttggcattaactaggaatcttcatcttgcaaagccagtgtatttattggggtttaaataaattaagctctttgcttctgctaaatctatggagaagtggattcccacccatgggaaagaaagcataaaatacaaatgcactgatcctacctcctatcctttttcagtctgcttatcctaattttgcttttcccaggttccttgcattgggggaagaatcacgtgtgcatatgtacacagtaacatgtacactctgcattgtcttagaacagattttgtagggaacagagctaagtgtgcatgttcattctaccatctttaattggaagtctattttctacttaataaaagttgaacgatgagcatgttttgtcacatactaaaataaagtggactcttcccctgaatatagcacatgtcaaagttaccattaggctctctggatatcttctaaaaagacttttgattgtggtagctttagtagcatctgttttgacatagttcattgttttcttgcagatgcttttcattagttttcattttgttgctttagtattccctgctggtgtctagataatccgttttattttgcatgtgtgtttaattggggggtgggtcctaggagatgaaagaggatagaaatgcttttctccttaaaatatgttatttggggccgggcgcggtgtcttacatctgtaatcctagcactttgggaggccgaggtgggcggatcacgaggtcaggagtttgagaccagcctggccaacatggagaaaccacatctctactaaagatacaaaaaattagccgggcttggtggcacacgcctgtaatcccagctacttgggaggctgaggcaggagaattgcttgaacccgacaggcggaggttgtagtgagcggtgatcacaccactgcactccagcctgggtgatagagtgagactcagcctcaaaaaaaaaaaaaagttatttgggtttttggcaaataggtgcaattcatttgttattcacttggtttgggtcactatttattatatatagttttgtggctttattcattaaacatttctggaccaagcattggtgatatcatgagggatttttagtctcctctgcccctggttggagcctgtgcagtaaaggggaaagatttcattcctgtgttcatggttgggtttcacactgatttacttttctatttcttggtgcttttcgccgttagactttcttgttactagttccatgatgatatccaggtgttcctttatagtattataatacaaaaaatgttctaagcttcctgcctactttttcttcctctggaaacaaaatccctactttttcaaatctagcagataagcagctaagtaacagaggatcagcagtttgagtgaatgactttagtgtgtgaattacctgtactgccttctaagagatctctgtattttaaaagaagatacctgtttactctaaagaatctagtggtcgaattctagtggtagaatttcactattgaagccaagagaagtaaaaaaataaaggcattttggggtgggaggaggctagagggctggatttttggcatctttggatcaggtgggcacactaccagtagtacagcctttttgaaaggcacggttcagggccatgttcacccaaagctgcttaactttcctgcttctgaattctaggttctttctgatgcctcagagtttcctccttacatagttgtagcattttttgtgtatgtgtgttttaaatcaagcaagaccttaaagattcacccagccaggtccccctccctccacactccagtggtgaacaaagaccttgttgtcactttgtcttttattttactttgttagtcatccaccaggaatgaaaaacttttacttggaaaaaatgtcaaattgaatagaaacactgttgccccaagtagatcaatgtttaaaaactgagatatctcaaaatgaagtggatttttccctagattgcctagaagttgcttgtcatcaaattcaagaatcagaaattcaggtggtgaagtatatggcaactactgttgttaggaaactcatcgagacctctccttttgtgtcacgtcctatctccctctgctttacaaccataataaagtaagcgtttaagtgatataagattattctgcattgtaacttgtcttctactttggttagtttttaaaagaataagcactcctggctaatagaggtaagaacagtttcaatgggtctggcttgtgataagatgtaggatctccagtcgtcttgtgtttttccacctgatgatttctttcacaaaggtagactcaaatatagttgtcattgaagattgtcagataaatcttattttagcaggctgtgttaatcttttttttttttttctttttgagatggagtctcactctgtcacccaggccggagggcagtggcacgatcttggctcactgcaacttttgctgtcctggttcaagcaattctgcctcagcctcccgagtagctgggattacagccacctgccactgcaactggcaattttttgtagtttctgtagagacatggtttcaccatcttggccaggctggtcttgaactcctgacctcacggtccacctgcttcggcctcccaaagtgctgggattacaggcatgagccaccgcgcccagccaatcattttttttttaaagcattttaagtgaataattgagcatttgatttattatcctggcttttctatctgggtctttgaaagggacaaaaggagcacatatacaccatgggatgtagcctggccagattgaaaactgaaaattgatggatttggagtatgcaggcagatagttgaatgctgggacagggatcctctttgctgactgcctcatggttaagcttttaaaaatttgttggttaagcttttaaaaaaattttagggtttttagggcaatgaagttactctgtatgatgctataatacatcgtggatacgtgtcattgtacatttgtccaaacacatagaatgcaggacaccaagagtgaaccctgacataaactgtggactttgggtgataacgacatgtcagtggaggttcaccagttgtaacaaatgtacccactgtgtgggatgttggtaattatcccaatgggggaggttatgcatgtgtgaaagcagggaatatatggaaaacttctgtaccttatgcgcaattttgctgcgaacctaaaactggtctaaataaaaagttacagatgcccaggttcttcttttgtagattctaattcagcgggtctgatgccggctggagcatttgtgcagccagagttaagaactgctttgagaggcctcacgttaagactgtaggaggtcttactaagtgcatgtttgggttcctttacttcacagctgtttgctaactaatcgatagctgaatttggttatgatttgttttgagcaatgcctaggacatagtaagggcttgataaatattaactctaattgttattatattttaaaatcctgattatatatttttctcaggattttaccagctttcttaaatttctgatgaaaatacttaagtcgtatgccttggataaatttctagtattcttgtattttatcactatttggcttagaagggccttaatgtaaacgtatgccacttatatatttgcaatgtctttgtaatttaaataacttggttagactgaaaaattaaaccctatttagtacttttacaagtaagaaaaaccccacaagatttaaaaatagtatattttatcttgtaattttgaataaaccaatccctagtgtccaaggacttacccttctgttggagggtcagaagagagacattggctataaccagttgtgttacaaaaatgtagaatgtcaaaggtgaacttatttcccactgaaataaactctaagagtagaaatatttgttttttgcagataagaagttgcaaatttagcaggctatttagcagctgtttacttagagcaaatgaagatttagataattcttcctcataagctagaatactattccattaaacttttattaccaaaggaaggcatttatggaatgcctgcagggctgtattttatgaatggctgagcaactgacatactagaactgacagaggtgtttattgtcttgtttaagcaaaaaaactttttttgtataaaatttgtgggtatttacatgtcatcaaatatggttttcttagcaagctttaagatccattgctctgggggcttttttgaggttttctgcatcttcattccagaggttggctttgggtttgttgtggagctagaatgtaaatgtgaggagtgggaattggttcctggaatagccttctgcatacctgtttggagatagaagtcctccaagtgggcacaccctagtctactagctgattcttgtgtcttgaaaactattgaaaatttctgggctgcaggagataaaaactacaactgcctaagaaataaattcgtgtgtagttatgaatgagatattaaaaggttgatattgtttaaaactaaaaattagcatttattttctttttaaaaaaaggggccatatcatagacttcaactgttattgacagtgggtttttttgtgttaataatgttggtagcaggatttcagatttttttggtgccattttccacatagcataaaaatgaaatatatttttgcatcttgtttaagcttaccgagttgcttatgagattaattatatgctcagttaagaattctgaaatatttcaaaacccagcagactggggtggaagaacattccattgaatactgctcttagacttgatgggcttggaagcatcgtgctcatgaaataagggccttacttatataacaagtaagaagggcaagtaaggagtcaaagtatctatgtgattttattaaaggtgaacctgtgtgcttatagctttactaggatttccttttaaatgattgcaggttacagttactggagggtatctttgcagtctgttctagtctagtgtgtgtttttctaagcagcagctttttaattttaatttttagcaactgaaactacattgaatggtattttgtgtcattcctgtcaacaacactgcaaaattcccccaatattctgtcataatcctttgaatcctgtggaatggaaaagatgtggcaatccttaatgaactgtgagaagttttcctttctccctcccttcctttttttggtttattctctaaggaatagtatacaagaaaaatatgttgtaagaatccaacatgtttacgtaaatctcttatctatcttaactgtttacttgtatacgtatatacaaagttttcctgattaatgaaaattaagtttgaaaaaaatttttcagttacaaaaaaaaaaaaaaaagaaaacaaaaagaaagggacgggtgctgtggctcacacctgtaatgccagcactttgggaggccaaggtgggagaattgcttgagcccagaggttttagagaccagcctgggtaagatgatgaaaccccatctgcctctaccaaaacattttaaaaattagccaggcatggtggcatgcacctgtagtctcagatactcaggaggctgaggcaggaagatcgtttgagcctagaagtttgaggctgcagtgagccaggattgtgccacttcactccaggctcagcaacagagcaagaccccatctcttagaaaagagaaatatgtatttatgtatatgtcttctatatttatgtatctacatgcatatgtttgtatattatatataatatgtatcttttttgagtatttggaaaaaacgttttcaaacttaattcttactaatgatcagggaagcttttcttaagaatcttcctttactatatcaatgtctcatttactactggaattatgtttttaacacacacacaaaattgaccagggtttctttttcctggggtttgaatgaactttgggaaagagatgtgttgacagctcccttagattggtaagaaaataattatctgataaatcacagccttggatttgagacactctctcttcttccgtatggttttattggattcccatcctcctcccccaacaatgtatcagttgttgtgtttgctctgtgcatacctttctttccttggccttttatatttgcatagtgttgtttggagctagtgcaaaatacatagcttcagggctgtaatgtatagattgcattgtgcgcttcccatcatcgtctcctcagcacacaataactgcagtgtggagggccctacacggagacagtgatggtgtttataaaacgccagtggtgtgtggcattcactacaatctgccgggtaagcagttgcacaaattcctccaagttgagaggcctccagaaatgtcatgttttggcctcagtgttgaatgccacaaataacagcacaggcatgggggactttgctcagcctctcagattccagcctgccttccttgggctgcatctgcagtagatttcatttactctttttctttttaaatgaaagttcccaaaagctagcattctaatttttgaataatgtattttgagcccatccaaattgtcttgttttgtctctcttttgtgggtatctataatatataggtttttaaaaaaactaaaactctgatacctggaaagtagaccaaagggctttttttgtttattgttttaaagttttcaacccgttaactttatattgctagtgagtggtataagtagggttagggagaggcagacagacgaaaaatagatagctaagcttgttgatatttaatatagaaagttatattcaaaatatttctttttgaagtgtatttggcaagttttattaacagttgcatggtttttattgtttaataaacttgatatcatattattagaatagagattgactcggattgtactttatgaagattctactgtaagaacagaaacaaagcaaaggcatgcttcagatagcaagaagaaatgacagcgaaagtgatgtcttagtggaggaatgtgcaagactaggaaaccccctgtcctttctgcataaagatgaggtatggcctactcttaagaggaaggggcagattggctttttccctctagttcccaaaatgtatttggaaatgccctagtttactaaggaagagtataagcataatgtagaattgtgaaaatgaagtgttggtctgtgctggtcttctcccagaaactagttggcagtgtgtgtttggtttaggtccttgaacattatgggttggtagtccatcagctaggtaaggaagattgtgtaagaaaccagcaggcctgaattctagactcaactctgccaactttttgactggccttatggcattgagccgttccatcagcagctatcttttggcctactagtcagctaattactcagtaggaggcattgaagtaagatgtcctctttcttaaagaactcagtatctgaaagtaataagtatcaaaaggagtagaatagaagaataagtgccatagatgtgaataatgctcttgaaggagaatgatgcaatattgagagattggaacaggcttcatagggaaggatattttggagatttgtatacaagtagaggtagttttgacacttgtaaataaatcagaggaaaaaaattagaatatgtcttgataagtcagtaagtggttctctttatctggggcaataccccaaaattgctgtgacaactaatgaagcaactacgtgtactggtatcttaggtgaaagttatgaagcaaaattatgtgtatattttgcttggttaacaaatgtatatttgtagtcctttttatacagtagaattcaagttgttgatttttttttttttaaaagcaatgttaatggaagaaaattactttcctggatagaagtgtggaatattagtgtatattaagagcatacataataatttaattattttaaaagaaattcagaaatcagactgaaaaattagataaactttctataaccttatttttcttatttgtgaaataagaaagtttgattagataatggaaaactttaaaatcatatttaaaatcaattattattttagagcagctcaaaaaggtcttgtaatttcagctggctttaatgaatccatgtaataagccaaacattttattgatcactttaaacatacttcatttaattatctcatcaccattataaggtgggtacttttaaagagcggaactgaggcatagagaagttacgtaacttactgtggttacagagctgttaagagtagggctgggggtcaagcccaggacactgtgattatactgcagtacttttcttccgtattgttaagaattggtgattctcaagaaagatggaacataccagaatctcgggggaaaggaagaactattttgaggaacaatttcaacttacatgcccctgtacatttttatgtgctaccattatgcattgtgccttggttcttcacccccaccccaaagagaattattatttatggaatgtgttgtgaacagtgtgaagacaaagttgtgagccactagatggtgttgctgtctgagccgacccaatcgagtttgattgaacattagtgctataaatgttataacttggaacattcatatgtagcatttaatatgtgtcacctgataatctgatgctttttagaatataagaagaaatgtactacttattttgtttgcctttttgaataagcctccaaagcacatctgttttaggtttcttaggagtgacttttctgtgtttttttgttacaattttccttctcagtccttctttttattccctagcttatgtttcattccctcttgtcttgatgactttattatagctatttaaaaaaataatgcgtgttagaaccttttatatgttgagtataaataataaattagtagaataaaatcattgtagattaataaattttattaattttgctagggattcattgagctttcttaatttgaagttttatagcgttgtttcttttaatattgcctttcccttattctctctcatctccatctaggactctgatgagatatttgtagacccctcattctgttctccatgtctgtgaagttctttcatattgtccttccctttgtctttctcagccacattctggatagtttttttcagatctatcttccagttcactggttttctcttcagctttgtcatatcctgtccatttggattataatttagttactatagttttcatttctaggtgttttatttgattattttcaaaacctgctttttcatattcactttttccttagtcatattttaaaatatttcttataaacacataaaacatatatattttgtgttttgttcttgataattctactatgtgcagtctctgaagatctgattctgatactgtgtctctcaataatggtgtctggtttccttgtcgttttgtgatttttaatgtatgttttttgagatttttgtctatgagaatttcttgcttctcccaggcagctgggcatatctaatcttggaccagtttaaactggattatcttttggcatttttgaatcaaacagatgtgaataccagtgtctacatctgcgttagagtcagatggtggtacaggttgagtatcttttatctgaaatgcttgggaccagaaatattttgtatttcaagttttttcagattttgtaatacttgagcactccaaatcaagaaattggaaatccgaaatgctccaatgagcattttctttgagcataatgttggcgttaaaaaacttttggattttggagcatttcatattttgggtttttggatttgggatgctcaacctgtaattctttcctacctcatttagtgaggtgtggtctttaaaacaaaaattctgttgtagaatacattagtaaatgttgtattaaaaaatagtgggctcttttgctaaatagttttgggaaacatcaggtttcccaagtgaaaggaataatgggaaacagggtttttgcattgcaggactcctcagggtgtctgttatacaaataggtgttttggtgctcagtaatcatatgcaacaaggagaatttttcttgtctcactctgctgctctttttgggaatgagtggtgtatataactcatgggatgagtgggaccagtggaaaataactttggcaaatataggttggcctcgtgatacctttggcttctgctaattgccttctcgctgtctttcctactgtttataccactttatgactgtgcgtgtatgtgtgtgtgtgtgtgtgtgtgtgtgtgtgtgtgtgtgtgactgtctgtcttgtatttaatctccctgagggaagtcgtgattctatctgctattcctcatccccagagcaaaagattgttgttgtgcagagctcttgtatcaggctatcttgtaggctactggtcacttttctttgagccaattgggccaggtacctaattatgtccaaattggtagatacataatgctttatttttggcttcccattcattctctttctctgccagttgcatataaatttcctgagaccatgtttgtcgtgctcatcattgattccctggtatcttaacataggaactgacacatatgggtcaataaagattgagtgctagcttggcaagtcctcacagtcatctgagagtcggacagggtaaccagcagtcatatcgcatggcttgtttattctggatggcttccttttttcattttactgtatcctccagtatcttttgaacagaaattcactcagtctctataaacatccgaagtaaaaagtaagctctataaacatccaaagtaaaaagtaagttattttgaatatctgttttctctacctcaaaaaatcatttcctcctctaagattcccttcagatatcatattcttggcgcagctgtgatttctgttagtcacatttactcattccattcctggtgttctgatagcactttgtacatcgctctctcaacatgtgcttcatgtgttgttgcatttttgcttttccttccagattttgagttcgttgagggtggagaggcagatggaagcttaagtaatgtgtatgtgcaatcaggatctcatcaagcattgagaatatctgttccctggagagagaaggaaagaatagtagagaagcagctttagcatctagaaacattttggtgtttgttagatgtggactagtgaaggaatagttgacagtagagtactgctatggttggttgaggcatattccatctcactgggttaattttattctcacgtgagctctgaggtagctattaccctcattttacagacagggagacttaagtggttttactttgtcacactggtgcggtgcagtaatagtaaatgcttacaaaatgttgaatgatagaggaactaggtccgatagaggaactggtccagccatcatgctgatacctcatgtactgccaaattgtagtggtgagctgtgtggatgttttttcctcttaatcttgtaaggaaattctgcccatgagggcatgttcctatttttgaaatggaaaccaatgagaacatgtgaattattagtaagagttgacttgaagctagtgttggaattggaacgtgttttctccttgaactgaggtgtatttttgtagacatcagttgtcttaaatatcctttttaccctaatttcaaatagcatcataaccaattgttatgtactgcaactcttttagtactcaccgcacctcctgtggtatctgctatctgttatccccatttcacagatgagcagattaaggcaagcagacgttaagtgtcttgccatgggtcacatagcttgtaagtagtggaagtgtatttagaactttggtgtttgacatacagagcccaatactcttattctctatgctgtatttgtatatacttttaatatgtagacaaacaagcacatatctatcttaaacatgctcagtaatttaattgactattaaatcctcattgcaaacctgtaatatgtatgtgacacattgttttatttttaaattttttattatttatgtatttatttattgagacagggtctcactgtcacccagcctggattgcagtggcgtgaacacagctcactgcagcctcagcctcccaggcttaagcaatccttccaccccagcctccggagtagctgagactacaagcacacgccaccacacctggctaacgtttgtattttttgtagagatgaggtttcaccatgttgcccaggctgatcttgaactcctgagctcaagagatatgcctgcctcagcctcccaaagtgctgggattacaggcgtgagctaccatgccaggccttacactgcttattatgttgaaataatgttatctgtgtggcattctccttcttccctttacaatttgatgcaattctattcttttcagaaatgttaccataagaggcttaataataaaaataccagattctcctcctcaagatacatgtgtggggaacattaattttcacacactggatgagctagtacacattttgatagtgagagggcattcgttttgaggatggaaaagtctgatggctttttctttttcactagcagtgcattggtggcttttatcagtgcacctggggaggaggcgtgtgtctgacctgacctcacagttgggttgttccaggggtgtgcatcttaattggagatgagtcaccactctgcttatgttttgccattgaagagacaatgagcttttcttctatggctgtcaaaggctcttacatctctgttcacagcagcttcttaaatttatatatatatattcaaggtaaaaatatgttaagtccttaggggcagttgatttcttgtcccacttccattatcttgtatttttagaatttatcccaaggagcgaacaccatatcattttctaggaaattgtaaataggagcatagctcatatagaaaataaaattctattctacagatatcatggaacaaaaaatcaaacatgaaaccaaagtgttgataggataaattatgttaggatctactgaataatagggctaaatgattttcctggggagtagtgtactttatagatatgagccaccttgaggaattgatggaagcagtttgaacatttttgaaataagaaaatgaacagctaacatttcgcctttttcgtcctttttatgtctatattgagtagcagtaaagcagacggtgcttgcttatgcttttgtttcagattttatgctttgtatatgtgtgcagggtgggagggctaaagttaaaaaattaatcacttttatattgttagaaaatgagaaaacaaatatttaatgttaatttataataaatcatgtatctgatatgatgtcttaaatttatagcagtcttggaatctttagtacttgaaaagtaaagttattattttttctccagaaacatgccaagggacaagtgttatttgacaaagtgtgtgaacacctcaatctcttggagaaagactactttggacttttgtttcaggaaagccctgagcagaaagtaagtgatttcaagtttatttttatctttttagaacatattgtatttttttattaaccagtttatctcagtttaaaatttagctttaaaataacttaggtgtttattatgacttcactgtgaaatttggtaaatactgaaaaactatcttgtgtagagagaaaccacctgtagctttttggtgtatgtgtatttgtgtgtgtgcatgcatatgtgtacatgctttgcacttacatcatgagcagacagaatagaatgtcatcagtggaaaagtgatgttctggcataaagagaacacagaataaatggtattattttaatcacttttggctctcaatcactcagtctggcctttcggtactaaataagtaaagaagctggtcacatctgctcatattgtgcagtcacctgtatgctaggtattaaagcatacctgaaaggcagggaaggcggcacattggaacgattctgtctgaggataccaagaacacttggtcacagtgaaagggattactctccatgatctaacattcaaatcacagtcagcagaacagagcaatcaatagaagaacagaagtgtgaattttatttgcctacattgctatcgttgttagtatttacatgtcctactaatgaaatataagataataagagtgataattatatatactttaagttttctcaacttgcttagctttaaatacttgatatctaatttgtggtttaattctttgtttagactaaagacagttaaattacatgcctgcctgctgaatactacatgagtattcttaatagaactctgtttagagtactgttttcagacgtaatagcacatttgactgaataaactaggttttttagactgtaaattataaggtggtcttgataatgtttccaattatgtgctcttctgtttgtcctaaaagctgcaaaagagaaagtggtgggaatttggctaggattacctcctttttttgagatcacatactggtagattcataggagcatataatataatctttgtaaagtagagggacaattcagtatgttgtacaatatgtagaataacatgttctcttagtaggcataggatatactacattaagaaatctgggctaagcgtggtggttcatgcctgtaatcccagcactttgggaggccgaggcgggcggatcacttgaggtcaggagttcaagaccagcctggccaacatggtgaaaccccgtctttactaaaaatacaaaaattagccgggcatggtggtgggcacctgtaatctcagctactcgggaggctgaggcaggagaatcacttgaacccaggaggcaaaggttgcagtgagccaagatcacgccactgcactccagcctggatgacagagtgagactctgtctcaaaaaaaaaaaaaaaagaaaagaaatctgatatttttgaaatactagttttgcataagaaaaggtagtatttagtagtatttatttagatagtaggatatactgtttttttattttgacaactctcaatttatgtcaattcagctttcactgaatctcagactcatattcttaattgcctactggatgtaggagttggcaattccctctgtctgtcatctacacatttagtacacaccttgtttgttactctttctccccattattctatgaattcctcgagggtagaggccatgacttacttatctgtatagcctccgtatatgtagacattaactgctatttattacgtgtgtgttatatcacacctataaggatctccactctcatgaaaatagaaaatagcaagtgttggcaaggatgtggagagactggagatgctgtgtactatgggtaggaaggtaaactgatacaaccactctggaaaacagtgtggaagttccacagaaaattaaaaatagaactagtggccgggcatggtggctcacacctgtaatcccagcactttgggaggctgaggcgggcagatcatgaggtcaggagctcgagatcagcctggccaacatggtgaaaccccgtctctactattaaaaatacaaaaattagtcgggcatggtggcatgcgcctgtagtcccagctacttgggatgctgaggcaggagaatcgtttgaacccgggaggtagaggttgcagtgagccgagattgtggcattgcactccagcctgggcaacaagagcgaaactgcatctcaaaaaaaaaaagaactccatgatctagcagtcccacttctgagtatatatacaaaataattgaaagcaaggtcttgaagagatatttgtttacccatgtttattgcagcattattcataacagccaagagatgaaagcaacataaatgtccattaatgggtgaataaagaaaatgtggtgtatacatacaatggaatatgtatgtacatatcaatacctactcagccttgagaaagaaggaaatcctgtcacatgttgtatcatggattaacctagaggacaccatgttaagtgagttaaagcagtcactaaaagacaagcactataggattccacttatatgaggtatctaaagtagtcagactcatagaaacaaagagtagaatggtggttgctaggggctgggggagggggagttgaggaattgtttaatgggtagtgtttcagttttgcaagatgtaaaagttctagagctctgttggacaatgagaatgtagtttacattactcaactgtatattaataaatggttaaaatggcaaattttatgttatgtgttttttactacaattaaaaataatcccactacctgtgtacaaaccagcgtgctcgctgctgaggctctaaccgtaaacggtgaggacgtgactctgccctcagagatgcccctgcttatgttttagttgagaaggcagagtggaaaagctaattctgcagttagtgaattttgattactactctgcaggaaaaagtcaggatgctaacaggaggactctgcttaggaggaagtgatccttaagcagaaacctcatgtgtgagtggactttggctgggtgatgggacatgggaagcacatacacgaggccctgagactggagcagctgtctgcttaaaaactggaaagaagcctggtgtgggttagtaaggggagaatgagattaggctaggggaaagactgggtgttaacaaggctcagatcatgcagggccacttaaggctatatgttaaggcttgggacatttcctttttgctaagaaaaatggcaaaccattgataggctgaagcaaggatatgagatgaccagttttgtctttaaaaaggtcactttggttgatgggtggcatgggatgagaggggacttgagtagggctgtacacccaaagcacaaaagtagccttgagtaaggttttggcagtggaagtagaaaagcgaatgattgaagagagaatgaggaaggaggctgactcaatctgatgaatgattgaacatgaaggatgacagataccaagaattaaggcctgggtttctggatggttggagttgttcagtaagaagggtaggaggactcgactggggggttggtaggggatatcatgagtgtagtttctgacatattgagttttaggttcaataacttacggaaagagcaagtaaataaatgaatttagttttggaggtgtcttaaagaatgacagcttgcatggaacaaatactccactctaggtataatctgtcttagcagtgcagggtgcatggggtagctttatttcctgatgtgaatatcatattcatatggaggcttgtaaccaggagtacttctttgtaacttacttgtttttaaaaaaatcagaggtggcttttaccttgcaaatattccaaataaaatataaatggctgttaacagctgatcattctggtattctcactaggcagcaggcaccttccctgtgttgtctcatgtagttctcagaataaccctaaaaggtaggtactattaactacacttatagatgcagaaatttgaggcatagaggaagttaaagaagtcacccaaggtcacctagccaataaatgttggtgataagattcaaattcaggcaaaaaactgagaaggaaaaaatacattttagattttaaggaaaatgccaacagttgtaaaccttctgtcagtcaaggtaaaaatgggcacagtttttcatagctatcacaactggaagtagaagaataccatgttgcctcagaggaatttttcatgttctcaaattctgaaagtcaccttgcaagactttaaacatagtgtgttgaaggacattgtaagctgagttcctaggatgagtttcacagttgtcatttctattatattgtcaacaaatttaagggcatgagctaacttattgatggtgattctgtgatggtctgtgccagtgctgctcaaaagagacttcttcctttgtgttagaatcacctgggagacagattttcaattaggaatcttatttatctctcttcttcctccattgttcgtaaacacacgtgcgtgcgtgtgcgcatatgcacacacacatagaaatgcacattcattgggtatgccatgattccttcctttccagttaaaaaatagtgccattactgtttaatttacatataggatgttgaaggatgttatgggctgtgcttccagcagggatatgtcctattcctcagatatgttgggacagaaaacagattaacctttggtcaggttgatattttcaagtatatagctttccagtaatctaattcagtgatagagcttaatataccctgtcctaaataccagctggacatttattagggactagataggagagacacttgcaagttttactacctgacaagggcctgtggtatgaatattttatattggtatattaaagcagatctataaattttggaaatcatatgagcagtttagtgttgacattctattatagctattgagaattacggccagtattctggatgtgggcagggaagggacattttgcacagaagaaaagtaatcgttccagcatgaatgatcatgatgtgggtgcggagtttaaagtttgtccggagggctggaggatgtggcagttccagcctctcttaataggaaagacctgtgaggggtaggcaagctggcagggggaggtagggactcgtgttttctcatgagcacactgttttaacttagatcatgggttaatttgggatgactttgtggggagtgctaatggagtttatgggaaagcagctggaaaaataagcaaatatcattctttggatcttgtatctcatgctgaggaatctagattttaagtaggaagtaacgtggtcagatttgcatatcagaaagaacctgttgatggtgtggagcgagatgataggggactgagaccagaggcaggaaggtcaggagacagttgcggtagtctagtctagaggtgatgaaaaccagggcagtggtactaggagtgaagaggaaaggacagagattctgtgtaggtaatgtctgcagtcactttgtgactgccacctgttagctatgacagcgaggggagagttgaggaaaagtcctaggtttcagggttgggtagctggggagcttgatggagacttttacacagggaccttggaggaagagcagcagtttgaggtatgctagggagcggagatggaacttaatttttattttgccaagttggacacgtttgtaagctgttggctagattggggatcagggagtaggtgaaggatgaagaaatttaaaagtaaagaatttgagaggccaggtatggtggctcatacctgtaatcccagcactttaagaggcccaggcgggaggatcagttgagccctggaatttgagaccagcctgggcaacatagtgagactctgtctctagaaaaaaattaaaaaattagccaggcatagtggcatatacctttagttccagctattcggaggaggggagaggggtgctgaggtgggaggatcacttgagcccagtaggtcaaggcagcaatgagctgtgattgcaccactgcactttcgcctaggtgacagagcaagaccttgcctaaaaagaagaaagaaaaaaagagaaatttgacagtgagtgtaaattgttgtttaaagaagtgtttggctgtggagaaaagaacagatgggagaatgatactagaggatgtaaacctgcaatgtccagtacaagttttcatgatgatgaaatgtttgatacctacactgtccagcatggcagccattagctgcatatggctattgatcacttgaaagagtgctagtgtgtacgaggaaatagacttaaattttatttactgtaagtaatttaaattgaaatagcctcgtgtgaccagtggctatcatattgcacagtggtgacagttgactgagagttttggggttggcagatttactttgatggaaataactttgactttagctatgagaaaacccaagagaagttatgtttgaagaaagaggagagtgactatgatgatgaaagtcatgaagaggattagtcttgaataaagatgttatgtcatcctgagtctgcaagaaacagaataaaaggtggtgcagttgttaaaaaaaaaaatcttagttgagcaaattgtagtctccaatctctgtgaaatagagggtaaaagcatttgcttaagagtgactagggtagcagtgggacaagagaaggagccaaccaagaattagtatgtggattgctgttaatagttctgctgagattgtgggggtcatacatttgggatggcagcagaatatatttgtgtgtgtttttctctaattgccattagcaaccttagtgtcatagctgaaaaaatggagtattagcagggttctcagttgactatgttcatggaggcaatagtaagaggatgcaggattgtgaaatctgaagttgctgatgagatgtaattaagctgattattcacagggtcacaggaaagaaaattactgaagctgtaataggctgatacattgggagaacgtggctggggcaaaggatgaatgttcaaagatgttgaagagtaggtacagtggtacagtggggatacatgggtagaaaattagagggagaggaaatgattgcatctgagaatgagctgatgaagtctaatgaggtgaagaactatgtgatgatgacaagacccagggtgtggctgtgaaaggggatggctgaagtcaaggagacagattaaggtcattaaggaagaaaatactaagataaaggtacatttgtttgggtctactgtagcgttcttattgacagaaagacactaatgctaaataaggaattcataattccttattatacgtggtagtttctcttatgaaaggtaagatgaacatataaaattagacacatgctttgtatatagactttaactcaaaaactttgggaacttaagaatgaggtgtcctttctgagacattcacttttcaggtgtgaatatttaaatacaattagcaatatctttaattattcatatataatctgatttgctataacttttatgttgtgtaatttttaaaaatttctatctgcttatgtagacaaaatccagtcctcaagacatctaggcaaaacaactcttattcttccactatagatttgtatggtatcctattttttcccccacataaatttattactattatactaactcagctcaatcagtcctgctttgtttaaatcccatgcagttttaacaacagaatataatgatgtaaggatctttcctttccatgccgaatattatctgtacttatgggaaattttgattcttaattcaacccattataaagtaaaggtgagtgaaaaccacgattatttgtatacaaatttttcatggagagaaaatctacacatttgtttggttttaatacagtactatatctctcatggttgagacactgaggtgaaagtctttttagttcattctaggtatgaaaaatctgtcattgttagtgttaaagcttttttaatgtctattgagagtgcttatataaactttactatggaaaatgttgttaaaaatacgtggaatcaggcaacatgttattcaatatggaattccaagtccatatagttcttgtattcatgtctaaatgaaaccatcgttaagggttttggactctctttaaagggaaaaatattgtcttgaatttttgatgttaatagtttggcatttggcccaaaatgacattataacgtcattttgctgcaagctatattgaaaaaggagcttgttagaaatgtagttgatattcacggctaactttatgaaaattagttgaagcagtcatctaatagaccattttgttccagaaactagaactaaaaactcaaatattaaactgtttgcatatataaactattctttaataaagttctacattcaatctagttaaactttataatcccacattctcccagatgtgtagtgaatgtttcactgtgatacagtgcctgtaacttttctcctaacaccagcattatggtagagttctcttaaacccaatttaggcaaaggtatattaaaggggatctgtttcagcactataaattcctgtgagaaaatgcagattctagacaaaactacttttaacatttagtcatacactgtgaattgggttgaatttgttaatttctcttacctggccaaattagagatcacctaaagcaagtgaggaaggcatggcgaggcatttgagaaacttcgaactctggggtcttagggtctaacttaaaggagaattaaatgaatgagatagatttttttggggggaaaggaactgttaaagaaaaacttattctaacacttgttaaaatggtaaggcagactttattcaggactgttgtaataggtataaggacctttgcagtggggttttgcagtaggcaagagagattgggctcagctccagatacgacaaggagaagtggaaatttatagtcaaggagcagggtgggggttagtagatgggaaactaataagaggaaacatcaggggtgcacttaggggaattctggttaaaccaagctaacaggattcttgttgaaggcaggtgagggtgatctgatatcacttgggggatggtggaggatgaggaaccccatcagatatcaagggtaattagttatcaaggatgggggtttcccactaaaccaacttattaacaggattcttgctaaagttggatggtgtgtagatggacacagaagtctaaaacctgaagcctaattgggaagaggattcagaggagcctgactaaagtttggtcaagaaaagactctttgtcttaactagaagatggattttatgactgtattttgggttgttatccaggtcaagcatggttaggaccctgctgtggacaactgcacacccagactactaatgccagttgatgactgtggttgcatatctcttctcaggtgaaagtggttagcaagtagaataaaaagacctggaattctttggtacagctgcttattgtgatggggaggagttcaaaggaacacttagatatgggaatgtggaaactgtgccctgccagggctttctgcaggaagctgtcaaaaattagaaggtttactcagtgaaggctgacaagccagtaggacttgaaaaatgtctctctatattgagctttcaggaaaagaaagaaatttctacataaaaagaactctagggctatcctactcaaagagtggtccaaggaccagcagcgttggctccacgcagaagcttcttagaaatgaagaactctagcgctcaccctagacctgctgaaatagactttattttggctagatgttcaggtgattcatacgcacctttaaagtttgagaagcattgatgtagggataaactgttcttttgatgtagcagagagcattacaggagtttgaaatgtcatgaaagccacgggaggaggggagtcctagtgggcccatgtggttcatggtcccagaagtgttcaaatattcgtagccactgaggcaagagttaggccgttccccaaatatggacatttggaccattattctgaggttctttctaacactggtattctatgaatataaatacagtattaggattcataattaagctttttttttccccctagatgtttctgtcactagagcataattgagaatcatgtttaacactttttctgggaacccgtaatgaaaatgttgtaggggaaatgtcataagacaagactttcatcctcagatttgtggcaaataaagagtaagattaaggagattctctaattaactaatagaaagattttagtgtaaaatacatataagtacagctattcactgtgctgcttagtttaaaaaaaattctgtaaccttttaaggcaggaaaaaaaaatcccacctctttttgtgccttgaattcctttggcagtctgctgaattctataggctgcttctcagaacagtgttttcaatgtataactataataaaagtacacagggctacaaagaaagccaataactaaataacattcccaaaatagtaatctaaaattggagacaaagtaataggtatgtatattagtctgttttcatactgctgataaagacatacctgaggctgggcaatttacaaaagaaagaggtttacaattccacatggctggggaggcctcacaatcatggcagaaggcaaggaggagcaagtcacatcttacatggatggtggcaggcagagagagagagcttgtgcagagaaactcccgtttttaaaactattagatctcgtgagacccattcactatcatgagacagcatgaagatctgcccccatgattcactcatctcccaccaggcccctcccacaacaagtcagaatcatgggagctacaagatgagatttgggtagggactcagagccaaaccatatcattatgtgtttttatttatatattaatcatcagtatcaaatctagtagctactgtgacttcaaaatattggctagcataaatggtattttaagatctgcagctactacaatgtgatgtggaaatgtttttgatttctgcaggtgacaaagaggttctgctgatattaaccaggtttttttctgctatgttcctaattgacagtgatgctaagtttcagttagaagttagtaaaaataaagatggaacatatttccccaaacttgagttcattacctcccaatttcatgtttgaaggtgatttaacaatacttgatattctttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccggtgatttaacaatacttgatattctaaggccacattttaattttattttacttctgttggaagcctgttttaggattccttataacttttattattagtctcttattttacctgatgttcatttaggagataaatatttactgtgttcatgttttgggtttggattagggaatggagaggagaaagtaaggagaatactgaattgagtaagtgactgttcctgctcttaagtagttggcaaaatccttgttttattttttttaataaaacaagataaattttattgaaatctgatataggtcagctctcgagttttgcatggttgcttataccttaatgtttgggaaacactgagaagatccctgtcttgcctgatcttgaattgcctgaagctgtcactttcctgagttccttccctggagaatgttttaggatgttctgggcagttgtccatggacaaagagctgtcttttaaaaaatttgccgggtggatttttaccatcggccaaactggataatactttaacatgtacatagaagctcttagactagtcatatagaaagggcttggttttcatgtcatctcgcctgtgaatacagtgaccctattttgtgaaccgaaagtctgatttattaactttttgtgggtagaaatattcatatagagattaaattctttaatgtatataacacatcacctatggatatataaaattatgtgaagaagatatatataccaaaagatgataatttagttttattattgcaaatagtgatctactaatgatgatctgctggggaaggtacttgtatgcatatttattcttcaggcttgaatattgtttgaaaagaactaccctatgaggtagatgttgtgatccccattttgtgtttgaggaaattgaggcttaaagaagccaaggaatgtgcccaagttagagttgatagaaaaccagaattttactgcgtgtatttctgattccacggtttatatatgtggccacagcagacaaatctttaagtctaaaacctggcaatgaatactgtagtgtatcatggggtgagggcggttgttgtatgttgtgcacacacaccctcatgcatttttctcattctctgatggcattttccatctttttgtgtctgcttcttggtctgctcaaccctcctccttaagtgtcaaaccaagaaattaatttttattatttactgtatttatttaaaagttttgtttgttatttctttgtaactggtaatgcagatcattaacttgtatttcttttaagtcatttaagtcattttttttttacttaggaatttatgatgctataccccacttaccatctaagtactcattagagatatgtattcaagtaaaaataaatgtaataaaagtaatataacgtgatcatttaagatgatcacagcgtggagaggaaggaggcaagcaaggggcatatatcagtcagcaggtattaatttagttctcactggttgcctaaaactgtattaagtaccctggaagatataaataatatggtctgttccagcccttgcaaagttgtagtactggggagtgagaagacagcctaatgcttggcaggaatggaacttacagtgtgaaagtgagtgtggttaggaaagggaaaacgcggtgaggaagtcatgctgctgtttgatcacatcaggtaaaccccgcccacttagtctttggatggttgaaagtaagccatttcagccttcagtaatctgtctggcagtgttgtggaaagtggcctgagaatgacaccaagtctgaatttggctgtctgacttttcactcatattgctgggtttatagagctgactcttaccatgccctatagaaactgttaggtaatttgtacaagggccgggtgctttaggtgagaatagaaggtgccaggtggctgggacacagggttagtccttgggttcacaagcttccaccatcttctggaacagagaagggtcctttgttgctcttctgtactggggatctgtatcactgctcacacttaatgaaattggggatttggaagggtctgtctttaagaccagcactttctcttaatttctctgtgttaatattctggggactttttttttcttttcaatttggcgccattcaatttcgtttttcttgctatggttgttccttgggtgaaaattccacccatttgcccctttctcacctctctcccagcctccaaccagtgtgggctagaggctgaatgatgtgttttttcattcctgtgcacttatcgaggctggccatttgtgagccagctgttgggtgggacagcagctgcagtgcatgcaaactgaatggcaggctctcttctgaaggggtaattagagctgctccctcacatggcactggaggcacccttagagaggcctgctgcccctcacgtcagtagtgcatgcagctgggacaccagtaatatgaaactagaccatgctctggtagttctttattgagaggtttgaatataaccagtgttagaacagagccatgtacaccttggatccttgctaccccgagtgcgggccatgaacagtagtgaaacccgaggggccatgcggctctgctttcacagcatcttactgttttactttttaatagtgtcagttaatgttccgttataccattttaatatggtattaagacagcaggttattttctgtgtactaataagcattttaattgtttgctttatatatctgaataaaattctgtttaagcacagatgttgtaatacagtggtccccaacctgtttggcaacagggaccggttttgtggaagacaatttttccacataccggggtgggggtgagggaatggttttggcatgaaactgctccacctgagatcatcaagcgttagtcagagtctcataaggagtgtgcagcctagatccctctcttgtgcagttcacaatagggtttgtgctcctctgagaatctaacgcgggtggtgatctgacaggaggcggtgctcaggtggtaatgcccacttacctgctgttcacgtcctgctgtgcagcccagttcctaataggccacgatcggtaccagtccgtgggatgggggttgaggacccctgttatattattttggacactgcttagaatgagtaaaacttaattagactcatttatttgaattagtttattgtacctcaaaaattgcacttctcctatgttagtgataacttgagggtagaaaaatgtaaatataaaaatataaacaaaaaaatctaaattttttattggacttttgcttgtagcttcgaaaaacaaaaatttaatgtccttgggtggttcgaacctagtggtttaaatttggtcttttttgctttaagatgctgtaacagtttcctagcatttttttaaagctttcttttttgttgtttagttggagagtttatttaaccattggatgtaactattgacttgttttctttttttttattattattgtactttaagttctgggatacatgtgcagaacgtgcaggtttgttacataggtatacacgtgccatggtggtttgctgcacccatcaacccccgtcatctacattaagtatttctcctaatgctgtccctcccctagccccccacaccccaacaggccctggtgtgtgatgttcccctctccgtgtccatgtgttctcattgttcagctcccacttatgagtgcgaatatgcaggttttctgttcctgtgttagtttgctgagaatgatggtttccagcttcatccatgtccctgcaaaggacatgaactcatccttttttatggctgcatagtatttcgtggtgtatatgtgccacattttctttatccagtctatcattgataggcatttgagttggttccaagtcattgctattgtgaatagtgctgcaataaacatacgtgtgcatgtgtccttataaaagaacgatttataatcctttgggtatatacccagtaatgggatggctgggtcaaatggtgtttctagttctagagccttgaggaatcaccacaccgtcttccacaatggttgaactaatttacactcccaccaacagtgtaaaagtgttcctgtttctccacatcctctccagcatctgttgttttcctgactttttaacgatcgccattctaactggcgtgagatggtgtctcattgtggatttgatttgcatttctctaatgaccagtgatgatgagctttttttcatatgtttgttggccacataaatgtcttcttttgagaagtgtctattcatatccttcacccactttttgatggagttatttttttcttgtaaatttgtttaagttccttgtagattctggatattagccctttgtcagatggatagattgcaaaaattttctcccattctgtaggttacctgttcactctgatgatagtttcttttgctgtgcagaagctctttagtttaattagatctcatttgtcaattttggcttttgttgccattgcttttggtgttttagaaatgaaggctttgcccatgcctatgtcctgaatggtattgcctaggttttcttctaggattgttatggttttagtcttatgtttaagtctttaatccatcttgagttaattttctataaggtgtaaggaaggagtccagtttcagttttcggcatatggctagccagttttcccaacatcatttattaaatagggaatcctttcctcattgcttgtttttgtcacatttgtcaaaaatcagatggttgtagatgtgtggtgttatttctgaggcatctgttctgttccattggtctatatatctgttttggtaccagtaccatgctgttttggttactgtagccttgtaatgtagtttgaagtcaggtagtgtgatacctccagctttgttctttttgtttaggattgtcttggctatatgggctcctttttggttccatatgaaatttaaggtagttttttctaattctgtgaagaaagtcaatggtagcttgatggagatagcattgaatctataaattattttgggcagtatgatcattttcacgatattgattcttcctatccatgagcatgggatgtttttccatttgtttgtgtcctctcttatttccttgtgcagtgctttgtagttctccttgaagaggtccttcacattccttgtaagttgtattcctaggtatttttttctcttagtagcaattgtgaatgggagttcactcatcatttggctctctattattggtgtataggaatgcttgtgattttcgcacattgattttgtatcctgagactttgctgaagttgcttatcagcttaagtagattttgggctgagacaatggggttttctaaatatacaatcatgtcatctgcaaacagagacaatttgacttcctttcttcctatttgaataccctttatttgtttctcttgcctgattggcctggccagagctgccagcacagcagtctgagtaaagctttcttaaggagttccttgtgattgctacttccaacttagaatgaggttaagaagaaagaagggtgttatattaagaccaggaagggaaatattgtctccaacctgaccttacctctccttacaattatagagttggagggaaagggaggattaaggaggaggagtagttcgttttaggagttgagataattgtgttcgcttggtatgtatatacttttagccaacagtttcaattttcacactttatccttcatgactaggaatccattattgtccttgaagagctctcatttcagtgtctgcaggggctatttgttggcagttctacagaataagactgtgtgaagatatgtctcatcatttggaccattttagatgcaggagaatgaggcccatgggacccaccttaaaagcatgtgaatattttacttatagtacacacttaccacatttacacacatatgtccccaaggacaaagcaatacttagcccagtggaatgctgataggtgcaagttgctttgaataatactttattaaaatgtgtttacacttaaataattatgtgaactgtaaactgttctattttagactctagaatatttcttatgaattaatttttttccctcatgcagaactggttagatcctgctaaagaaataaagagacaactgagaagtaagtatataaataatcattctttgaagttaaggtgtcttgatatctatttgtgatataaatgatcagtaatagaatggtcagttctattttgcatttatgccatcttagaagttaataatactaataatatttttgtggaattgtgactgtttcgtacatggctcaggtgctcctacttttgggaaggttctagactcacattcctaaatattcactcagaatgtcctaccaagtaacatctgacattttttttctgggaaagaaagagaaactacttttctgtaaattttactttctatgtaaattttactccagtgagacctgatactattgctttgtctgcttcattttgaaagtgcataattagttcaatatgcacatctttggccacagagacatagagacactgttcctggatgtactggagtgaggactctttggggagaagcaaggggaacaatcttttcagttctctgaggtcactgccatctctgctcattggttctacaatccaaggccactttgcatactctttgagcctgggcttgtagttaggcctcattgttcatttcttccccttttcccatttgttcttgtacaatcccaaaatgactccaagagtcccactctaaccagcttcagttctctctatacgttctgcctctgcaggttgttttgcctgtggctgtttttttggtatctgtgccaagaaacatgataaatagagagaaatctctgttaggggatctggatacttaatttacttcagggtctgtgaatgactgaagcagagaaggtaggcagctacaggcagttggaattttcggtctggagaataaaatctgaaggctggtaaattcctaacagccttcctcgactgtggagcccagagttgtcccaggagaaacctcttctccaggtgccagcatgcaagatgccctttgtactgttgatttcatttccttacttacttattattcctaaggtcaaaatactgaaaccaatctgtcctttcccttcttgcccttttcatctaccatctagctcccattttaggttcttcacatttgttttctttatttctttctctctcgaattatttatctttttggtagtcttcctgtcatttctttgcttccctactctctttttttattctgagcatataccttatttttcccatttcctcttcctgtagactcatctttcttttcctttttaaaaacgtctttgattagagtgaccaacctcctgatttgcccaggactgaggggcttctcaggatatgagactttaagtgctaaagctggaaccagtcccaggcaggctggaatggttggtcactatccttttgattattattcctggtttcccacattctctttcttgcatttattttcttggtgtttcatccatttatgcttgcttcatgatggaaaagggagaaaaagaagaggaataagtagacaccagatacattatgcttaccttatggaagaaacagtaccagagctttgaaactttttcctttgtcccttctgcagttgttactttgcaaagtgcatgcattcaaaaaggttacggatgcttagttcttacactttctctgaaaccagacctgccaagtgacccaaacagagagaacagggcaacctctgaaacatgattgatgttccattgagttgtttcctatggttttgtttgggttcttgtttgattattattattattttttttttgtgccactctcttcagagtcatggagatttcctaacttttggaagccaaacctcttgccgattatgaatcatgttcttatgttttgattatctgtgaagtttcaaaaagttatttcagaacttttacccttgtggtttggcaatatgagtaacagtaagattagactttttaaaactgttggaaccagttctttaaatggcatcctgtactgtacccatcatgaaagcaggctgaggaaatgaagctttagcagttgtatctacctctttctttctgtattaaaatggaccaaaaaacctgcctattctatccttggtgtctgctataattttatttttatttttcagctcataggcagttagcgaagataaatattaatcttttttgagctacctatgacaaccaacaacttaatgattctcatttaaaatttgccttaaaacctttattttctgaaacataaataagactatatgtctaaggcttgcgtatgactagtatgtaaacatttctgtagctagaaggactgtttataaacagctaggtaaaaattatgatgataatatgtaatcaaattaaaagtttaacttgaaaactgctaagggagtagattttaagtgctctcactgcaaaaatagtatgtgaagagtaatgcatatgttaattaggtcaatttagccattccacaatgtatacgtattttaaaatatcatattttgtaccaaaatgtataccatttttaattgtcagttttaaaaaagcttagcattattggtacatttcaacagcttttagatttggaagtatattagaaaatatgtggtctagtagaaatgtctccgagtcctgtccaggcaagcatgttctagtgttattacctagaaaacaaacaaggagccattaagaaatgataatcctgtgataactttacttaattcgagactagcagtcaccttgaagaaatgcttacacaaacacgatgcatggatatttgacagtcatcatggcgctataggccaagaaacctcatatatcttgatattcaggaaaatcttatatcccattattatgttttaaatgtgtaaagcagaactgaaatctgcttcttaagttcagcaggattgacttcattggttgaatcagtggtgcattgagccaaaatccagcaaaaaatgcatttgtatacaacagtagccatttaataaatatttgagtgagtgaaaaggtagtgtgctgatggtaagacaaaggacaaaatgccacactgaacaagagaatgggattcaaggaatttttcttcaggttcataaattaaacatctcataaggtctttaaatatgtatagaatggaataacttggctgggcgtggtggttcatgcctgtaatcccaacactttgagaggctgaggccgggagattgcttaagcccagggattcgagacaagcctggcaacatagggagaccccgtctctgaaagagtaaaaaataagttagccggacatcgtagcgcatgcctgtggtcccagctacttgggaggctaggatgggaggatcacttaggcctgggacgttgaggttgcagtgagccatgatcatgccacggcactgcaacctgggcgacagagtgagactctgtctcagaaaaaaaaaaaaggaataacatatatacacacacacatttttttaatttaaaaatattatgaacttgaagtcaaactctaaattcaggctagtggaattatttggattccattaggaaaataatacctgccctttcccccatagttttacttttttaaagttatcctacacatgatctatcaaaatagcagttaaattttacgtataaatagcagtgttttaacttttaacaagccatttatgatatggttgcttgacttattcattctttatggcacaatacagccaagtgtatgttatatacgaatatacttacacctactctactaaaacctgggaaataattgtattgtcctaaagtatcatgaaattataccatgctttcccttcttgggatctcttttaacaccttcttcaaatagcccattaataattttttgaatagctattatctcttgatcattactctccttccccacaacaatgtagaaaatcctgaattttaaaaaaaaaaaaaagggtggagaatatttggcaacaggagatcctgtggttaaattgaatcttatctcagaactattacatggaggttatattaaaatttttgtataatagatcaccatataaaacacatgttgaggtatcagtaaatgtttataagaaagagaacctattactctttaatggtggcttatttatgtaattgatttctattttattttttatttcatttttattttataaacaattttaattttatttaaataaaaaaattctgcatgctgatttatagttggattagtctgtactgtttgatccttgacctttaaattttatcacaatagtcattcttctgttaattgggtgcataactgtgatatttaataattacagaccttccatggctattcacttttaatgtgaagttttatcctcctgatccttctcaattgactgaagatatcaccaggtactttatatttgcatttttaaatgaacctttccttacagctctcgtttatttttgtgccctgggagcatagtggtaatttcaggattgaaaaccaaaacagtttttcttaagttttagaagtttccttgaaaatgggtacatccaaatagtttgaaatgttgccagtttcaaaaattttattcactttctttaatatcttcatttatattctagtaatgaaaattttaaaaatgatactgctgacaactttgttttctatgttatacttttaaaagtcactaatatttaatatttgagattttaataccaaggtcatttttattgtatataactcatgtgtgcttatatactagtctcatattacaaagatgatatgaggttagcaaaatgaaattattttaaaagtccaattgaactggtaatttctttctctcttctccctccagaaccaaacaaggtaggatttcttatgtagagtcaatagctagttcatttccatctccttggagattgtgtgagctataagaacatacacttgaattgcaaagaaaggattctgtttaggagcaagagaatatttattgattctgagtacctgaatggcaaccaagaaacattgtgaatcaacaagtaccttgaaatcttagcccagttagactgggtaccagaaacattgtgaatcaatcaacaagtagcttgaaatcttagcctgattacactgggtaccagggatagcatttcttagctttggtgagaggaagtataaagggttgatttttttttttaaaggatgatttttatataccatatttttaaaaggttacttacatggtcaagtacaactgtgtgcagtgcatgacttttagaaaactagaggggcttagcaaaagagtctgcttgtctttagttcctgtatctttgatgctttctgctgggccagttttgttgtcagacatcaagttgtggaagtggttaagagttcataatatccatgtgaaatagcaaggatggaaatttctttccaatattgggtacatagcaggccggccttttttttttttttaaactacttgttgctgaatatgaatgcactaattaagctctgaatgaattagcttcacctagtaaataataaatagtagcttttgtaactgcacagtgagctacttagagcataaaacctgaccgaatggcatgtgtaggatgcagagcttcactgcaggggtgcctctgaacaatgcatgtaactggggctttgtgacccaacactctgtacatacactcctcctggcagtaatttgtttggagaatgataatcctttggtgattgcaagtttgtagcatcagtactttggttttccatataaatggaacttgaacagtctccctgtctagtgggaggaacaatatagtctgctcagctaactaaagttctcagtggtgcagcctgagaccagccacctgcctgtacttgtggcctggaagcttaaatgtcatgatcgaaatcttcaccatgacttgagtgaacatttagaagctggggtaggcttctgagaagggcaagaacactatttcgaataatgtttgaagaatgcttcatagtgctgtgtgaaggtacagttgggtaattcaggaagctcatgccattttttgtttgaagtttttaggatttagacttaggctttgaaaacagaggaaaggaccaatgtgaaaagcagagacaataatataaaaggaagcaacaagatgaaatctttgtgtttaggttctaaaacttccataaaatgtggagaaacatcactgttgtttattagagaatttgaggataacctggacccatggttgaaaattcagttgtctgaagtatgtactgttaatgcttatgtttttctacgggtcaaggaaacatataatcctccttaaaaggagatctgcaaggcataaaatactcaaaatactgtagtgatagcgagaagactttcagtctctcaattaccgagcacttgtcatgtggcaagccctccagtaactgtgggactatagtgatgataaacagagtccccgccctgcctgatgatgtatttgggtggtaatccaggttctgaactgacctggccccatgtgctgggttgtgctctctgacccagtaacaacaaggcctggaccagaggccagcactccccatttgattgtgtagggtagagagcaggaagaggattgggccctaaaacccaggccaggcaagtgtccacaggactaagatggccagctgccagtatgaatgccagtctctaaaaggtcttaaagaatgaggactctgctgttgatttgggaggatccatggtgaccatagcaagtggtgaagttaaagagtagaaatcacattttaaaatgttaccaagaggaattgatagtggggcttaaaaggtgggggaaacccacagggtatatatgacatgtttctgcattttatttcatggaaaacggaaattcttttataaccgtagtgagccacatggaacattgaatgagaaacattatagccactaattattatagctactagttattgattcttaagcatgtaccagatattttatttatattatctaatgttcatgctcatcttcaaagggaggtagagttcttagcgtcttataggtgggaaattacccttaggcaagtaaattaacttgctcaaggtcatatagagtcaggtcttcctggcttcaaagcccaggccttttctgctaaactgagctagctactgctttaaatggggtaaatggaaaagtaagggcttcaaagtagagatttaccaataactgttgttaaaggtgtttctggaaaagaagaaatgtcaagatgataaagggtgggtgaccttagcttttcttacaaatgattaagactagtttttttttttaatctattaatccttacatcttttgaggggcgtgctaatttttattacagtttgaaatccaaggagacagtttaagtgattgaaatttttacttcagttataaaactcttatatatatacacacacacatataaattagccttctggactcagtttctataaataagccacaagtttagaagcccaaggagcaagttgaggctttttattagagaagatgatttttgctgtttatatgaagagtgcctatattgtatatttgttttcaaaggggtactagcttttaaggactgtgagtgctccaatctcacctaatggttctcccctgacccatttctccctctgctcctcacagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggtctgttgccttgcttactggagagaatggccatgggagatttaaatagcttctcttgtagcacttactagacatttgagcatgatttacaggattatccaatttttccttttggagtttcacctagcactaatcaaggcaacgtggagcccttgaggtatcctttcattatttttataactaccgtctgagaaactatacttgtaagactgtatgttttcatgtattggaaaaatgtacttttccccatgacaccttcttctccctatccccctaacacatacacattggagacaaacatgtccacatacttatttgacatttactttatatttcttctgccttataattgtccttattactatatgtggtaagaaagctagggagataaggaggcattgggatttgaattaccagtgtaggtggtgatggacgtaggaatagtaactgaaatgtacaggtgattccgttggaagatgacccgttggtttagctaagattacttaacattacattaataccatattacgcttctagaacatttatatgtgtgtgaaaagaaaatggactttttacacaaatttttataacgctagctacaaaatgataatttgttctatattgcaaaattacagttttattaaatattactaaagtgatctgaaaggaactttcaaaaattaggtttttaaacaggccacattcattgatttttctttaaaaaaaatatggtatttgactctaaatgttttcttattaatttacttaaattctactcaatagacatttgttgtataattctgatgtgaaatatcaggtactgacatgccatggggaatgtgaaaattaatgggacatgatcttgctctttaggagcttaaagtttacttagttgggtatatagataggaatggaaataattttagtatggacaattgatttgtgttacctatcataggtataaaatcaaatacaagtaatttcaatctttattatgatcaactctagtgaaataaaatgaaggagtaagaatgtgtttatcacagaaagatgagatcactgttttttattctccagtacttatgttgtacactattgctggggcttttttcctcagtgaaaataatcaaaagcaactttttaagataaaatgggtaagagtggaggtatacctccatgcagtttagcaggtttacattataggatcttaagggaaaaatgttagaggttgagagttgttttcttaccatttcctacttttctgcaaacttggctgggtaactttctctcctccaaaccctctgagcacagacactcctcccattctgactacatttgctctgcatccattaataagataatactgtttcttttgattctcaggggcttatcgccagcacaagctgattcccagttcttagaaaatgcaaagaggctttccatgtatggtgttgacctacatcatgccaaggtactgtaaatgtaacggggagtagcatcatagtagtctgttgactgaggttttgagagggctccagtttcaggatagcacagcttatttttgggaaaaggatatttgctttcaattgagggtctctggaatatttccttggtgactaattatggggtgtttggttgtgggagggaccatgtattctgtctctaccacttgttttcccagtctttttaattaatgccctttcataggtacttactatgacacaccttgtcagccttttttttttcaccgcttatcctggtttattttgcattgcagcttctgctaggccaagtgctgtgtctgtcccagttccctctcccacctctgtcttgggagaggagagaagaccttagcaaccataaaagggcaaaagtagcatgggaccactttccaaaaagcttatgtttgatgaaggagccctagagttggtcttttccctgtaggtgtgttttgtactttgtgaaagataacgtaggtgggcccaggctctgggtgataaagcaccttcagtctaatttgaaagatggtaaaagagtgggacaatggggacatgggaagccagtcataatcctgaacaccgtaatcccaaaagatcaaaatctcaaaaatataatgctcgaaaaaataattttaaaagttatttaaaagacatttatttacgtttttaaggggggatttgagaaacataaaacacaacagaagttcataggccactttacacgataaattaggcagtagtaacatacattttttttgcaagcataaacgttcggtatactaacgagagtcacagggtatgagttatgaatagacaaatcctgttcataaagaaataagtcaaaaagtgaaatgtgtaagcgcacatcgctatagttggttgccagtaacaatatcacttacatcatggttctagtttagatgattatgtagtggggagagtcgaggagaatgacaagcaaggtgaaatatgaatttggttttaaaaaatatgtccagagtcaacatttccttatggtagcctgcttttaaaagaccctgccaatctgtagatgttgtttagaagcccagattatatgatttgagaaatctctaggaaagctccccacacaatgatgtctttcctccctaggcctctgattaataattcttgcatttgtgttattaatcatacttcatatttacaaagcactctttttctcctcagtggcttcctttatttaaatatttttctttattacaaaactaatacatgttcatcatagaaaatagaggcaaacagaaggaaataaagatcacttaaatctttttatgcagaaataagcattcttaataccttttttcttttctttttttttttttagacccctgggcagttgaattcacatgccttctaaaaatggggtcatactatgagcatcatttttgttagttttttttttttaacttactattataagatttttctgtcagtaagtagtctctggcagcatcatttttaaccactagatgctgtatgcccttaattttaaaaagtactttcataccatctcattttttacaagtataccatctcatttaaagtttgaatgttttttaattttacagctacataaaacagtgcagagaatgacttgtttaaagccatgtattgttaaatggtctatctgcctgataccgtctggtaaatcctagtaggaggtgaaacagattgtcttaacactccagtgtttttcagatcattttctatgtaatggggacaggctaggttagccaagaaacagaaatagggaggaaggaaaaaatatgtttgagaccaaaaagagctcccaaacctctcctcctctagaccctgccattcttaccacatgcaaatcttgcatctctactttgttgattgttagttagaaaccaattcttaaatggcaatgctgtatgtaaggtttcaggattcttgtttttaatgttgtctcttagaaaagtaagaaattgtggactctgttctaagtataatactctttcttgctgtgtagttaggagcagaacactaaaaaaattcaagataaccttcattctgtttatcatccgatagactccttaggtaatatttgataagcaagatatttgtggcttattgaaaagaatatatgtggcagtttaaaagaacttttcatatttcatgtcgtttaaagttttgtgtctttatttttcattgccttaaaatcagatttttttttttaattagaagagtttgtaatgtcatattcatgttaggatgagttggagagagttaaataaaaggaatctcaacaaaggtgcagagaaaccataagagaagcgggacacccgtggtagccccaggatagtatctgcagctatcctaatctctctaggtctgtctgaaggagggagggcagagtggtttccaaaactcccaaggagagatatgtgtggagagggccgtcttgtggggagccattgtcagagggacatagtcagcctgaggtgaccacgtagggagggaatctggatattaaacaccctgacctccctttcctttctctcctgatcctttgcaagaactccctttatactgaactcatttgaaagccagccatctccatgcattgccccatgcattgctccatggagcagtgagcaatgcagagaaggtgctcctttccattagtttatttttctgattttgataccatgtggcataacttacatgtgaaggatcaaggcctgccttttcctctttcacttcctacccttcatctgtcgtttctattcacacaaatactggtaattctaaaataattacatagaacaacaaaaatcaactgatttacttgaatctgcgttgtgtctatttttaagtcagataaaatagcttccttgtcctgtccaaagattgcttcagactagagatggctcattcaatgtttcaaatgcgggttgcctccccacttgtggtaagaacatgccgtctcgggcaatcttctgccttgctcccggtggccatgggcagtgatggttttggcaaacacaccatggggtctggtgccaagttgcttgggcacctgtgcctgattcaccccagctttttagtctattcctagagagagttgtggctgccaagataagggtgagtaaagcaattgattggattttttaaaatggctcaagttggtctaatgtaattttatttgtatatatgaattactcaagtgtcacagcagagaaagcaactggcatcaattagctaatactatacttttatttataaaaaactgatttaaatggtatcaaaatgttctgagtaataagatagacaaaatgtccttttattaaattgggagttagactaaatatggggtttgttgcaacattttttgtgagaatttgtttcgtattgtttgtgatttctgaaaatgtgaatgtctttgagcggtagtcttcaattttacatatgttgaatgagagccagctctcctcttagagataaacaataatttgtatgttttgaatacatgcatcttagatcttcactacttgaaatgtgaggagacaggttttcacttttgcctgtaaatttgtttggtttttaaaacataatttaggcctgtgattattctagattgtcatcgattccagattaaagctctagggaaagaaaactattaataacttcaagaatagtctgcagtcctttgaaacgtgccagccaaaggaatgcctaatgagaactggatgtcagcattctaagttaatgaaaaactgcttgaaagaattcagagatttcagcactgtcagcctggaagagaaattatctgcaagggattggtgttttgcaaaatattggcataattttaagagctattagctagggtaatccatctgaggtaaatgcacctaaaggaaaatggttgaacacatcttagggtaggccaacagactgtccctgaggctggactagcctacgggaaaagctcattttatttcccgtatcttcaggatctctagttctgcttcctttcttctctgttagctcctacagtggagcttgagaacatatgcattacgccttttgaaggacactgtgtcttatggtcatgttgccgtaactcttcggcaaatcacacctgatccctgaagatgaataaatttaacatgtatgtgtgtgcgccatagttttcattaacgtgcgtacttgtcactaaactttaaatacaaacctgttaaactgtcattcctgatcatgatttgagggagctaattagcttcttgatttgtgtaactttcacagctcttaaccatggttaattgggttatgcttggcaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagaggtaagccaagacatttctaatcagttgttgttagtcggcctgtttacgaccatgaatttaaaaattcttttctattaattctaaaattttaagaaaataaactatttattcttccattgtaaaaggtcagggttcttaatggtaaaattgcagtatatatacgtctggtctgtttttaaaaaaagcaaccatcacgctttttacaaaaaagaaaatgtgataaggtgtgggctcgttttttcttgttgaatcaattaagttgtgatcattaggaaagcaataagatgagttttagtgaacattgaaggatagttggtttatgtgagccgttgttacttgctttttgtagaaaatagtattgcagtctatgaaattcatctttatatgattatattagatatgcaatatttaccttttttgagaagaataattgcttctcacagaaacatctgaatgcatgcttttcagtaacttctagtcagttcttaaggaaatatgctgatttgttttacggatttattccagctggaacagtttgagagtaccattggattcaaactgccaaaccaccgggcagcgaaaagactatggaaagtgtgcgtggagcatcatactttctacaggtaattttaggaaaacagctcggaagccgggcatgatcgcacatgcctgtaattccactgactcaggaggcagaggtgggaggatcacttgaccccaggagtttgagaccagcctggggaacatactgagactccatctctctttttttctaagaaagaaagaaaacagcttggtattgcttttagtaacctctgtgaattaggaggtggtagtggtggggaatgtggcagatgcattaacccactgtctttgaactcttttctcccctccttgcctcatctcctttgtctgcagtccctcccaggtccatttctgtccatgcattgtcatttataactgagctgcccctgcagctgtctagagctccactttctgactctaaccacctttccttccaccacagccacactgcctcatgcctgctaccattcttctttccactatccctcctcttaggtttcacttcgatattctcatcagctgcctcctgacttaacttctttcccaaaccaacttgaaccctatggtctgactgctttgtcaggaacgttctgaccccctcaaactactctcctctttgcacatttaccttctctgtctgctagtcctggattagtcctgtgtcctgacctcaccagttttggacctgtgctgtccaagtgctaccttaaaaatagtacaaccattgtgacacatgcagttactctatataacaaaaaatagcacaactctatggattagtgctattacagataaataatttccagcatgagctggatcctcagtgctgctaggcaagcaatttgtcttttgacttcctttgccactccaaatgctcatggtcctcgtgagtccctaggcacccctgcttcctcttctgatgccctccactgtgtgggtcactgaaagaagaagctgtgcatgagtgttcttggtttcatgcaccttcccttcttcccttttgcctttaatgaagcatcgctcctctctcctcccattcattctttcccacttctcctgtctcaaggaggagataatcattcctctgctttgatccctcattttgtgcctcttaaattatcctgctttgtaaattatttgttccctagtgggtacctttaggttctttggccaataaatatgtccacatcttgctctttaaaaaacaacaacaaatatgtatatatggttatataagattttgtatataaaatctttgatcatctaaccatctttagcttgtatcttgtctctttttatacttttcttcaaggacatgttttttacatgtagtttgcttatctttgttttctccgtttcctcagttttctctcactgcagtttagctagctgtgtatctagatccttcatctttaaggtttttgctctggacttatggtctaatactgttctaccaaatacgagctgtgtcaccgtgataccaacctctctgcttcacttccatcatccatatatgatagtaatactagtatctacctcataggattgttttgaaaattaaatgagataacacacatgaaacaacttagaaccatttctggcatatcataaaatttatcttcaccattatcattattcttcgtttggtatcacagtttgctatttttaatgtgaattatcagctggcacacatgattctttcttgacgttaaattgataatatctatttttcaagactaatatgttaatttttgaggagaaatataactcataaaatatgcttgaatccctcaagttacactgatcatataaatctttgaaaactttataatttttcttggtagccataacaaatttctcctccagacaacatgagccagctcatataaagctagtagatgacatttatgacacaggtccaagctgggcagacaacagctttccctgtcacataatgataaaaaaaaaaaaaaaaaaagcaataatctgttcagaaatggcaagtgctagcattcattgaacacttattagagtcagacacagaattgattgctttatatcgtggtctatttctcgccctaggcaagacaactgatgcttagagatcggtgcctgtggaggagcacagcagccaggcatctgagcagagatggggaccgggcttcctgattctgacacctgtattcctcacctctgtgctgtcctcttcttgtattcttgtagcaggagtttccgaggtgcattagctgtgcaaagcctcaggcctcctcatttttgctaatgtaccatggactccagtttaaaagtagaccaatttgctcctgcaaacttttgatataatggttaacaaaagcagttttaaatttttaaaccttgcataacgctgcttacaaagctatataaaagaatatatctaacacaaagggccagtcatactttgtctatagattgctttgaatcaggtcagtggaatttattctgtttcagtttatcatgaaaggtacaaatgatttctttagaaaattacggtggcttgcagattgaagccattaatctgtaaacagatctattaattgatagccaatcagctagattgatactagtggaataagaatgtagtaataaaactgatatggccgggcacagtggctcatgcctgtaatcccagcacattgggaggctgaggcgggtggatcacaaggtcaggagtttgagaccagcctgacctggtgaaactgtgtctctacttaaaaaaatacaaaaattagctgggcatggtggcatgtacctttgtaatcccagctactcaggaggctgaggcaggagaatcactcgaacccgggaggcggaggttgcagtgagccgagattgcaacactgcactctagcctgggtgacagagcgagactccttctcaaaaaattaaataagtaagtaagtaagtaagtaagtaaataaataaataaataaagctgacacccttgcttggagcatttaatagagcctgtcaccattctgagtgttgtacagggattcttttttttttctttattgcagaagatgatttctaaaaaaattgtacagaaagtctagaaatacttgaaatgatagtgttctttaagaaatcactcttccatagtaaatgataggaaaagtttcggtggaattcttcatgtttttgagttgtcaacaaaagtcttcctatttaataaattaagagctctgagattatgtttctgttaagatatttgtcaacttttgatcaaagagagcaaaataatttcagttgaactcccaaaaagattggtccatttgctaaaaacatgcttttgtataagcctagaaatatttgacatcaagaaagtttgatttcattctttatgaacccagggattaagcagtagaattgtgctggcaagaaggggtgttagccatctctacagatccactgtgtggcatgttcttcatgggaaagaatcacttaatggaacagattcctgagttagatgttttcttcccaggagaaataggcataaatattaagaattactaatggtaatggattgttacttggcgcttatagctagaagcaaaaattcagacatgtgtttatataaatgatttaagctaatacaaataaataacctttgatatactgagaacagctgtttctttgcttaggtggagaagaacattattcatgaatacatgaatgtggatttactcatcaccatcataaagctgtgtgtgtaggagggtttataaataatgttctttagaaagtttagtttttgagtaatcatacttaaaatgagatatgaaagtacatagctttaaagtttttttaaaaaattccgtaaagtctaattttgcttcccctttctctctctctttttttttttttttcctcccataggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggaggtaaacacatttatgataattttgattttcattcatctttctctaatcccatgaggtcagaaaatgttaatccagttaataaagccaccagaaataccctacagggatagccattttttcccgagtaaataaaatgctattacttacacctacaagagaataattttgttgtgttttagagttgttactcttttttgaagctgtcacacttttttctttttttttgttttaaaacaggttgaacattccatatctcaaaatctgaaatgctccaaaatcagaaagcctttgagcactgacatatgctctaaggaaatgcttattggagcatttcagatttcatatgttcagatttggggtgttcagctgctaagtatatatattgcatatttcagaatacaaaaaatattagaaatccgcaacacttctggtccctaacatttcagataagggatactcaacctgtattgtcagtgcacacaaatatttgttaagagttctcatttatgagatgttggacacatatgttttactgatttctcttgatcatgatgtgttttatgtggttcaatttcctgaaccttttaattaatggcaaaatgtaattctaaggattttttcgtatggtagcatatgaaccttaatccagacgaacataaaacattccctgcatcagcaaattttcatgagtgaaacaacttaccaaactttccatcttatgagaaagctttagtagcttcaaaggattcattttaaatacagcattttaacaaaaagtaaatataatgtgtttgtttgttctttagcccaagggaaaatatgtataaatgtgaatttttttctattagaattctaattagctacattttgtagttttatataaactacacatgaaataagttttatataaactacacatggaaaaatatatatataaattacctggtccaaaatgggttaataataggttttctataaaagagctaaggttaaatttatattagaatgccttgtgaaggaatattctttctttgtaatagaaaatgattagtatggatgattttctacccaaagaaatagttttccaacatttttggttgattgaactaaaatatatatataataataatactaaatttgaaaattgtattttactactagttattagcagaaacattttttcttgtctattgtatttttctgaaatatatgctcgaacaacttatattttaaataattggagtaaaacagatcaaataatgctaacagatgaaaaagctttcttaatagtgaaggattcatatggattgccttcatctgctttttctagaagaaaaacttggaaaacaaatgcaggtggacacatagagatatttgccaggatttgttggttgggattttggtatatagttattaaatcctgaaatgtgcaagggggtggtgaactgtgctttaaacaaatttccagaattgtggaaatgatttaaattcagttgattgttaatgtactatcactgctaaagtatcttttaggtcttcaacaactgagcacttttccaagtaaatctgaaaaatgtgccaacccatgtaaatatttcccaagccttgccccttgccacagagaatttatacaagtgccgaataaatgcagtcactgttgtttagtaccctgagagaaatgattgctctttctggaacactgtctgttttcagcatttgtttgaaactgtgaggctgtataactcttatattgcaaagtttagcatttaaaaagagcagtaaaacagcattttctttgaggtatacaaactgtgctcaaggaaatccaccatcttgtatgggcagttagtgcagagggttacaggaggtctgtatctgaaaacaatgatttttccaagtgaaaacaacaaacatggcacagtaatccattatttttctctttgtgttttggaggccgtaattcatcagatgggtaagtcatcaaaaggattattgtgttattgtgaaaaataggaggcttttaacgccaatacatgaccagacagccagtgaactctttgattagggcttatattctccgttttttcccccagagcaaagctaggctgtaacctggcactgagcttttattttctttaccactccttatcaacataccatttgttgttgtagtcttcatgtattgtattttctttttcctgtttactttttaagtaaggctagaataatttaggtatattagcctcactttaaagtttggcaaattaaaataaatcctcttatgattacatagcaagtgaaaagtgggattcaatctaaagatcaaatatcaaaatgaaaatcaatctagaacagctgttttaggacagggagtcccctccgagattagaaaatcaaaccccaaagaagacaaatcagtcatttaagagaaccaacaaccaagatgcatttgggggttgaggaaccaagtgatttcctgaaggtggaaagtaaaatgaacagggacgttacttaaataggatcatcagggaaggaaggcctatttgaggaagaaccaggtcagttgagacttgaaggatgagaaggaggcagccaaggaaaggacaagagatatttaataataaagcattccaggtagcagaggcggcaacgatgaagctataaggtgagggagagctggatacattcctggaacagagagaaggcaagtgcagtcagagcttaggaagtggcgggagaggtaagcctgggtcagatcatgcagggccttggaggccatggtgaagaatgtggtttttatttattccatatgctctaggaaaccattgaagggtttatgtgggtttatgtgcccgcaagagcacagcgttatcttttaaaaaaaaaatcatttgatgcaagagaacaattagattgagcaaggaagcaggcaggctggttaggaatggtccaggtgaaagcgatggtggtcttccctttagtgggagtaggccaattagccatttggtatcttgggctctgccagggcctacaagcttctcagatgtttaagacctgaataaatgtatcggcttcaaaatacaagaaactgcatgctgaaattaataagtgtttaaaagtatgcaaagtcagcattttgtcaactttaataacttttaatttgatattcaaattttaatatcattacatttgaagccatttctaggtcagatttttttcattttgcaaaatttctgagtatgtataataggtgtgtagaaatcataattgtaagcaaaagaattaatcatagccatatactttccaagggaaacttatttagatcttgttagaagtttctttattaaaaaaaactgctggaggctgggcacggtggctcacacctctaaccacagcactttaggaggccaaggagggcagatcacaaggtcaggagtttgagaccagcctgaccaacatggtgaaaccccatctctactaaaaatacaaagaattagccaggcgtggtggcgcgtgcctgtaatcccagctactcaggaggctgaggcaggagaatcgcttgaacctaggaaatggaggttgcagtgagccaagattgcaccactgcactccagcctgggtgacagagcgagactgtgtctcaaaaacaaacaacaacaacaacaacaacaaaaaccgctggaaaataactatacttaatgtaaaatgcaaatttattctaatgttgactatgatttgatatgggcattcaaagtgtgagtatttaagggctgggaaaatctccacaaggtgaggtagtagaattagaaatggaaagaactggccacatttagaaatatatacaaggaccttgttggacttgctggtgttgaggggtgaagagtcttggaagatgttcacgttcccagttcaagcaaatgggagcaaatatgagaagagcgttttgtgaaaagggcaagactggaaaagaattaagttttggacagggcaggtgaaggctgtggattgagaggtagcttgggatacatgtattcaaagtgcttgaggcctctcaagttcagtatggtagttcacacacaatcctgccctccaagagcttgcagtctaaaggtgtttgtgttgaccaggcttcccttaggacatggaaccagagtaaacttcatggtgtccgtagagtactttttatgtaaagtgaaatgaccttgtggtagttctgttgtttggggaggagctacagatggacagaggtcctgccacctactactcactttgccttgctgatgtttgaggtagtcttggtttgatctgcactatgacagaattttcaatacaatgtacatttctgcctatctgtaggagagaagaagagagcacatgagggccaggttttctgggatgagggaggtgtctatgtatagatttaccatagttcgtgttaaggcattgaggaaggggattaaaaaataaaaaatattaaacataaatatagaagttaaaatccctaaaatttacctttactgtcttttatttactattttttcttttgaagggtattcaaattaaaggttcctttatggagcaattcttaaaacttattggagcaaatcatcttaataattgcataatcatttgttgcaatagatagattcagaaataaatcgtaggagaccaaagagttaaaatactgcttaccttgtaattctgtttgccttaactctggtgtttcagctggtcttagagctcctcctactggccagttccatgatctgagtttatccttccaatacctgtggtttgagaccctggtgtagctcagtgcattaaaattcagaatactttcagaatttggtaaacgtttaaaaattagtttattttatatggtgggtattttcagagctcaagcaatgtctctgttcctgttcactatttatatgctgcctgtttatctcctgtaagggggaaattttccataaagtttatgattcatatgtcctaaaataatccaaaattgtcactctttactagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaaggtatggtaaattagcacagtatgtggttttaaacatttacttaacctagagggtatctgttgtattttctgtttcagaaatcaagtatttaaaattagttgttctatgttctctgctggtcatttatgttttcaaatatgcatagtggtctctaacctttgattgttgttcaaagcagaatatttcaatgtaagttattttaatgcaagtaagtaatttactggcctttttgactgtcctcataatcaccttatctaattgaatcctcaaagtagaaaagctatgatgatttgaaatttatttttggtttggtccaagtaaaatttaaaatgtagcttcttgattattttaattattgacttgaatttttttacatcaccaaagataatctttatgaacaaatgtattcattaatgatctataattaatgaaattctcaagaaaaggtaattgttttgtgaatagagagtgagaacatggtgtgttgcttttggctttatcttgtgcgtacaccatggtgaaatggagaagtaacccatattgtgttctcaaatgtgtcactgttatcttttgttaccttgggcagtaacatcacttgaatattgatttgagaagcctttgaattcttcagatctcttttctgtgtctgcacaaagcgacttttttttgcatgcaacattggaagtaagcacagataaaaacaaatgaatccatcatattgatttcatagtgttttctattttattttttttattttttcgagatgaagtttcgctcttgttgcccaggctggagtgcaatggctcgatctcagctcactgcagcctctgcctcccaggttcaagtgattctcctgcctcagcctcccaagtagctgggattacaggcgcctgccaccacgtgcccggctaattttgtatttttagagagacggggtttcaccgtgttggtcaggctcatcttgaactcctgacctcaagtgatccacctgcctcagcttcccaaagtgctgggattacaggtatgagccactgagcccggccgtatagtgttttctaaattttaactttgaaaatttttaaaagacataaatgtataaagacatgctagatgaagtagctgccagtgcctcaggaattcctacactgatagcctctgaggcccagcatggagaaggtctcagggaccaccacatgggcccagtcttgtgccacaaggtcaagtgctacctgtatagcaagtgacatcaaatcatcgacattccatcgttaaagaatttgtgactgtcatatggaaaaattatttggtggggaattcagataaaaataacagaaattgtgaccaacaaggtttctttcaattgctgacaagttgtcaggatagttctttaaaaattttgctaacaaggcacccaggagagtgactgcttacatctgaaacagaagagctcagcatttcagaatatctctgttccattttgcctagttaacttgacatatctagttattttccttaaaaaatgaaaaagttcttttaaatttcaaaggaaatcctccttgtctgcggtgaacaactgggtacactggcatttttgctaatgctttgaatgtctgtcagcaaccaggtttaaaagtaaataatgctgtttgagtttcatgggatctatttgcaactagtttgaaaataattaaatgagtcatatgtataaattttatgtgacacaagtagtctagtcttttctctttaaaaatgggtcatttaattcatttctaactacactgtgttaatatggtccctcctttaaagtaaacgttttcactaactactcattttttcttttgtcctctttctctcttgcatctgtttttcctttgattgtatctgttgtgtaatttcatattcaatcatgggtttgcacttgagaatagactgtttccatgtgcccaccttcacctctcatccaccgtacttcatctttttccccaaacctattgcctgtccctgaaatggacttgctttcagacatttcagaggaagacccctttggggaggctgaccagatcacactagacagcttagagcacctttccacaggtgaaatatcggagcagggggattctgaagttgctatgcctgatttggtcttggattctgccatagccccttctcagcctgactgtccttctcccatccatgggaagactcttaaagcagctgacgacagtgattctgagtttggttacttctccttcagtttctccaaatgttttccctccggcttcccctcccttcttgatgaagatggatatcttgctttccccagcctccccaaggtctgggtctccttcctccccgctggtgtgcagcactatgtcccaatcacctccccttcattcattccttcccttatcctcatctttgggctacttctgtctgcttctcagtcagttcctttttctcttgccttttcccttcctctggctctatccctctgctatctggaggctaaagccgcctcctttaatgtttcttatgactgtgacttgaatgacaagctcgaggaagaggaagtagttgctggcatgcctacgtaagctcagtttgtggagtcaacacaatacactttatcttaaacccttcctaatatagagtgtaaatgtgtgcatacatttcaccactgattaccctcaacatagtagtacctgcacattttcacacacacaatattttagtgcatgagaaataagtgtagacacttctccttcattgataccattgaccagttccacacattctaagttaggagcgaaattgtaggattattttacaaatatctagatcaaagtagatttgtaacagaaggtgtgggggaggagggaaggaggagggaacctgtattgcccgtaacaatccatacagggtctctccattttgcaaacagatattaatgctgttcctttaggatgacatctttttgttttgatatagaatttaggatgcagtggacataactgttcctgatgtatattagtagaattccttagtactgttatttctcttgttggaaacccaagtgtgttctagcatctatgaggatgtatctgtaacctttactcctgacatttgtaagtctaatctcaaaagctccttatctccctattattgtagtatttggagaccagatgaattttagctagtttttttttctaaccttaaattatgtaattatatataagagtcactatagggtattttataaggaaggtactattctgttgtctttaacaaatgtatgtgaaaagtgaaacatggctttttgaaaatttagactatataacactaagattgggcctcatagtgctcctttatttaaaattaggtgtttggtttgaggatttttacccctatataaggcaaatttttttcaagtatcctacctctgtgctactaagtcagcattaacatgtacaatatatttttgattattttgttaaatgtggcctggtgatttagtgcctcatattctatggatcctaccaatacatacagtaaatcacaaaatttagagcaaacctaaagaaaaatgtaaagataattgcagtgagtatgcattgtaggacaattgttaaaagtttacctgaggaatgtcaaagatcaacattttagggaattaaatgttgaccaaggagttggaagatgtttcttaacagattattgaatgtctgtgtctcatttttcacatctgataaagactctgagctccttgcttacctctgaaaaatactatgaatggttaaaaaggtaagccgtttgaactctcagatttgacactatcatcctaattaagaaggaaaaggatatatattaggaattaacctataaaggttaaatgatttgcctttgataagggagtcaatatttttattctcaccattttttcccttgagtcaaaattcagtcagtatttgttagttttaaacttctacattcattcttttgaatcatcagatattgagaaatgtccaactatgaaaaactgttcttatttaaagaattttatgtaagtggttatatttcaaagattatttttaaatacccaccattttaatatgaaactagttaaataagccaatccccctcccccagccagaaaagaaatccatatttaacaaactgaatcataggttgaacatttgttccccaatataaagctaaaaacgaattttacatcattatactttaccccatcactagttgctttagacatttcaaattagaacagattgaattatgccatttttgcactctcatattcttgttcctgagtacaaaatattcaaaagcagagcataatctagggactgagaaagagtgaagcttccatcctccattccacctttgcaaaggatcatttccatcattcgtacaacactgtaggtgaagaaagaccaaagaggcttaatattctgcatcttctgagggcctcacagtaaaggttggtaacactggttcaccatttaagttcaaatacagcttctttgcactgatggtagagtttccactaatactccccttctttctggccgtttgctgtgtgacttttcaggcgaagatggaagaagaggaaacgcagctggaagaggtggctgagttttccctaaagttaaacatctcatgactgctgcctgccattagtattgtgtggggagggtccactctcagggtttatttgtgagttgtgtttgttgtggctttaagttcataagatttgtattcctcttttattttaatgtcttagactgtcgaactctgggtcattttggtgcttgctgattgatacacttatgtttatttgccttttcccccctgtgtgtgatttaatttcacagaaaaattccttgagagtagaaggggataatatttatgtcagacatagcaatttaatgttggaggtttgtataatctaagaaaacaactctgtcctaatggctgcccggctgctgtggacgggaggtcacgcctaggctggctggcaatgttcttcaagcacggtgcatgcagtgcatgggggaattcagctcgggagtgcatgttaccagcctgacggtgttcctttcaagtggcttaggcaggactgtatctactagaagttctcaaagtgacaagtgggaaaaaaaagtttagtcaaatgaatcaagtttttatccagtactcttgaagttgttctacaagtaaacctattctctcctaaagggttaactctagggcatcaacctgaggtaacacaatctcatccttaatatgtattaactagaacagagatttgtttattgatctggcattaaatcatgtgactcttgatcttgatctgtgcccactttttttgttttttttggttaaaatccatgattgggaatgtggtccactttcagtattctgtttgagaatatgctaattaaagaaattattttaattagaaagaacaagcaaaagtgagagagaaggaaaggagaaaaagaaagcccaatcacccaattatgaatgtaaagtgtaaaatatgttccccgtgtcacgtgagaacatttttttttcccttcttattttacagtagtatgtggcaatgtattcaatggagaactgcagctctcagtaatctgactaatctgtttggttgcttttggcagcttggtaactgatggaaatgtatttttgcttaacttactaaaatgctgtacagtgtaataagtaacattgctttgaaccaatgcaagaaatgtgcctgatctcaagccacagtcatttttccatgccatgcaaagatttttagattttcatgagtttttgcaaatggctatagaagctcatagatgagctactatgcttgtgcatgaatatggaatatctaattttattggttgcatgacctgttccttaaagtgggatgaaagctataatccacaggtggccctatgatttttgaaatataaataaatatttaaaatttggttaaaacaaatactatttatgagagccagtcgaaaaaaattccacaaataccatttatcagggcctgctcccatgaaaatggacctggtagtttttcttgtatatttgtctgtataaggacgatctggcagttgcggaggctagaccccacttttgtgcttggcaagtacatgagaccagtctgtggtttatttattctataaagaggctaaacagaagcagcctctggaagcagtaatttttattccttaagaattaaaagccatcactggaatttcctgaaaacaaacaaacaaacaaaaaaccttggcttttccagctgggggttgatcctggtctggctttttcttccagccagtgtgcttctgagtctctaccttcctctattttgtacttgatttcctatattcacagaatgcaattttaggagtagtcctaatcagaaaggtaaatttgctggaacaaagtcatagtctgagtttcaaatccaggtactggaaggaagtgttattagccattttgatgatcagttccatgtcatctttctgataatgtaaataattattcctttaaaaatcctaaatagagaagaaatcagaaccctttaaaatgtaaatcattgaagaagtacgcattgactttattttcaaattttgatgaattcatgaacttactcatagataataatatggctttagagacttggcatttttcttgctttactatggttttttttttaatcgtaagtttgctttgtcttattttttggttttatttttgtcctactgggttttttccttttggatttttcccccctttgttacgttacatattgctaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaaggggtatgtcattagctatttgttggctctgtctcacttcagttgctcaataaaacttaaattgttaatctctatgttgagtctagggaagttacaaaatgttcccatttaattatttttatgtaattactaacaattttgtaaatactaaatattaacaatgtaatagttattggcctagttcttaggtaaattgcatgagtttcaaaatacttttgaaatagttttaggataatttcactattttactcaggtaaattgtagtaatgaattgttatataggacaatttagaaactaacatactgtatttaataagctttttagttactgatatctgaaatagggacatttacttagtataaataattaataaataaagaaatataggctatctttagagtggtttaaagttattactgtgaggaaaatgagtttaacttagctttaaagaccgatgagccctgttgaaagcttgaaaaatattatatataatatgacttagtattgaaacttccttataatgaaatgttagaattgtgttttaaaaacgttttttcaatcataacatttctcctcacttactctatttcttttcatggtttacttctccccaccactgatatgagtacatattgccttcaggatatattctcaatacatttctccattcattgtcatccacatctgtgcctctaggattcttccaaatccctcctgttattgaccaagaacttccatgggctcgtttatcatacttgagcggacagtgatcatactatatttaatctgtagtttaaaaaatggtataaagatgttaccctacaatttcatctttttcctttcagcatctagtctggcttgaatgttgccaaattgtagacattgatttagatattctagtgctatttttattcacctttccttaaaaagaaaagctgttagttgctttaaatttctaagtttgtgccattgaaaaagaaagctctttaagaacagatgagcaaaaagaattgctgaactgaaacacagaacttttgaaaatattaagacatgcttggtagagtcttatgaagttgaatacaacttcagttcttagtttcagatttttctgaagatgataaaaaatgtcaatttcagcagtctattccagaatgttgtgttttctggagaaagggtctgatgccatgccaaggttttcaccttccattatgtgccacttctcctggtgtgtgtcattgacccacactgggtcagtattttgtgtttgtgttgctataggtgtaatgtatgtgtcttatttgttgattatgtctattgtttaaaacaatagagaaaaggagaccatcttttcaaggatattttatccgtgaaggagaagtacctgatgccgacaatatggacagttgaagaaaaagctcaggagacggacaaggtgttcaccttgcacccttggatctactcttgctttttccccctttccttttgtttctatccacagccataagatttcttttttcctgtgtgtcatactaaaatttttttgaaatgatttttgagcatttaaaaagttaaatcccctgtgtatagaagcataggattgttggatgagaaataccatattgcagaagcacttgaaaagtcaaaatttgaaatacagaaacatcaaccaatttaggtgataactgattcctaatttgatgtatgtggctgacagttgggaaactgatttcatgtgaaagtgcactgtttgtacaatacttatgcatgtcgtgttgttaaaataaccacttatgtgccttagatgatgagtttactaattacatatggaaaccttttgagttttcacttgtaagatttttaatgggaacaaagattttgatgcaccatagcagcccctcacctctctctctgctcctgcatgtgtgacatttctgacactggtgaggaagttcactttccattgcttttacatcctcattcttctctttctactgattttacttagccaggtggtcagtctgttatttgctgggactggagagcttggagtctagtggaggagacatggaaatagttaattagaaaagtttcttttttttctttcttcttttttttttttttgagatgcactcttgcacattcgcccgggctggagtgcaatggcatgatcttggctcactgcaacctccatctcctgggttcaagcaactttcctgtttagctgggattacaggtgcctgctaccaagtctggctaatttttttgtgtttttagttgagacggggtttcactatgttgaccagactggtcttgactcctgaccacgtgatttgcccttcttggtctcccaaagtgctaggattacaggcgtgagccaccacacccggctggtgattagaaaattttctaattggtacttggaaagtttcagacactaggaagtaaatgttaagaaggtgaaatacaatgttgtgttaggaggggattaggaagaccgttttgtcattgtggtcaggaggagatgacatttgagttgaaaccttaatgataaccaggtggacatgtgaaaatgtatccacgtgtaaggacgagccacaacacaggaactgaaagaccaaatgacaggggcttggtgagcaagggggagcacgaaggaaggaaaattcaaagaggttagaccctaggtcatgtcacgatcttaaaggccatgctaacagtttggaattgtacaataagaatgatgggaaagcattggagagtttgaaggtgagtagtggcagaatcccacctgtttctgacagaagtccccctggcactggatgaggaatagattataggggctgtgaatgagaacagagattattaataaggaaacagtgattcccttccacaaagtagattctgttaattggtagagagtattcatcagaacacgtagcagggttgggaaaggaggcaaaataagtagaaataaggagtttatggtctagttgagatgaaatattttcagaacattgcaaatgagaaagataatgtcatgaagctaaaccaagtgacatatttatatactttaaaggttagcctgaaaccaaagccaattagactccatgtgtataatgaggactttaatatcacatgctttgaaatattacgtatttttcataacctgtccttcagaagcaatcacatggtatcattcgatcaaatttaaagtgatgtccttggatttttgcagtaggaaactttgacattttagtggagatgtttaaaattattatcatttttctggatctcatgttttaggaatgtacagtgtaaaatatcttgtcatagaagtcacattaaagtgatgttaatgtgaaatttaaatctggaaaagcccccaagtggtttatctgtacttgaagttacttgtttttctgttcttttcctctccaatacatgcaggaaaatacatacttttttgacattcatatagattgttcttattacaatcatccattcatccgtttgcccaacaaacatttattgaccacctacattgtatcttttttgtttttctttaaataacatactactattagttgaaagtatgtgagcatttgtctacgggagtgttttgactttaccagagtaccttttcaatttctgtctttgttgtatcttcattttactgttaattctgcaggggttctcgtttatctttgaattgtaattcttattgaaagtaaaataaaaaaattatgcataagtatataatttgaccacttttccaaatttctataatatgggcttttatagctttttaaaaaagcaggaatagtttctttttaaaaaaaaaaaatacattgcattttcaaagtggctgtagtttgaacaattttgagagtagagcagaaaattggaaaccaagtcatttaatctttaatgggtaaataactctattgtaatcctcttaacgtgttgtatgaattatgatgacttaaatttgcatagactattctctcctgagtctaagagattatgtacattgagttgtaaggtacttttgaaggtatgtcattggataacgaaatgtgtggcacttctttaaattccccagtgatctctcactgggaagggcatcccacccacccccacttccccaagggacgatgtaatcatagagatggtaatgaagttaagtcagtccaaaagctttttcctctgctgaatattgcaagtgcctactcccctcaccctcctcacctcactttctgcgctcctcacccttcttagctcacagtatgaaggggccccttaggagcgtcattgatttttctttaagatttctgaatagtgactgggtgcggtggctcacgcctgtattcccagcactttgggaggccgaggaggatagatcacctgaagtcaggagttagagaccagcctggccaacatggcaaaaccccgtctctactaaaaatataaaaattagctgggcatggtgctgcacgcctataatcccagctactggggaggctgaggcaggaaaatcacttaaacctgggaggtagaggttgcagtgagccgagatcgcggcacactgcactccagcctgagtgacagagcgagactccgtctcaaaaaaaaaaaaaaacctgaatagtggggtttattaggaattattctcacacttctgacatgagggggtgcttcatgatgactcttgaatattgacatttcaagtttctaaggacagttctgctgtccctcaggcaggttgggagccattgtttaagagccagacacagcaaagttaaatttgctttaatggtttaatttagggagaaataattttcacgttgctcattgagctttcaactctgagtttgtcttcctattttgaattgtttttctttacctgtttctttttgcaaaaaaaggggacagggtaatttactctgtggcatatttagcacgcctgagggaatgaatgtgggctgctgtcagaatgtttgttgtacagagagttaaggtggtattgaggagggagattgtaggagttggagtggtgagggaaggccttacagaaaatgcagactatgaagtgggcctcagggaggttagaaaactggaaaggcccagaatgtgcagataagggcaaagaagggccttggaggcaggagagggaggactgcccaagctgtaacacaggaataagcatttcaagtgtaggggccactgaagaggccattccgtgcagagaaaggccaaggaactacctcaagaatatatgaaatggcgtttgggtgggtcggttgtgctcagttggtgatcagccaagcagttttcactggtttctggaggtcgcaactatcaaagattctcaagcagggtggaaaagctggcgctcacaaacctcttcataagcctgctccagaatctgtcagaattctcatcttttctttcattttatgctgttctgttgttctttcttgtgtaacctttcctttcttccaataggtcactgctgtctgttctgacttattgctaattctttgctcttccttttctgacctctctagagcctagaagaggagataacatcaattttgtttagtgaaaagggcttttctgatagcatgaaagccaccttcacttcagccaccacttggacagcagagggcgctgttgtgagcgctaatgcaccttctgaaaagctttcttcctcgcccttctcacacttgcttgaggtgcattttactttgtttcccctgttactaaaagccacatatgagagagattttcatttttttaaatattcaggcaccattccctccagtgctttcattggtgaaattaattcttcctgggagaaacattcaagaaacaatgactgaattggaacatgaagaaaagatatagattggatgtttctcctgcttctttggtcaaagaaaaaaaaaatctgcctaaattcagagaataatttaaatcattaagttccagagtctgggctgttaagcagagggaaaccctcaaccagatatgctttgcagagttgacattttcaaaaccccaaatttcaggcatcctctgatggcatgttatttttaaaattctgtttatatggaaaaaatctgaagtgcctcccatgctccatgacataattgcttttgaatgaccctaaggaattccctgaacttgggcagaacctatccagctaattgaggttaagatataacaataataataattcactgatctataataataatgaaatgtgtgtttcagaaatgttctggtcactggatatgtttattatatgtagtcatggttaaattttacctgcttatcaaaatagattgagagttttttcagtttaatatctagaaacctctgagttttcaataaaactggaaagatagctgtcttctgttagtaatgtgatttacatggtattaatttgggtcaatgaaaccatgcccttaccatgtgtttaagaataatagggcaggtccaagagagtttgtgagtagacgttgacagtgctgcagagacgtgtgtgtgtgatgttaggatcttcagctcatggttgtccaagtgtctgggagagatgaactcagccctgctgtctattagaggctccagtccagttagtaccttggcagcttcacaacaatatccagagggctcagtggtgtggtgcccttctccatccagaatggagtcactttcgtgaataaatagggctcctggctctagctgaattatttttaagttagatcataggcagtagtaccacctagaagtcaaaaagttggccatgcttgagttatatcattgtaaagcagactttttgtaagtgtgagaaaaatgtgaagctttaaaaacccctctgtacaaaaaggtttccaccctagttaataatatcataacatagtaatttgttcctaatgtattaagtcaacagatatttattgaacatttaggtgctatattactcaactggagtaaattactttactcccaagaagtagatgtctgaaggggataggagtgaacatgtcaaataataaacttgactgagtttagatttcaaagatgctagtagaggagctaaattgtaaaaggaaacacttggagtcaccattgacacccaccctattgtataatatagcctttgccaacctatgatacgaattggaaagttaataaccatttctggaatgaacattttcatgttaatagccttctgaggctaactataattttgccaattaaaactttttttttttttttaaagaaaaccagcaaaaaataaaagtgccatctccttggtgctgtgttcatttaagaatcagcgttccaggctagactttatagtctgattaaaaccaaaactgttactaggttttaaaagttaaatttttttctttaaaatgatgagtcagctttggtataattcaatttttgtaaactgttttaactacataggtagagcttataggtatatctataataaaagcattttacttctttgggaggatgctggctgtttttgtgtctttttgtaagctttttggcatttgtcttgattgtcctctatgtgaccttgagcagaggtttctgtagatgttgattcttgctgttttgtctttgcagtgtcagatgtttgtttcagtggttgttgaggtaaaactgtattgattttgtgtcctcggttgctttttgttctgcagacacgtgctcccgagtcagaagggccttgcactggagccagggatgctgttaaggttctcccctttttccatgttaacaccattgcctcacgtttctcattgccctcacgtttgccccgcttccctttcagtcagccatcataatcatctttgtttttctccatgacatgaatctgccatcggttaatttgggtttccgttgtttttatttattcatatatttttgttttccctcatccatctttttttgtacagagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagacatgggagaagaagcagaggaagagccacagaaagttaacggagaggtgtcccatgttgacattgatgttttgccacaaattatttgttgttcagaggtaaatgggagtcccaggtgggagccaaactctagagctgcttctcagatggggaactcctgcctttcttctcctgtcctcccagttcttcagcttttttcaacaagaatctgatttttctctctcatgggaggaagggggaagcactgctttgtggattttctgcccgcccagttcatgggttccagcttctctgcggccactggacacctgtagggtaaactttcctagaagcaccacatcaatttttccttcccttttcacatttaaatttttctttgcatgttttgggtgttttcaactgttttgtcttcagttgcactgcttcctcacactaaatgcctttttttccccttttggtttaattagaaaaatgtatatgtaatgttgaaaaaaaaaatggtcactgctgagtgtgtgtgcccctgatgtcatgattgggtttgacttcttggctcattcttcagcttcagagttttagaaatgacagcagtctctgattaccgtggttctctgaatgcagtatccagcagtgatgagaatgttatttcttgaatgccactgtgatttctgttttgggattgcaggggttgtatggttttgttaagagcctttcttttcttccaggcagccagaggctaggctatttgataggaggatatcctcgcttctcattctatcctgatgtcaattctggagtatttgccagatgattatatgttttgtggattatctatacattggacatgaatctttttcttttcaaagaagagaactttttggtcactaagtgcagtgtctctcatttgggagttaggctgagggagggtttatttccttgggaatatttcttgattttaatattaaatgcccacagtacagagatttattttgttctcttcgatgggatggaaaatgttgaagtgactttgtcttaaaataattaagtggattttaaccatgttacttttaaacttctgtttcactttagagaagatttttcaagagtctttgaacactttgaactattctgtatttaacatatcgttactcctctttaaataattatgcctgttgagaatgttctctcaaagaaagtactgcagtattttggtagtagtatagtctggtgttgcattaatattaagcatgcatactcggcagactaaaatgttaataagccgttgaatatttcctttaatgttttaaattgttcaaagcattggtgtaacattgatggagtaattttagatagagcattttaacttaggtaatacagaagaaacactgcaaattttagacaggtataactgaaaacagtaatacttgaagacatcctttctgaaaatggtgtgtctgttaacaataaggcagaaaaggtattgtgggcagaagaacaaatcttagcctacctagctggcatgccagttaaaggcagtgagccttcacacaaactatgtggtcctttaaattataataaaaatagagacaagtcacttcacatagttcattctattttcttttcaatttattattacttgcccaaagctaaggagggaggaggagagagagagagagagagagagagagtgtgtgtgtgtgtgtgtgtgtgtgtgtgtgtgtgtcactatacactaggcttgacataaaagtagtttgggaccatcttaatttaaagagtaacataatttaggaagccatcatgtcaacttatttttcatatatgtgtatgtacacatacacacattcatatatatgtacgtatctatgtgcacatgtatgtatgtgtatatatgatatatttgaaggaaaatttttcttttatttcttttgtttgttttaggttgtttgcttttactcttttcttttgtgcatgagtgtgtgtttggatatgtttcttactattatttgtgaaggttccattaaacacttttactttattacctctagaatttatttttcccttccttttccacctcagccaccagtggtaaaaacagagatggtaacaatttctgatgcctcacaaaggacagaaatctccaccaaggaagtccccattgtccaaactgagaccaaaaccatcacatatgagtctccacaggtacaaaagctctagacttggactgttcgagctcttttttcccttagtgtatctatgttttcattctttcttctcttagtttacatgtttctggctttgatgtagctttttgtatctgcactttgtaagtgtacttcaacaacataatttgctatgttctcttagattgagacagagagctgcaattaaattggtaacccagtaattataggggaactgtacatatgattatttaggacagacagtatcaatcttgttcatatgattgaaagccatttctgagttgacatatctaagaatgtttgtgtacacttaggaaacaaattgtcttgcaaagtttatctgatataattcatcgattaataataatccgatctaattgtggatgtgatttaggcttctttccctctctaactccgtgaagattgacccaatcaactcattcttgcttgtaataacacacatacacacacacacacacacaaacacacacaggcacacacacctgtgcttctccttcgtgtggaattattttctaaagacctatgtagtcattcatatgtgaatggtgataccatgtgtctaaataattatcagatttgtgtgtttgattttaggttttcacacattggttctgtaaagatttggaataagcattaagatgtttaaccttaagaataacaaaaaaagataaagcattcatgatttcaaaatagaatataaaataaatattttctccacttagaagatgaaccttctgtggtagaattgtatcatggtggaggatgtcaggttattgacctctcagaatattttttaaaaggtttaatgcatgcatgtgtgaaacacatctgaaaattattttggatatggcatccttgtgtgtgccttgatcccacataagcacaaataggtttcttatgaacagcttggcgggggagcattagtgatgtgtctgtgctgtgataagttgccagaatgaagacatacaggtgcatgacccaagtttgaaagagatttcctcttacagtcagaaaggctctggaccgtccagttatttcctcgtgtcagtgtcaggaaacagagggcaaatatgtttcgtgatcttaacataaactgttaggctattaatttgcttcattgattccccttggaaactctagaatcttctgcatctttcaatatcaaagcaaacaagttaaaatctattttaacatatgtatgggatttatatatatgtaggagcacatgcgtatgtgcagtattgaaatatatgtgcccgtatatatgctcacaacatgcaaactattacaggaacaatgtagttgatgaaaacaatcgctagaggtaagcagataaccaaatcatgcagattcagtttgtcctggtcaggttctgttgcttggtaatttgataaaatgtttatctatttttacccacctgtgcttaaaaaacaacaaactcagcgcttctggtcactgtggaaacttctctgcctggctctctagtttcattttctagcttgtgcaaaagtccttcagacaaattctgtcataattcccttgtagctttcagtcccacctactatgtccattctcctctcttttctccactcacacagttgagtttgcttctccatgtgcacctagccttttgcctctactcggtttcaaataccagccgctctcctggatggtaattactactgcaaacacgcaaaccacatggattttaaaagatgcatattcgatggggcggggatcttctctgacaacataacagaagttaagcattactttgtatttttcccccaactatccaaagattgatggcggggctggtggtgattcgggcacgttactgaccgcacaaaccatcacatctgagtccgtgtcaacaacgacaaccacacacatcaccaaggtaaagcaatgcaggggatcatatggagaggatggtacattacagacagaatcttttctgaattgtttctctcttcctgtacacacttccaagtaagatacagacagtgccagcggaatcaaaatgccttggtttaaagtatccaagaaattaggctccattgacaaatgcattcaagccaaattgcaattttgtgaagtacaagggggtaaaaatatgttacgaatagctatatgtaagatagctacaaaaccataaataatttaataaaatttataatttataaaaacaaacttgtgcttctacttttattaaaccagccctcctgactaaagcgaatgaatgaaggccatcattcagaattttcagcaagttgttcaaataatgtagaatttccctcatttaagatcgctagtatactgatttggggcattcccctgttcctccctgcataattctctaaatgtttagcactgggtaaccagtcatccctggatcagcagcatcagcttcacccggggcattgttagaagtataaatagcgtggccccactccagtcctcctgaaaccttagaattgtcttaagaagcttccagtgattctgatgcatgctgaagtcatcagctttctaactccagccttattttccactatttccttcttctgttttttactttggataagtgtctaaaggtcttaaaggtgtcccttgtgcccttcccaacccatgtttcaacaacaatttaaaaaacagcaaaagtaatttgtaaatttaaaaatgccgcataaatgcaaggtactgttggtgctcattttaaagcatatccagttattaagcatagtgataagcctggtttgttatggtaaaatgctgtcacttgtgactgagagtgtacatttatcagagttgtaaatgttggatgtgcgctttcccaggaccgtgtggtatttgcttattgactgtttagaaggtcacagccagatgatctcctcagcctcatccagtgtgccccaggcactcgcagcttgtacggagcccataacgctgtgaggcagttcccccaggagctccctcctccagccccgctcgcagcctttgtctagccatgcgccatgtctacgtgtatgactacttacgcagggtgtcatcaaatcaaacattcaacaaaaatctcatccatcttccgtatctgaaaccaaagcaaatcctttttaaaattattgcactaaatgcaataaacaaaatcagcaaataaatttgtatgctcagaatccatcagtcaaaaccatcacatcatacagaagtcttctgtgatgggaaaaaaatatatatcacatcaaacagtttctcaaaccaaaaacagatacctaaattcttataatttcttgtaattctgcaagtaactgatttctccctactctcctttttaaaaattggccagctaggagtaaagaaactcgggaaactataacagaattcccttaaaggaactacttggattaaataatatctgtcctatcttaatcaagtgagattaagatgggacagatgccatcttgaatattgataaatgagttttaaggttgctctcagctgagggatacttgtggatgctataactttagtaataggattctctattgagcctaaaaataaagcacaaagtgtttctagaatatcagtcttttgctgcttgttgtgtgtggccttacaatgatccacaggtctaggtggactcccatctctgtttgctctgactgtgtaaacgtgcttcagtgattgctgttttttcttcttctcctttatgacctttagactgtaaaaggtggaatttctgaaacaagaattgagaaacgcattgtgatcacaggagatggagatattgatcatgaccaggtaaataagttaagttctagttttggaaatggccctgtttgttttctaagtttcacatttgtcatcatgtcgcatacctgtgtaaacctcttctccccaaacctcctggatgaagtccacctcctaagcaggacataaagacacagcctggatacaagctttcctacctctgaatcagaataaaacacagatttctctttatttcccactggctttacatgcacttttgggtcaacgtaatctggaggatttctggaaaacataagattcgtgtgggcctggtttaaaggcaagtgatcaaatatttaaaaatgaatggcagttcaatgcaccagtttccaaaaaatgaagaaagccactaagcttgacctatgcctacttttaggaacttttcaagtatatttatggcattagaaaagttgagctatttacttccaggtgttttctcctattgcgattattgggggaggggaggtaatacaaggtttcttacaaagtgaaaatttacattgattctgaaaattttttaaaagaatcatgcctccattctaatgttaaatttggcagcatgcatggctttgagcaggtgatgaatggaactgctggagactttgagagcagttttaattttagactgcagtcccaagtgatgctgacaatttttttaaaagtgattttaactcagctttaaaggagaccaagctgttttccttttataacaacttgaagaaaaggaaaagaaatattcaattgactatctcagctggggagtaggagctaacgatagttacacagctttggacacaatactgagctcaggaaagaaaattttagagaacaaaattcctcatttgagaaaggcagcctatatgtgatcagagataaatggatttttcatgcctaagaagaaaattactcccaatttttttgacctttgtaagtatgatttgacttacatattcgtaatgtacttttaaaattttcttaagagttattagaggttaaaaggttgccttgactctggattttgacataggacataggactggagattcctagagagcattagtacacttgtctgcttaccatgggaaaatgagtgacttatgtggaaacaagcctccagttttccagaggggatttattctactatccactggaacagtcttgagtttcgcctgagaaattggagtaaacctgcttctttctctctgggactcttctcaataagcactcattgaattcctagaatatgtgaagcacaagctcacattttttggcatggtggaaagtgcaaactagggtcttctcccagccattgtttcttccacccccctctccccattgaacctaggccctttacacactttaaaatgccacctttccagtactcaggttttacttatgtgtattgttttgccttttataacaaaagccaaaataattttgttataaaaggcaaaagaatattttggcctgttttaccccaaaattcaaatctagatagtactgcttctgaaaggcaaatattaaaaacacaatctgaaatacaagtgccaaaataacatatacacctgactcttaaaaaatcatgatgacccagcagccttaactgctgctgttgcaaggacagtaatctccttttttgtatatgatgtcatgtttcagccctttctaaaactgaggtcagatatccaaatgaagagaacagagattttgcctttttatgtttgtgagatagcataaactttttttttttttttggggagatggagtctccctctggtgcccagactggagtgcagtggcacgatctggactcactgcaacctctgcctcctgggttcaagtgattctcctgcctcagcctcctgagtagctgggattataggcacccgccaccacgcccggctagtttttgtgtttttagtagagatggggtttcactgtgttggccaggctggtctcgaactcctgacctcaggttatccacactcctcggcatcccaaagtgctgggattacagtcgtgagctaccacacctggccaacatttttgagtaaatgtgattgtggcttttggtctgcttgtcaccagaagctgttgggggttcactttctcctttaagcctgtaatgagatgacagagctactttaaattaaatgatgaaatcgctttgctgtcaaaatccgatgttgatcatagagtgaccttcataacattgacatctttttcagttccttgcctacgttaaaaggaatcttcaggctgggggcggtggctcacgcctgtaatctcagcactttgggaggccgaggtgggcagatcacgaggtcaggagatggagaccatcctggctaacacagcgaaaccctgtctctactaaaaatacaaaaaattagccgggtgtagtggcgggcacctgtagttgcagctacttgggaggctgaggcaggagaatggtgtgaacctgggaggcagagcttacagtgagcggagatggcgccactgcactccagcctgggcgacagagcaagattccatctcaaaattaaaaaaattaaaaataaaaaaggcatcttaaaatggaaggacactttcactgggccagacagaaaacaagaaatcttttttgtgttggcaaatcaaagaggcatgcttttacagaaacttgctttgcagattcttcaccctgtgctggtcatgatactttcagctccataccaaggagaggtaaaatacactgcagtgtctcttcagagtgtatttctttctaagaaataattgctcaatttggcagtaagagccgggcgcggtggctcaagcctgtaatcccagcactttgggaggccgaggcgggcagatcatgaggtcaggagatcgagaccatcctggctaacacgatgaaaccccgtctctactaaaaatagaaaaaaaattagccgggcgcagtggcaggcgcctgtagtcgcagctattcgggaggctgaggcaggagaatggtgtgaacccgggaggcggagcttgcagtgagccgagatcgcgccactgcactccagcctgggcgacagagcgagactccgtctcaaaaaaataaaaataaaaataaaaataaaatttggcagtaagatgtgatgttttctcataatccttattattgccataataaattaacattttacagtatttaattttgcatgctgatattatggaatgaaaggagttttaacaaactgattttgaatgtgtttcaagatgactgtagcagtttttgcttttcccaatctttctgtgaattagagtgtatttcatatgtgttgccttcccttgggcatcatctacattttctcttgaacagttgccctgctttattgtaggcagatctttgtagatcagatactcaaagtatttgatcatttgtctgtagctacgtttggctcccatcagagcttgtccttgtctttgacttttcccagtgtggactgcacaaaccaacatgtagtaaatggcttggatcattccaatctccttccctctgaagacacacacaaacacaatgtagaactgcacccctgtgcctcctctccctttcctattcccattccagtcaacacgttgaaaagcttctctgcccttccctggaaccagatacctgctcccactcctgctccacgctagccctccagccattcactctcccgccttgacaaacacttctgctactgcccagattggagtctggttccatgttttatttctctattgtcccaacacaggtcactcacaagagtttgttccctggtggaaatttaagcaccctcaaatgtcttccaagtttctgtgcaaaaaattttctgtatgaaaatgatgtcttttttttttttttggtagctttacctttttttaaacgaaacgaggcttagggtttctgtttagtatccttacagctgacagaaactatcatgcaaacaagaaatgcagttgtccccttaggcagctgacagcaaaagaaaaaattgcatggctttatttcaaatgcagtttccttatgagatatggtattctctgtcctagtaaaattttctctttgttttagcattctttcctagacttttttttttttttttgagacaaagtctcactctgttgcccaggctggagtgcagtggtgcagtcttggctcactgcagcctccacttcccggttcaggcaattctcctgcctcagccacctaagtagctgggattacaggcgtgcgccagccaagcctggtgtttttagtagagactgggtttcaccatgttggccaggctggtttcgaactcctgtcctcaagtgatcgcccgcgttggcgtcccaaagtgctgggattacaggcctgagccaccacgcctggcctttagaattctttcctagacttcaagggttctctgatgttttgttttctcacccatactttaaaaacaaaatgagtaataattaggaaagctattttcctcctctgaaaaataggatctttccattgtgccacaacactcttacagtttactttctgataaaacacagagaaactttgctttcttaccacgtggtccaaggaaggaccataaaccactggagtcagccctctgggtcctccctgctcctatcctgctgctcacaggctggatggccttgagaaagacccattaatctttgtgcctgcagttttgtcaactgtcaaatagggacctgtattttataacctgaagattagtcagtctctgttctttagctttactaattgtatgttgttgctactgctctttagttctgtgtcttagaggtttatagacatctttcctgcagtcttttagttcagcaaacattttagttcaaacaattactgagagcctaagaagataaagatgagcaaggcctggtcctctgccttgcagtttcaggcaattgggtgacagctagtatcacctgaatgtctagatcaggcactgtgctggctgctttacagcattactttagttcacacagaaaaccttaaaatgatcgttacaactctgcattagtctcaggttacaggtaagaatgctaagctccaaagaactgttttctccaaatctcacagtgagtataataagcctgggattcaaagccaacatgtttcctctacgtgtcattatttgaaagtggactgaagaattgggagatttaggaaatgagaagcagtctgtaaaatgacagtgaacccatttcaaatcttcctgctttctcaaatacagaagtgagtgcctcttggcttgaggttgggtccgaggtgatcagtgtgtgtgtgttttgccattgtgaggtggaggctgttccccagctcacagccgttctctgtcctgaccctggcaggcactggctcaggcgatcagggaagccagagagcagcaccctgacatgtcggtcacaagagtggtggtacacaaagaaacagagttggctgaggaaggggaagattaagtaaggtaagagagccctcattgtctgtggcctttctagtgactgctctgtactcctgaacttgtgaaaggatgtgaaatgaaagttcatatcagtgtcttcttcctatagtacatttgactttctagactgttatcatccccaggtgcatctgctcgggtgtatataatctctgtgaactgatggtcatgtggtgtcaataactctgatttattgaggggctgctaatgattgacattcatatattgctttactgtttatcaagcacattactgtaagttacattaattaatattcacattgaccctttctggaagatgctattaaccttctttggatgagagatttttattgtaggagagataagagggagatgagctgattccacctatctctactaaaaacacaaaaatgagatgggcatgttggtgcatgcctgtaatcccatacttgggagcctgaggcaggagaatcatttcaacctgggaggcggaggttgcagtgagccaacattgcgccactgaactctatcctgggcaacagaagtgagactccatctcaaaaaaaaaaaaaaaaaaaaaaaaaagatacatctgagaatgaaccagaaaggaaaagatttctttgactgtgtaaaaatggaaataaatacttcagttaagccaatagaaacaaaagcaaaggattaataaatgattaagtttaatgtgcttggcagagaaaggaatagtatcctgagtatattaagaactctactgtgtcattaagaaaatttaaacacttttgtagaaaaatgggcagagaattaaatgagtaaactatgtgcaaactaaaagatcaataaacaaaaaatgtgcagcctcactattacttaaatcaatgcatactaaaaactcagtggacaagttttcacctataaatttggcaaaacttatgtttttaatagtgttgggaaggctgcaggaaatatatactgctgtataaattagtaatattttatggaggacaatttgacacaaatatatctaaaaaatatccacattaaacatgtctaccattaaactacttataagaatttatcttaatcagaaatatatacaaatattcacctacaagggtatttgtcacattttaatatttatatttgtataaatttatatttgctagtattagtaacaggcaaaagatttacacaccctgaagagaaaccagagtattatatttgctagtattagccaaaaaaaaaattgaaataatctaaatggtcaagagtaggggattagttaacacattatgctgtttccatgtgataactaaatcttgatgaagtgggtaaatgtttataattatctattagggctttaagaagcaggtcttatcacacaataacacatactaagattactttctgttgttaaaataatctgtatgttgaacagtcaatagataggtaacccacaggaatggctgggtcacaggttacacattttcattttctaccttgcgtggcacagccacctgctgttgcatccactaggaggcaaggattcctaccattttacagctgcctctctgactttttaatttttgctagtttggtaaatatgtgtaactgtgattataattctcactttcttcattaatatattttcatatggttattagccattcttgttttctcttctatgaaaatacagatggccaaaaacttcaaaaccttaaatgcttgttcacctctcttgcctgcttttgctttcattctttctttcattgttaattgattcttgatagattctacatactgatcctttgtcaattttatatgttgcaaatatcttcaggcttgtggtttgtctttcattattaaaatagttgaatagggttaatattgttgaatttatcaagcttttcctttatgacttatgttttttccatacccctaggtgataaagatattttttatgtagaaatttaacattgtttttcatatattcttaatccatctgaaatcattttttctaaatgatgagaaagtttcctacataagtagccagcattccagcactgtattgaagagcccttctttcccccatctcatctgcagcatcctatatcaagtttcttatgtgtgggggtgtttctgacactatttctattggtccatgcgtctatccctgctccagtgccagaattactataactttataatgggtcttgatacatggtatgcatgtctctatccccctgcaccccctccccccaccaccgatagtgttctttttcttcattcttggctcttcctgttacatacaaattttagaatcagattgctgtgttctaagattaaatcctgcagtacttcagttggcattgtatctactctgtagttcaatatggggagaattacatctttttaatattgccttcttttccttgaacataagatgtctctatttgtatatatcttctttaatgtctttcattaaaattatatagttttttaatcaaatgaggtcttacaaatcttttctagcttttgctagcatagagagatacagttgacttttctatatttatcttatatctagcaacctgactcttcatatctgagattctattttaaacacagggtatataatgggcccataagcagaaatcattaacaattttagtaaaaataaaacatccagtggcctgagtaaatgtactgtgctgtatgtggatattgatctttttatctttgagatgtatttccctaatggttttatttattttttatttttttgtgacggagtctcgctctgtcgcccaggctggagtgcagtggcgcaatctcggttcacttcaacctccgcctcccaggttcaagcaattctgcctgcctcagcctcccaagtagcttgaattacaggcgcccaccatcacgcccagctaatttttgtattttttagtagagacagggtttcgccatgttggccaggctggtcttaaactcctgttctcaagtgatctgcctgcctcggcttcccaaagtgctgagtttacaggcgtgagccactgtgcctggccccctaatggttttatttatttatttatttgagacaaagtatccctctgtctcccaggctggagtgcagtggtgtgatctcaacccactgcaacctctgcctcctcggttcaagcaattcttctccttcatcctcccgagtagctgggactacaggcgctcaccaccacgcctggctcctaatggttttaaatagggaaggctaaaagcattcttacttaggagtcagaaggctgaaggctatgttttcatcttgccagatatccaactatattgacattaggcaagtcagtgaatggtatgatctacctttcctaactcataggacttattctaaggatagaataagataatgaatgagaaaagtgagtgttatacaaacataaggtaatagcactggatgtttttttctctaaattttatgaatcagttgcttcttaatcaggaatactagcaaaaaattggtgacactctaagcgttaccagtagctccaccttcacttgtggcattttaataagtttttaaatgaattcattgtatcacttattcctagcaccttatgttcatttttacaatggacacacacagacacacacacaacttttgaagtttgcccatctcagaggctaacttttatgagaagccttgttaaacagatttaggaagttaaagtataaacttacatataaggtgaacaaactagataaatttggaaagattcattcatgcattcaaaaagtatttaatgagtgcctaaatgtgctagggtagggctgggtattgaggattccgtgatagacaaagcaaacatggtccccctccttggcagagaggatgtgctccaggaaggtaggtgtgaatattaacaaatgaacaaaatgtaaatgtgatcagccctctgaaggaaataaaatgctatgagagaacaaaataggagacttgaactatcataaatttaaccaatttcctttagaaaccagtttacttgagaaacgaagtttgagtttaaaatctgaaggatgactaggaatgacctcagtgtctcaaagtcattttggcatctccaccccccactggctgcagctcactcttaaaaaatttcctttgctggtgactgtcagatctgggaagagtgtgttttcactgcttcagctactgtctggctgccctgccagaatcccacagaggcagcaggtgggctgaggcaaagagcaggatcaggacaatatcggaatgtcaaaaaagaaggggaactgtctgcaatgtatctgctccgtctccctttttcaggcacataaagctctcctcctgacctgatcttgccctttggagtagctctgagcttttgatcaagtgttgaaagtagggggaggggagagcaaacagaaagatggtaaaagaacaacctgcagaggacgaacctcccaagtccacctttctcagtggatggcagccagctgtgaggcagagaggagctaaatgcaaaccccgttaaaaagaaaacacacttcagatgaggacttcactaaatctttgtaactttttaatgtcctttcaaggactactccctcctgccggcttagcccaaatgcatatttatgagccctcacatggatgaaaaatattgctgaccttatcaccactgcagtggtattcccaaacggtcccgatcaggaggaagaagggttccaggcttggtggtgtgatctgtgtggtctcagaaagaatgagccacaggagagggagctctcccaacccagacttcacaggagcctctctgactcttagagtaataattgatgtcaggtaaaaaagtgaatgaagcctcctgttcatccaaaatcagtgagcacctgaaggatgaaacgacagaggagtggctgctcatcctttcactcatccattcatttatttgttcattgcataaatatgtatggaatgcccactgggtatcgtctgctgttttcccatggaaatatcaaataaaataaggtctgctcttcagacaataaatcagtggtagcagaagaatttcaagttttgtgataatattctgaacctcgtgtaatgggaacaagaaggagagacctctgaatcagaatagagcatcagagatgtttcacttaagcttcgtgctgggtaggagttagctctgtgaagaaggagtaaagggggccattccaggcaggattggaagcattgaacctgatgctccaagaacagtgcaaaatcagatgtagctggattgtgggatacttgtaggagagcgatggagatgcaggaggaaggaggcagaggcccaatgttaaggagtcttctaagccaagctgaggaggctaaactatcctgaaagtgatggggttgctcctcctgtgtttgagagatggtaaggatgtaacttaccttctttgtgacttgttgacggtcagcatgaggctgtggaagttagtgcattgggaagatgggagcagaggagaatcacacatcatatttaggtttttggcttgggcagggagttgatgttggcacctataatttgaatcgtgcaatacatgagttttgtcttttgcatgtcatggccacgttactatggctggtcttctctgcttggctaccttaaagcaaaggtgtatttttggttctgcggtactgccggagagaccaactgtcatgggaattctggaggaaacttagaaatgaatctataaggccccatcttataacatgacatgattaattggaagttttctggatcgtctgcatgttaagagggagcataggatagcagatttgctgggttcatatctacttcttagttgtttgaccttggctggtctcatccctttgtcccagagctgtcatctgtaaactggggatgataatagaagcagaagggcttgtttccaaggcaggttgttaagaactttttataacttacaaggtcggccatgaaccctttttgctcttaagagtccaataaaaatgagaattttctaccccagagataatgagtttgagatgcatgtgaaatgcagaaatggcacatttgggagcacaagagctttgagagtgcaacaggcttctgagcaggagagagatttgtgagtcccctgaatgaattgtgtactgatgaagcctgtgttttgagctgtgttatccagggctagctcagagctgaggtctgggaaacagaggccataaagaaggaggagccaggaggcagaaaggaaacagggaaaaggcggaggtgacacaagctgcaaggcaagataacttcaagaaggagagagtaaccaagtattaaatatggcagaaaaaccaaatgagcatgtttttggaaattgatgaacagaagtcagcctggaggctttgtcagagctgtttcagtgtggtagtagggagagagccctgtaacaggttgaaaacacatgaaaacatattaagttgaaaacccagtgacaggaccttttgctcttccatgagctctgcctgccttcatctgagaagatgggagaacattaggtgtcatggagccactggagctagtgctgtgattattaaaagcagggtcagttcaccattcactggaacctcttagacatcccacccgttaacctgcagtgaatacctctaaattagtcgtgttgctttttccactgttgtgggtacacgaatgccaatttctaaacaaaacaatcttgtgtttgtttcaaagtcagggtgatgtgcagggtttcaaaacatgaactcataagccaaacaggaaattaacattagctgcctagctgacttgatgagagaaaagaaccctgttggctgaactgagctctagctaatcatgagccactcatttacatgtgggccctgatgagtgtcacccctgaccttcaaagagaacaaacctattgacttccagatgactatttcagttctgcaggcatatcaggtgtgttgcatttttattttattctgtttgcctagttgtgttagtctcatacctaaaattagcatcttattactgcttcattttcaatatagattaatcacacctcagatgaggactgacttctgcatagaaataaaaagctagttttggtttagtgagttttaggcatagccagttttcactctgaaatgctgtggaatgttctcatttaacattgctaaatctaccaggtgttatcaatgagtcagttacaatctatttgaactccccccacacaagaggtgctgggtaccactgctctaatgcgtacattaagaccaggcagtagtcactcattccccaaggcttgctcttggacataaccattactgactattattttttcaaatgaaactatctttattgtttttttctggtaataaaagaggggttataactttttaaaagggagagatagtaggaaatgtcagtgacccataagtcccatgctcccagagatagagaatttctttccagtgtgtatgtgtgtacttataaatatacacacatgtagacactcacatacacacaccccccctttccatataggctgatattgtgattcttgctttttcctccacttaatagtactttatagttattggtccttgtcgttacctcatcatttttcagcagctgttgaatggatgagtgatggtttacttaaataacccctattaatgggcatttaaattacccctcagttttcacaattattacacagcttcaaagattatacttgtttgtacatttttgtatgttgatctcattgtttctccagggcaaatatgtttaaaagtggagttggtatgccacgaaggttgttttttgtctttgtttttttgagacagagtttccctcttgtcgcgcagactggagtgcagtggcacgatcttggttcactgtaacttccgcctcccaggttcaagcgtttctcctacctcagcctcccgagtagctggaattacaggcgtgtgctaccatgcccagctaatttttgtatttttagtagagacggggtttccctatgttggccaggctggtctcgaactcctgactgacctcaggtgatccacccgccttggcttcccaaagtgctgggattacaggcataagccaccactgcttgcccaccaagggtttttgacatattaccaaattgtcctccttaatggttctgcaaacatagaccgccactagcagtttgtgagcatatgtttccccacagccttggcaacaactaaacattattaaacattaaaaaaaagctttgctagtctgatcaggaaagagcatttgtttctcccttgtttaaactgtgaggaaagaaccttctttgtgttttttcaatgctagtgaagttggaatacatgcatacatatgctacacacagggacagacacacacatataatttgcatttcttttggttgccagtttgtgtcctttgtccattttcctattcaggtgtctatttttttctcttatagagattagttgaatggacgcatgatggtttacttaatccctactaatgggcatttaaattatccctcagttttcacggttatcacacagcctagtaacttgaaaagatgagtaactaatcttttcagattaaagttattaacctcttagtcacaaatgctacattttccctccaatttaaaaaattggcaccaaaagtggggagaggggcaagacagaactgaccgcttagagacaagcaggccatatccacagttttgttttttgttttggcctaaagggtatatcttagaatttgaatcaattattagtgcttaaacattagaagatagtcagcaattttagaaaaatcagaagctctgatgacattgagcctgctctccctgtggttactatgctggagcttagtaggtgtggccagcatcaggctgggaggagctctctaggtcaccacagtgctactgcctgtcatatcctgtctttatgttgaggcccttggggcccagtctccttatgcatatatgttacccatctggcctctgaccgtgttggggtggtggttatgactttgttaccctgtcctaggctgtgtttgagagtctggaaatgtaaagaatatttaatgttaaactgcctgtagagcatcttcgtgtctctcctctaaccttctttataaggaaataggatcctagacattaacgtaactgtcataggtcacctgtgctaagtatagattgatttatctcaaggcttttctgttagataccccagataccaattgtttaaacatgtaaattttgtgggtggcatcagaggggaattttactatggcaactaattaacaagtttgtgtatgtgtgtgtttttgtaaagatactcctgtccttacgaggattacagtccaaggacatattgatgctttcttgcatcaaaatagttgagttagcattagagcacatggaagtctggacctgttctgtccagtatggtagccaatacccacttgtggctattgagcacttgaaatgtggctagttcaaattgagatatgttgtaagtataagatatttactggatttcagacatgagaaaaaagtaaattatttctaatttttaaattaattacttattgaaataataatttggatatattgggtttaataactacattaaaattacatatacatgttcctttttattttttgaaatgtggcttctagaaaatttacatatgtggctcacattcattgcttgcagtatatttctcttggacagtgttgatctgtggagggtaggagggatgaagtgagaggacaaccttaaactaatatggcacgatgcagtttagattctgtgtgtgtgtgtgtgtgtgtgtgtgtgtgtgtgtgtgtgtgtgagagagagagagagagacagagagagacagagactgttagggggcagggaatagtgttttaagctatctttatttaactttgaggaaaagtgatttttttcccatgttccctcagataaaaagtgagaaagttgggtctagaaatttcttttgattcccactaaccttccttttttctaaaagatgaaagctttgttagtttgtatttttaagctcttatttgatgctacagagaaatgttttctcattactacccatcttatgaacctaagtgacaaaagctcagctctaatagagtatactgagtggagcctgaccatagttcatttgttatttaaaagaagctttaagattttgtagaacgcttttatatcaaattcccagaagatttgacctagcagagtgaaccagaagaccttaacagctttagggccggcactactacttttagaaacttgtgttacggcttcagtgatttgaggaaaccagttttttaaagaagtaagagtcctcatgggatatcatagatatagttaatcaacaaaagagaacagaaaaatgaacctgatgtttttctacttaaacaagaaaattggcagatgagagtaatggtaaacatgggaattagtgcttcttcctaaagatataatgcaattctgttgttttttttccctgccgtttcctcaagctcttattcttcagtcttacgttacaaattagtccctgatactttcacttctggattcattaatctatattatgagcctgttatgttcaagggactattatagttgtgtgtgagaggggaaggcataggaacatgcataaaaataatgttcagggcacaaaaatagtatatttgaagagaagcctagataaagggctgtggaagttgacaggagaaatgcttctgattggccaaacaagacaaagctctccagaaaggttgcaggaaagctcctctgtgcaaagcaccaagggcaatctggatagttggagattggggagggaagaaagagcacatgggaaaacaatgggaaggatgtcgggaaaagcaaacctccatcgtggttatgtatagagttctcagcacagctggaaacatttgttgaaggcaaattgcagatggtcttacatgccatgtcctttagtaatatgaatttatcagtagtgtgtatgattgactgaaaagcttctagattagatgaagtaccctgtaaagaaatcaagatactggttcagacagttagtaatggggatactgaactggacatctctaagagtaagattgaatttaacttggaagcaaagccaggagtaaaatatcataggaacatctataaaagttaaatccgatatttttttgcttttcagtcagatgaagctcagtatctttattactatttgaagtaaagttatattagcatgtaggcctttgagagtaatacagttcattcagaggacacagggctcaggaaggtcaacccagtcccaaaaggcctgaagatgggacttgggccttaaaggacccacagaagagcctcctaagaaggtggggtctccaaacagcatgaacatgttccagcaaaccaggaaaagcaaaagcattttgctgaattatttgtagaacagatactgtgcttcatttgactgcagagaaaaacactggatttaatttctccctgtactcagcagatacacaaatatctgtgacagaagaaaacggcagtagtttagtgatagcagattggacataagcagttctcaaactgaatggtctcaggaccactttatacacctaaaaattattgaaggcccaaagagattttgttcatgtgaattgtatctattgaaatttatcataagtcaaaactgagaagttttataaatatttattaagttaaaaatcatcacatagtgaaagaagtctgtctagaaagactatatatgttgtatgatcaaactgtatgacatcctggaaaaggtaaaatgatggagacagtaaaagggtcattcgctgccactgatctcctcaagagtcttaatatcgggaagctatcaagctcatggtggccaaaacaccattttccaaattctaatgttcacctaaaagcttgcattttatcattggcaacaagtactgtcaattgtttctcttgaggcgacaggctcaacttcattttcaataaaaggtttacctagtatccaaattgaataacatcccttgtctgtcagtgattctctcaagtaagaaaggtggttgatgaaaaagcagctgcttcaactcacagttcagacattcccatagatgcttttcctctagacattgttgtacttctgtatgcagcgggaatggcgtgtgcatacttcccatttcatcacacagaatattaaaaagatgcactcaggcttgagatgtaggaaaattaatatttcttctgtgtcctcaaggacttccttaagtgaaactgtcttctctattttactgcaagtgcacactggtaaagaataaggtgccaggccaggcctggtggctcacgcctgtaatccgaacacgttgggaggttgaggtgagaggattgcttgaggcctggagttcgagaccagactgggcagtatagcaagagcttgtgtccacaaaaaactttttaaaaattagctgggtgtgatggtatgtgcctgtagtcctagctacttgggaggctgaggcaggaggatcccttgagtccaggagttcaaggctgcagtgagctatgattgcaccactgcaccccagcctgggtgacagagcaagaccctgcctctaaaaaaaaaagaataaggttacctcaaatatagtttgattcctctgcttcgacttatgtaggctgagctgccagtagatttactcaccattatttgtttacaccattggtgaaaatgccaacacactgaaaaggacataatgtcttagtatgataatgaaaacagttttgactctatggtccccttaaagagactcagcagtcctcaggggctgcaggctacacttcgtgtatattttaatggtaatacagacattttaagaattgacttttttctgggtttaaccaaatggaaatttagcatgcttgcatttttggctctgggatttttattttatttatttatttgtttatttgagacagtctcgttctggcagccaggctggagtgcagtggcatgatctcagctcactgcaacttctgcctcgtgggttcaagcgattctcctgcctcagccccccagtagctgggattacaggcgtgtgccaccatgcccagctaatttttatgtctttagtagagattgggtttcgccatgttggccaggctggtcccaaactcctgatctcaggtgatctgcccttctcgacctcccaaagtgctgggattacaggagtgaaccaccgtgcccagctgatttttataatttaaacaatggaaattctgtttagaaattaaaatcaaatatgcaaattgaggataaaagaagaataaaatgaaaagttcagcatttgaaataactgtcaaatccataaagtatcatatttaaaatttaattttacacctgagtgcacagagttcatttttgcttaggaaatgcagtgtcttaagacagtcttgctctgtggccaggctggagtacagtggcacgatcccagcttgcgcaaccttcgactcccagcttcaagtgattctcctgcctcagcctcctgagtagctgggactacaggcgcccaccaccatgcccagctaatttttttttgtatttttagtagagacgggatttcaccatgttggccacatggtttcaccatgtgaaacccctgacctcgtgatctgcctgcctcagcctcccaaaatgctgggattacaggcgtcagccaccatgcccagccttaagtaaatatttcattcccgttttcagaatatttgattatgttattgctctgtggtaattgaatgttcattaatctgaagaaatgttgttttcttgtattatttgcattgttgtattatctgggggaaaaccacatttttgcatttttattgagacttctctctagatgagtgctgtaccacttaaaggcagcattgctagtattttctgtcaaatgctttttgaaatcagtttactgagtcaatttctggagtagagcactcaagattgagatcaatacatgagccctttgtctctagaaactcaaagattgtgcttttcgggcaagatcatagaacttgtatgtatggacttttttcaccactgctcattgggtgcactgagagggtaaataactctctgatccctctgtgagtgcttaagacaaggcatgcaaccaacatatatccttgaagaacttgaacatagaattactcctgtgattagatgaaattgagccacattgatctattctcacattggccaaaagagggggacatagactaaggaatgtgactatagtagttagaatgtttactgacattgtataggccagggtggaacagtgacacttggaaacagaacagtggtatgaatgcttttatttttgttgacttcaccacaattctaatacataaagtataatccatatgcttaacagctatgatcttacccaaactcaggatgaacctgtgatagtgtaaaagtgaaagcaggttgaattaatgtctataattaatgcctgccaatttgtattgacaaagatgcccagacttctatgaatatgagtagaattcaagcttagagaaagaaaagaatgttcttgaaacttttacagcttttacatgaagagccattgcctagttttcagtttggttggaatatgtaataaatcatttagtcccaaattctagcctgtaaaaaattgtcagatattaagtttatttctcacagacacctgccagaggacagaaaagtacagtatttctgatgcttatgtagcagtgacattggtgattctgtctttatcttttctcttttctagctcaaaagctaactgtttagtacttaggaacgtatttctacatgtgtttaagtgcaagaaacagtcaaaaaagataagtggatatgtaaataaagtcttcgtacaataagttacttcttgttcatccacgccaataaggaactgggatgttttgacacaatatctaataactcagagttaaacttgatttactgatttttaaagaatgagaaaataaataagttttaacattaaaatggcaataaaatgattctgaaagctgtttggaatcctaagagcacatgaaggttatcatttataatattcattaccagaaaaaaagtttattaatggaaataaattacattttgagtttatttgggtaactatgtctttttctctatatttagctcagtaaatgttgaagttttttgagatcaagatcccttcaattccaacatatgcttagtttcctgtaataactttgaaacaagtttaattttagcttttctttacaaatttatgactcattacaaagtgaaatttttatttttgatgaaaacagatgcaaagcaataaagtgacatagggcctagagaaaatggagactagaatcctaaacattgttctctctgtaggttttcaggccctgatagcatcaggggtttgtttttttaataacataaactaggcaaaatggcagctgtgttcaacaaatgatgcatatttactaaacaaagcaaatggaaataccagctctgaaggaacaagaacaggttccatgactgaaggtgtcatataactgccaaatccaatttgattggtaattgtatccatttcccttcatcatcccccacatttcttttcataattactaacctaaaaaaagactttctattttctccattgatttttttttcccccagcctagaatcaaacagaagtactaatgagtaatgaaataacctaaggcagacaacagggtagaaaacaatgaagttgattaatcaatctgtcctgaataatcaagaggctttaatattatctgtgataaatctaaatggtaggaacttttttcattaaagcaagacttaattttacctaaccaaaagagtgtacattctaattgactttgggagcagtgtctcttggaaaagacgttaattaccactctgcactgtcctttgtgattacctatcatttgccaaaacttccaaccaagttcaaatataaaatgaaacaattgccaccttaaaaaccttttctctttcagggccattgcaccatcatgggttttttaaaaagtcttctccacttacctttgattgtggacttctgcaagactctgtggctttcatttattcctatgctcacatgagacttagttctatctgttggtttcacttatcccttgttctgatgcccaaatctatatccctaggtctaatgcttcacccaggctgtaagccttcattctctcctttttttgaggtcccagactccaaaccttatcatcctgtcttatacttacttcttaaccaccacactctgattattctccttagtggtgcctctcaaatttctctcccacctgatttctgtggtgaccactcaagtctgggtcctggccatctggcaggaatgcctgacatttgtcatcttcctcatccagctggactcctgcactggtctcctgactgttgttcctgcctctactccttgccggcttcagcttattcatcacactgaagccacagcagtgttttcaaaacgtaaatcacaccatgacaaacccttcctcaaaaccaaagaagaaacgatcccaacctcctttcctgggcttatcatgccctgcatgactggccaaccccaagttctttgaccagtcttctatctctctgtggctcttgcactctgccctggaccattgtagtagattgccaactggtcttttcgtccaaatgttttttcttaattcatttttttttttttttggtcaattagatcaagctggtacttctcagtctattaaagaatagacctaatattttgtacctttatttactactcactataccaatgctcaactttagtaatgtccctttcttcaccgtcctattccttccattcgtttctgcctcctcccccaacatacatcttactgtcataatactgtgtacttcttcacctccatgcctctttcctcattgtgtttttccacctgaagcaccatttccattcgttttagcacaaagaaaatagactttgactttccctttccctgagtatagctttaaaacctaccttggtttctgtctttaaattcttacatatgaattgtctctgttttatgctaataaattcttttgcagtgaactcttatttgccagttgcttctagcgtacttgtcaattctccaggtattttaaggccctcgagagtggaatagtgtctcatgcttgtcttctggtaaacatactatttaatgtaagactaggcagacagtaactgttgattacttgattgaaaacttgatgaatgttacttaacatttttttcaagcctgtgtttttggaatatttaagccttctgttttttttttttttttctcttctagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccacatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctct

SEQ ID NO: 35960 - DNA, 223876 bp, Homo sapiens; identical to SEQ ID NO: 35959

SEQ ID NO: 35961 - DNA, 57199 bp, Homo sapiens
tttttaaattttgcatttgacttaaagtgccatgagaaaatttgcatactgcaaggtggtcctagccacctccttgatttgggtactcttggatatgttcctgctgctttacttcagtgaatgcaacaaatgtgatgaaaaaaaggagagaggacttcctgctggagatggtgagtgacattttataatagagctgttttaactactatatcactggtttttactaactaatttggataatataaaattttaacttttttagattaactgtagtctgtgacttcctgtgggagatatgaggatcatattgatagttctccaatgggttcatccagcagttaaaagcatgaaagtatcatatatagaattgctgaattcgatttttgtgttcaatatttagtgtagttaatttcctgtaagttactttatgttactaaataatgtgggtatctcatagttgggatatcaaaattgtacagaagattagtctaatgccaaaatgctgagtggagcattaaaattgcattataaggtatcaaaagagattactcctcccctcccatctcattcctaaggggaagaaatttttatagatagatgtgatctgtagaagttgttgttgttgttgttaatgttttagatagctgcagttagcacttttagggagaacttttttgaaaagattgggtgatagaatagaggctgcagtgagatcattgcaatatctagtatggaaaggaaataaatatacaaatataaaggagggaggtaataggtagtactgatatttttggcagaggacattggaaaattcagttttaaactccttttattcaacaaacaaatgttgccattttttaaaaaattctttttttttttttttgtttttaaccataatgaaaatgactgcattgcaagagtcagtaatccagttgttctgggctctgaactctgtgattagttatagaatacatggctatacagcagttctactatttttagaaattatatacaaataattactctttaaacatgttttctttaagcatatagccacatttaaattttttatacttttatgatgagaagggcctttggtcccccaaaatttacaatagaaaaaaaatattgatttgtattgttaactgtaccaacttaactttaattgttatatgtgggcttacataactggttctatttatatcttcttgggaaatctgcctaaaattaggcttagttgctagcactgaattccagtaatgcctaggctaattcctaacttaaattttcactttttccaaatgttttaatacatttttcatccaaagtcagcctattagtttgcataatatttactttatagctctgctgttgagtatctttgttgggtgacaaaatgttgccaccttaactgttgctagaactgtattcatactgtctatgtttaaatcaaagaacaggtattacgattcatcagtcagaaacttgagtattcttttcccaaatagaatggaataaatttcccctcaccctaccttaattcattgccatttataataagctcatggtgttctatcttaaatgtaaagacttgacagtgagaaagaataggctctatagcatgtgtagattcacttgaattttttttgacttttatatgtgctgggcaaggtactaggtgctgttgatacacagctgaacaaaaaaataagacaaaattcctcccttcagggaactcacagtctaatggaatagaaataacaatagtaaatatcagcgtaataaatatcactttaggaatgtgcacaagagtagaaaggaaggaatgccttggggtgtctgagaagctgcaataaggaagtatgttccagcttagtatcagcttgagcaggtgtttgttaggagaggagaagaccttccaagcaaaggaaagaaggatgtgcaagattagcaagtgagaacgagttgataggagaacaagagcacaggaggtggcagaggccatgtcacacaaggccttttatggcatgctaggggttttggacttcatctgtagacagcggcatggcgctgaagcactttaaacaagggagtaaggcctgatcggacctggacttctggaagaatgctttggtggtcatgtaactggtggactggaagaggacgaggcaggtagcagataccagtctgagactgttgtgagagtttggaaaagagcttggaacagacactaaaatgacactggagatggagaggaaataaatatgtatgaaaagcatttaagtagtggagtttacataacctggggggccatcgaatgtagggaataagagaaagagaaaagtctaaggtggctttcatgtctccatggttggacgaattgatgctccttagaagaggagcagctttgatgaaaaggtggatgcatgaagttgagtttggaattttttttttcatttttcttatttatttattcatgaatgagatggaatgtcgctctgtcaccaaggctggagtgcagtggcacaatctcggctcactgctgcctctgcctcctgaattcaagcaattctcctgcctcagcctcttgagtacctgcagttacaggcgcacgccaccacacccagttaatttttgtattttagcagagatggggtttcaccatgttgccaggttgttctcgaactcctgacctcaggtgatccacctgcctcagcctcccaaagggctgggattacaggtgtgaacaaccgcacccaacctgagtttggaatatttaactttgaggaactggtagcgatgttctgcagtagagaatggtcgagatggagaaaatagatggtagtttaagtcttttctgtacctgaggctgtgcatggtatgtgtagagttggaagacacagactccctgttggagagcccctcctggagggtcactgaaggaagagaaggcttcccaggaagtcagagtggaatgaaaagccccaaggagtaggtcatagaagcccagccaagggtggcatttgctcagaggttttacctaaaataaagtgtttctgatagtttggtatggggcttcttgtgaccctggcaagtgtcatttcagggaatggtaactgtggaagtcagtggattctggattcaatatactggagaaacagtagggatgtggctgttctttaggaagcttcagcatgaagggaagcatgtagtatacggtagttacaagagagaaatggagccgaagttggttttctatgtatttattattatttatgtatgttcaggaagaggtttaaactataggggaaaggaggaatacttgaaagaacaaattctcagcagatgagacagtggggtatcagaaacgtgaaaaggattctcctcaaagagcatccacaggttattatagttttgacaaccactagtggcataagtttcaaagaaaaagactgggttttgtacaaaagtacaagctaaaggagcaaaagtctgaaagtaacggaggtatgagatggcctccttgcctctggaggaaaggagaacgaatcattctcccagaaacagttgtgaggttaaatggactctggaggagagctagacttcagttaagtctgtagatggagcctgtgtattgtggagaccagacagtggagaggctttacaacagcctgggggtgtcagggtgttcaggggacagactgagaaggacctccaagcgtgagggaagggctgagccgtaggctggaggggaagtacatagctaaggggagataatctttgaggtccctggtagtcttaagggaagaaatgattaggggaagagcacagttgatgctaataagcaacagtttgaaaaatctgctttgatatgaagtttcagtgcagtaggtgctgagaggtcttaagtcttttcagagcccagaggttgttaaggttctgctagtgacaaatttctgtggtgcatttgaagagatgtttactaaagaggatcagggagagggaatgggtaatggcaccaaggatgccaactttctagtggaattagcatgtacattatgtgacctcaaagtttctctttttttttttttttttaaagacagagtcttactctgtcacccaggctggagtgcaatggcgtgatctcagctcactgcaacctccgtctcctgggttcaagcgattctcctgtcccagcctcccgagttgctgggattacaggcacccgccaccatgcccagctaatttttgtatttttagtagagacggagtttcaccatgttgaccaggctggtctcaaactcctgacctcaggtgatctgcctgtttcagcctcccaaagtgctgggattacaggagtgagctgctgtgcctggcatcaaagtctctcttaatagaacacatagggcctcctggatctttgttttaaaacaaacaaccaaaacaaaacaacaaaaagcattgagcagtattacactccagagtgactttttcatattggaagtacctaatttctgaacgttctgctttacagctctgatttcggtgaaatttagcaaattttactgtctctgctgtgaaaaaagttttcctaggtttgaatagaatggattgatgtcattgtgataatgctgaagacttcctgtaacattgttgttgatatgctgtacttaagagttttctaagattcttctatttacttgttacttgcctgcttcaaggaatagtgagtctttggtgactccagaggggtttgttttttctgagtcgttctcttaagtctatacttgtattttatacctgaggctatctgaaaatagcagagttctgctgctgctagagttagattgggctcccttgaaagaatacgggtagtgggggttatggcctaggaatatttttacactcttctgctttccagaattagcccatttatccactttatggatttgggtgttatatagagtgttcagtatttttaaagatgcagtttcaagtagtaattgattcttcatgtcagtactgcattttcagatcattaaaatattaatgatttaacttttcatgtacttatgctggaattatttcaactgttgaacattaggaagccttggagaacatggtttatggaaaaaacttacaatgataaaaaactttaaaatattactagtaaaggctataataactttataacaaatttttaagtgttgatttttatatatgcagcgcaggtaaattgaacatgaaattggaaattgacaaggatgttgaagtagcagaaagttaccagtgagttaaggtatagatgatattttgatgtttaaaaaatcagatagtgtactgcattttattgcatcttacatacctttgtttatagaatattctgtataccaccgtaaaagtgataacattccagttaccattgtgagccacattccaatttcagaaatgttaaaatatagtaggaaacattttgaaatagtgaatatagtgcataaggacagtaaaaatgttaattgtgtagtaagatcagaaaatagtttgggagaaatgattttagccttttattagtatatttaccccaaaaagaagtcatataactttagtctactttcctgagagaaacacacataagaaatttgaaaaatatccttaaagtgtattcaaaggcatgccagtggtttgtgtatgttaatcttatttgggggctttcagagtgaacctgtagttttcttggtaattaccttttctaaaacatgatacttatctacagtgtcatgtaaatgaaacttaactgaagtatataataaaatatgtttgttctcacataatactttggaataacacctttgtccctcccttgtcaaagtgatttgattcttagaaatgagctgcatgtagaattttatgcaaagatattttctttagttcatgaaatgacatccaaactcatttcagtttctttctaataaaattttcacagaacctacttttaatacacatagaagactggcagtagagaacatggaaagtttatacttaccatctttttagttgctttctaatgctataaatgcattaatagtaacatatattcactaaccacatgcatttcatccaaactcgtttgccaagaaaattagtttaatagtccatttaattctgtaggatattgtattttcttattaataattagagtattgtggtgcattctctaaatcattcagtagacatgtaacttttgattaatgataattttaaatgtggctctgaaatttcatatgtaacagtaggttagagtacataatgcaggcactatgttagattttcagattaataaatatcaggtgatgaaatgtgcaaaatagtgcatcagcaggattgtatatgctgtacatttttgcctgattctttaagatctcaaaaccaactttaagcttctggttatataatttcatgtgtaataagcaattaagtttatattttgtagtatttatagtaataatttctccagtcctccttaatgcccccctccaccatggaaattctcaaacagaaacaaaagtagagagaatagaaaatcatggctgggagcggtggctcacacctgtaatcccagcactttgggaggccaaggtgggcagatcacctgaggtcagaagttcaagaccagcctggccaacatggtgaaaccccatttctactgaaaatacaaaaattagccagatatggtggcgcgtgtctgtaataccagctactggagaggctgagacaggacaattcgcttgaatctgggagacaaaggttgcagtgagccaagattgcaccactgcactctagtttgggtgacagagcgagactctgtcttaaaaaaaaaaatcaaaaaaaaaaaattaaactctcatgtatccatcatctggcttcaagagttgtcaactcatggctagttttgtggcatggatacctctttctctttgtctccctcagacctgttttgtttgttgttgaagaagaaattgaggtatttctcttttccagtttcctgcagtctggatttgcatccctttaatggtgcatgccatgtccctttgtcccgtatatttcctgtaaattaggtctagaggcttgatcaggttgaggatctttttccccctagtaaaaacacagatggtatatgtatatgttaatactcttcatttaaaaactgagcagcatgaaaacgtttctattttgatttttctataaagcattttatactaaaatagagcatgggtaacagaaggatatttataatcagggccactagatgtctcccacctactctttatgttatctgtgccatccacaaaagatttttgtcaccttcagaactctgccggttccttttgaccactgatgtaccaatctcaaaatctgttggttgttctttactttcagagactggcaagtagaaatgactatacgagtttaacagtatttgatttttaaagctttaaaggctgattttatatggagtattacacttctgtacttatagtttttactacacttgttgatgatttttgtcattgagaatttttaaaaactctaccaactctcatatttaaggagcttacttactgggcaaacattaggcaggacttgtttttaaaaactatgttacttgagtttcctataatttttaaagtaattttctactattttaatgttccacataaaatcccaatttatcctgagaacaggggaaaactaatgcacacttttttcatcatcattttctgaaatctatttttaaattctggacgtggttgaggacacagtgaatagtttcatatcctgcagctctggtattggtaggtggctttgtaccactggctgaaacaatcaccctaaagtcagctttaccagctcgtcctgttcttgtacagatgaagcctgactgaagagagatggcttttctgctgccttgatgccactattttttgtttagaaatgttttgaggatgcctaaaaaacaatctacaagagaataaaactttagattttaaaataagtaatgcataaaatatattttcatcccatttttgacctcacctcattctttagccatcccttatagatgagaagtttaacatagcaccttccaaatttaatatatcccagaacctgtttttcttggacatttattaacgtctcaaaaacataaggaagaaagtttgggaagtgctgatcaggcacattgctctttttatgtctgtatcaagagataacattacttttgatgagaattcttgttctaatgggaggggtacataagacaggtttgacaatcattataatgagagatagcaattggttagagacataagaaccctgaatgaaataatgtgatagtcaagactagtaaataaccactatagagagattcagaaaagctacagggaagagaagccattttagttgggcatgggaaggcaaatagggatttggtgttgcagcgatggaagccgtgaggggatgtgagcaaaggcatggaagcaggagaatgtgaggcacgttggaaggaaggcagtgggtggctgtttgactgcaagatgaagtactgtgggatgggaggaaaaggtctagcaggtgatagttttggaaaattaggttcaattccccattacagaggttggactctaggaggccataagaataacaatgaaggctgcactttaaggagatcagtgtggcagtagtttttgagttgggagccaacaccatgcagtgactcaggtgagtggggcaaggtgacgaagtcttgagtcaggacactggtgtggaggtagaggacaagacagccccttgaaagggttaacagcctaggagagggtgggctcagaaagggttctggttgttgagggcacagttcaaacacaaatgttattaaatagaatcatgaatcaatcaattgctatgaaattaatgttagttaagtttcttcctattcttagttctagagccagtacaaaagcctcatgaaggtcctggagaaatggggaaaccagtcgtcattcctaaagaggatcaagaaaagatgaaagagatgtttaaaatcaatcagttcaatttaatggcaagtgagatgattgcactcaacagatctttaccagatgttaggttagaagggtaagtacttactgtggtcctgatagtatgtgaatgaaaagtatattctgaattttcagtaaattgcacttgagtgctgattgttcttaaggcaaatgttatatcactatgttactacttaccccacttagaaaataattaaatgctgatagaaataatatctcaagcttctactgattattagcactatgtatttcaggcattggaagataattatttatcttaatggattagaaggggattttaaactttattattaccaaaatactcacatactcaactttttacaaaaagatttaagttgtatgtaacttgaaacagtgaaatacacagtcgtaagtatacagctcactgaattttttgctatgtatacacctgtgtaaccatcagccaaatcaagacatagaatgatcccatcacccctgaaagtctccttatgttttttgtagtcattacttacatccccagaggcagccgttatattgacctctctaaacatagattagttttgtctctttttgaactttttatgatggatccacaccattttttgtgcctttaagattcatattgttgcatgtatcagaattttattcttttctactgcaaatagtgatttgtaatatgaatatgccattgtttatttatacattgatagacctttggattatttctactttttgacccctataaataaagctattgtgacattcttgttcatgtcttttggaggacttaagtgcccattaccgtatgctatgtactagagaaaggaataggttatgcatttatatagcattagcatgtgctaccaaatattttcccaaaatgtttataccaatttacactcctatcagcaatatattagttagatgtctagttgctccataagaagaaggtaatacaaggtactagagtaccataggcccagttaaaagcaagcaaactatacagaaaataggtagagtaagtgaacatgtacattctgtgctgaggccccctaaactccttgctctcattgatgctggcagccaagcttgcctcctccagagaagagactggaagatctttctcatcagaattggataggcctagagagaagggtaagtacctagtgtggtcctgatagtatatgaatgaaaagtatgtgctgaatttccaacaaattgcactttagtgctgattgacttgggaaagtttccaacttaatggcacagcctgatcacccttatggaaactcatagtcattgagtcctactcatgtgtttaggcctcatattcagcctcttggtcttccattcttaataacaaataggtaagcaaggaatactagacatctcaggaaaccctcaacaaacagagaaaagcaactttgaggaaacaaaaactattaaggtagaacacataaagagaaataactaataacctcaacaaaatagagaatatattacaaccataaaatgagaataggatattattcaaaagatacactgagagaaccagaaagagcttttgaaaataaagaaaaatgcaccaaagagatggacaacagtaaaattatatgaacattgaaataacaatcaagaaatccaatattttaataataggagtctcaaaaagaattttaaaaatagggaagagaaaatttatccacaaaattttccataactgaactgcacaaattttcaaattgaaagagcccaccaactttttgggacaatagatgaaaatagactgtactccaagacattgtgactttcagaacactgaggatttcaacccccaggggggaaaaaagaccttttacaggtttcttaagaggcgaaagaaggtcacaatcaaaaggttattaatcagaatgccttcagacttctcagcaactctagaaacaaaggagcaaaattctaaaggaaaataatttccaatctaaaatcttatattcagccaaacttgcaataaagtgcacaggttaaataaggatatttttggacatgcaagatctcaaaacattgaactcccaagcatccattctcaggaagttactagagataggacgctaccatttaaaaccttggttttaaataaaccaaggacaagagagacatagaatgtaaaaaacaggagattcagcttgtgtaagaaatggtgagaatgaccagaaggtgatgaagggagagcctgagtgagagttgcacaggcagaggcgaccagcccagatggagccagtgagaaaattccagaagagacttcaaaaagataccattgaagttacacctgatatggctgaatgtctagagtagatttagacaattgataggaagtttgggattgaaatacatagaaaaccatagtaagaaaaaaattaaatgagcattaccttcagggaaaactttaaaaaaattgttcagagaaaacaaaagtaatcatagtttactactacatggcttagccatgaataagtcataataaggtaactgttgaatattgtgcatgtaaaaattaaaccaaggagatgaagagtatctctttatctggcaagttgattaagtggagatcagtcaagagaagcttaatttgtaaagatttttcacaaaccatttgctttcctgaaaatttaaacattgttgaagaaaactatagactctccacagtctacagttaaaatgatgcctgtattataaacaaccttacatttacttcaagagcctcaatcaactattattgtttctggtagaattgtttttgtcattttaataacccccctaagtatatcaccactcttaacacattttattaaatatttatgtctttttgtctttatgtggtttttgaagatacttttattaatgagtgccttttaagtgcattgtaagtcaccagtttttggacattgaacagctttatgatattaggaatagtgttgaaatggtgtgatacaaatgcttgtgcaccaagtttcacacttgaagactcttcagacttgacgaagtccacttttgtgaaagctgccaatacacagtccttctggccaactgctgggtctctgtgggactgggctgcctaggaggtagcgcagagtcactactaccactgagtagcctttttatatcttcactctatctctggactgataaccttttttaaaaaaaaaaagttttagaagactttttattatggaaaatttcaaatgtatacaaaaatagagataataatgtaatgaaccctcttgtatttaccacccagcttcaacaattcctaacagttttgtcttacgaattcttataccctctgagatgtccgtcaacaatctttgcctcctggtattgacacctctttgtagtctccatcttgcactaagattggtctgtgtgagcaatagaacatggtgcaagtaaaatggagtatctccttcaatattatgttatcaaatatgctgtggctttcatgttggtcttttactcttgctgtgatcatttgctctgggataagcccctggacacaataggtgcagccctatgtcgacacccgtgtggtttatggctttttgtgaacaaccaaagaagtaagattagaagcatattctccagccccaagcaaagacaaaacatttctaaatatttcaatatgtagctctgaaagataaggactcatagaaaagaaaaataaaaatgattataccattttcacccctaaaaataacataaacaatgatactttcatatcataaaatacccagttaatattccaacttccctagttatgacatatatatttctttttttatagcgtaggtgtcaggatcaaaattgcagctggtggatattctcttaagtctcttttagtctgtaggttccttctctgttttttttccttacagtttattatttgaagaatccaggtagaatgccttacatcttttctcagcctacattttgctgactgcatcactgtggtgtcatttgaacatgttcttcagttccctgtcctgtgaattggtagttagacctaaaggcatatcgtaccaatatccttaaagtcaagtaaattgtgtggttgtggtattaaaggtgtgagatctggcccataatatgcattgttattatggacaggttcattacatgtttcatttgtctactttccctttttgtagctcctgttagctaggcattaagtgcactaaggaagaaaatatgttatcaaagttgatgatgtgaatgctgcatatcaaaacttgtgaaatgtagctaattccatgcttaggtgataatatatacctttaaatgcatatgacttttttaaaaagaagatggaaagttactgaactaaccatcttaagaaattagaaaaggaacacattaaagagaataagtagaaggaagagtggaaacttaaaacttggaaacttaggaaataaaaacgtacagtagaggaacagcaaagtcaaaagttcatgggaaaaaatgattaaaaaatgataaaattgactaatcaagaaaataagagagtcacaaatccataaaaggtggcgtcattacagatccagaccttaaaagataatatatcacaaagatgagaaattataaagtagaatacaaacatcgagtatagaggctcaacaaagctgaaagttctttggaaaaaaatcaacaaaatcaaaaaacgctctcctaaatagcagataatggtatgaaaaagacagcatccctacacatcttgcagacgtttgaaagattatatgtagattatatgaggttttttaaaatagtcaaactcgtagaggcagggtgtagaatagtagttgccagggtccggtggcaggggagaaatgaggagatgctgattagtgggcataaagtttcagttatgcaagatgaataaggactagatacctgctatacagtattgtgcctgtagataacaatgctgcattgtacccttaaaaacctattaaaaaggtagatctcatggtaagtgttcttaccacaatgacgtaaagataagattataagtgaatattataaaatcccaattttttaaaatttagatgaaattagtagttcctagaaaaatataacttagtaaaattgacatcagagaaaagaaagtataagttctatagctattaagtagaattaattatttaaaagcattacacacagccgggcgcactgactcacgcctgtaatcccagcactatgggaggccgaggtgggcggatcatgaggtcaggagatcaagaccatcctagctaacatggtgaaaccctgtctctactaaaactacaaaaaattagccaggcgtggtggcacgcacctgtagtcccagctactcaggaggctgaggcagaagaatggcatgagccggggaggcggagcttgtagtgagcccagatcacaccactgcactccagcctgagcaacagagagagaccatctcgaagaaaaaaaaaaatctttacacacagacattcacacagttagacataaacacagacttccaggcatagatggctttgccaatgaaaatgaagcaacatatcaaacttatttcatgaaatcagcatgatcttgatatgaaaatctgacaaggttattacaacaaagaaatattacagaccagtagtctcgatacagatgcagatttataagtgaaatccagcaatatatagaataaatgatacattaaaaataaattggtttattccagacatgtgaagttggtttaggatttgaagatcatttagattcaccacatttataggaaaacaggcgataagttatgtgatcatttcattagatacaggaaaaacatttgataaaatttgtcactgtcatgataaaaccccttagcaaactagaatagaagggaacttctttaatctgacaaaagatttctagaaaaacaaaaccctcccagcaaatatctatatttaataataatgttgtaagctttccctttgagatctggaacatgacacagatgcctgttaacaccacttctgttcagtgtcttactggaggtcttagccagtgtaaggaggcaagcaaaagaactcactgttatgaggactggaagagaggaattaaaatttattaaaatttattactttaagaagttcattaaaattttattatttgcagttgacatgattgtgtataacaaaaatccaaaagaattagaggattagaataaaaaagtgtttagagaccggtcacggtgactcacacctgtaaccctagcactttgggcacctgaagcaggaagattgcttgagtccaggaattcaagaccagcctgagcaacattgatgagaccccatctctacaaaaaaattaaataactagctggacacagtggtgcatgcctatagtcccagctgctcaggaggctgaggcagaaggataacttgagctcaggagttcgagattgcagtgagccatgattacaccacactgcactccagcctcggtgacagtgtgagactctgcctcaaaaaaaaagaaaaaaaatattcagtaaggttgaaggttttaaggtctatattaaaaagaaaaatacgttacatttctatatgttgttttcttacaaaagctagaaaataaaacaattttaaatattacttataatgtagtctgaaaatatcaaatatccaagaaaggctcttcagagtaaattctaaagcaaagaaaaattaaatacctaaataaatggagaactatcccacattcatggggtcagactccttaatattataaagatgttggttctttctacattcattagtaggtttgatgcagtgccaatcataaccacgtatacatgtgtaatttgacaagttgattctcaaatgtgactggaaatgcaaagacctggaagagctagacattcttatagaattattaagatttcttagaaaactgtaataattaagataatgtggtatcgttgcaaggatagacaagcagatcagtggaacacaatagcgagttcatgaccagttctgtacatacttgaacacttggtttaggacaacggtggcactatgtggcagtaggagaaggatgatcttctaaaaaatgaacaaatgaatgacgctgggtcaacttgatataattcaagacaaaactgaaactgcatctttacctcacatcatacagaaaaatcaattttatatgtattacctgaaataaatgtgaaggcaaaccagcaaagccctaaaagatcacataggagaaaatatctttatgatcttggggtaggaaaggactttgttttaggtgtatttgtactagatggctggactttttttttcttttaaatgacagcctaccatttatttatttaattttttgcttctctcgtgctcatgttcataggcagcctaccattgaagggactctcactctgtatatacacacatatatatttttgagagacagggtcttgctctgttgcccagactggagtgcagtggcacagtcacagctgactgcagcctcaacctcctgggctcaaacaatcatccgacctcagcctcccgagtaacaaggactacaggtacacaccactacactcggctaattttttaaacgttttgtagagatgggggtctcacgccacgttgcccaggctgggactttgtattttaaatttaatctttggtttttaatagatgacttttgtgtatattatgacttgatctacatgtattatgacttgatatatttgaacttcttttaggttgaaccatatgaaattgatattcaaccacttttgacctacgaaaatgacaatttcataaagtttgacttaataaatcttgctttctgtttagtatctttttcatttttttcctcctttcctgcttttctaattgatacagtttcaactggtaaagttttagtattcatgtttttctgtctcttggtttggaagccgtacacttttcctttattagtaagacctaggtatattgtaattgtcaaggtgtagatttatctttatgtatctacatgttcagtgcacatagtatacttttgatgtgagcactgatattattcttcaattgtgggacattcctagctgtaatctcaaatactgctgcttcactatttcctccaatctgttcttttggagctacttatatgcatatactagagcttctcaatctatactcttattttttctctgtttgttccttttcaaattgtctctaggtaaatttctcattaatatcttgatagtggcaaagtccaagtctggctctgccatttactggctatgtggtttaggacaagttgtctgacttttctatacctcaggtccttatctctaagataaagagaattacaagggtggttgtgaggatttgtaaagtgctttgcacacttcctggaatctaggatacagagaaggcctctgttcaaggagtgagctccaggtccctgtttgattctcaggagaagctgactccaaagggacttttccatctctacttttttttctttatttttctactcatttcctgacttccaaagcagattcacaatgaaatgccaagtggtaaatattagatggtattttcttcagcctcagctatgctggacagaggtagttagctgctttccattcctgctccccgaggtggaaggaagaatggtgtgggatggcccttggagtgcagctttttcaccaccttttggaacccagagaaaccttgcttatgttctaagacatgggcttaactggtgtgtagctggctgtgcccagatcttcctgtctgccaataacttctactgccttgtacagtctctaagagcatgtttcctgaaggaaactggagggaagaatgacattattacactgttcagaagagttaaatagaagtaacagtccctgaataacttttctaatgtgtgatcttagggaaggaagtgtaagacagattccaaatcatctagtaagccaaatccatcctatatagttagtcttagatatttaaaaagtaattttaatagcatttattgaatgctttattatataccagtgttatacacattgtcatattcaaacagttgggcaaagtagtagtaatgtgctcagtttacaaatggggaaacttggacttagggaaattaaatgatttgtccaaagtatagttagtaagtgacgcaagtgaaatttgaacctaggtctcagggacaaaatatgtgctctgaatcactatgctttgcccttagttttatggttagatcttagttgatcttctctgaatgagagtgtacagaggagaaattttgtaacattgccaaacactgcctggcaggtagccagacatcttatgagatattgagttgtcattgataaatgctagtgacagatgaaatttaatgggagaaaaagaatacattgaaaatcatagcttgaagggacatggaggagagcattggattatacatgcatagtcaccttgatgtggaaatttcttgaaaattcttttcttggctcttctttcatactatagttcttgacatatatatggatgattgatgagcagtataagttttatcataatttgcagatttaacttgtagttctgttacttactagctgctatcatgagcaatctactttatttaagcctcagtttcctcatctgtaaaatttggagagtaattcctctgtcttagggttgttataagcatacatgggataacatatttaaacctcttaatgcagtttcaggaatttaataaaaagtcaggaggaccctttcaggccagtgccctgggataggataaatagagtaggacttttttagagatggagtctcactttgttgcccaggctggtctcaaactcttgggctcaagtgatcctcttgccacagccttgcaaagtgctggattgcagacatgagcccctgcatccagccagagtaggactataacaattgaaaaatattagtaatagtaaataccaagcgacttctgtagttctgtatttctgaattgttaggtacagtcatgtgttatttaatgactgaggtatgttctgagaaataggtcattagacaattttgtcattgtgtaaacattatagagtgcacttacacaaacctagatggtacagcctactacacacctaggctatatggtatagcctattactcccagtctattaacctgcatagtatatttctctactgaatactgtaggcaattgtagtacaatagtgtttgtgtatctaaacatagaaaagatacagtataaatatggtataaaagatgaaaaattgtacacctgtatagggcacttaccatgaatggagcttgcagaagtggaacttgctctgggtgagtaagtgagtgctgagtgaatgtgaaggcctaagacattactgtatacactactgtagactttatcaacactgtacacttaggctcttctaaatgtattttgcagattaagtaattacgctagtatgttgatggtggctacagtgacactaggccataggtatttttcagttccattataatgatatgggactactgtcatatatgtggtctgttgttgtgggggtgctattgaagctcagcggggtgaatgccctgggtatccaccacattccactggcaaccgcacagtatgagggagaggaaaacaaatggaagcacactggaaccggggagggaagtttcttcctcctgcattgtccctgcagcaccttctacctacagagcttaggcatgcctcatgcatactgcaaaggagaaaagcttataggggccagtttgtatgtatatatttcaatagaaagttaagactcttccctttcttcctaacctataccttgctgttaaacctgtatgtaacttttagaaattagcataaactggcggagtgcagtggctcacgcctgtaatcccagcattttgggaggccgaggtgggcagatcacgaggtcagaagattgagaccgtcctggctaacacggtgaaaccccgtctctagtaaaaatacaaaaaattagtcgggcgtggtggcaggcacctgtaggaccagctactggggaggctgaggcaggagaatggcgtgaacccgggaggtggagcttgcagtgagctgagatcacgccactgcactccagcctgagcgacagagcgagactccgtctcaaaaaaaaaaaaaaaaaaaaaaaaaaaagctcgttttcataactgaggataaaagtctcacttgggcaagtgtggaagaaagctgcttcctgaacatggcctgtggcctttctgctcatcctcagctctgtgttctatgaacccatccccctacccacttcaaaccccaaaacacaaaaggacaggtggtttcttgattggaaaagcttagctagaatgctaaagggctctttggttcttctcaagtgccttgtggctcttccaggttaggggtgtgtgtttgtgtgtgtttgtacctgttctgaggttaattatggttgtttaatattttctctatgtttcctcatttgctttgagagaatattaatttatgaatttgttatggtctctgattaaccatttgatttaaaaaattatttcctttttatcatctgttcttctggatcctaatattgcttctctctctgattcttccatccagtttctttctattgttcttataatcttacaatcttacttcctttccatacagttttagaattttattctttaacatattatacaagtagtaaatttgggttatcacttctcttctgcagaacctgctgtctccacatttttctgtcttcctttctgtttcctagccatagacatggctaacagtaccatttgtatctgtacatctttcatgcatcacttgattttattattttattttattttggtaaggtagcagctatatagccaccttggctgtttcctgcttcccaattctacaataataataagtaggattcacttgggaaaagagattgtatgtgtggcataataagattcagctaagtaatggaagaaactctttttctgacccccttttacccatacataggccattcctgacttcagagtcttattccaggagtctgtgcatcaggcattccagatacagcttgctcagctatgatgtacctgaaactagtactaattatatacataaatattctagccaccatttataacagagttttgatgggaaactattttcagaagtattattaggactgctgaggacacatcttttccccctctagcctagtcttttgggccacacctctttagcctagacttaggaggagggagctgcagacagggtggcaggctgtgtgggccttcttgtggtggttagagtgaacatagggagcaagcagtgaagtggaaatgaggctgtggattttctggatcagtgggtagagggaaggttactgttagtaggagacggagaccatcctgtgaaaggggtcttgggaatggtgaagagggagagaggggctgcagtggaatatatcgaaggacagggacagctacttgtttctccttgtctcctggcagaaagaaaggacaagggctgatggggcccctacgatgacttctttcaacccttttaccttgtcatctttttacccttcgcttttccttttcttccaactgccaactggcagccctagggtagagtgttcgataagaagttacttcaacagcttcagaagaggagtcttgcttgtgttttcttcatttcctccccatccttcccttttcccactcccactgacaggcgattacagttgagactggggagtggaaagtttgaggagcttgagagagagcagggaataaaggaagaaagaggagggtggagcaactgttagaatcggggatacctgggagataattatatatgcactgtttaggggggcttatgttctaaagcacatcccttgatctcaggttacctgccgctgttactgttctctgataggctgttatctagtaatttcatctagctaacaaggttgaaagaagagaccatgttgcctaacaaagtgctggaaacatacaattattatgtggattttgtgtgcatatcttttgagtgtgtttggtatttctgattattgcatgctcaggcataaatagtctttagtgaacgagatacatgttgatatttaattatggcggtggccccatcaagagttggaacagcagggcatgggctgtggagtcttcagtcaggttctgttgcctcctcgctatccctgccctgtttctcatctgtgaaatgtggctccaagcatccgtcttatagaatgactaggaagagtaagagcctggtacacgataggtactcactaaatatttctcttcttttgtggaaggtatatttttgtttagattattaaactacgtaaactccagtggttctaattctttgtctaatagggtctttgaaatacattcagttttgggcagataatatagctttatttcattctccattaaaatgaatcacctgaaaacattcatcaggaggaagtacctaattttaagaatataaatgacatctttgaaataattttaatctaaatatatcactttaaataggtgctatttattaaacacataacattaaccaagacttaaatgaaaaggtaccaaggatcccaccactagagcaaactgcttttattgttctatcacccttctagtccagattcctttattatgcaatcttaacagtcactttttataaaggcatttgctttgtctctaggtgtaaaacaaaggtgtatccagataatcttcctacaacaagtgtggtgattgttttccacaatgaggcttggagcacacttctgcgaactgtccatagtgtcattaatcgctcaccaagacacatgatagaagaaattgttctagtagatgatgccagtgaaagaggtaaattttaaattttaatgccaataatttgctacaccttttgtcactaacggttaaaactagttgctataatttttaacctaataattttatacaaaattctaatttatcccaaaaatatggcatttggattcattcacatatgtaaaaaagtacacccttgtgaaacttaaaatattactttaattagtaattaatttaatttgtgtgttgcatcttaatcttgtttcaaaaagaaataatgctctataacataaactattatgcaggacagtgaaaaaactctcatcattttgttaggattttctctgtgggaagctgcaggactgagtcagtagagagagactggattctgcttacatccatgaatggagaaatgtagttccatgtttagtaggaaatatctctgacagcaaaatggagctttagctgggtgaacctttgttctccagatttttcttaggtttccctattttctccatttctaagtttcaggaatgatctatagctaggtgcataaaaggattaggaaggatgaaaaggtgggatgtaatatgactctcatagtaaatctctacagactcttgcccacgtccttctaggagtctcagaatttttcacaaggctaaaatctcccaaactatttcatgaaatactctttgggaaaggacatattaattaatggtggcttggtcaatattatttattctgaatccttactagagatttcacactacagagtaccatatagaaaaggctctgcttagtccatcagtaaagaaacttgcttaacttagatacccagtatttcctaattttcttattcatagctcatctgtttaggaatcattggtgtcatgtgttccaccaatgttcctgtgttcgcatgagaaaaatttagagctacagaaaataatttcctacttcttttcttccttcatcagccttaaatgatctaccattttaacctcttttgctagtatcttcaactttcttgcctattctcccattgcatctgctatgatttagttaagtatcatactttctccttcctgtgtccacactgaatacatgcatttaaccgaaattaagtttattcacatcaaatatcaattatttggagtaattaatacaataaaaacaatttaaatcttattgctttgccagtttatacagttgcacatgaagaaaaggataaatcctaccttttaaagtaatttatatcttacctttttaatcaaattaaagagatactttataatcacacaagacatttaaatagtataatacattatataattacatgtcagaaggaatgagagcagttaagaataccacacgtaaagaaataattgttgacaacagaagtataaaccttatgtggataatctatttgctaggacttaatccctctgtaagaaaattaacctaagttaatataaggaggaatatatacaaacatttatcctgcaaatgacttgtgcttggtttacttacgtgtcaatatttgctagattaaatatattcttccagaagagatacttaacctgagataaaatgaattattttttcatttcctcctttgtttttctctctcgttctgtgaatgcccaagaaggctgtgtagaataataagtttttgtagaatatggcctaatttaaaaggtgcagggtcccacaacaagtgacagagaaactcacctatagcagttctctctttcctttccctcatgcagccctcacccaacaccccaatctgtgtacatctgtgagaggaaactggtgtgagcagatgtctacctcactgctccacctgaggcttagtctctaggcagggtcctggagtgccgctccagagtccctgctcaggggtctgattctcctttatcttcctgccttggaagcctcaaatatccgggttaccatttccggtatctgggagacagtagatctttgtttttgtggttataatttgcagtcttgctttccaggttgagaatcatctaatgtatttttctttggctccattgtttaagtcgtaattgttagacccagaaaccagagcaagctgtttgcttttatgtaactctttacatctgctttttttcctattcatgagacacatctaaggcaccatcatttctcacctggatatggaaatagactaactagtcaaactaatgtccccacatactcttaccccctcccatctgttcaccatggtgcctccagagtgagcttttttaaagcatgcaaatttgatcatttcgcttccatgcttaaaacccctccactaaggcctgtatgacctggccccacctggcatctccagtcacatcttgaaccattcccatacttcttccctctgtccagttttcttctttcagtttgttaaagaatatcatccttcttcctatctcagggccttcaattgtactgattttgttccctctccctggaacattgttctctagggaacatttatctccaccatctccccagcactgttaacattgaatcatccatcagagttcagctcagatgtgatgtatttagagaggcctttcttgacctctccagacctgtcacatccctctgaaaacatctcataacactctactcctctgcagctctaaccagggtttgaattacttgtctgtttaatagataccttcccccagtagactgtatactttgtcaggtctatttgctcaccattatctcttcagttcccacagtgcctgttatataacaacagtctagaattatataatgaatgggtgaaagaataatgtacactggtatatttaatcttcacatttacttcttctctgtgcaaacttcctaattgggttgtgtagcatagatagtgtgcccatggcctctgaatacttgatttcaagttaacctgctgagtaactctatttattaaagaagtatgaagtaggtgctataattattcctgttttattgatgaggaaaatgaggcttagcatggtagaggagtatccaaaccctgtataaatccagagcctgacctcttaattgctgtgtacctcacttctgattgcttctggtgcaactttactgttacaggatctgtaataaagtcagaatttggacgaatccctagtttatgtcagaagttatgtaattttcatctcagaaagttatcttaagacttagaatttatgtaatgtttctaatctgagaagactattattttttcattttatacaaaaagcagaggtttatatttagtagaggttaggagttagatttattagattctgaattctttattcttccctttattcttctctactactccttagagttttggctaatatttctcagacattgatgtgaatagtgaaattttttcctgatgttcacactctctgacaacctcacactctgagaaatgcatagggatccatttataggccaatagttataaaggtgtcctaagaagattctcccttgtttttagatgtaatagtagcttctaactataatctcttaactcatggcttcatttttgtaaaatgagacttggataattcctaatcccccacccatccctgagtccataattctgtatcgactgaaaagaagacacctatatcctaatgtaattgtgtgaaagcaacaaagatgtcaaacaaagatgccaagaaaatttgtggaagagcaaattttgtgagttacccgaccacagaatcatgcatttttttttttaattttgttcataaacaagacagtatagctttcaaagacatatgggacttggggattagattgctttagttctgaagaaacgttttaaactaatatttttggaaaaacttgttgggagacgcattgtttatgacacatccagtcttgattgatctaaggtactaaaatatatcttataccctactgcatgaaattctatcaaattctggatacaaagtattttaaatttgtgcttgatcaggtgcttccacagacctgaattgttctctctatagagttcccttctaggattctcttgttgtagataaaaagatgggctttaaagtcaggcagacctgggtttgaatcttggatccatcccttaagctgtatcaccttaatcaaattcatgtaatatgctgagccttagattttcatttctaaattatgcataataacttcatagggtcattgtgagcattaaatgagataaaatatataatgagactagcattacatatgttagcattatgctaaacagacacaaaatgttaacagttactacaaaatgttgctcttctctgggattggcactacccttacctttttactcagaatcaatttagatccttctgaccctaagacttggttcataaaatcacagtgatatctttcagataactttttagctcaaatattagaaaatatattagcagaaatgggaaagatcagtgttttggtgtagtgggacacataggcctttctcttttacagctttttatatccctgattatttcattattgagtcattttgtcttgttgagtcaaataggcaagaattgttttactcccatttgtcttttccacctcactatgtaggaagccttttggatctctacttttagtatttaattaatagatatgaggataatctctctaggggttccagtagttccatctcaaatattttcttccctagagagattatcctcatacttattgtatggtgactagttggaaaggcatttggccatattaccaccaatagcagagttctctagcataaattctgtaaaccaacctgatcggaaaaatgttttctctttgctttgaggaagttgcaccttttctgctttttaaagtcagttgtgaactttggaggtaaggtttatcttatcctatatgcttgcctgtgtcctgaggagcataacctcttatctgaactctccaggatagctattgatttcatacacccacatactctccctttccccttttgcccactttttctcttttcttcttcaattgccctttcctttttaaactttttttcttacacctaattgtcagtttaaggatctctatttggccttgcagttaacagtccagcatttcttttccaagtgtgaccccactttctgccccctgattaaaaaaaaaaaaaaaaaaaaagtatagtcaaagaccatggtaatcaacaagacaatttgtttgtgcttctgaggaaatttcacaattttctgaactctacagctattacatattctgtgtcttctctctgttgaggtctggatttaatgctttctttgtattgctgatccttaagcatgattagagaaagaattgagtctaacagagttacttagcgaaacataggagcattcctatccttggttaagtctgagcacaaaggcattctcctaattctgcatataataaaatagaggcagctgtagtccattctcttggggaatataaaggcttcctttagcagaatgggtttatgagtcagggagcctcactgagagtgttcagtaagggtatgttgaataaattttccaaatcaaaattactttcatctgaatagtgccaggccacactggtttgcatgttttcttttgttcattttccagactttttgaaaaggcctttagagagttatgtgaaaaaactaaaagtaccagttcatgtaattcgaatggaacaacgttctggattgatcagagctagattaaaaggagctgctgtgtctaaaggccaagtgatcaccttcctggatgcccattgtgagtgtacagtgggatggctggagcctctcttggccaggatcaaacatgacaggtaattttctggtgtctgtaagtttgcttttagtacatttgtcctaaactatatggtgagttgccaaattctatattttttaaataaatataaaagtaatttcctcccaagtttgctttaaaatatccgtgaagaggactctaaaggaaatatccagaagaccacattctgaagcctggcaggaatgtttgcaaactgttgtactaatgaggagtgattaggaagcatgtcattggaatgtatactatatgctgtgttcaccaagctggagcagaacagatagatggtgaactcagggaagacagcataaaacccttcacttgtccttgcactctaaagctaatgctggagcaggcagatcctctcagcttgtagtgcagcaagaagtagaagagaatggagagaagcacattgtgtcctgaaatgcttaattttgtatggaaagcaccataatcttagataatacaggaagaacagtggtgtaatgaacacctgtggttatagtttttcatgttacacatttttcaaagaactccctatttctggcttagttcttgtgcatcaggagagaacctgacttcagtctgctagacctatgttggttgaatttctgcttgtcattgtaatttgaggtagagactgtccatgtttagattttagtggagtgaacttttactagtcaagtggaacacggtgggagctaaagccacagcatctattctgtttgatagcaaatgctggatctatattttttccctttcaaagatgaataaataggaaaactcagcattgggccaatcaatgggaaagtagagcagctttagaaaagagaacattgccctgaagaatcaaaagaataggatatctgtaaattattttctttaaataatagatgacgttttagggaatatttgctcgcctgaagataacacacaacccatagagagaaagcaaggtgaggtgatgacagaagtatggaagggagtcagctgaaatagcaaccacagtgacttccagtttgggctgcatggtggattcgatattctgaataacttttccaactgaaaaagctggataaaagacaaaacaaattttaaatgcatcattgagttggcacaaaaggaagaaatttgcaaatctcgaaaagaagtgagagcaaatgtgcagtccaaacactaaagccagctttcgctggtagggtttctgctgaactttggggtcactaagcttctgccttgagagacaaataagatggaaggataggagacaaaaacctaggtcctgcctcaggtgagaaggttaatagcaaacacctgtataaagctgggctcttgaaatctgtatcttagtataaagcaagaatgaaaaattaatcccaccacatcagagaaaacttgcctgtctcaaccttggtatgcagtggcagaggggaaacaaatctcccctaagaatttgtaaacaatatagaaaaagaggaaacgaaccaaactctttttatgaggctggtataactgtgatatgaaaaccagaaaagtactacaaggaaaattacagtgcaaatctgttcatgaatgctagtacaaaaatctcacaataccagcaaactaaaccagcaatatacacacacacacgtgcacgtatgcgtgtaaaaaacatatcatgatatcatgactgcttggtttagcgtaatattacaaaaactaattcgtttaatacatcccattaatgtatttttaaaactgtgattacaaacttattaaacacctctgatcactcccatagataatgaaaaagggttcactgaaatttaacatgaatttattgttagaaaatacttagcaaactattatacagtggaagtttactaatccaagaaaggatggcttaaaaaaaaaaaaaaagcctttgcaagcagaaatcatgttaatggagaaatgttggaagcattttttaaaaagatgtggaagaagatgttaatgccctcaatcaccagttagtattattagaagtctttcttaggttttgcagtactacagtaaataaagaacatttatttattggaaaaaggaaaagcattgttgtcaattgtgtatgtgtttgtgaagaaaacgaatctatacataaaataatagaaacaataagaatttagcaatgttgccaaacacgagattactatagaaaagttcaggctagagcagtggctcacgcctgtaatcccagctctttgggagaccgaggtgggcagatcacttgaacccaggagttcgagaccagtctggccaacatggcgaaaccccagctctactaaaaatacaaaaaattaggcagtcgtggtggtgcatgcctatagtcccaactacttgggaggctgagtcgggaggatcgcttgaactcaggaagtcaaggctgcaatgagccaagagtgcaccattgccctctagcctgggcaacaggagtgagactccatctccaaacaaaagaatgaaaagtttatttcacaccaacaaggaatacttagaaaatataatgcaaaaagaaaagataccattcgtaatagcaatggcagtcatagactacacataggaatatgtttatcaaaagatttactgaaattcacgaaaaaatcttgagagagaaatggataggaaagtcaatatcataagagtatcaattctacccaaattcatatataaattcagtgcatttccaattgaaatctccacagaattttctttgagagactgtacaggccgattctagcattgatacggaactgtaaaaagaaaaaaaatagttgggatgcttctgaagaagaatcagatctaagggggcttgccttactaggcgtcaagacttattttaaagctgtgttaattatggcagtggtatattgatgcaggaattcacaaatagactagtgaaacagggtagggtctagaaaccagctcatttttgtatgtaatcttgatttatgacagagcagtcactcatagttacagcagaagaaaaagggaccattacataaatagtggtggaacaactggttatccatagaagaaataaatgaagttggatacttactgtatatcatagttaaaatcagtcccttgaagattaaagtcttaaatataaaaaacaaaaaaaaaatttttttaattagttgagtgtggtgttatgtgatcccagccgtggtcccagctactcaggaagctgaggtgggaagatcacttgaggaggtcgaggctgcagtggcccctgattgcactactgcattccagcctgggtggtgacagagtagtgataccctgtttcaagggaaaaaataaaaaataaaaacacttactatacaattgttctgtagttggcattaaacaggaatgttttgaaagatttcttaacttgcttttatgacatcaggagaacagtggtgtgtcccatcatcgatgtgatcagtgatgatacttttgagtacatggcaggctctgatatgacctatggtgggttcaactggaagctcaattttcgctggtatcctgttccccaaagagaaatggacagaaggaaaggtgatcggactcttcctgtcaggtaattaatttgtcagacattttgcctaaagtgttattggcagaaggttgtggagctttgggaatcatatcaaatggataagtgtattttgagaaacgtgaagcattcgtataccttatggtagttaacagccatctttcacatatgtgagtgttttaaagaaggatttctcctctaataaaattagaaatttttgcttattctataaatctagtgcacatgagaaatgatgacatgcgtgttttttcattcctttatgaacattttgcaaatgcgtcagatctgtactttaattcagttattaaggataataatacttagcttaattaattgtgtcagtatgtgaagatactacctaaaactgggtccttgcattaaaatgtacaattttaaattcagacttgtaccatctggatgacagttattgactggtaaagttagaaaagcttgtgtaaaacataaaaatagctagaattgacacaaaatataaaaaaattcattaatccatttattctctgattttttttctctacttggtcatatatagatttttttttcaggatggaataaaaatcttcatgctctttttagaacatgaaattgagacctttgagctcttctgagccatcctagaatttagccccattgtaccgacctgctacttctgtattaagagttccttcagaaccaggcttcagcttttctgtttttgggcctcctgcgtctgccttcccttgaattcaagttcagttctggcaacactgaagagattttccactgactgtgtgcttttttccttagcctgagttcttagtagtagtagtgcaagggacttttcttctctttagctgttagtgcaattcactatctaaatcaggggttcctaaacatttcaaaaatgacaaaattttttgaaaatctggtgaaagctatgggtcttctctaatggagaaaaatgcacatgtacatgcagaagatttagcacacaaaaaactcaggtcaagaaaaccctgtattaaatgataattctgaattttggctgtttcttttaaatccttttctcattctttttttcttctaaaatcaaaataagtccaaaccttttttggaaacaactgtttcctctggaaaggcaatgagtacattttagggttcatcttaaaatataatcttcgtggtatctttggtccctgtaacttatttttttctcctggttggagtttactttttctccatacttgttctttataaaaatcaaatgggctgatattcatttatttaaatcttccttcatttcttaataatttctctgcttaatttcacatgttcccactccctttgcatacctgagccctattttgatgaattagactcctcttttgcagaaaatataccacacagtcaggaaggaacatattgattttattctatattttgtctcctctccttaaagatttctagtgggtattaggaaaagacctcactgtttccatccagtttatcttatgtatttatactatttgccaccctttagaacatggcatggtaactctaacctcaatctacttggttaatatagtcaactgccttgaagttgctaggatctgtggagtgggtgcacagtcagatggagaggattgtgaggaacagctttaatttaaggagtttgagatctaaactcagttaggacctgagggccaagaaagatagaaagtactcttaggactgtgacagagagggatgtctgggcagaagcatgacacagcaagtctagcagtcagcatgaccatggtgcaggtcatgtgtgaagaccaaataacacagcataaaacacagaaagcccctggggcgtatgaaagtttatgaagagtgtgagaataagtacttactcagtagttataaatagttatgaaacagcttttaaaaacaaaaactgattgattgtaaattttaaattgctaatggtatagcattattgaatttcaggacacctaccatggcaggaggccttttttcaatagacagagattactttcaggaaattggaacatatgatgctggaatggatatttggggaggagaaaacctagaaatttcctttagggtaagttcccttaaaaaaatttaatcttttatttaacttcaagtatagatgtgcattgattattcatgtatctctacataaaaaataaaaattgaatttaatacaagtttaatgtaacttcagagccttcagtccataaaaaggactgatagtaagggttcattataaactattgaagcaaataatttagttacctttgaagttcagctataaaacttacacaagattccctagttgtttttaatttttattattttcaaggaagtaatttaagctctaaaagctaatatatagtttggatatgctactttgctgctttactctcaaaaacataaatttcacatttaaacataaatttcacattttgtaatatgctttttattttagtgtgaaaattttttttatataaaacctagtcactttaccagctttatatttttcaataaaaatgcgaaagaattctaaaatgactctaaattaatttaacccagtctacatataaagtctttgcatttcatgttcactagaatcaacatatcgtttaaatggcattgcatatttttgcaaataaccaactttagacacatagcttattatagtggaaatcacactgacgtgtactgtaatctgaaccagcgagctcactttgttcccagtgaatcgctttgccttcttgtcaaagagagggttggactcaatatcaccttggagatcctatccagctctaacacttataatcctgggaaaacttgaaggtaggaacactgaatatttaacaaaatcagaactttccaaaatgttattttaattataaagagttatgagatttttaacttggtggggggaatgtattttgaaagaaacagaaggatttcattaaattaaggatgtaagcccatacttgatcatctttcttctgcccctttttttgtttttattgttctaacaaagacaacaaaacatgcttttactgtctcactgaagaacttacaatggatctagttgagattcctaggttctgtttcatgtacaagccgtgacgcaggtttggagaggggtgaacagatgagcatctggctggttactccatggtcaggttttgtttggtggttgtttttaaccatgagccacattaataaatacattatacattctgcacacacaaaacataaaatttaaacattttatgaaacagtatgtccttgttaacaagtacaggttgcaattcatcaatttgaatttatgattctcttaggtataatggcctgcagttagaaaaatactgctctagatcccatatcttttctgtatttagcctttaacctatgttttctttattttaatcttcaacttttggtttgatcagaacccaaattagagaaatgtttctcttgaggaagcactggctttgtaacctaaccatacagccggagcccatcatgtgcccctgattttgcgaaattccaactgtggaacccaatagatgtcaatacttttttaaaaactatcaatgtcatatatggtctttgctgttattttcagatttggtagtatggaggtactttggaagctttttaccagtaactacaatatgttccatttaagtttaaacaaaagccaaacccctatttaattgaaaagaaaaatactatgggaaaactaaggtgaacatttcctgattactcagctacatgttacatggtcatctctgctgttttcagatttggcagtgtggaggaactttggaaattgttacatgctcacatgttggacatgtgtttcggaaagctacaccttacacgtttccaggaggcacagggcagattatcaataaaaataacagacgacttgcagaagtgtggatggatgaattcaagaatttcttctatataatttctccaggttagcgttgttttgcattagaaatacaaggctgtacctttgttgaccctgatcctggaggagaagtaagaaggttagaagtgaagctttgagcagaggtgaacacctgcctcataaggtcattgtaaggaatgaatgaaatcacacacagtatagaaagtgcttggcagaatgcctagaataatatataattaacagtaataaattatccaggtcagtgttgctagcccaggttttgcagatgttctattttttttaaaacctaactgcaacatttagtatttattcctgtgaagtttcatcttgttaaattttcagccatttttctagcttatatgactttttcttgattcttggagttttcattcaacataacaaaaccactgtttttgcagtgggtcatgaacgttctctataagcaggccctcaatgctgtcataggaggctttcgtcaagtatcacaaggccactgagagcccaaaacgtgccacagggccttctttccggaaactttgctattcagagttttgtaggaacagttgttccatcagctataagtcggcctgacattgttactagtccatccttattttttagttactgcaagactgtcaagtggcagggtgcacagttcagtgagttgtgtgagagaagcctgactgcaaacaattgctctgtttaatatttgagcaaaatagaccttgatttttttgtttgtgccttaacatatattgaagtttactgatcccatatcacttatatttcattctcacataaatgtcatttttctctgaaaaattaaaacacattttaatgtattttccttgctttatacttttggtggattcatggtgtctccacttgtatagtcacatatcacccagctgataccactgttctgattcatctggcttattagattcaatatataaacatgtgttacctaaaacaacactaataattcagagtcaattatttctttcaacaggtgttacaaaggtagattatggagatatatcgtcaagagttggtctaagacacaaactacaatgcaaacctttttcctggtacctagagaatatatatcctgattctcaaattccacgtcactatttctcattgggagaggtaagaaatatatatatatatattctatgtggttattatgttcttacttttttattaaaaaaaaataggagttagttaaacttccaataaggaaagtaccttcatgttaacatttaacttctcttgcttccttcctccttcttaccacgtaagtctaaactatattctttttttcccattcctcctccctgaaagttgatttccactgagttgatgcgcctggagataagctgtgtactgtggggtctgtttttccctattctgtctatagtgatgtgtttcctaaacagactgcaccatctgcaattgtggatctgtaaaatctgtatatatattaaaaaaaaaaagacttctttgcaggtctttgtgaacttgtaattataagatggcttttagaaaaaaatatgaagccaagtagggaaagaaatccaacctttttgtgatagaaatcaatagaaggacaatatttccttttataagtcacagcagcaaatgatgatatgtgtagacagggccacaagcaggcctaccccaggattaaatctcaggaaaagtggcctcccactctgaagaaggttgtcacttcttcagtcctttcattcattcaacaaatatttgagtacctctagtatatgacaagtactgttttaagtactaggaatacagcaataagtaaagcagagatcctgctcttgttgatcttacagtccatgagtaagacagattatgaaaggcacacaatatgtcaggtggtggtaagggcagaagggatagagaatgactgacaagtgagcgtgggtagtagtactgttttatgtaaggaagttgaaagagtacggaagttgaaagagtcctgtcaaggtgattttgagcagagatctgaagaaagtgaatgagcaggtcatacgagtttttagggaaagagtattctgggcacagggaagaacaagtataaaggtttctaagatgacaatgtacttagcgcgttccagaaacagcagggagaccagttgtctggaatagagtgaacaaggtggagagtagtagaagataaggtcaaagacaaagtgagggtcaaatcatataaagcttttaggttatagtgagaactttgcattttgcattttattctgaatcaaatggaagctatcgaaagataccagcaaacttccactagaaaaggatcacattgtatgctatgtggagaaaaactatatggaaacaggagtagagctggtgtattgttgaagagagtaaaggattatgtctggtttctatcaagcttgagacactgactgtaaagttgccattactgagatgggaaaacctacaggaagagcagatgctcaagggaatcaacagtagtttgggacacatcaaatttgagatccaagtgaagatatgaataggtctttacatttaagaatattcactttgggggagaggttgtgatagagatgttaacttaggttgtcagcatataggatggtttttaaagccacaaaactgtatgaggtcacctgaggaggagaaaatgttaagtatgagagagaagaccgaggacaatgccagagggaatgccacagtttagaaatcatggagatgagaaggaatcagcaaaaaagattgagaaggagtaggcagtgaaataggagaacctagagagtggtgtcgccaagactaagggaaagacgtgtttcaggaaagaggaagtgatcagctgtatcgaatactgcagagaaattgaggaagatgagtacttagaattggttattgcatttggctagggacatgttatcagtagcctatctcacagtgttgagagagttccccatggatgttgttaaaaactctgttttgaagagagaatggaagaagcaacatagatgaatgtgtacaagtcttgcaaggaattttcttgtaaaagagagaagataaataggtggtagctggaggagaatatgggcttaaaggggtttttatttctttattaagataaaactgtgctgatatgagcaacccaaaagagaaaatttaaagatgcaaaagaaagagccaacttaacacccattagaatggccactatcaaaaaaacagagaatgacacatgttggcaaggatactgaaaaattggaacccttgtgcattgttggtgtgaatgtaaaatggtacaactgctatttaaaaatagtatggaggtttctcaaaaaatgctcaaaaaagagaactacgatattatccagcaattccacctcagggtatgtatccaaaggaaatgaacgcagggtctgaagagttacttttacttacatgtttataacagcactattcacaatagccaagaagtagaagcactccacgtgtccgttcattctggcccagctagcaatgcttaggcattgtccaaaattgggtcagttcaaagtaaaaaactcctccttcttggttctaaagacaagctacagagtgactgctataaatcgtgatacaacgtacaatggaatatttttcagtcttaaaaaggaaggaaattctgatacatgctacaacatggatgaaccttgaggaccttatgttaagcataatacgacagtcaccaaaagagaaatgctgtatgattctccttatataaggcagctagaatagtcaaactcatagaaacagaaagtagaatggtggttaccagggctgagggaagggcctaaagaagagttacttcatgggcatagagtttcacatttgcaagatgaaaaagttctggagatttgtttcacaacagcctgaatatacttaacactactaaactgtacacttgaaaacagtttagatggtaaattttatgttatgtgtttctgcaccagaataaaaagaaagaagggatctgttgttatgggtgtcatgtatttgggtggataggaggtgaaatctgtacacaagtagagggtgttgggtgggggtgggaagaagagaggtcatctcttatcatggggaggaaggtagaggaatgggaacaagtgcagggcagctgtaggtttggaggtggaaactggcagtttgtggtggaagtgtgaggaccttctcttctggtggcttgtttcctcagttgaacacaagattatgggctgagagtgaagaaggtgttggtgagggggaattggggaaagagaaaaggatgtaaaatagaaatgtaagataagggaaagcaagtagatcactgaaggaagccagatggtggagagttggtgaagccatctggcctggtgttttcttcagtgccagggcaggcacagacttacgcatttatcctaacagttactaaggctacttcaggattgacttgagctccctacctctgaaccttgttgtgatttaaggaatttgttttcaaacaagtgagggctacattgagtttcttgagcctttcattctcactgatgcctcattaatgggaatgtgttttcctttgctgtgacctcgtactggtcaaagaaggcccagggtgagtggtgcgccagggaaagatttctagcagtcactctgcagcttgtctttagaaccaaaaatgaggagttttttgtttttgttttgttttttttgagctgacccaattttggacaatgcctaggcattgttagctgggccagagttcgggcgtgtgacaaagaaacacttgtctgctccatggtagatgactgccaaggcaagcttgcgtcttacctgcctcttgccagctggcttctgggcaagtcgcagcgtttaccctctgtggcctgcttgttatcgccttattaacttaacagctggccttaagccttgtacgcccttaataccaggccacatcctacaggttaaaagtgtcatttctagattggaggtcattcttaagagtacccaccatagtgcagcccagggatcttatgcttctgatcacagcttcacccatgtgagccttcctttgctagcaacagtaatttagcctttcatagatctcttctcatgcttcaagggtccagggaaacctgaaatcataggatttttcagcagaaagggaaatcagaaaatgtaaatatgactagggtaatagatataatttagggcatctggcttcagctaacgctgacgttcgtagttcctgtaggacctgaacaaatgtgtttcattgtggtatctgatagttgttaactcaggagctgagtattctaaacaacaaaaagtaaacaatctagacctttactggtttagtcagttttaggggctgaccaattgcttttccaggcagatctaataatcctaacatttactgagcatgtactttatgtcaagcacaaatctgaatgcttgatgaatattaaagcacaacactataggattgtgctgttatttccacttcacagataagtaaactgagacacaaataaatggtttaaaaaacacggctaaactcacaaccatctggtttgagagcctgtgctgttaacccctaatgtccgtattctttctcaaatctaaccagtatttcccttgcagcagagagtagaaaagtgaatccagattcactaatgctagattataaaaatggtttaacaaagctcttacattgtccaccctaatggagatactgattctggaggagactaatagtagaaacaaagaaacttaagctctaacctcttgcctggttttccaagaatgggtgcattcacaattattttcaattcctaatgtcaaaaatagtagttttaaagtggcagtcaggtacagctaagttgctacttccaaaggggggttgaagagttgctgggtctgtggataaaggaaagaaaaccaacggttactgtgtgcctgctatgtatctgtccctgctagagcctctgtatgtattatctcatttagagcacttaacaaacctgagagagagagagatttatccctgctttaccaatgagaaagggttcttatagcagtgtttttaattctgtgttgtaaataatattgatatctgatgtccccaaggtgctcaattagaaaggcgaagtgctggggagaaggaggtagattttgaggtcaaatatgtttgggcaatactattttacatcttacatccatctgtaccaccattccccggtcctaccaatagtcatgatatattaaaaggctttgagaagtccttcaacaaagaaacctatttaaatttatttaactagtatttcccaaacatatctgatcataaaacaccttttttattggggcaccttgcaagatgctgttcttcagattgtggtttttggaatcacagtcttagagtaaataacctgcccaaggtctcatggctagtcaggaatgaagcaccatctgcatgtccccacaatctaaactctcacccctacagacactttgaaagtgtggatattcacacactgtaagtcagacactgctgtgattcaagtagaaaagtttgtttctaacagctcctcaccctttatgatactctcagtttgtacatcgtttctagattgttttggcttgattcagtggcgtgcctggccacgtaaggaaagatgagttaatcagccataaacaattcctatgaagaggaccattaacccactgatctttccccttgaaataacttagatctcctaggatttacactgtttcagaaagtacaaaccaaacttgggcactttccacgtgactttcatagggtggccaatggtgtgagaacttgggtttattagcatgttgtgcaacttttcccatcgttggcaagtagctcctcacaaatggtggaagattttctcctatgtgtcagcatctagacctgcacatctgacgtgtcggctacactgaatttaattaaaattaggccacgcctggtgactcacacctgtaatggcagcactttgggaagccgaggtgggtggatcacttgagatcaggagttcgagaccagcctggccaacatgccgaaaccccatctctactaaaaatatgaaaaattagctgagtgtggtggcccgcatctgtagtcccagctactcgggaggctgaggcgcgagaattgcttgaaccttgggggtagaggttgcagtgagccaagattgtgccactgcattccagcctgggtgacagagcaagagactgtctgaaaatataaaataaaataaaataaatgaaaataaatgtaattaaaagtaaatagaatttaaagcctggttcttcagtcacaatagccacatttgaagtgctcaatagccacacatgactagtggctgctaccatattagcacaaatatagacatttccatcatctcagaaagttctactggatggtgctggagacattaacaactgctgttttaaaacagccaacacggccaggcgccggtggctcacgcctgtaatcccagcactttgggaggccgaggtgggtggatcatgacgtcaggatttcaagaccagcctggccaagatggtgaaatcctgtctctacaaaaaaaaataaaaaataaattagccgggcatggtggcaggcgcctgtaatcccagctacttgggaggctgaggcagagaattgcttgaacccgggaggcagaggttgcagtgagccgatgtcgcaccattgcactgcagcctgggcgacagagtgagactctgtctcaaaaataaaataaataaaataaaataagccaacacaggaggttacccatctgtctctgtatcatgtactgctaccctgtcatttcactcatttctccttcccaggtcctaagttgaagtggtcatatttgccttgtcaaatctattgttttcaaatcttataactaatgtatgccccctctaattctctctactctgaaataatttggaattatcataacataattcatagggatgtatcatatcaaattcccaagccatcctgtcagtagataccttcctacttggttaaggagaatatcaggaccatattgatattcaggagtatctacttcaaccaagaaaagctcccttcttttcccatatcaaatctgccttttatttaagggttcctgataatttagaatctcagttgctgttagatgtcctgatgactactgaatatgttaccaaacaaggctcacttcttgcttttctctttccaggatagtcaagaggtgacttgaaaggagtgaactaaaggaattggtagtgtaataagaccactgagcagttagctgtagactgtgtgtacaccaagaaatgggataaaatcctctgaagagtgggagactccagaaagaatctagcccatttgttccttaaacttcaaaataccccttatcagaaggttctcactctttttagaagtccaacaaataagacatttgcctagaacatccttaagagctagtcctcaattcttgaatgtattttctcttccttctatattttccaaattctgctgttttaaaattttttcaaatgtcagattttgaataaccaacccaaatacctattttcatcccagtataaacttgaaacaagtatgtgttgtcaccctttctaccctccacatctcattagaaagctggtaattggttatatagtcttaaagctatatggaattacaattttgaacatttgattcagcatccctagaaaatgtttgttcctcattttccctttctccaaaggctcttcaaacttaactcccggcaaacaaacctattaggtggtcctctccctcctagaatcctagaggacaaaacttaccccatagtcaacctaattttccatgtccttgaggaaaacatcttacacaccccatagatgaggtagtccacatgtatcactacacagaaaagaatgttctctgaaaactctatattctctagccaggcggtatatagagggacccacctggagagcagatgtcccttcagctacaaagaagccacatatttgttgagccaaacagaatcctctgtcctctaatgtgaaattcacttagggactctaacatcatagctgtgctctttcagaagtgtaatctccagtttctcccctttacatcagaggagtgcctccaggcgccaccaggagcctgaatctgggtctctgaccatgccacccacctcacctgggcctcactgaccatatgttgttgatgcagtttagttactcctcactctaacagctaatgggaagcagtggtttccagtccttggagaaactccactttcaacatctaatggtcagtagtaaccccaaaggatagaggcccagatctcgcatgtcaggaattagttataggaatcttgtaaggatggtataagctgttatgtacaaatctcttacaaaatagaggcagggtctcatcatgttggccaggtaggtcccaaactcttgagctcaagggatcctcctgcctcggcctcccaaagtgctaggattctacatgcatgagccaccacgccccgccaagaattgcattttttgttttgaattttggtaaaagataggcaattatttaagcaaatggccattccatatgagagcgagagaagctgaagataacactggtgttaatctaataattcctgtggcatttatcatctttctttagccacctttatttacatctgcatttgggggaagaaatagaggaaaacaggattggagagtttataatttatatcaaaagtataaggaaataattattttttgtgaatatatgagataaatactcatctttatcacaatatgaacttttttttttttctttaagagacagggccttgctctgtcacttaagttgaagtgcagtggcacaattatagcttactgcagccttgaactcttgggctcaagtgatcctcccacctcagcctcccgaataactgggactacaggcgtgagccaccatgcctaagatttgtatttttattttttgtagagacaaggtcttgctatgttgcaagtcttgaactcctaggctcaggcgatcctactgtcttggcctcttaaagtgctcgggttatagacatgggtcactgtgattggcccaatctgagcgaaattctttttcaagtgagatagccatcatcgtctggtattaattgatcacctaccaggatgaaggaaggtgtgctttatgcaaattggtattttaccataaaatcttttatacaacctaacacaacctatttatgagggaataggtttcacaattaatggataaaaaatgatgatgtaaattatgtggtaaaagaactcttggaaacatataatgtattggaccctgagaaaaaaacattttgaaatttctagcttgaataattggacaagttgtgggaatagtaataaaaatagggatatcaggaaaacgggaaattttggagaaatgataatgaggtttgttttaggtagcacttctcaagaggggatggggtggggacgtattaaaatgtgaagatgattaagtgttcatattagaaaattgagaaattctgttttgaacgaaccgagtttgagattttggtggaatagcaagatggatgtgactagtgataaagtgacagtgcagattattactgtctctgagcctgttcatgctggactctgaattaggtgcctggatacattgtcttacatagcatcagcacagaactgacattagcatagaactgacattacccccccagttcctgatctcaaaaggtttaggtaacttgtatttaaacctgagtcttctatgtcagaaccctggtttttattcctggctgcttgggaatattggaataatatgcagactgtatatgtgtttatagaagtaactggcttttttgtggttttaactttacccctactttatctatcacacaaaattagttaccttttttaaaaagtctacatgacatgacagatgtagtttctcttctggcttaacctgctgacagtaccgtacataggaatagatttaagactttcaaacatctgttaatttaccatatgcttttaaaactgcaacagtttagaggaaacaaaatatcaaggggcattacctaaaatattcctcctaattctgatgactgacttaaattccttttatgtaatccacaaatgtctagtgaaagagtagagtttgtaccacactatgcttaagcttccaggtaagacaagttccaagctctttgactagagtcatcttagtctctcctaagtcatcagagtagttatcagaattaatgttcttgtcttgattgataatagtgtcatcagggagttaattttttaaatcattaaccaaagtagagtttgttgaactcaatacaaatttgaaaggaataacttgaaaaaaatgaaaaaagaaattgtaaggattttcccccataaacacagaaaattacataaacagttgtaagacctttctagaccaatgaattttagatactcagacagcgataggccaataggccatttcagagtagggccagggaaagtttaggttgatatttagtgtatatgtgtgtgtatctgtctgtctaattaacttctccaactcctgatattttcattatttattgtcccatagatacgaaatgtggaaacgaatcagtgtctagataacatggctagaaaagagaatgaaaaagttggaatttttaattgccatggtatggggggtaatcaggtgagtatcttagaaaactcttaaaagggataattttcagattgtttttactttgccttttttttataccatgacatcattcaggaaatattttccttcctttaaagagaaaataataaagacttttaggtgaaggaagctttcaatccagtgatttttttttttaatgaaacatttgtgaaaggcccattgtgagaactatgtttacattgctgagcacaaaatttattttgccctttttattcaaacagatgacaacccttgacaatacattcagtgtatacagagagctcaaggtcatttttgcttcagcttgtaagcaagaaaatgagtaacataacatcaatgtaaattagtggtagcttttctgagtcactttattcttcattactttaataaagtacataaatcatgtaccttgaaatacttgtattttccctgacagctaattgggcatttaaaatgctgactaatttattttttctgtttatgtgtgtgcatttttatttccaggttttctcttatactgccaacaaagaaattagaacagatgacctttgcttggatgtttccaaacttaatggcccagttacaatgctcaaatgccaccacctaaaaggcaaccaactctgggagtatgacccagtggtaagttatgcagttgcctatagtaataaaattatgtgtgtcactgggtatatttatatactttatatctaaaggaatgagttcttgtggaccttgaatatggatcaaacttgtcttatacactaaatattgacaggcgggaaaaataagtaaaataaatgtgttttaatctccctaataattaaattttagtcttataaaatcacagttgcctccaatccctgggtccttgtttactgagtagccactgttccttctgtatgtcttcaagttctatagtctagtttgggagaaatgaggcagaaagtaggcttttaaaattacttaattaaacacttcagtgaaagataagttttaattaataaagttctctggcttgtgatgatttcccagtgacatatatgacagaacctttcctatttatctttccttttgtctggaacctttctctccaccaccatcaaatgggctcacatggaagtacttaaaaggtattagttcaattaaagcatccgtggtaaacctctttccacctatttgcctaatttttcaacttgtgcttttgccaggttctggaaccagcaccaacatcttcaatatttctttctctggttctttttaatttggcttaacttctgtaaggcatttagtgccactaaacagatgacttttttttttttttttgaggcagggtcttgctctgtcacccaggctagagtgcagtggtacagtcacagctcacacaacctccacctcccaggctcaagctatcctcccacctcagcctctagaggagctgggaccacaggcacacgccatcatgcctggctaatttttgtaattttgtggagacagagtttcaccatgttgtccaggctggtcttgagcacttaggctcaagcgatccacccgcctcagtctctcaaagtgctgggattacaggcatgagccatcatatctggcctgatattttctaatttatttttttttattttttattttatttatttatttttttgagatggagtctcgctcttatcgcccaggctggagtgcagtggtgcaatctcggctcatgcaacctccacctccctggttcaagctattctcctgcctcagcctcctgagtagctgggattacaggtgcccgccaccatgcccggctaatttttgtacttttagtagagacagggtttctccatgttggccaggctggtcttgaactcctgacctcaggtgatctgcccacctcggcctcccaaagtgctgggattacaggcatgagccactgcacccagcctggcctgatattttcatatcctcttatgccttggccataagatgcactactgtttaggttcttctcttagtttgctctctgttccttttgttggcctggctctctctccttcttcgtcctactccttaaatggaaatgttgtcccaagttactgactttggccatctttcctccctttactgtgtcatacaccaaccatggtctactttaatcatcaatatgctgttctctgaacataccttatactttcctagttcacatctaagataatatgcttccctctgcctgacacaccttacccattcttaagaacccagctttgacatcacttccatgaatcctaacctgaaattaactctgtcaatcttaattacagtcatctctgacctctataaagctgtacttgtttgtagttatttatctagcaatcttttctccactattagattgttagatcctagaggacagagatcatcttttataaatcctgggtctcctttcacaatgtcaggctatagaaaaaatgatattacctataataatagctcagttaatatggccattggaaatggcctgaatgctctgttctagggtttcccatggtatgtgccactgccattttgggtgtgactgccccatgcattgcagggtatgtagcatctctggctccagatagtaagtgctagtggcaccccatagccattgtgacaaccacaaaattttaaaaatgaaaaacctcttaagtttattggaaaatgacagtatattaattaggcagtatttttagaaacctatttattatagctaaaacaaatagggatttatttttcttacataagtctagaggtaagtaaattcagtggcatagtgatgtcagggataacgttgttgtaatattcttagcttttccttgtggccacaaggtggttgctgcagctttatcgcatcccaactccaggcagaaagaaaagggaaagaggaatggtacactaccacatgtgttgctctttattagcaaagtaaaaggtttttctggaacccccttagcaggctctgcttatgtcttatggaccagaacatcccatggtgacccccagctgcaaaggaagctgggaaagcaagtctttggttttctagtcgttagagtgtgagatggccaagagatagagggattgggaaagactgttggctagccaacctacacagtctaccacaacagtattccaaaagtaaatgtttgatgaaacaggtaagaagctggagataagagtatttagaaagagccggccgggcgcggtggctcaagcctgtaatcccagcactttgggaggccgaggtgggcggatgacgaggtcaggagatcgagaccacagtgaaacctcgtctctactaaaaatacaaaaaatacaccatacaggcatggtggcaggcacctgtagtcccagatactcaggaggctgaggcaggagaatggcgtgaacccaggaggcggagtttgcagtgagccgataccgcgccactgcactccagcctgggcgacagagtgagactccatctcaaaaaataaaattaaattttaaaaaaaagagccagttatgagtgtgaagttttaaaacttctagatcgctttgcaaggttttttcctgctgagataaaacattaatgctggggattgatttctcccagaagcagactcgaagataaagttgagcattcaggatgtttgttagggagcactttctgggccaatatctgtaaaaggaatacctccctctccctgggcagagggagaagttgagttgcaatgcaggtccaacagcctgagcagactacagggaaagcactggaggggaacagcccatcagaatcgtcctgcctccatccattgaaaacttaacagtctagaaaaataacagaatacttatgtccattatctgtaatctaaaatcatgaattcttagatttcaaagcaaccctagaaattaaacccaggatactttttatacaagtagaaattgaaactcagaattaatttcccaaggaaattaattgcccaaggtctctgagcagccagatagtatgactagatctcaaatctggaattctagattctcgatccaggtttctttgcacagtaccacgctatttttgattaatagttttgagtcttgcttgtattacatattacataaaatttacaataaggcactgggctcttttgctttgactacttgtatctgtcctttctggaataaaatgcagattttagacctagttacatctagaaattaggagtaggagcttggcaaattattttttctaggatgcaggtagactttactaaatgattaattatagcttttatcctctccttcaaaggttacggttagatgcttgtcacttgcttgtcctgatgccttagtccagctctctctgaatggagactagttggtgttgcctgagtcctctgaggagtgctgtgatgacagcatcctacccacaaggttccaagccacaaggctctgtgcctgctgtcagcagccagagttgtatctggaacagggttctccaccagagtctaggcttcctgggggtgctgctcaccttccaagttatggggattctgtcctgatgtcgaatagttaaatactcagcacagagcaataacctatgtgtttgtgatgggtttattttaatgaatctagatgagtgaaatgcacatttttagaaactaggttaagagagaccaactctcccaactaaattttttgttgtgcctagttgggggttttttgtttttagtaatagtgaccatgggcctgatgagggaggccactgggataagctttgcgggaactcccggaatgtttgagaggttctcttgttctggtctttcctgagactgaagccactggcagcaatgtgcacgctgagccgcagcgctctggctgctggattgtgtccatgactgctcaggacgttgccaggatgttgtgttttccaataataagcattactctataaatgcaaattaccattgtatgtaaatgtcattgtaccatttatcaagcatttactctgggataggcagcactttatgtacattatctcagtgtttcctcataaaaacccggtgaggtatttttgtccccattttatagatgaggaaactgggtctcaaagagtttaggtttttgctcagaagcatatagttggtgtgtgacaaatctggaaatcaccccaggaatgtctgactgcaaagcccctcctctcaataaactacacaaagtctgcattaaaaaaagaaaaaaaaattcccacagccatgctgactctcttctaggttctagtcttatatttggaagcattaaagatagaatcctgaacctaaagacagtatcagtagtgacatctgcaaagatagactgtcatctgccaggtcctactttgaccacaacacggaagaataataaatgactggaagcctaagtagttgtatacaattattagattttgttttaagttctaataggtgcaaaaaaggcctcatgaaaatgaaatgtttcagataaaagaactacattaaaatagagccatgagtaaaagaatcagataactatgtgttaaacattttacatttccttcgagttaatttacatttgtagagtaatgcttaatgcacattcctgtatacaactactttgaagtccttaacatgaccagagcatattatcacaatcattggtgtggatcattgttaactatctatctgttaattcttacctgccctgccctttcaaaattatcctaataacatgttgctgcatcaaatctagaacttaaataagtggataaaatatatagctatgtctgttaaccatttattaagaatctcttttgtaggtgaggcactatgtactttatcttcattatctatgtagtttcccaaaatctgctcaaaatatgtaatgtgatcctaatttttaaaatgagaaacctcaagttacccaggctgtgaactcaactccacattcctgtgcttttctttctgtaccacaccatctcctttaaccaccaggatagcctctgggtttgctatggacataggcataagattgattttactaaatatcagctgtcccaacattcttatgattttgagttatcagaaagacctgagtttctaaaaacttgagctttggaatcacagaattaacttgaacagccttatcatagagaaatgaaacaattttgaaatagctgtttgaaaataggttgaggatcctaaattaggaaccactaatctggtctttttttgttgtttaggaaactgaagcacaaaaaagagaagcttctcatagtgttacagagcttatgccagaattaggacttagaatttaggtcatcttgcagcaagtcaagtgtaccctactggaccccagtgcctttctccctccctcatacctctttatcgacctacatatctacctacttctctctctctctctctctctctctgtttctccatccatccacctacctaccttttctccgttgtcttttaaataatgtatattaccaaaaaaaacaccttttctgcagaggaacttaatcaccaaaactgatgcttgaggtgttttgttttcttccactctcatgttaagattttttctatttcagaaattaaccctgcagcatgtgaacagtaatcagtgcctggataaagccacagaagaggatagccaggtgcccagcattagagactgcaatggaagtcggtcccagcagtggcttcttcgaaacgtcaccctgccagaaatattctgagaccaaatttacaaaaaaacgaaaaaaataaggattgactgggctacctcagcatacatttctgccacattcttaagtagcaaaaaaggaaaagtgctttcctcctctgcaggatgtaaggtttatcagccattaaaacttagacttctctagcttttcactagctgtgaaccagccttcctgtccatggacgtgaaactgcatagtaatgagactgtgcacactgatgtttacaagattgaaagagtctttctccgaaaatcatggtaaagaatactgagacaatgaaaaaaaatcaacaaaatatgctttctggagaactgtaccttttatggtttgcttgcacatcagtagtttctgctgaacgtgctgtcataatgaagagatttccaagattttttttcctgattagaactggtagccagtatattaaatattgatataaaaataaaagaactggaaccagattcagaatcatgaaaacaacatttttacaacaacaaaaaaactatattaaacagggtttaaaggaaattaaaacagaactatgagaagtacaatttgttatagtatagtatcaaatttctatatagattttatacctcagtggggaaaaataactgattccaatgacattcattttgttttcatctgtgatagtcatggatgcttttattttccttggggtgctgaaattgagctgaaaaaaaaaggctctttgaatatagttttaatttctctctacagttttttttgtttggtttgtgggctgttggaattgtaatttttaattgccttctaaaaaatggaaatttaacaatgtctgatctcagctgaacaaattagatgtttcagttgctcttgggtcaactggcttacagatttacatgtgcacacacacacaaatttcttatcacattttcgacttcttcacttgacctaactgattatgcgaaatacccaagattcatgctactgtaccacagatttgttttcacagcaataaatcttcagttctttgtttatgattccacttaacaaaaggcctgcagaagtgatttattatttgggtatttggagataatacatttgatggttttttggaaaacctttttcactccatactcagatatgcttcattgtcaaatgcatatttagattagattattgaattgtaatgtttatctgctgctttttttaaataaaatttgactgaaaatgtttaattggcattttttaatgacttagccaaagaagtgcagctattattccatattaataggcttgcatttcttttcctaaatcttatttaggctaaatcagttttatttttctctgattttttttaataccacagaatcacctgagtgtcaattgaaagttgtcaattaaaaggtaaccttttaatctcgtaggaggaatctcattaagacatttttcctgatatgtagagcagtctgttggcaaaaatgcatatattttctttcatatttgtaaaattatatttaatggaattcttttctttgattatcaaggactttcactgcaggcagtgctatttcttgtgcctaagaatgtttccaaaagtcgcatcgctaatgatatttgccaagttgagtgtacacaaagtttctcatatcctgttcaagttaatcaacatcaagcacatggggatgctttagggtgagtctatagtacaaaatgcataaaccatgtccccaggaaatttgaaaggaagcaggtgctgaatggaatttttttccttttccatgagctgtgttaattctatctccagtaggcctaatgcttgaataagcaagatgtctaatcaataaattattttcatgctcagaatttcaggtttttgtactccagcatagcttggtcttatttcttactgtatgaaagcttaacagcaatgtgatttaaggttttgttttaaatgggagatgtaagtgatttaattcatgggtacttttagaacctgatagataatcccattgcctttatttttctaattaaagaattcctaaatactttgaaaatacaaaatattcctg

SEQ ID NO: 35962 - DNA, 486468 bp, Homo sapiens
ccgtcgccgccacctccgccgccgcttcgacccctgccgccattttctccgcgtctgggctttgtgtgagcgaacgggctgcaccgcgctgcgcctgcgcgcccacgtgacccgacgcaaccagtaacacctgcgcccgccgctcccggctgcctccttggccccactcgccccgggccacgcccccgccgcgcgcaggcgcagaccggcagctgttgatcgcttctctctcgagatacactcgcgttaggcaccgactggctgttcccggcgcgcgtcctctgagtccgatagaggaggcatctccccaccccaccccacacaaacacctagacctagtcactctcagctttctgtaaccagagctggagcagaggggaagcaatgatcctgtctagagattcctggaagttttagatgaagcttgttcaacccgcggtccggcacacgattcgtaaactttcttaaaacattgtgtctttttgtgtgatttttttctttttgtaacgcaattgcgcggttctccagcgcgaactttgtaggcaacaacggaacggcatggaataatatcagagtattatccgtaattcgcattataattgcaaacagttcgtccagaagaaacggaaaactgttaaaattcactaataatggggccaggcgcgatggctcactcctgtaatcccagcactttgggtatgggaggccgaggcggcggatcacctgaggtcaggagttcgagaccagactggccaacatggtgaaaccgcgtctctactaaaaataaaaaaattagctggacgtggtggcgggcgcctgtaatcccagctactcgggaggctgaagcaggagaatcgcttgaacccaggagccggaggttgcagtgagccgagatcacgccactgcaccgcagcctgggagatagactgagactccatctcaaaaaacaaaaagataagtattgagtactgggcttaatacctgggtgatgaaataatctgtacaacaaacctccatgacaagtgtttacctatttaacaaaccttcacatttacccccaaacctaaaagttaaaaacaaaattaaaaaaaaaattaatggctgggcgcggcagctcacgcctgtaatcctaccactttgagaggccaaggcgggtggatcacgaggtcaagagatcagaccatcctggccaacatgatgaaaccctgtctctactaaaaatacaaaaattagccgggtgtggtggcaggcgcccataatcccagctactggggagcctgaggcaggagaatcgcttcaacccaggaggaggaggttgcagtgagccaagatcgggccactgcactccagcctggtcacagagtgagaccccatctcaaaaaaattaaaaataataataaagagcgagaggactcttgcaatgttgcataaagtgaactgtgacagaattcagggtgtattctgtactaggcataatgctgtatggtcttatttttgtgtgcattcgtggcatcagttttatggtgctgtgcagcctccaatgtgccattttccaagtgcagacagtcgaattggcaccatcagatgttacgtgtgcttgtggcaacttgggcagtaagatgcagcgattatctttttgagacggagtttcgctcttgttgcccagactggagtgcaatggcgccatctcggctcgctgcaacctccgcctcctgggttcaagcgattctcctgtctcagcctcccgagtagctgggattacaggtgcatgccaccacgcccggctaacttttgtatttttagtagagacaaggtttcatcatattggtcaggctggtctcgaactcctgacctcgtgatccgcctgcctcaggctcccaaagtgctgcgattgtaggcgtaaaccactgcgcctggccttcaatgcagcgattatcaataatatatttttttctttttttggagacagtcttgctctgtcacagaggctggagtgcagtggcaccatctcagctcactgcaacctccgcctcctgatttcaagcgattcttctgcatcagctttccaagtatctgggattacaggtgcacaccacgacgcctggctaagttttgtattttttagtagagatggggttttgccatgctggccaaactagtctcaaactcctgacctcaggtgatctgcccacctcagcctcccaaagtgctgggattacaggtgtgagtcaccgtgcccagcctatcaataatatttcaatctacctttgtaaatgatagctcactgcaaccttgaactcctgaactcaagcgatcctcccctgcttagcctgtcaagtagctgggactgtaggtgcacgccgctgcacttggctaattttttatttttattttttggtacagatagggtcttgccgtttttcccaggatggtctcgaactcctgagctcaagggatcctacagccttggcctcccacagtgctgggattataagcgtgagccactgtgctggtccttagaggattattaaagacaggttaacaccaaactaaaactcttctctatgaaagtattagaatagatttgcaaagaaaacacttttccttctctctctctctgtttctttctctttttgtagagacagggtcttgctatgttggccaggctggtctctaactcccagccttcaagcaatcctcctgccttggcctcctaaagtgctgggatttcaggcatgagtcaccccatctcgtctctctcttcctcatggcatgtcctgaggcatctgtacatcaactcctggggcaccacaggccaaagttggcctgaggaaagatgggtgtcaggctgtgtagggagttcagctgcaggagcaaggaaggcccccccaaggggcaggagagctcatgcgcactggtgtgatgctccgtttttgcagaccactggtgcgtcagtcaccccatgcctaggaggccctgcccatctctccagccacctgcccctcaatcacactgctccagccctggggttcctccctgctgctcttcctacaggctaagcagtttccagcctctgggcctttgtgcttagctgtttcctccactcccatggccacacaggcttctccttgcccttccagtccaggcagaaagtttttcttcctttgtgagtgagctacataccaggcagggattcatatggaaaacagaccttgagcaatcagctcctccactctgaggctcagtttgcttaactgaaaatatggataataagaaatgcaatgcaccaggctgggcacggtggctcacgcctgtaatcctagcagtttgagaggccgagtcaggtggatcatttgaggtcaggagttcaataccagcctggccaatatggcgaaaccccatctgtactaaaaatacagaaattagccaggcatgatggttggcgcctgtagtcccagctactcaggaggctgagacaggataattgcttgaactcgggaggtggaggttgcagtgagcagagatagtgccactgcgctctagcctgggcaacagggcgagactccgtcgaaagaaagaaagaaaagaaagagagagagagagagagagaaagaaagaaaggcaccagaactcacctttcagggttgccctgagctttaaaagcagacagatgccaagagcctttaaatataaaagaatcggcaggcagaaagcgctgaagaagtaggtgttgttattagattaactgcattctgggccaggctcggtggctcacgcctgtaatcccagcactttagggggccgaggtaggtgaatcacctgaggtcaggagttcgagaccagcctggtcaacatgacaagacttcatctctactaaaaatacaaaacttagctgcctgtggtcccagctacttgggaggctgaggcaagagagaatcacttgaacccgggaggcagaggttgcagtaagccaagatcaccaagatcacgccactgctctccaacctgggtgatggagtaagactctgtttcaaaaaaaaaaaaaaaaaaaaaaaaaaacacgtattctgcatctttcctgagtcttcctccaaaaggagtcctggtgtcaccccggctccacttcctacagctctgagaccttagattaaggcttccctgccctgggcctcagtcttctcacctgtaaaatgtaggtaataaccacttcttccctaacaagtgacagtcaaaggagggagagactcggaactatgcctaatctatagtcaccctaagtcagcgtggatattgtcaccatttttaaaaaattgtttgtttgctttagagacagggtcttgccctgttgcctagaatagacaacagaagtataattatagctcactgcagcctggaactcctggattcaagggatcctcccacctcagcctcctgagtaactgtgaccacaggtgcatgccaccatgcccagctaatatatatatatttatatatttatttatttagtaaagacagggtctcactatgttgccaaggctggtctcaaactcctaggctcaactgatcctcctgccgaagcctcccaaaatgctgggattacaggcatcagccaccaggcctggcccatgctggactctctacacttaactaaaaactaacagtggctaggcgcagtggtgcatgcctgttgtcccagctgccagggaggctgagacaggattgcctgagcccaggaggtcgaggctggagtgagctgtgtgattgtgcctctgcactccaatctgggtgacagagcaagaccccatctcaaaaaaagaaaaacagaggccagcatggtctgtggactggcagatgcaaagtaagaggaaattgttcttatgtctattttatttttctattttttattttttgagacagagtttcacgatgtcacccagtctgaaatgcagtggtgcaactgatctcagctaactgcaacctctgtctcccaggttcaagccattctcctgcctcagcctcccgagtagctgggattacaggtgtgcgtctccacgcccagctaatttttgtatttttagtagagatggggtttcaccatgttggccaggctggtctcgaactcctgacctcaggtgatccacccatctcggcctctcaaagtgtgattacaggcatgagccaccatgcccagcccgtatgtatattttaaaaatcatttttataaccctgctacctgatttttacttgaagactgagcctttgcttcttcccatgggcttcagaacagatccctcaaaacaagccagtggtttttattgttttttattttattttattttttttgagacagagtctcgctgtctcacccaggctagagtgcaatggtgcgatcttggctcacggcaacccctgcctcccgggttcaagcgattctcctgcctcagcctcccgagtagctgggactacaggtatctgccaccacgcctggctcatgttgtatttttagtagagacgagatttaaccatattggctaggctggtctcgaactcctgaccttgtgatccgcccacctcagcctcccaaagtgctggaattccatgcatgagccactgtgcctggccaaccagtgttttttgttgttgttttgttttgttttgttttggagatggagtctctctctgtcgccaggttggagtgcagtgacgccatctcagctcactgcaacctccacctcccaggtgcaagcgattctcctgcatcagcttcctgtgtagcacctgggattaccggcgcgcaccaccatgcccaagtaatttttatatttttagtagagacagggtttcaccatgttagccaggatggtctcgatctcttgaccttgtgatccacccacctcagcctcccaaagtgctgggattacaggagtgagtcactacacctggctggccgccagtgttatttttttacctccatgtggtccctccctgggaggcctcctttgagaaacataactgacaagtccattttgtccagccagggctccttttattcattcaggggtgggtttttgaaacgcagtgcaacttttatataaagtcgagggtgccaggaaagtgggcctgccgggtgcagagaagcgcaagaagcttgctggaatgttccagctttaagggcgcccttgatacaccggccacagctgctggcccagaaggtgccatgtggacctcagaatgagatcagggtgcctgctccgtccagagctcaggaccatgtccacctgtcctccatatgcaaaaaaaaaaaaaaaaaaaccctgaaaatatcttcacacaggatcacagactaggctctgcatggtgtctcttggcctaagaagcgttcaggccgtgcgggaactgttgaagtggaagtgttgaagtggaagtccttccacaggacagggtatcaccagctacctctggcctctctgctgcagggtccggagagcccagcattcatactggtgtctcctctgccaccttcttcaggagtccagctgccagtggagaatgctgggggccctcggggctgtccgcctcccggatcttcaggcgaactttctggttggtctttctccactcggagtacagctggcagtggtagcggaaggagacctgtggggcagccctgcagtgagcggaggcctccacccgcaagggaggaaaacaagtcgccgtggtggcacctgcgttggcccaaaccatggctggggctcatgcttccagaagcagagctggcttatgaacattcctcccacaaagtgcacacacacagacccattcacactcctggtgacacccaccagcttccagagtcctgcaaagacaagatacaccccacacacaccagcaggaagcaaacgggagctcctttcctgcctctcagtgggaaaggagtgaaacagcctcttggaaggcattaaatgtcaatcaatcaggccgggcgaggtggctcacacctgtaatcccagtagtttgggagcccgggcacgggggaagatcacttgagctcaggagttcaagatcagcctgggcaacatggagaaaccctgtctctactaaaaaccccgtctctactaaaaatacaaaaattagcctggcgtggtggcacggacctgtagtcccagctacttgggaggctgaggcaggagaatcgcctgagcctgggagatatgggccgcagtgagccgaaatcacgccactgcactccagcctgggcgacagagtgagaccctgtctcaaaaaaatttttttaatgtaaatcagtcacataattgccaaaacgtgcaaccagaacgtgcaaacaaaaaaaaaaagtttaaaaaaaaaaaagtcactcaataggtgaatgaggccaggcgtggtggctcacgcctgtaatcccagcactttgggaggccaaggcaggtggatcatgaggtcaggagatcgagaccatcctggctaacacggtgaaacgccatctctactgaaaatacaaaaaattagccggccgtggtggtgggcgcctgtaatcccagctactcgggacgctgaggcaggagaatggtgtgaacctgggaggcagagcttgcagtgagccgagatcgcaccacggcactccagcctgggcgacagagcgagactccgtctcaaaaaaaaaaaaaaaaaaaataggtgaatgaataaataaacagtggtgcttccagataatgagatcttattcagtgctaaaaagaaacgaagctgggtaaggtggctcatgcctgtaatcccagcactttaggaggtcgaggcgtggggaccacttgagctcaggagtcgaaggccagcctaggcaacatagcgagaccttgtctctaccaaatatttaaaaattagccaggtgtggtggcccaggcctgtggtcccagctacttaggaggctggggtaggagaatcatttgagccctggaggttgacgctgcagcaagctgtgctcacgccactgcaatccaacagagtgagatcctgtctcaaaaaaaaaaaaaaaaatgctgggcgcagtggctcaaacctgtaatcccagcactttgggaggccaaggtgggtggatcacctgaggtccagagtttgagaccagcctgaccaacatggagaaatcccatctctattaaaaatacaaaattagccaggcatggtggcgggtgcctgtaattccagctactcaggaggctgaggcaagagaatcgcttgaacctgtgggggaggggtgcggaggctgcggtaagccgagatcgctccacttcactccagcctgggtgaaagagcgagactctgcctcaaaaaaaaaaaaaaaaaaaaaaagaaagcccttaagccacgaaaataaccttaaatgcttatcaccaaatgaaataaaccaacctgaagatgctgcatactgaatgactccaactataggacattctggaaaaggctaaaccatggagacagtaaaaagatcagcagtggatagggcttggggaaaaggagggtggcatgaatagagagagcacagaggacttttagggcaacgaaactactctgtctgatattataatggtgaatatggctgggtgcagtggctcacacctgtaatcctagccctttgggaggccaaggtgggcagatcacgaggtcaagagatcgagaccatcctggccaacatggtgaaaccccatctccaataagaatacaaaaattagctgggcgtggtggcacaggcctgtagtcccagctactcgggaggctgaggcaggagaatcgcttgaacccaggaggcggaagttgcagtgagccaagatcgcaccactgcactccagcctggcacacagtgagactctgtcccccccaaaaaaaaaaatagtgaatacatgtcattatacattcatcaaaacttataaatgtccaacagcaagagtcaactcctagcctgggcaacatggcaaaacccggtctccaccaaaaaaatacaaaaattagccaggcgtggtgcacacatctgtaatactagctactcaggaagctgaggtgggaggatcaattgagcctgggaggttgaggctgcagtgagccatgatcacgccacactgcactgcagcctgggtgacaaagaacaatcctatcccctccccgccacacacacacacacacacacacacacacacacacacaggccaggtgcagtggctcacacctataatcccagcactctgggaagccaaggtttgagcccaggagtttaagaccagatacaacaacatagcaaaacactgtctctacaaaaaatacaaaaactagccaggtgtggtagtgggcacctatggtcctagttacttgggagggccgaggtgggaggatcgcttgagcccaggaggtagaggttgcagtgagcggagatcacaccactgcactccagtctgagagacagggcgagataccatctcaaaacaaacaaacaaaagaagtgaatcctaatgtgaactatggctttaaagggataatgaaggttcactgattgtaacaaatgcactgcttgggtaaacgatgttaatagtgggggaggctgtgcaagttgtgtgcgtatggagcagggtgatatacaggaactctctgtactttctgctaaattttgctgtgaacctaaaattgctctaaaaattagtctataaaaaaatttaaaaatggcctagtgtggtggctcacacctgtaatcccagcactttgggaggcagacacgggcggatcacgaggtcaagaaatcgagaccatcctggccaacatggtgaaaccctgtctctactaaaaataaaaaaaattatctgggcatggtggcgcacacctgtagtcccagctactcgggaggctgaggcaggataattgcttgaacctgagaggcagaagttgcagtgagccaagatcgcgtcactacactctagcctggtgacagagcgagactctgtctcaaaaaaaaaaaaaaaaattaaaaaataaatgttgcttagcgcaatggctcacgcctataatcccagcattttggaaggccaaggtgggcagatcacctgagtccaggagttcgagaccagcctggccaacatggtgaaaactcgtctctactaaaaatacaaaaattagccagacatggtggcagatgccttaatcccagctactcgggaggctgaggcatgaggactgcttgaacccgggaggcggaagttgcagtaaactgagattgcaccattgcactctggcctgggcgacacagtgagactccggctaaataaataaataaataaataaaggtcagtggttcacatcctttgaccaagcaagttcccaagaaacatttgcatggacagtcccaaagcactgttcataatggaaaaaacaaggaagtagaaataaaaccacacacacattggaaaaaatcccagtgcctgtcaaaagtgatttgttaaataaatatggtccacccatacaatgaatgtctgctgggtggctgcctcgttgtgtgtgtgggtttttttttttaaagaacaccagcaaaatgaaaacaagcagatgctaaaacagtagctatgatttcatcctatttacatattttaaaatatgctggtaggggcagggcgcgatggttcatgcctgtaatctcagcactttggaaggccaaggtgggtggatacctgaggtcaagagttcgagaccagcctggccaacatggcgaaaccccgtctctactaaaaatataaaaattggctgggtgtggtggcacatgcctgtaatcccagctactcaggaggctgagacaggagaatcgcttgagcccaggaggcggagatggcagtgagccaacattgtgccactgcactctagcctgggtgacagagcaagaccccgtctcaaaaaaaaaaaaaaaaaaaaagaaatgctggtaggttcattgaaaaatactttgtgaggcagggactcccctacagctggacaatagtggttatgtctgaggggtgagatttgggggagcttttgcctctaagcaagggttctgctgcctaccagaggcctagaacaatacctcacacccccatcattctgtctgtctctcattcaggctttttttcttttttttttttttgagacagagtcttattctgtcactcaggcacccaggctggagtgcagtggcacgatcttggctcactgtaacttccacctcccaaattcaagtgattcttgtgcctcagcctcccgagtagctaggattactggcatgtgccaccacacctggctaatttttcttttcttttcttttcttttttttttttttttttgagacggagtcttgctctgttgcccaggttggagtgcaatggtgcaatctcagctcactgcaacatctgcctcccaggttcaatcgattctcctgcctcagcctcttgagtagctgggattacaggcatgtgccaccacacacagctaattttgtatttttagtagagacacggtttcaccatgttagtcaggctggtcttgaactcctgacctcgtgatccacccgcctcagcctcccaaagtgctggaattacaggcgtgagccaccgtgcctggccaattttttgtatttttagtagaaacggggtttcaccatgtttctcaggctggtcttgaactcctgacctcaagtgatatgcccccctcagcctcccaaagtgctgggattacaggcatgagccactgcacccagccttttttttttcctttttcttttattaatattattattttcttcgagacaaggtcaggctctatcacccaggctgaagttcagtggtgcaatctcggctcactgcaacctctgcctccagtgctcaagcgatcctccacctcaccctccggagtagctgagactgcaggcacgcaccaccacggccgacaaacttttgtattttttctagagatggggttttgccactttgcccaggctggtctcaaactcgtaagctcaagcaatctgcctgcctcaacctcctaaagtgctgggattacaggcgtgagtcaccatgcccagcccctattattattttttgagatggggtctcaccatcttgcccaggctgatcttgaactcatgggctatggtgatcctcctgctgcagcctcccaaaatactgggattacaggcagaagcactgcacccaggctttttatctttttttgatactgggtcttgctttgtcacccagggtggagtatagtagtgtgatcacagctcactgcagcctcaaattcttgggctcaagtgatcctcctgactcagcctcccaggtagctgggactacaggcatgtgccaccatgcccagctaattttttaaaattttttgtagccacggggtctttctatgttgcccaggctggtcttgaactcctggcctcaagggattttcccacctcggcctcctaaaatattgggattacaggtgtgagccaacatgcccagctaattattttccttttgtagagatggggtctccctaagttgccctgctagtctaaaactcctaacctcaagagatcttcccaccttggcctccagagtagctgagagtgtaagtgcacaccaccactaatttttaaattttttatagagatgggcatctggctttgttgccccgtcctggtcttgaaccttcttgcttcaagcaatcttcctgcctcagcctcccagtgtgctaggactgcagatgttacaaccactgggcctggcctcactcagtgttttcatctcagttcctctctctcttccccttcaatttttcttttcttttctttctttctttttctttttttaaagacagaatctcactctgtcgcccaggctggagtacagtagcaggatctcagctcattgcaacctctggcttctgggtttaagcgatgctcctgcctcaacttccctagtagctgggatgacaggcacatgccaccacaccaggttaattttttgtatttttagtagagatggggtttcaccatgttggccaggctggtctcaaactcctgacctcaaggaatccgcctgcctcagcctcccaaagtatggggattacaggcatgagccaccgcacctggctttcctctttcaatttatttttgtttttatttttattgagacagagttttgctcttgtcgcccaggctggagtgcagtggcgcaatatcggctctctgcaacctctgcctcccgggttcacgtgattctcctgcctcagcctcccgagtagctgggattacaggcacccaccaccacgcacagctaaatttttgtatttttagtagagacaaggtttcaccatgttggccaggctggtcttgaactcctgggctcagatgatccacctgccttggcctcccaaagtgctgggattaaaggagtaagccactgtgcctgggttttccctttcaatttctttcttttttcttttttccttttttttttttttttttttttgagatcgagtttcgctctttttacacaggctagagtgcaatggcatgatctaggcttactgcaacctccgcctcccgagttcaagcaattctcctgcctcagcctcccaagtagctgggattagaagcatgtgccaccacacctggttaatttgtatttttagtagagatggggtttcttcatgctggttaggctggtcttgaactccctacctcaggtgatccacccaccttggcctcccaaagtgctgggattacaggcgtgagccaccatgcccagcctcaatttcttaatcaatatatatttccccactatcttgttctcccccgatctctctctcaggcttttgctcctctctgccccactcctaatcttgggggttcatggatgggggttcctgcactcaggtcaaggttcacacctggctcagggattccctagacctttgtcacatttggaatctcaagctcctggagaggcagggtgacctcagaagctctcttccacccacggccatagacagaggcagccagggagccccgtgccccacaagccaggggccaaatccttggccctgctgctcccagcggcagagctcgagacgcgtgctgcacaaccacagccactcaccagcgtccagaggacatagatggtgaagagggcgatggtgagggcaatgagacccacggcctccagctggctgtggagccggaggtggtcctgggccccgcgcaggcacaaccagcctgagatggcggccagcggtgtgatgaacaggaaacacaccatgtcgcagcacagtgtccgcttctccgtccgcggccccgggtccttcagccactgcaggggagaggatagggggcagaggagagggggcagagaaggggctactgagggggaggggtaaggacctccaggcctaggcctccctctgtcctttccttctttcttttttttttttttgagacagattctcactctgttgcccaggatggagtgcaatggtgtgatctcggctcactgcaacctcgaccttctgggtttaagcaattctcctgtctcagccaccggagtagctgggattacaggcaagcgccaccatgcacggctaattttgtatgtatatatattttttgagacagagtctcgctctgtcagccaggctggagtgccgtggcacgatctcggctcactgcaacctcaacatcccaggttcaagcgattctcccacctcagcctcccgagtagctgggattataggcaagcgccaccatgccctgctaattttgtatttttagtagagatggggtttcaccatgtttgtcaggctggtctcgaacttgtgaccttaagtgatctgcccacctcggccttccaaagttctgggattacaggtgtgagccaccacgcctggccctttccttctttcaaacatttattgagcccatgaggagccaggccctgccaggtgctgggcacatttacccccattttacagatggggaaactgaggcacagaggaattaactcaagtgagcaaactcacacagctacatagtccacaaagctggggttccaacctgggaagtcttgctccagggccgaagcgtctttggctactaatctactacgcttggccttccccagatgacaggccaaaagaaatgggctaaaaaaaaaaaaaaaaaaaaaaagccctggtgtggtggttcacgtctgtaatcctagcactttggcaggccaaagtgggtggatcacttgaggccaggaggtcaagaccagcctggctaacatggagaaaccctgcctctactaaaaatacaaaattagctgggcgtggtagcacgcacctataatcccagctactcaggaggctgaggcaggagaattgcttgaacccaggaggtggaggttgcagtaagccaagatcgtgccactgcactccagcctgggtgacagagtaagactctgtctcaaaataataataataataataataataataataataataataagttctttcatttctttgatttttttgtagagacagggtcttgctgtgttgcccaggctggtcttgaactcctggcctcaagtgatcttcccaccttggcttcccaaagtgctgggattacaggcatgagctaccacacccagccaagaaatgggcttaattcatgaaattctggtggatgagacagaaagggcccctgccctcccatgctggcagtggaggtatgaaatgggtgaacggtcacatggggcaaggccttgccaaggaggtgacattgaagagaacggaatgaacagaaggaaccacgtgaagaatgggggagatggggctctaggctgcaggggcggcagatgcaaaggccctgggatagggggaggcggcctagacaagatgtgtggggagggggctgtgtggctgtagcacggagaccaaagtgggtgtgggagggtgtgtgaaggggctggacctccctcccacttttctccctacactctggctcctaggtgggccaggggcttttctagggtttttgttttttgttttttgagacggagtttcgctcttgttgcccaggctggagtgctgtggtgcaatcttggctcactgcaacctccgccttccgggttcaagctgggattacaggcccccgccaccatgcccagctaatttttgtatttttagtagagacggtgttttaccacattggccaggctggtctcgaactcctgaactcaggtgatccacccacctctgcctcccaaagtgctgggattgtgagccaccacgtccagccttggttttttttttttttttttttttttttttttttttgagatagagtctcaatctgttgcccaggctggagtgcagtggcgctatctcaactcactgcaaactccgcctcccagctttaagtgattctcctgcctcagcctcccaagtagctgggattacaggcatgcgccaccacacctagctttttcctcatcgtttgagacagagttttgctttgtcacccaggctggagtgcagtggcttagtctcagctcactgcaacctccgcctcccgggttcaagcaattctcctgcctcagcctccctagggttcaagcaattctcctgcctcagcctccctagggttcaagccagtctcctgcctcagcctccctagtggatgggattataggcacccaccaccatacctggctaatttttttttttgagatggagtctcactctgtcgcccaggctggagtgcagtggcctgatctcagctcactgcaagctccgcctcctggattcaggccattctcctgcctcagcctcccgagtagctgggactataggcacctgcaaccacgcccggctaattttttgtatttttagtagagatggggtttcaccatgttagccaggaaggtcttgatctcctgacctcgtgatccgcccgcctcggcctccccaagtgctgggattacaggcatgagccaccgtgcccagcccacacctggctaattttgtatagctagtagagacagggttttcccatgttggccaggctggtctttaactcctgacctcaggtgatccatgcatcttggcctcccaaagtgctaggattacaggcgtgagccaccgtgtctggactttttttttttttttttgtattttttgtatttttagtagagacggggtttcaccatgttggccaggctggtctcgaactcctgacctcaagtgatctgcccgcctcggcctcccgaagtgctgggattacaggcatgagccaccgcgcccggcagcttgttccttttcatctctcaggcctcagctggggggttcacctccttttgaggccttgcctgacaccccaagttgccccaccccctgtgacatgtttttcccttactgcactattgctcccagaaaccagttgcttcgttgattttttttttttttttctgtaacctcatatcagaagcgatgctttgaagtccagattaaagttactggactttaatctccatgagtgcccagccctacgtgtcttgttggtggctgggtccccagtgcctaacagagtgctgggcatgctggaggtgcccaggaaatctctgctaatgaaagacacaggctgggagcggtggctcatgcctgtaatcccagcactttgggaggctgaggtgggcagatcacttgaggtcaggagttcgagaccagcctggccaacatggtgaaaccgcatctctactaaaaatacagaaaattagctgggcatggtggcgcacgcctgtcatcccagctacttgggaggctgaagcagaagaatcgcttgaacctgggaggcagaagttgcagtgagccgagatcgcaccactgcactccagcctggacaagagttagactctgtctcaaaaaaaagaagaaggagaaggaagaagaagaaagaagaagaagaaagactgaatgaaaacagggagaggttaatgggtctgggagctcttaaaccctaggcctggtttctgacacaccatcagcagacccacctggtggacaggggcggtagggagttctgccctaggaggaccaccagattgcccggggcagctcctgcctttggcccccatgtctgccctctccccactgcccaccgcagtctcagactcttaagggtacctctgtgaggggtcgaggccgtttctccactgcaaactccgtgtggcacagctcgcagtagctggtgttagatgaggaaagccacttctccagacagctcttatgcacggcacccagcgtgccggtgcagccacacggggacagcaagcactccccgttcgctccctcatggcagatccggcagaaaggaccatcactggacacagagataggacccatgagcaatgattgggctttctgtctatacctgcttcactacccactggatcacaagctcacccttaccccatgctgccacttagtgaactcctactcatccttcaatgcccagctctaaatgtccttccctttgggaaggagatgcagggaaggtaaccttgcgaagccttcccagactcccacaggtggagtgatgtgttcccttcccagggaccctgcagcaccctctcagacccaagatgggcatctgttatacccgcccccatgtcctctccaaatttccctaaaatacccaccctgattgtcctgcacaacttccccaccctcaactctttttttttttttttttttttttgagacagagtctcgctctgtcacccaggctggagtgcagtggtgcgatctcggctcactgcaagctccgcctcccgggttcacgccattctcccacctcagcctcccgagtagctggaactacaggcacctgccaccacgcccggctaattgtgtttttgtatttttagtagagacggggtttcaccgtgttagccaggatggtctcgatctcctgatattgtgatccgcctgcctcaggctcccaaagtgctgggattacaggcgtgagccaccgcacccggcccccaatcctcgactcttaatcctcaaagaccagctgggtgaggtggctcattcctgtaatcccagtactttgggaggccaaggcaggaggatcatgaggtcaggatttcaagaccagcctggccaacatggtgaaaccccgtctctactaaaaatacaaaaattagctgggcgtggtggtaggtgcctgtaatcccagctactggggaggctgaggcaggagtatcacttcagcctggaaggcagaggttacagtgagccgagattacaccactgcactccagcctgggtgacagagtgaggctccgtctcaaaaaaaaaaaaaaatcctcaaggactagggcagagcagacaacactcctcatgacctcaggcctcatactggaccagtcagaacaccaggccgggagcagtagctcatgcttgtaattctagcactttggaaggctgaagcgggaggatcacttgagccgaggagttcaaggccagtgtgggcaacctagtgagatctcatctctataaaaaaaaaattttctttttttttttttgagatggagtctcgctctgtcatcaggctggagtgcagtggtgtgatatcagctcactgcaacctccacctcccaggttcaagcgattatcctgcctcagcctcccgagtagcctcagcctcccgagtagctgagactacaggcacatgccaccatgcccagctaattttttttttttctgtattttagtagagacggggtttcaccgtgttagccaggatggtctcaatctcctgacctcgtgatctgcccgcctcagcctcccaaagtgctgggattacaggcgtgagccaccacgcccggtcccaaaattttttttaaagacttatcttggcgtggtggtacatgttgtggtcccagctacttgggaggctgaggcaggaggatcacatgtgcccaggagttcaaagctccaatgacccataattgtaccactatactccagcttggacaacagagtgagaccatttgaaaaaaagaaaaagaaaatagaacagcacgcacccctgctcatgcaaccaactcaggcttgtatgataccatcagagtcaccgataatctattcctaaaattctttgtttccccgtaaactccagaactgtcggccacaaggctgacagaagcctggagctcctgcagctgcctagtctgtgtggagcctgtgaatgatgccagcacagaggagagcagagccaagagacagggaaaggtagatttttttttttcttttttttgagacagtgttgctctgtcacccaggctggagtgcagtggcgcgatctcggctcactgcaagctcgacctcccaggttcatgccattctcctgcctcagcctccagagtagctaggactacaggcgccggccaccacgcccggctaattttttgtattttttgtagagacggggtttcaccgtgttagccaggatggtctcgatctcctgacctcgtgatccacccgcctcggcctcccaaagtgctgggattacaggcgtgagccactgcgcaaggcctgggaaaggtagattcttaaggacatctttgcgggcccctggatctaatcacacctgaagcccgtgctacctgagaaacctgtgcatccagagagaagtgctcacctgctcctctgcccttgtgagggggaaatagaaataaaaagcatctgcagaaagctgcctcggaaaagtctccagccctggcccagtctctggggatgccgggtccttcccagggcagctcaggaggcagggggcgtggcccagaggccaaacagccatgagtcactgtttcccaaacatttctggccagaaggcagactgtgaggtcacacaaagaagagctattttccagacaacgccaatttcctctcagagagactgtatttttttttctttcttttttttttttttttttgagtcacccaggctggagtgcagtggtgcaatcacagctcactgcagcctcggactccctagctcgagcgatcctcctgcctcagtctcccgagtagctgggactacaggtggcaccacgccacacagctaatattttttaactttttctagagaggggggtctcactatgttgaccaggctggtcttgagcttctgggctcaagcgatccttcagccttggacttccaaagtgctgggactacaggcatgagcgaccacgcctgcctggaaatgactgttttctatccttttctcagattctcatgctgcggggtggagttgggcggctttaaaaagagcccaacaggctgctcatggctgctttctcaacagtcctgtccctggactgctatttcctcctgcaatggcaaaagggcatgcctgcctgcctcctttctgaacccataccccgatcccaccctcccccaagtacacacacaaacaaagttaacaaaaaaggaaccctttgtccggaaaccaacccagggaaacagaagtgacgagaatcttgaggaagaatcatgtcagtttggagcttgttctgggaaactgtgaaaaagtttgggagagcaaattcagagaagaggccaggcacagtggttcatgcctgtaatcccaacactttgggaggccgaggtgggtgggtcatctgaggtcaggagaccagcctgactaacatggtgaaaccccgtctctactaaaaaaatacaaaaattagtcgggcatggtcggggcgggggggctgtaatcctagctacttgggaggctgaggcaggagaatcgcttgaacccaggaggcagaggttgcagtgagctgagatcatgccactgcactccagcatgggtgacaaagtgagactctgtctccaaaacaacaaaacaaaacaaaaaaacaaattcagagaagagaggaaaaaaaaagccttaatatttgttgagcacggccaggcgcggtggctcacgcctgtaatcccagcactttgggaggctgaggtaggtggattatgaggtcaagagatcaagatcagcctggccaacatggtgaaaccccatctctaccaaaaatacaaaaattagctgggtgtggtggcgcgtgcctgtagaaccaggtactcaggaggctgaggcaggagaatcgcttgaatccgggaggcggaggttgcagtgagccgagatcacgccactgtactccagcctgagtgacaaagcaagactctctaaaaaaaaaaaaaaaaaaaaaaatttaaaaagaggctgggcacggtggctcacacttataatcccagcagtttgggaggccgagacgggcagatcacctgaggtcaggagtttgagaccagcctggccaacatggcgaaaccccgtctctgctagaagtacaaaaactagccaggtgtggtgacgggtgcctgtaatcccagctactcgggtggctaaggcaggaaaatcacttgaacctgggaggcggaggtttcagtgagctgagactgcgccactgcactccagcctgggcaacaaaatgagactctgtttcaaaaaaaaaagagagatacagtggtgaagtaatttgtcccaggtcactctgggagagagagaggtgtccactcagggtcagggccgaggcactgagcccacagcctgcactcctgaccgccccctatactgcctcccaaaagtgtgttacttgacaacatttgaccttcagatttcacataataatctggaatttcagcttttcctaaagaatcagacccggccaaagctaggcctctgtttccacaaggcgataactgtttgtgtctctttctctatttacccacttggccctctgtcaacggttggacttctaaccccaggctgggagaaactcactgcgcccagagagaagaggcaacaaaggccaggatatccacgcagtcaccactcacctcggtgtgtccaaggcacggatgacggtggagaggagccggccatcccttgaagtcacctgtgccacatactggggcggtccgaggcccgtagcctccacgaccttggagaaggcagggctgccggagcagtcacacagggagccggggaggtggcagcagtcacccgtcgtcatggccaccgggagccccgtatcctcagggcctgaggcccatggttccaggagcctgggaacaggccagtgcggaggttaggggcaaggttaatgagcctgacggactaaggtttgagtcccctcttgtcaaggctgtagggaccactagaccatttacatctctgagcctcagtttgcaccatctgtaaaatgggcctctgtagggccagtgaggattcaaggagacgatgcatgtaactcagcacaaggctggtatacagcaggagcttgggttgtattatttctcactctcctaagaaaagctatgcttccctggccaggcgcggtggctgacgcctgtaatcccagcactttgggaggctgaggcgggtggatcacgaggtcaagagatcaagaccatcctggccaacatggtgaaacactgtctctactaaaaatacaaaaaaaaaaaaaaaaaagaaaagaaagaaaaaagtaaaaaaaaaagaaaagctaggtttcccattctggctaacacagtgaaaccccatctctactaaaaatacaaaaaattagccaggcttggtggcacgcgcctgtagtcccagctacttgggaggctgaggcgggacaatcgcttgaacccaggagggggaagttacagtgagccgagatcacgccactgcactccagcctgggcgacagagcaagactctgtctcaaaaaaaaaaaaaaacccaaaaaaaacaggaaagctaggcctggccaggtgtggtggctcatgtctatagtcccggtgctttgaaagccaaggtaggaggattgtttgagccccaggagtttgagaccagcctaggcaacacatcaagactctatctttataaaaaatgagaaaattaggccaggagcagtggctcacacctgtaatcccagcactttggattcaagacaatccgcctgcctccgattgcctcagctcaggagtttgagaccagcctgggcaacatggtgaaaccctggctctactaaagaaaaccaaaaatattagccaggcatggtagcacaagcctatagtcccagccacttgtgaggctgaggtgggaggatgacttgagcccaggagtttgaggctgcagtgagctatgacggtgcccacagcactcctgcctatgccacagagtgagaacctgtctctaaaaaagagaagacaagaaaagctaggcctcctcttaccctcaaagcctccagggccaggaccacctttcaactaatatcacctttccagataaggtatcagaaccagttcttttttttttttttttttttgagacagagtttcgctgtgttgcccaggctggagcgcagtggcacgatctcagctcactgcaacctccacctcctgggttcaagcgattctcctgcctcagccccccaagtagctgggactacaggcatgcaccaccatgcctggctagtttttgtatttttatttatatttatttattttttttttaagatggagtttcactcttgtcgcccaggctggagtgcaatggcatgatctcggctcactgcaacctccaccttacgggttcaagcgattctcctgcctcagcctcccaagtagctgggattacaggggcccaccaccacactcagctaattatttatttatttatttatttatttatttatttattttttgagacggagtctcactctgtcgcccaggctggagtgcagtggcgcgatctcagctcactgcaagctccacctcctgggttcacaccattctcctacctcagcctcctgagtagctgggactacaggcgcccgccaacacacccggctaattttttgaatttttagtacagacggggtttcaccatgttagccaggatgatctccatctcctgaccttgtgatccacctgcctcagcctcccaaagtgctaggattacaggtgtgagccactgcgcccggcaattatttttatttttatttttattttttatttttatttatttatttatttattttttttttgagacggagtcttgctctttcgcccaggctggagtgcagtggcctgatctcagctcactgcaagctctgcctcccgggttcacgccattctcctgcctcagcctcccgagtagctgggtctacaggcgcccgccaccacgcccggctaattttttctatttttagtagagacggggtttcaccgtgttagctaggatggtctcgatctcctgacctcgtgatccgcccgcctcggcctcccaaagtgctgggattacaggtgtgagccaccgcgcccggccaattatttttatttttattgtattttatttatttattttttgagatggagtccggctctgttgcccaggctggagtgcaatggcgcgatcttggctcactgcaacctccgcctcccgggctcaaatgattctcctacctcagcctgctgagtagctgagactacaggcatgcgccaccatgcccagctaatttttgtatttttagtagagatggggtttcaccattttggccaggatagttttgatctcttgaccttgtgatcctcctgccttggcctcccagagtgctgggattacaggcatgagccaccacgcccggctaatttttgtatttttagtagagatggggtttcaccatgttggccaggatggtctcaaactcctgacctcaggtgatccatctgcctcggactcccaaagtgctgggattacaggtgtgagccactgcacccggcccggcagagaatttcattgaagaaacaagggccctttctggagacctccttgaagccaatacaggtgccctggagccaaggatctctgttcccagcttgtccaacccccaagagctacaatgtccagagcccctgcagcccctaaagtgttcagaaagtccaagcaagagaggcaatcaagtactcagcgaagtattcccacccccaccccaagtcagcttgtaaactgccaatcaaaatccgagccctgggccaggggaagttgttcatacctgtaatcccagcgctttgggaggtccaagcaggaggatcacttgaggccaggagtttgagacgagctagggcaacatagagagaccctatctctctgaaggtttttttgaattagccaggcatggtgctgaaagcctgtagtcccagctacttgggaggctgaggagggagcctcaacctcttgagcccaggagttcaaggctgtagtgagctatgatcacaccactgcactccagcctgggtaacagagcaagacccagtctccagtctctaaaacagaacaaaagaaagcaagcaaacaaacaaacaaaaaaacaaatctgagctccaaagtggggaggtgaaggaacaggggagcaattactaactcttgcgctaggacggttcactgctggataaatgccctctaaacagctcagccagcagccttcctggcctcacatgttcttctgagcatcatagtcaggcctctgcaggccagataagcaagtattgcccaaaggcagggacccaagaggaagactgcaggcctgagataacacccacagggcagtggccgggcctgacacagggtgcctgctgctctccctcccaagtccctgcaaccagaaccttaagctcagaggccaaaggggaagcggctgggctctttacgggaaggcaggcagaggcgagtcctttcctccagcccagcccttctgaggctaggtctttacatttctttttttttaagacagggtcttggccgggcgtggtgactcatgcatgtaatcccagcactttgggaggccgaggtgggcagatcacctgaggtcaggagttcaagacgagcctgaccacatggagaaaccccgtgtctactaaaaatacaaaaaaattagccaggcatgttggcgcatgcctgtaatcccagctactcgggaggctgagacaggagaatcacttgaacctgggaggcagaggttgcagtgagccgagatcgcaccattgcactccagcctgggcaacaagagtgaaattctttctcaaaaaaaaaaaaaaaaaaaaaaaaaaaaaaagacagggtattggccgggcgtagtggctcatgcctgtaatcccagcactttgggaggccgaggcgggcggatcacctgaagtcaggagttcgagaccagcctggccaacatggcaaaaccccatctctactagaagcacaaaaattacttgggcatggtggcgggcaactgtaatcccagctacttgggaagctgaggcaggagaatcgcttaaacctgagagatggagtttgcagtgagctgagatcacgccactgcactccagcctgggtgacagcaagacttcatccccccgcccaaaaaaaaagacagggtctcactctgttacccaggctgaaatgcagtggtgtgatctcagcttactgcaacctcaggctcctgggttcaagcaattctcctgcttcagcctgtcgagtagctgggactacagctgtgtttcaccacacccagctcgtttttgtatttttagtagagacagggtttcaccacgttggccaggctggtctccaactgctgatctcaagtgatctgcccgcctcggcctcccaaagtgctgggattacaggcttgagccaccacccctggcctggtctttacatttctgcaaataactggatattacaggaactatcccagctcctgcatgtggtgttctaatatttcttctatcagggagaaaaaaaaaaaaccacaggtaaatctcttaatgcaaggcctgcaaaccaccaaaattatactagcagcttctatctattaagaaccagacactatgccaagcaatctccatacatagtcatcatctcactgaactcgaaacagttgttataagtgtctccttcaaaggtcaccttcctggagaagccttctcgacaatgctgtctggggcctggcgcattggctcatgcctgtaatcccaacactttgggggctgaggtgggaggatcgcttgagcccaggagtttgagagaagcctgggcaacataccaagaccccgtctctacaaaaaatacaaaaatgagccgggtgtggtgatgtgcgcctgtaatcccagctactcaggaggctgaggtgggagaatcgcttgcacccaggttgaggctgcagtgagccatgatcacacaactgcactccagcctgggccacagagcaagaccctgtctcaatcaatcaatgaagtgccaatggggtccacttgattccactcgtggcatgtgtccctgtctgaaacattctacttattcacctacgtatttagccacgtctgttgtcctaccctacagtgaattctgtaaaaaagagaccctgtcagattgcctcccgctgtccccagcacctggccctctgtctagcccagagctgctgcatttctggttgctgctgcagtcattttttttttttttttttttttgagacagagtctcgctctgtcgcccaggctggagtacagtggccgatctcagctcactgcaacctccacctcctgggttcaagggattctcctgcgtcagcctcccgagtagctgggattacaggcacccaccaccatacccggctaatttttgtatttttagtagagacagggtttcaccatgttggccaggccagtctcgaactcctgacctcgtgatccgcccacctcagcctcctaaagtgctgggattacaggcatgagccactgtgcctggccatgttgtagtcatttctcaatcctcactccgtttaagaacagcgtgagagagccacatctcttgaccctccgatcctggtcggccagcccctgtggtgggcatcagagatatttagaggctagaggtccactcaaaccacagaggcccaggcctggaagaggccaaacttgaggctggacacaaagagagggtgactgcaagtcggactcagctctgaggctgctgaaatgggagagtgatctgatggctccagcaaacttggcccagtgcccaggagatttatttctcttctttcttttgtctggtttttttttttgttttttttgtttttttttttttgagatggagtttcactcttgttgcccagggtggagagcaatggcaccacctcggttctctgcaacctccgcctcccaggttcaagcgattctcctgcctcaaccaccagagtagctgggattaccggtgccctccacccacagctggctaattatttgtatttttagtagagacggggtttcaccatgttggccaggatggtctcaaactccttatctcaggtgatccacccgccttggcttcccaaagtgctgggattacaggcatgagtcaccgcgcctggcctatttcttttctttcttttgtctgtttttttttttttttcttttgaggcagggtctcaatctgtcacccaaaaggctggagggcagtgtagtaatcacagctcactgaagcttccaccgcccccaggttcaggtgatcctcccacctcagcctcctgagtagctctgcacaccaccacatccagctaatttttgtatttttttgtagaaatggtgttttgccaagttgcccaggctggtcctgaactcctggcctagtgatctgcccgccttggcctctcaaagtgttgggattacaggcatgagccaccacgcccggcctggagatagatctcattgagtcttcacaacaaaccaataattacaccctatgatggggaaagaggctgaagctcggagagaggcacctactttcccaaggtcatatagctaggaaggggtggtgtcagaatttgaacttaaaacagtccagggagtggttctggacctcaagagacctgggttctttaactcctggccctcctggctatgccaccgatgctgggtgtcctggttcaagtcactttgcttctctgggcctcattctaatgatggagctggtggactctgtccgtggaggggtctcctgagaaggagcctccaggctgaattcatccagtaaagctcacccttagctaggcttgtttagggtggcactgaggccccccagtcttttccatacctgcccaggctccttttcctgaaggtaggaaacagagggcagaggaatcagagggccctaaaactccctacattgtggtctcaggcagctgttttactctctcagcctcagtattatcatctctaaaatgagtgttacaggccgggcgcagtggctcacgcctgtaatcccagcactttgtgcactttgggagttcaaggaaggtggatcacttgaggccaggagttcgagaccagcctggtcaacatggtgaaaccccgtttctgctaaaaagacaaaaattggccaggcacggtggcgggggcctgtaatcccaactacttgaccagggtgaggtaggaatcgcttgaatctgggaggcagaggttgcaatgagctcagatcgtgccactgcattccagcctgggcaagagagagagactctgtctaaaaaaaaaaaagacggggagtcataatgatatgtagttcataaattagtaaaaaattaagaagttaataactattagctcttattataattactatcatcagcttacagagttgttgatgagaggtcacacagtcaaccctggcacacacagtaagtgctcaataaaagctctattaatattttttagggtaaatgtggaggttgttattgcattcattcctccctgcatgagaagcaaggttccaatcccagctctactccttatgtgctgtgtggccctgggcaagacacttaacctctttgagcctggactctctcaactgtataacaggggacatttctactgcttccacctactcagtatggtttcaaaagaactgaatgagctcaacatgcccatttgactaccccgttttgagcacccacatagcacagggcatcctgtttcagcatctttgtgcaaagtggctgggtcattatattataacttactattttgcaggcagagccgctctgagaaggaggttggggaagggcattggccacttagcagttgcctactgtgtgtcaggcgttttctgcaccagccacctcctgaatcctcccagaagccccatcaggttggcaatgggatgacccagtttcacaggtggggaaaccgaggctcggagaggcgcctatgtgtgccggaccccggagacctcccaccggccttgacacgggaactgaggtccccgcgtccccgagaaggctgtggccaagggatcgagcccagccgtcccgcccgggtgccgagctccggcctcgaacccggggccggcccgcggactggcgtcctccggccctacctgcaggcccgtgcctacctgatccgcggccgggccgggcggccgcacaggcccctcggttcgcctcggccccggtcccggcccggcccggcccgtcggcgccactagctccgctccggccggcacctgcgtccgggcaccgcccgccgagccgacagcgccgcggaccaatagcgaccgcctctcgcctgcattcgccaatcgccttgcacgtcccgccctaagaggcggggccggaggccacagggacgacttgggccgcacaggccccgctgtgccgcagctgctggctccgcccctgccgcgtcttggctccgcccccagctccggctccgccccagcactggccccgccccagccccgccccaggcacgagggggtgctgctgcgccacctgcagacggccagcgtcctctaataaataaaacctctgcagaatttaacttttttttttttgagactggccgggtgcagtggctcatgcctgtaatcggagcactttgggaggccgagacggaaggatcgcttgaggccagatgttggggaccagcctgggcaacatggtgagttcccgtctctacaaaaaatttaaaaggatgggcgcggtggctcacgcctgtaatcctagcactttgggaagccgaggcgggcggatcacgaggtcaggagatcgagaccatcctggctaacacggtgaaaccccgtctctactaaaaatacaaaaaaattagccgggcgtggtggcgggcgcctgtagtcccagctactcgggaggctgaggcagaggaatggcgtgaacccgggaggcagagcttgcagtgagccgacatcgcgccactgcactccagcctgggtgacagagtgagactctgtctcaaataaatacataaataaataaataataaaataaaataaaataaaagttagccaagtgtggtggcccaggcctgtagtcccagctgctctggaggctgaggcaagaggatcacttgagcccaggagttcgaggccagtctgggcaacatagtaaactcacccacccccatctctaagacagatcaatttttaaaaaaatactgcactatatgttcacttagtataagcacacttttgcacataatcacagtataaccttcaaaatcagaaaattaatgttcatctaatattatcatgtaattcccagagcccattcaaaggccaggtgcagtgactcatgcctgtaatcccagcacttggatcatttgaggtcaggagttcgagaccagcccggccaacatggtgaaaccctgtctgtactaaaaatacaaataattagctgggttttgttgtgggcacctgtaattccagctactcaggaggctgaggcaggagaattgcttgaatctgcaaggtggaggttgcagtgagcggagatcttgccactgcactctaacctgggcaacacagccagactctgtctcaaaaaaaagaaaagaaaagtttccaataaagtcctttaaaaatccaaagtccaggccaggcacagtgagtcatgtctgcaatcccagctctttgggagcccaaggcaggaaggtctcttgggtctaggagtctgagatcagtctgggcagcacagtgagaccccatctctacaaaataaaataaaaatattagccagttgtggtggcatcctcctgtggtcccagctacttgggaggctgaagtgagaggatcaattgagcccaggagttctgggctgcagtgagccattacctcaccactgcattccagcctgggcaacagagcaagatcctgtgtcaaaaaacaaaaaatcccaaatccatcccaggatcaagcattgtattttgttgttaacgactctaatttagtctctctttctggaacattttatcaatcttaccttctctccatgacatcaatatttttcaaaaattccaggctagtaattttgcaggaagtccttccattgctatttgtctaatactttctcatgattttgcatttgtggcaggaaacagatgtgacgttgtgttttcaggatgcatacaatgctgattttgtccactatcgattgtgctaacttggttcaaatggtgtctgccagtttctccagtgtgaggttagtatgttacactgtggtgttttgttgttgttgttgtttttaatattttatttaattttaattttttttttttttttttgagacagagtctcactctgtcacccaggctggagtgcaatggtgtggtctcagctcactgcaacctctgcctcccaggttcaagggattctcctggctcacctcccgagtagctgggattacaggcccgcaccaccacgcccagctaatttttgtgtttttagtagaggcaggtttcactatgttggtcaggctggtcttaaacgcctgacttcaagtgatctgcccacttccgcctcccaaagtgctgggattacaggcaggagccaccacgcccgaccaattttttttttcttttttggcgatggagtctcattctgtggcccagactggagtgcagtggcgccctctctgctcactgcaacctccgccaccggttcaagtgattttcctgcctcagcctcctgagtagttgtgattacaggcccgcaccaccacgtccagctaatttgtgtatttttagtagagatggggtttcgccatgttggccaggctagtcttaaattcctaacctcaggcatgagccacggcacctgactttacactttgttaataagtgctttctggggagatacttcgaaagtaattaaatagcctgttcctcaacacacgccgtttccaagagcttaatatcaattgatgacccttgcctgagtcagttattaccataatagcaaccaaatggtgattttcttttttgagatggagcgttgctctgtcgcccaggctggagggcagtggcgcgatctcggctcactgtaagctccgcctccggggttcacgccattctcctgcctcagccccccgagtagctgggactacaggcgcccgccaccacgcccggctaattttttgtatttttttttagtagagatgggatttcaccgtgttagccaggatggtctcgatctcctgacctggtgatccgccctccttggcctcccaaagtgctgggataacaggcgtgagccgccgcgcccggccccaaatggtgattttctaattccatcttggggcatttccttactaactggctcaacaaactcttccaggctgacttgtcttgtcttttgcctgccccaggcctggactcaaccatttttccgaagagccctggttcattttagtggcgaatgatattttatttatttatttatttatttatttatttatttatttatttagagacggagtctcgctctgtcgcccagctggagtgcagtggcgtgatctcggctcactgcaacctccgcctgccgggttcacgctattctcctgcctcagcctcccgagtagctgggactacaggcgcccgccgccccacccggctgatttttttgtattttttagtagagacggggtttcaccatgttagccaggatggtctcgatctcctgacctcgtgatctgcccgcctcggcctcccaacgtgctgggattataggcctgagccaccgcgcgcagccaattttttattttattttattttgagatggagtctccctctattgcccaggctagagtgcagtggtgcaatcttggcttactgcaacctctgtctcctgggttcaagcgattctcctgcctccgcctcctaagtagctgggaatacaggtgcacgccaccatgcccagctagtttttttgtatttttagtagagacggagtttcaccgtattggccaggctggtctcaaactcctgacctcgtgatccacctgcctaggcctcccaaagtgctgggattaaagacgtgagccactgtgcctggccttaatttttaaataatagagacggggcttgctatgaggcccaagctagttttgagctcctgggctcaaaggatcttcctgcctcggcctcacaaagtggtaggattacaggcgtgagccactgtgcctggcagataatttcatttatttatttattatttatttatttatttatttatttttgagatggagtttcactctatcgcccaggctggagtgcaatggaacgatcttggctcactgcaacttctgcccccaggttcaagcaattctcctgcttcagcctcctgagtagctggattacagtcacttgccaccatgcccatctagaatttgcatttttagtagagacggggtttcatcatgttggccaggatggtgtcaaattcctgatcctagcactttgggaggctgaggtgggtggattacttgaggtcaggagttcaagaccagcctaaccaatatggtgaaaccccatctataataaatatacaaaaattagccgggcatggtggtgtgtacctgtagtcccagctactcaggaggctgagacaggagaattgcttgaacctgggaggcagaggttgcagtgagccgagattgtgccactgcactccagcctgggtgacagagccattctgtctcaaataaataaataaataaataaatacacaaaaaagaaaacaaaaaaaagaaggctgggcacggtgtcttacacctgtaatcctagcactttgggaggccaaagcaggtttatcacatgaggccagtagttcgagaccagcctggccaatgtggtgaaatcccatctctactaaaaacacaaaaattagctgggcatatgcctgtaatcccagctacctgggaggctgaggcatgaggatcacttaaacccaggaggtggaggttgcagtgagccgagacagaatgagactgactcaaaaaaaaaaaaaaaagacccgtctcaaaggaaaaaaaagtaacctggctgggcggtgcagtggctcacgcctgtaatctcagcattttgggaggccgaggcgggcggatcacgaggtcaagagatggagatcatcctggccaacatggtgaaaccccgtctctactaaaaatacaaaaatttagcctggcatggtggtgtgaacctgtagtcctagctactggggaagctgaggcaggagaatcgcttgaacctgggaggcagaggttgcagtgagccgagatctcaccactgcactccagcctggcgacagagtgagactccatctcaaaaaaaaggaaaaaaaaagtattccagaaataagagaaggaatacaatttgcatatcaccattttgtagccgctaatggattatgaagcttggtaatgctcattagcagctgctaatgccacaaaagagggaaacattaatgtaatgtgtcttctaatgtatgtacacgacactagttaggcagcgctcaatccagtcctgactctaatcaaacctttaggtggtttttttttttttttttttttgagacagggtctcactcagttgcccatgctggagtgcagtggtactatctctgctcactccaacctccacctcccaggttcaagtgatcctcctgctccagcccctggagtagctgggattacaggcacctgccaccatgcccagctaatttttgtatttttattagagatggggttttgccatgttggccaggctggtctcgaactcctgacctcaaatgatctgcctgcgtcggcatcccaaagtgctggggttacaggcatgagccactgcacccaccccataaaacatttttaaaaagttggtatacttcttcccagtctccattcattcattcattcattcattcactgtgacagtgtctccctctgttgcccatgctggagtgcagtggtgtgatcacagctcactgcattctctacctccctgactcaattgatcttcccatctcctcctcctaagtaggtgcgtgccaccatgcctggctaatttttgtattttttgtagaaacgtggtttcatcatgttgcccaggctggtctcgcattcctgggctcatgcaatctgcctgccttggtctcctgaagtgctgtaattacagacgtgagccatgctctcagcgtttctttattatttttttagagactgggtcttgctgtgttgcccaggttggactgtaactcctgggttcaagtgatccttctctctctctcttttttcattggcagtttctacttgaaatcctcctgttgccctggcgcggtggctcacgcctgtaatcccaggactttgggagcccaaggtgggcggatcacaaagtcaggagatagaaaccatcctggctaacacggtgaaaccccatctctaccaaaaaaaaaaaaaacaaaaaaaaatcagccgggtgtggtggcatgtgcctgtaatcccaactacttaggaggctgaagcaggagaattgcttaaactcaggaggcgagggggaggttgcagtgagccgagatcaagccactgcactccagcctgggcgacagagcgagactccatctcaaaaaaaagaaaagaaaaaagaaattctcctgtctcagacccagagtagctgggactacaggtcacaccactgtgcccggctgtcttcccagccttttatctgggcattttatccacttcttagagttttctggctcatagctggtactcaataaatgctcagagaagcctcataacttagcggttacacacagttctgggtttgaaacctgtctgcatcttactaattgtgagaccttaggggaatcacttaacttctgtaaaaggggccagtatattatgcccacctcgttgggttgttgcaaataacaaataatgatgtgtgaaagatttaacacggtccctaagaaaagtaaacgtagaattgccatatgggccaggcatggtggctcaagcctgtaatcccaacatcttgacaggctgaggtgggtggatttcttgggcccaggagttcgagaccagcctgggcaacacagtgagacccctgcctctacaaaaaatacaaaaattagccaggcgttgtggcgtgtgcctgtggttccagctacttgggaggctgcggtgggaggatggcttgagcctgggagttggaggttgtagtgagatcatgccactgcactccagcctgggcgacagagcgagaccctgacttaaaaaaaaaaaaaaaagttttttttttgagacggagtctcgctatgtcgcccaggctggagtgcagtggcacaatctctgctcactgcaagctccgcctcccgggttcacgccattctcccgcctcagcctcccgagtagctggaactacaggcgcccgctaccatgcctggctaatttttttttgtatttttagtagagacggggtttcaccatgttagtcaggatggtctcaatctcctgacctcgtgatccacccaccttggcctcccaaagtgctgggattacaggcgtgagccaccgcgcctggccaaaaaaagttaagttttatgttatgtgtatgttaccataataataaaagatttaagaacagagtctggcagagtgagcaggacgtgcttattaaatcactgaaatcagagtaattaaactggcattgctggcttctgactcttaaagggacatagagtatgtcagtcagtccccatctcaggcctagcagataatggcggctctagaaatatttgttgatcttttgactgcttgaaattcaaggtgctaaggccaatcacggtggctcacgcctgtaatcccagcactttgggaggtcgaggcgggtagatcatctgaggtcaggagttcgagaccagcctgggcaacatggcaaaactctgtctctactaaaaatacaaaaataagctgggtgtggtcgcatgtgcctgtaatcccagctactccagaggctgaggcaggagaatcccttgaacctgggaggtggaggttgcagtgagccaagatcacactactgcactccagcctgggtgacagagcaaggctctgtctcaaaacaaacaaacaaacaaacaaaagctcaaggtgctttcttgcttagcacccaatgcctctgtccaccacatgacctgccctgcccaaacccaggggaatccatgtcccaggggtctctgtgaatgggccttggagcccagggtgcccaggtgcctccaattctgccagttagctctgtgccaggctgctccctgggcctggagcgcacaccttggctcattccaactcctgtgtctacacagctcccagcgacctggagctcttctgggaaaaggtgtctgtgatcccctatccctccaggcagggcagccagtctagaatcaagagggagtggtgctgtcctctctcatgggtccccagggtcttcagggtgtgggtggcctcttcagctagaggctggagcttttggacagctgctggcagctcacactggtcccaaggtcactgcaggggtgaggtggagggagacgctggatcctgggaagaggaactccatgccacacattttgctgtccctggcatttccccactgggccctcctccggtgtcagtttagggtggagacatctggcatcaccaacatccactgggcaagtcaccctcgtcaggaccccaggggaggggaggccctggcaggagacaaagtgatgaaccctggccactgctcttggctcccatccccatcaggggacgcccgcaggcctgaggtcctaggacccaggagtttaaagtcaaggacaagcggcagccttccatccctccctgccacaggggcagcttgaccagggcccaccccaactgcgctggctgacttccacgctgcccttggcaggtgctggggtcctctcgcttcctgtggggtgggctggggagacggggggtctggcctgcattggggaacgtgcagcgagaggggcctcagcctaggagctggcgcctggcggaaaagaaagaagacagaggcgcagcggcaggtttctgtacaggaagtcagattatacatttcagtaacgggcggggtgacggggacggggcaacagcgcaggggccacagggagaagaagagatcgagagctggggtttggcgtaaatcttacaaagtgtataaagaatctgtgtttctctacattaacaaaaaccaaaggctacaagagcggttgtatatacaaaacacggagatattgcttcacttgcaaacaggttccagaccagatggggagacgagacagaggagggggacagggagggccgagagggcgcgttgcgtgcaggagaggggaggggagaggggagagggggggacgggcttctccctgcatcaatcaacaggcagaggtgggaggcctgtgcgagctgctgtgtgcggaggagcgggtgggcgctgagagcccggggggtccgcctgccccggcccccgctgcctggttcttcgggctttggcccagagcacggttctgggtggggacgacgggctggctgggccacccggtcacggagggagggaggcaatcgctccctagagtcggccaaggaaaaggggagaaggcggcgccgtccgcccgtcctcctcgcctctggccagccccgtccatcctgccgccctccccaccccgccaagacgctgtggggacccgagtttcatgggtgcagcaaaccggggcttctagcttttccccgggcaggacggggtagcactggctcctgtccttcctgggccccggcccggccgtgcagagctcactgggagggctggaacgagccggccacagagggacagcagggaggggccagaggataccgtggcgggggcgggcggaggacgtgcacgcacgctgggtggaggcgcaggggtcacaggttctggcagcactgcagcttgttgggcttctgtccgtccgtggtgggcggcacgctgatgtccaccacgttgttccccggggactcgtcgtgggcagcgcggtctgcgatctgtttctgtgacacgatgcggtagatctctgcaaagggggtacagggggacgtggggtgagccagcacgtgccctgcctgccgaggggaacccctccctgcaggactccagaggccctctccagacccccacagcgcccccatcacatcaggggtaacaaggacaggggctgcgcacccagccaggacccacatctggtcacagccagccccggcctctcgctccctaagatcagaagcgccctcctccctcagaggtaaactcccagaagccaaaaggctccaggtccctgaggctacccgcctccccgcagcgccaagagttaaggcagggcccatccccaggaactggggccagggggtctctgtgtccccagtgccagcaagggctagacctggtctgaccctgtgaagtgtccaggtggaccggcaggtttaaaaagcaaaggttaggggtggtggtggaaaaaaatcaaacaggccaggtgcagtggctcacgcctgtaatcccagcactttgggaggctgaggcaggaggatcacttgagcccaggagttcgagatcaacctggacaacattgtgaaatcctgtctctactaaaaattacaaaaattagcgggtgtggtggcaggcacctgtaatcccagctactcgggaggctgaggcaggagaattgcctgaacctggaaggcggaggttgcagtaagctgagatcgagccaccacactccagcctgggcaaagagcaaaaatccatcctgccccgacaaaaaaaagaaaaaaacaagcaaacgaacaaaacaagcgaaggttcagaggccgtgttccaccctgcctggctggtgccctacccacacccatctggtccccggccacctgtgaggatgttcttgaatgcttcctctacgttagtggaatccaaggctgaggtctcgatgaaggacaagttgttcttttctggaacaaagaatactgcctaggtgagtggggaggcagggtgacaggctcccacatgctctcagggaccccgcccacccacctggcccatcccaaggccactcctcagggaagggaagccagggctgtggccagggccccaacactgtgaggggcctcctgccttccagacacctctctgatgcctgcgtctccgtctgctcacctgcgaaggcgcgggcctcgtcagtgggcacagcccgcaggtggcgcaggtcactcttgttgcccaccagcatgatgacgatgttgctgtctgcgtggtcccgcagctccttcagccagcgctccacgttctcataggtcaggtgcttggcgatgtcgtacaccagcagggcgcccactgcaccacggtagtacctgcagggtcaggggcccatgagcctctctggaggacaaccatgggcagcggcagcctcacgggataacagcacacatcacgcccagggtgggtcgtccagggccgagccaaggggcagtcattgtggcctcaagggaagggtgtgtgtctggaggccccagcgctgctccctggatccagctctgaaatgtgggggtctgaggagggagtttgggagctggaaatagaagataccgtgaggtcatcaaaaaaagggaagaaggggctgggcatggtggctcatgcctgtaatcccagcactttgggaggctgaggcgggtggatcacttgaggctgggagtttcagaccagcctgggcaacatggcgataccccatctctactagaaaaacacaaaaattggccgggggtcgtggctcatgcctgtaatcccagcactttgggaagccgaggcaggtggatcacgaggtcaggaattcaagatcagcctggccaagatggtgaaaccccatctctactaaaaatacaaaaattagccaggcgtggtggcaggcgcctgtaatcccagctactcgggaggctaaggcaggagaattgcttgaaccctggggggcggggggcggaggttgcagtgagccgagattgtgacactgcacttcagtctggatgacagagtgagactctatctcaaaaaaataaataaataggccaggcagggtcgctcacgcctgtaatcccagcactttgggaggccgaggcgggcagatcatgaggtcaggagatcgagaccatcctggctaatgcggtgaaaccccatctctactaaaaatacaaaaaattagccaggcgtggtggtgggcgcctgtagtcccagctgctcaggaggctgaggcaggagaatggcgtgaacctgggaggcagagcttgcagtgagctgagactgcgccactgcactccagcctgggcgacagagtgagactctgtctcaaaaactaaaactaaaaaataaataaattaattaattaaattagccaggcatggtggcacaggcctgtagccccagctactcaggaggctgaggcaggagaatcgcttgagcctgggaggtcaagggggcagtgagctgcaattgtggcactgcactccagcctgggcgacagagcaagaccctgtctgtctccaaaaaagaggaggcgacagccaggcacggtggctcacgccacctgtaatctcagcactttgggaagccgagagggtggatcacctgagggcgggagtttgagaccagcctgaccaatgtggagaaaccccatctctactaaaaatacaaaattagcctggtatggcggcatgtgcctataatcccagctacttgggaggctgaggcaggagaatcgcttgaacccaggaggcggaggttgcagtgagccgagatcgtgccatcgcactccagcctgggcgacaagagtgaaactccatctcaaaaaaaaaaaaacaagaggaggtgacagagagacagatgtacctgagggatgaaggagatgggagggagcccagaggatctcaagacggtggtgggaatggctggggggcttgggaggggtccagaaaaaggcagctgagtgggtcctgatggctgggaagcctttgcagggaatggaggccaggcccaggtgggaggacaggaggcgtgtgggaccaggtgtgggcaccagtgaggagggaagctgagggaggaggaaggctgggatgctggctgggcaggggcagcggcaaggcggagtggcctgagctaggtcctcactgcacttggtacccagagataccctggtgtggcgaaggctgggcgctggtcagcctgagggtcccacggcgcatggctaaagcgttcttccagcctcactccctggtcttgggagcacactctccccttctcctgcccaactcctacacatccttccaagcccacgcgctgcaagcccacgcccccgaatctcagcgtccctgcccaggctgccgacacgcacgcggaggtgatggcgcggtagcgctcctggccagcggtgtcccagatctgcgccttgatggtcttgccgtccacctggatgctgcgggtggcgaactccacgccgatggtgctcttgctctccaggttgaactcgttgcgggtgaagcgcgacagcaggttgctcttgcccacgcctgagtccccgatgagcaccactgggcgggaaggcgaggttctgtgaatccccacactccacccacgactgcccccacaaccttcccgccggttccctgggtgctgcaccaacgcggctgccaacggtgtggaggagtcgagagatgcctggagcccagggcctgcaggcactgtgctaagtggtgcagaagtgaaggcaggctcctgccttccagaaacagccactgcggatagcacaacacctgcctgtgtctggtcctcagagcagggctgtcccagctggggcaaggggacccaggcagccaggcaggcagagcagcttgagatccatcaaccctgagcctccacctgcagcctggtggctgggcagccagacacggcttgagaaggctcctgagcggggtgaccttgggcaagtcacttcacctctggactactttttccaaatgtgtgaacaggaaggcagtcacaggaggaggaagtaagagcaggcatggccaggcacggtggctcccgcctgtaatctcaatgctttgagaggatgagccaggcggatcacttgaggtcgggagttcgagaccagcctggccaacatggtgaaatcccgtctctataaaaaatacaaaaagtacccgggcgcggtggctcacacctgtaatcccagcactttgggaggccgaggcgggtggatcacgaggtcaggagatcgagaccatcctggctaacgtggtgaaaccccatctccactaaaaatacaataaaattagctgggtgtggtagcgggcgcctgtagccccagctacttgggaggctgaggcaggagaatggcgtgaatccgggaggcggagcttgcagtgagccgagatcacgccaccgtactccagcctgggtgacagagcgagactccatctcaaaaaaaaaaataataataataataattagctgggcgtggtggctactgtagccccagctactcaggaggctgaggcaggagaatcgcttgagcccaggaggtggaggctgcagtgagccgagatcgaatcactgcactccagcctaggcaacagagattctgtctccccccacgaaaagagcaggcatcgcacaggaagggacacgagtaggcagctgtcacggttgttgtggtttctggtcagggcatgggaagggtcactgctccaggtatgtaagtgacaggacatgaggagctactcccacctcaacccccacctctcctggtgcagcaaacccacatccagcttcggcacagatggctgagtgggaaacaggaatgtgccctgaggacgcagcccggaggaaagagcctgcagccacctcccaccacccctgtccccagggtcaggtcccctgctgagctgcagggagctccagccaaggctaagtcctcattcaaggggcagtccgtgtggcagtccacgtgtgtgcacagctcctcacaaggctccaacacaggtatgcattgtcccaggaggggggtgcacagcagagcagcttgccaagatgcaaaccctggcccagaaaggagtcagcgcagcgtggacagaacagagatgagggtttgtgggcaacagcacccagggacgggggcctgagcccagtcgacacggggtgtgcagcaggcctgtctcatgctggccaaggagcatcaggaacactttccctgagcagagcaggtgcctgctggtcaggccaggggtgagctgccttgtaaactgtttcctgtcccagccatggaagcactgtccctatgggcccagccgccccaggctctggggtggggtctgggtgagctgtccccagacccagaacataccatgtggggaagatcagtgtgtgtgtgtgcacttgaatacagccaaccagacgccccagccagaagccccgtggacccccaagtgtgggccttgggccccggcacctgagggtgggttggctcagtggcttggtcatccctggtcccagggagttagggggcatccactgaggatgaggcttccttgtctgggaagagatgggtatggctgttcctcctgagctcggggaggtgctggcagccaggctgagccctggctgacccagaggtccgctggccccactcgggacccctgctacattgagggagcaggccctggagcccaccaggcagccctcctctgcccttcccctggccacactgtggggctgtacctacacgtttggaattttccctctagaaaacattctctcctgacccaacttcctgcctcgggcactggaaggtatcatctacactcactcactccacctcctgtcccccagtcctagaactcaaaccaagcacgctttcgcccccacagtcagtgtcagcctcagctacccccactcccccgggcctgtgcagcaggcacccagccagctctccctccttccctgcctgcaggggctccacaccccgactcctctcctcacagtcactcccactcagtctcccactctaccttcgaacctcagggagcctcaggacaggcatctctgtccacacccagtccccaggtgaccccatccaggctcatggctgtaaataccagccatgggctggtaactcctatattacctctctccctagaagcccagactggcgtgcccattgtctccttcatgtctcctcaggggccccaggcccctcatacccagaagagcagagccaagctcccgatcactccctaagcctgctcacccaccgctcacctaccctccttatcttggttaactttggcttggtcctaccaggcactcatgccagaaacctggagtcattctcgactccttcctttctctcgcatctcagaatcaatccttcagcacatccgaaacagatccaagagaagggaggacgaggggtgcaccccaccatgtctccctgggcgattccattccagactctcagaccctggaaggtattgtctgtgcggtccctgtgttcacgctcatcaccaaccaaaacgctgtcctcctgcagcagccaccagagagcgcccgtgagtgccgagccagggcacctccctccctcctctgcagacaaccctccgtggcccccaccttccgcaggggaaaagccacagtcctccccgctgcccacagggccctcccctcctccctcccgccccccccccggctcactctgctccagccacacaggcctccatgctgttcccccaacacgccaggtgcgatcctgcctcagggcctttgcacgggttgctcctgctgccagaaacgctcttctccaggcacacacctggctccctccctcatccccttcgtgtggccccttaaatgccacttggccaagaaggccctccctgctatgctactaaaactctactctccgaattaccctgctcccggacccagttcttcctccgtcactcttgccactctctcacctgtcaggtggcatttatcttttgccagtctgccccaagggcaggaatcaggtcctggcacagtgcttggcacacaataaacacccaagaaaatgtctgtcaagtgaacaaacaaaatgccaaaaaggctggcagagcctcccacgcatgccgcctgccccatacctagaggatgccaggtcaccacccttgggccacaggtgaggagggcaggatcaggcagcccctacaaccccacctggtacccgctctggttggctgcttggaagccaagaataacaagaacaaggagaatattcgatgagcttgtgctaacaaagctcttgatgtgcgttacttcgcagaagcctcctgtagcccatttttacagatgaggaaactgaggcttggatggggaacggggtgcggggcagagcaggaccctgaagctatgcatgtttgtgggctcgccctcacctcccaacggtgctccccaagtgacttgtctggagccaccgcctgggaagtgagccaggcaggatttgaacccaggtcttctgcatccacagtccaagttcttccttcgcaactcactgccacactcactgtcctaccccaaaccccagcacgtggctcgggagtcgtggttctgccttatggggtgggcattgaggctctgggcaccccagctcccaccgcatagggcagcctgtccccctggggcggccagcaaactcctactcatccttcaagacccctcggctcagacctctcctctccccaaagaccactgcttggcctggcgtgaaagacctaagacaacggggctggcattctctcacgtcaccatgggtgccccgcacagggctaccaagtggacttcagagaaagacagaaagatggccgggtacagtggctcatgcctgtaatcctgtaatcccagcacttggggaggccgaggcaggcggatcatttgaggtcaggagtttgagaccaacctgactaacatggtgaaaccccgtctctatgaaaaatacaaaaattagccgggtgtggtggtggaggctgaggcaagagaatcatttgaacctgggaggcggaggttgcagtgagccgggatcgtgccactgcactccaagctgggcgacacagcgagactccatctcaaaaaaaaaaaaaaaaaaaagaaagatggaaagaggtggagtgaatgtaggcgtgtggcccagcacctcccaaccaagccagtagggatgagaatcggctcccaggccactgggggccaagatggactcactgtgagggcccccatctacaccaccaaccttaacctcctttccacggcagctacgggagcctggccaaggccagggaggtctgctcagttctcacgtcctcaggaaataagacaggaaactcgggccctgcccaggcattcccgacaccttcacaccattccagccttgccccagctgtacagccttagtggctcctcagccccatcagtttgtttgtttttgtttgtttgtattgagatggaatctccctcgcccaggctggagtgcactgacacaatctcagctcactgtactctccgcctcctgagttcaagagatcctcctgcctcagcctcccgagtagccgggattataggcgtgcaccacgacgcccagataatttttgtatttttagtagaggtggggttttgccatgttggccaggctgtctcaaactcctgacttcaagtgattcacccacctcggccttccaaagtactaggattccaggcgtgagccatggcacccagccccatcagttttgccctcaagcactttggccaggctgggtccccagtgctttgcaggcctcagctgtccacattctcagggctgccccagggacagatgtaaatattatcattctccctgaacagctggggacactcaacccagagtgaccaagtcagagcaaaggccaaatggccactgaacagatcaatgacaggccaggtgcagtggctcacgcctgtaatcccagcactttgggaggccaaggcgggtggatcacttgagctcaggagttcgagaccagcctgtcaacatggcgaaaccccgtctctactaaaaatacaaaaaataggtgggcatggtggtaggcacctgtaatcccagctactcaggaggctgaggcaggagaatcatttgaacccaggaggcggaggttgcagtgagctgacactaagccactgcactccagtctgggtgacaaaacaggtgaatggcaaagaggctgagctgcccaaccagtccctggcactgggtgcccgatgcagagaggtggccagcggggcagtggcgggctggtccaggatgcaggctggggatgaaaacttcattgtctaggacacaagcaatctgttgtcttggggaaataaagagcccttgaggacacagctccgagcatttccacagaagttggtggcttcactggctgggaagcgacccccctaccccagacacgccacttggctgacagagcaggcaagcccggttggcaaaaacaaagaactggcacctctgagaagtcctaggtgccctggcctgccccatgacagtgtggtggccctgggggcccagaccctaatgctcaggcagactgagagactcttcaggggaatggtgcccccattccggcagagcctggcggagccaagcagtgcccccatccctcccctggaagctggtcctaagcatcctaggccccagggaccggcactgggggccactcttgtctcagctcttctatggggaggtgtacagagccagggcactggagggacccccattctaaatggggaagatggtatgtttgggtccccaaacagcaactggaacagcaggcccactgtgaggtctgcccaggcttgagggctgggagctgcctcaggagcctcagcacagaaagggaagcaccaggcaggccccttccctggggacaggggccaccttgtccttgggcaggggaggggtggacaagacccagaggacagggcctggggcagctgcggcccgtttcccccacgacccatgtcctccagggccaggtgagccctgattggccagggcctctagggtaggggaagggctctgagaggacctcagtggcccttggggacacagctgcaaccatggagtaccgagtccatcagaaaagaaatctggggtcccacggcaattagtggcaggctatgaaaatggcccatggctaaaggagaaaatgttaggaggataaatgtgaggctctataattaggtacaaatcaacagtgtcattcctgggggaaggaaagaacattcacgaaggaaaacaaatggcacacggggcatcacccgggggatctgctggccttggccgctgaagtcaagggagccagtgcgtgatgtggccaccaaaaaaaaaaaaaaaaatgcagaggccaggcacggtggctcatgcctgtaatcccagcactttgggaggccgagacaggtggatcacctgaggtcaggagttcaagatcagctggccaacatggtgaaaccccgtatctactaaaatacaaaaattagccgggtgtggtgggtgcttgtaatcccagctactcgggaggctgaggcaggagaatcgtttgaacccgggagacggaggctgcagtgagccgagattgcgccactgcactccaggctgggtgactagagtaaaattctgtctcaaaaaaaaaaaaaaaaaaaaaagaaaagaaaaaggaaaagaaaaatattgaaagagaatagaggaggtcctctgatgaggcacagctgtgaaggtgagacggcagatgaccagtttgggaaaagctgaacttgtgggttagatttttgctaccaactagcttgagaaggtcagcagggcacctgctagactcagtaaaaggaggccagtgtggggagggcagcagggcaggcaccgcccccccccaccccacaccgcctgcccgccaaatgccagatgccgcagaagctaaatcagtgtttccaggaagcagtctctgcagacaagtcccgggaaccacacagcctctccattgctcctgacccagtaactgttctgctgggaacgcacttcaaggaaataatctaaagggcaaaaccatgacttgagcaagcactcggagctgggtcatttaacacagcaaaagggcaaaaataacaagcaggggataaccacagaaacctggatggggcatgtggggagcaacacccctgccctggcagtgccacgtctgggtgggtgcccagccaggacctgggagcagctgcctcacggtgggctgagtggagatggcacccgatcagcaggacccaaagtttagtccccctgtctccagacggccccttagaatcccagtctccaaaacccttccaaagcttcctcctgccacgaggggcgagaccttgggccgggcacctgctgaccacagagcctcacccaccagtgacattatcaacctgtgtgcagctgccagagccctcagtgccacaggacgactctaggcccttgtagaggcacttcctctccctccccccggaaggctttcgccacacggacagcccaggtggggagacctctgcctcattccccacaatcagaagacgctggatgagaccagacacaaggcccagctaggcctggtgcaagccacagagcacactcggaggaacggctcagcgaggtgaggataccaacagctgatgtgcgacgcaggccctcatagagcaggccgcagggtgaaggcaccttggatccaggggttagccctcaagggctgccattgtcagccagggagcccagcaaccagggcagaccactaggccaaagtgtagctgggcacagaaggctcagctgagaaacaagggactccggcttcctccagctgtccctaaatgggcaatggctgcctgatctacctaggccttatgtgatgctcctagagccccctcagtccctcgggcggggaagaccctccagcaggctggctggggccccggccatcagtgcgcacgtgttggaagaagttggtccaacaacccaaagtcccagatgctggccacaagccccctaagacacgcttcctaagtggtaaggcctacaggtggcctgggctcaatcgggttccaacacttataaactgtgtctttgtcactctgggcctcagtttcccaacgtgtaaaaagagaggctggttagtatcaacctcaaagggctgcagtgaggattttagttaattcgggtaaagtgctcagaaaagtgcaagtactggcttagcactgttgagagttctgagtgaagagatggaattcttgctgcacacacgggtgcctttccactcaatcccagctttgcaccccaatccaaggctcccaccaccacacacctcacccccaggccctcatctcggcccagcccccattgcctgccccgcctctcccgggccccacccccaaacacgctgccccaatcaggacaagcctcgtgagagccccgcctccgtttgcccaggcccaacccacctattggtcacgcccatcacgccttagccccgcccctaaaaaccccgcccccatcccgaatcacgctttcagcccagcccggcccgccaaatcttgggaaagctccaccccctgcggaggccccgccctaacagcctctcccaccgctccgggccccaccccctctaggctctggccccgccccggcgcgtcctaggtcccccaggtctctccgggcctccggctccgtatagccgcgcatcctagcccgaagctgatgctgcccggtcggctccggccttcccggctgcctgacccgccgggccccaagccccgggctccggcctgggcccagcggcctggagcgcggccttggcccgtctgcccgccgcctcgccgccacgacttcgcccgtctgtgccccaccggccgcacctttgaataggtagtcgtactcgtcgtcccgggtccccattgtcctggcgcttccggcgggatcggcgactccgcagccccaccacaaacacccgacgggggcggagccggcgccgcgcagagcggcggttgaatggcctatcagcggcgagtggagtagcgacgggcacccagcgaagccaatcagagatggaagtagtgctctgagggtgggcgccgcttggtaccaccctcctcgccctcggtgtcctggagaaaggcggaaggaatgcggacctttttgaagtgacggacgcgccagcctatcaggggcgagctcaagagggcggggcggaagactgcaggaatgaaatggattgacagaccaaataactaatgagaggcttgattgagaacctacccgactatcagaggacctgtccgggaagagaaatggggctacgtccaggtaatgctacgatgcttaacgtcccgatgacgtcataggtcagcgcgcgctgccctggtcgccccccaagcccataaatgaccatttccggggacctcagcgctgggtcccctttctcggttgcagtctccatctctatattgggactcactgggttatccttctgtgcctcagtttcctcctctgtaaactgaagaaacccgtctcatggaatcttttgaaaataaccagatcagccaggcgcggtggctcacgcctgtaattccaggactttgggaggccgaggctggcggatcacgaggtcaggagttcgagaccagcctgaccaacatggtgaaaccccgtttctactaaaaatacaaaaattagtcgggcgtggtcgctggtgcctgtaaacccagctactcaggaggttgaggcaggagaatcgcttgaacctgggaggtggaggttgcagtgagccgagattgcaccaagtgtgaatcaaccgtccactttctgctattctttgttaaataaatacttttaaatccttactggataccaatgctctccaacaggacctcctaccactacccctcttttgtcctatattttgccacataggtaaaatataaaaataggtaatatagaaaataaaacacatactgctgtattgtcaggtagtgataggatttatcactacctgacaatacagtatgtgtttgttttatatatttagggtgtacagcgtgtgttttgatacacatgtacccagtgaaataataattatgacagtttttttttttttttttgagacggagttttgctgtcgttgcccaggctgaagtgcaatggtgtgctctcggctcactgcagcctctgcctcccgggttcaagcgattctcatgcctcagcctcccgaatagctgggattacaggcatgcaccaccatgcttggctaatttttttgtatttttagtagagacggggtttctccatgttggtcaggctgatctcgaactcctgacctcaggtgattcgcccaccttggcctcccaaagtgctgggattacaggcattttcaccacacatggccaattatgagagttaagcaattaacctatccattgccttccataattaactgtgtgtgtagtgagagtatctaaaatgtactttcttggcaaattttcaatatactatgcaaaattattaacacaaagtatacgttactttttgtttgtttgttttggctggctgcggtggcttatgcctaaaaacatgccctttgaggaggctgaggtgggaggatcacttgaggccaggagctagagaccagcctaggcaacatgtcaaaacccagtctctcaaaaaaaaaaaaaaaaaaagaaaaaaaggaaaaaaaagagaaaaggaaaaaaaagaaaagaacaacaacaaaaattagccagatgtggtgcatcatgccagggtcccagatacttgggaggccaaggcgggaggatcattcgagcctgggaaatcgaggctgcagtgagccatgatcaccccactgcactccagcttgggtaacagagcaagaccctgtctcaaaaaaaaaaaagccttgctttcctgacccattgatctgtttgttttttgtcctctgtcagcagcatatcagcctgatgacatcagggactgtatctgtccccatcattgctgtaagttccccactgctgaataaatacgtttatttattcagtggtgaataatctaagcctagagtcaatgtactagttattagagcagatgccattatcgcctcttggatctcattcccagggtgttcattgggcatctgtcaaaaaaacaaaattacaacacatttagtttaaagatcttaattgattttatttgcaattctacaatcgggcaacacttcatttcacaaaatgaaactaattttcccatgagctgagcaggtaggttggttttacaggcagaaaaagggccaagtaaagcacaaacagaaaataaaacgtggaggtcaggtgcagtggctcatgcctgtaatcccagcactttggaggccgaggcaggcagatcacccgaggtcaggagttcgagaccagcttgaccaacatgataatgatgatgaaaccctatctctactaacaatacaaaaatattagccgggcgcggtggcaggtgcctgtaatcccagctactcaggaggttgaggcaggagaatcacttgaaccagggaggcggaggttgcagtgagcgaagatcacaccattgcactccagcctgggagagcagagcaaaactccgactcaaaaaaaaagaaaaaaagaaaagaaaacttggattggtcattttaaagtttccttttggagtctgagtcttgctctgtcacccaggctggagtgcagtggtgcgatcatagctcactgcaacctcaacttcctgggatcaagcaatcttcccacctcagcctcctgaggagctaggatcacaggtgtgtgccaccatgcccagctaattttttttttccagagacagggtcttgccttgttggccaggctggatttgaactcctgaactcaagcaatcctcctgccttggcctcccaaagtgctgggattacaggcatgagccaccaccgcactcagcccaaagttacttttcttgtaaaggttaaagcagagaggacatccttatcatgatggctaaaactgacctggtgggagacttggctatcccatctctctctctcctgattttgtagaaggtcagataaacaacttagtttctttttgatcacgtaaaactttagcatgagtgactccattttggtttagtttgttgggcctggtgtaggaagtcagtccaaagtaatagcctcctataagttttgtataacacatcctgtgtccagattggtgggttcttggtcttgctgactccaagaatgaagccacagaccctccggtgagtgttacggttctgaaagatggtgtgtccagagtttgttccttctgatattcagacatgtctagagtttcttgcttctggtgggcttttggtctcgctgacttcaggagtgaaactgcagacctttgcggtgagtgttacagctcataaaggcagtgcgcacccaaagagtgagcagcagcaggatttactgggaagagtgaaagaacaaagtttccacagcatggaaggggacccaagcacgttgccgctgctggctgcggtgtcctgcttttattcccttatttggccccacctacatcctgctgattggtccattttacagagagctgattggtccactttacagagtgctgattggtccgttttacagagtgctgattggtccgttttgacagagtgctgattggtgcatttacaaacctttagctagacacagagtgctgattggtgcatttacaatcctttagctagacaggaaagttctctaagtcccctacgcgattagttagacacagagcgctgattggtgcatttacaaacctttagctagacacagagcgctgattggtgcatttgcaatcctttagctagacagaaaagttctccaagtccctactcaaccaagaagcccagccggcttcacctctcaatcacccctctaaacagaacaccccaactgctgttgggaatttggccgatgaccactctagctacttcctgctggaagaaggggccctgcaattgtagtgtcctccagaggggaactctttaggccagtggaagggccagtgggtcggtccaggggtcctcagtagaagttgttagttgaactcatttggggttccatttttaagaccatctgtagcttgatggcctcgattctagaagaaacaaatttgacaagaaggttaaaaatgcagggcccaaaggtgagtaagagcaagatggctgccacaggacctaggggagaagccatgttgcccaactccagaggttggtattagagttcgaaaggcattgtctgatttcagaagccttttcctgtaaatgccaggtggcatctcgtgctatccctgactgtttagtgtaaaaacaacactcttcccctaagaaggtgcagagtcctcctttctcagcagtgaggaggtctaggcctcagtggttttggagagttgctgctgccaaagagtatatttgggattgtagagtaaggatagattttgttatttcttacaaactgtctgagaaatcctttgaaggtgtatggtagtagaataatgaagtggataaactggctattccggttcctgtagcagtagccattcctaaccctataagtagggatattagttgtatggccctgcgctgatagacttgagctttgaggggcacagatacggtctgatttccataagattagaagttaggataatacatgttacactgttaacttttttagcaaactttacttttgttgaaaaccttgtaagtttgggatttcaattattctttgctattagtaagaccttgttcagtccatattaacttagaattggtatagatggctgcttcctgattctgtaagtactttaagatttggctgagtggaaacaactggcatgtttgagcagaccaattattaggcaattttcctaactctgcatctacaagagtttccttatcacttactgaatacccattgtgtctttttcccttaatcgcctgggaggaaccatctatcatcctgtcctgaagggagttcctcctagatctggtcagacctttgtatggtaattaattaagatttagatctcctgttaggaaacctgctgggttaaggatttttgataggaaggctacaggttgtcagtggcctcagtgctttccggctatgcccttgtttacactgacaacaaggtggtattggagtgttataaggttacagagaagaccttcaattatcaattataggttttaaatttacgctagggtacacttttttttttttactacttctatctccttttctctttgacttcttctttgtctctgtctcttcctctctgtctccttctctttgtctctctgtttcttcctctcttctctctttctctgacttcctgtctctttctctctttcctttctgctggtctttccctgcctctgctagccacttatgctgctgttctcccctcttcttcccatttttgatggcttcggctgtgtaagactgccacctccttgggtttttgcactgtgtgcaataactccatggtttccttgtggtatttaatgggggttcccccagaggttagaaactccctttctttccatattgcggcatgggcatgtaggattaggtaagcatacttgctatatgtatacacatttattctttttccgtttcccagttctaaggctcaggtaagtgccactagttctgctaactgggcgctggtccctgggggaagaggcttactttcaagtacagttacatcactaactatggcataacctgcccttcatatcccattctccacaaatgaacttccatcagtatataggttaaggtcaagattagctaaggggacttctaagagatcctcttgggcagcataattctgggctataatttgttggcagtcatgctcaattggttcctcatactctgggagaaaagtggcagggttgagggccacacatgtgcatatttgaagcaccagcccctcaaggaatagtgcctggtatctaagtaggcgattgtctgatagccataaactttctttagcacctaggttgccatttacatcatgagtagtccagacagtgagatcctttccttgtattattttgatagcctctgacactaagacagccactgctgcaactacccataagcaatgaggccagccatttgctactacatcagtttccttacttaggtatgccactggttgtggggttatcccatgagtctgagtaaggactccaagagctatccctgctctctctgtgatgttttgtcctgtgggaaggcttaaagctggagcttgtactagggcctgctttaaggttttgaaggctgtttctgcccctggttcccattctactagatgagtatttgccctctgggtctccttgattagagtatagaggggcctggctatctcgctgtatctggggatccacaatcagcaaaagctggtgatttcaaggaacccctgcaactgttaaatgtcttagggtgaggataagccagtataggctgtatttgttccttgctgagggccctgattcctctggctaagattaggcctagatatttgacctgctgtaggcaaagctgggccttcgacctagatgccttgtacccttgattagctagaaagttcaagagatctagagtagcctgctggcatgaggcttctgaactagtagccaaaagtaaatcatccacatactgaaggaccagagcacctggatttgagaagtggcctagatcttgagccagtgcctgaccaaacagatgagggctatccctaaacccttggggcaagaccatccacgtaagttgggacgtgtggtctgtgggatcctcaaaggcaaagagaaactgagagtcagagtgcaggggaatacagaagaaggcatccttgaggtccagaacagtgaaccattctgcttcctctggtatttgagagagcagggtataggggttggatacaactggatatagaaaaattattgcctcatcgatgagtctaagatcttgcactagtctccattgaccatttggtttttgtactcctagaattggggtgttgcagggactgctgcatttccttactaagccttgagcttttaaatgtttaacaatatcctgtaatcctttataagcttcaggctttaaggaatattgcctttgataaggaaatgtggtgggatcttttaccctgatttggactgggtgggcattttttgcccttccaaattgtccttccaatgcccagacttcaggcttgatttcatcctcaagtaggggacaacaaatgggaaacttgttccccatattcatgtagataatagctccagctttggctaatatatccctccctaataagggtgtgggactttcaggcataacaagaaaggcatgtgaaaagagcaaagtctcccaattacaactgaggaggtgggagaaatacctggttacaggctgtcccaggattcctcagatggtaacggacctggaggacagctgttcaggacaggaaattaacactgagaaagccgcaccagtgtccaggaggaagtcaatttcctggctgtcaatggttaaagttacctggggctcagtgagagtgatgacatgagctgacacttgccccaggcaccctcagtcctgttgttggatcatctggttgggggcttctgtcccagagaagctttgtcctctggggcagtgtgccttccagtgattgccttggcataggggacatggacaagggggcagcttgtttctcattggacaatcttttttaaagtgtccttgcaaaccacactgctaacaagccatactggatgattggcctgctccattttctgtcctctctgaaccaccaaggtttgtttgtctgagggccatgactaagtctgcggcctttctctgatctcacttttccttttgggcctgttcctcttggtccctgttatagaacagtgaggttgccaggtttaataatgcctctagattttgttcagggcacagggctcacttttggagctttctcctgatatctgtggctgattggataataaacttatcttttaggatcaattgacccttgagtgatttgggtgacaggggagtatattttcttaaggccttctgtagccactcgaggaaggcagaaggattttcttcctttccctgagttatggtggacatcagtgaataattcatgggcttcttcctaattatccttagtccttctagaacataggtcaacagatgtttatgactccagtccccatgatctgaattgaagtcccagtggggatccatactggggatggcttgctgaccagtagggaatttgtccctttcttcagctgtcattctatcatttacttaactaagataccaggtacctccaaagtcttgggctgcagctaaagctgcattattttcattaaaggccagggtttgatctaacaatagcatgacatctctccaagtgagattgaagatttgccctagaccctgtaggacatctatgtacctatcaggatcatctgaaaacttccccaggtgtgccttgatctgctttaaatcagagagggagaagtagacatgtacccatgttaggccaaattcccctcccgctacaatttgaaggggacataaccgacagcccaggggagttttgtggtcctttggagatttctttgcttatttccttctgggcaggggagattagaggaggcttgtcactaatacgaaggggagctgtagggaggctaggatatgggggtaagctgaaaggttctcctgtgggatgtaaattgcaacctttgcatagatgtgtattctcctttaatgaaaggaaagcttggacataactatttcactccatttgcctttctcttacagaaaaggtcaagctgcaggatagtattgtaatttgtacttccctcagatggccatttttccccatcagagagagaatattggggccaggccacagtgcagaaaaaaatgagctgcctctttttcagggtttgcaggtcagactggtcccaatggcctaggatgcatttcaagggtgagcctgttgatgcctgtttcccatctgaaagacaaaaccacccacgattttggtgtgtttttcttctccccctgcccaagaatccacaatggtccttgggccctgctgatcggaatagttgcgctcactgatgcagcagcagaaacaacccctgcccaagaacccgtaatggtcactagaccctgctgattggaatagttgcactcaccaacgcagcagcagaaacagtagctttcctcccagaccacaaggagaaccgaggaaggtcggatttagtggcccttaccaacgcattctcaaaaaacctgcacccttgcctgtcctcctagaccacaaagatgaccgagaaaaattggatttagtggcccttaccaacacattctcgaaaacctgttacagtcctaagcattctccttttagtattgggaccttaccaatttcctacaatgatgttatgccccaaaaatgaagtggagggccataccatgagggaaggaagggatctccagggttggaagagtgacaccttttgtcctcacttatatgaataggaagaatacaatttctgaggctccccatatcctagcttcaggaatagcttttattagtcctgcttgtctgaggagggatcctaaaattccagatagcccccctacaacagggctttgggcaaaaattatgtctttctgattagtgagcctaggtgcctaaagaaggtaacagagtcctgaagtttatactagaagtcattcttataggagaaactagaaaagcaccagagacagggagtggtttttagaggtgggactagcctcggagaagagaggcgagaggaagtttgtctgacaggcattaggacccaggaggcaagggtcaggacagataggatagatgggcgagtctcacttgggcgacatgactttgagagttctgctcatggccacaggatcaaccaacttgttgtcaagaccccagagctgaatggctttcctgtcaaccctcgactcagcccagaagtacaggaaaagcggaagctggttccaggcaaactaacgctcccaactccaaaaagtcggggtttgttagagagccccttcccagaaagcctcacacccatgtctttagtccagcacctgcgctagtcgcttttaactggccgacaggtgcccggtatttagcccccaaattctaaggaaaaataggacgaatagcaagcgaaaggggtccgatggtactcaccgcttggtgataggcgatagtctcaccgcttggtgataggcgatagtcccttcgtggtcgccaaaatgtgtccagtattggtgggttcttggtctcactgacttcaagaatgaagctgtggaccctcacggtgagtgttacagttcttaaagatggtgtgtctggagtttgttccttctgatgtttggatgtgtctggagtttattccttctggtaggttcgtggtctcgctgacttcaggagtgaagctgcagatctttgcggtgagtgttacagctcataaaggtggtgcggacccaaagagtgagcagcagcaagatttattgcgaagagtgaaagaacagagcttctacagcgtggaagggaacctgagtgggttgctgctgctggctcgggtggccttttattcccttatttggccccacccacatcctgctgattggtctattttacagagagctgattggtccattttacagagtgctgattgttccgttttagagtgctgatttgtccattttgacagagtgctgattggtgcatttacaaaactttagctagacacaaagtgctgattggtgcatttacaatcctttagctagacagaaaattctccaagtcccctacctgattagctagacacagagcgctgattggtgcatttacaaacctttagctagacacagagtgctgattggtgcatttacaatcctttagctagacacagagtgctgattggtacgtttacaatcctttagctagacagaaaagttcaagtccccacccgacccagaagcctagccggcttcacctctcaatcccataaacaaatttgactccttccccatatccactccccctcttgtgtctccatccttccttccctccctcccatcaaacccagaggacatggacttctgtctcatcttctcctctctgcctccctccctctatcatcctcagttgccttattctgtctctcctccctctgaaatttctcttgattctttttttttttttttgaggcagggtctcactctgttgcccaggctggagtgcagtggcatgatctcggctcactgcaccctctgcctcccgagtccaagcaattctctgccttagcctctcaagtagctgggattacaggcgcccaccaccacacctggctaatttttttgtatttttagtagagatggggtttcactatcttggccaggctggtcttgaactcctaacctcatgatccacccgccttggcctcccaaagtgctgggattataggcatgagccactgcacccggactttttaaaaatttatcgtagagatgaggtcttgctgtgttgcgtaggctggtctcaaactccaaggtcctccagcctcagcctcccaaagagctgggattacagtcgcgaggcactggacccagcctgtgatgaatattaatgccttattaattctttaccaccccctccccacaccatgaggccaggaagggatggtggcatggaggggtggggtgtcaaaaccatccccattttccaaatgcaggaactggggccagtgagctcctgtggtccaggagagggatgtgatttacagctgcagctctggagtttaacaggtccaggttcacatcccagcttcctggccccttgttagtttcctgccatggtgtttttcttttctttctttttttctttcttttttgagacagagtcttgctctgtcacccaggctggagtgcagtggtgcaatctcagctcactgcaacctccgcctcccaggttcaagtgattctcctgccttagcctcccgaatagctgggactacgggcatgtgccaccatgcctggctaattttttgtatttttagtagagacggggtttcaccgtgtcagccagtatggtcttgatctcctgaccttgtgatctacccacctcagcctcccagagtgcggggagtgtaggagtgcgccaccgtgcccaggtggtggtttttttttttttttttctgtcgttccccaggttggaggggcaggaaatgctttgaggtcaaggtggctgcaggaaaaaggatgacattgaagagatgagcccatcattggcagagcctggaaatgaagagggtgtggctagaggaaccccctctcctgcagactggactcaccaccagctccagtgacagtgggctcagaggagatcctctaagcctgctcagtacaggacacaggcaaacaaggaacctggagagggcagcctctagcctccctggcctggcagctgtaggacctacctctacaaagctaaaaagtttgtcacctatacccagccacagccccagggaaacagctgtgtccccagcacctgccaggaagggtcaagacaaggaaatcacagatattttttcttctagcgcaagaacccccaccacctccccaagagacatctataaggaatatttggagggagatactggggcaaaaataaattaacaggccgggcacagtggcttgcgcctgtaatcccaccagtttcggaggccgaggcgggcagatcacttgaggtcaggagtttgagaccagcctggccaaacccatctatactaaaaatacaaaaattagctgggtgcagtgggaggcgcctgtaatctcagctactcgggaggccgaggcaggagaatcgcttgaacccgggaggtggaggttgcagtaagctgagatcgcactaccgcgctccagcctgggtgacagagtgagactcttgtctcggaaaaaaaaaaaaaaaaaattaacagcagctggggttcagaaaatggacagatgtggttttcctcaaatacatgtcctagatgtagggtatccaattattacaatttttattttatttcatatttatttatttattttttagacagaatctcgctctgttgcctgggctggagtgcagtggcactgtatccggaattggggggttcttggtctcactgacttcaagaatgaagccatggacccttgcggtaagtgttccagctcttaaggtggcgcgtctggagtttgtttcttctgatgttcaggtgtgttcagcgtttcttccttctggtgggttcatggtttcactggctcaggagtgaagctgcagaccttcgcagtgagtgttacagctcataaaagcagtggggacccaaagagtgagcagtacaagatttattgcaaagagcaaaagaacaaagcttccacagtgtggaaggggacccaagtgggttgccactgctggctcgggcagcctgcttttattctcttatctggccccacccacatcctgctgattggtagagcccactggtctgttttgacagggcgctgattggtgcgtttacaattcctgagctagacacaaaggttctccacatccccaccagattaactagatacagagtgtcaacacaaaggttctccaaggccccaccacagtagctagatacagagtgtcgattggtgcattcacaaaccctgagctagacacagggtgctgattggtgtgtttacaaaccttgagctagatacagagtgccgattggtgtatttacaatccctgagctagacataaaggttctccaaggccccaccagagtagctagatacagagtgttcattggtgcattcacaaaccctgagctagacatagggtgatgattggtgtatttacaatccctgagctagacaaaggttctccacgtccccaccagactcaggagcccagctagcttcacccagtggatcctgcaccggggctgcaggtggagctgcctgccagtcccacgccgtgcgcctgcactcctcagcccttgggtggtggatgggactgggcaccatggagcatggggcagtgctcgtcagggaggcgcgggccgcacaggagcccatggagggggtgggaggctcaggcatggcgggctgcaggtcccgatccctgccccgcgggaaggcagctaaggcctggtgagaaatcaagcgcagcgccggtgcgctggcactgctgggggacccagtacaccctccgcagccgctgtccggcccgggtgctaagcccctcattgcccggggccagcagggccggacggctgctctgagtgcagggtccgccaagcccacgcccacccggaactccagctggcccacaagcaccgcgcgcagccccgattccggctcgcgcctctccctccacacttccctgcaagctgagggagccagctccggccttggccagcccagaaaggggctcccacagtgcagcggtgggctgaagggctcctgaagtgccgccacagtgggagcccaggcagaggagtcgcagagagtgagcgagggctgtgaggactgccagcacgctgtcacctctcagcgccatctcggctcactgcaacctccacctcctgggttcaagcaattctccggcctcagcctcctgagtagctgggattataggtgcgcatcactatgcccagctaatttttgtatttttagtagaaatgaggtttcaccacattggccaggccagaccagcctggacaatagagtgagaccctatatagggatctcactatatagagcaatacagcgggatcacccgacctcgggtgatccgctcgttggcctcccaaagtgctagtgttacaagtgtgagccaatgcgcccagccctattctttttttttttttttttttttttgaaatcaagtcttgctctgtcacccaggctggagtgcagtggcatgatctctgctcaccgcaacctccacctcccgagttcaagtgattctcctgcctcagcctcctgagtagctgggattacaggcacccgccaccacacccggctaatttttgtatttttagtagagacggggtttcaccatgttggtcaggcgggcctggaactcgtaatgtcagatgatccacctgcctcggcctcctaaagtgctgggattacaggcatgagcgaccacgccatcttttttttttttttttaacaaaacacagatgtagaattagagccttcaggggtgggtgcagtggcgctcacacctttaatcccatcactttgtgaagccaaggcaggaggatcccttgagtctcggtgtttgagaccagcctggacaatagaatgagaccctgcctctacgaaaaaaaaattatttttgttttgagatggagtcttgctctgttgcccaggctggagtgcagtggcgcaatctcggcttatttgcagcctctgcctccttggctcaagtgattcttctgcgtcagcctctagagtagctgggactacagacgtgcaccaccatgctcggctaatttttgtatttttttgtagagatgggggttccaccatgttggcccggctggtctcgaactgctgacctcaagtgacctgcctgtctcggcctcacaaatggctgggattacaggcacgagacaccgtgcctggccctgggaacatgtttacatggactttgttcactttttaaaacaaactgagggtaacttactagatctgtgaactaaagaaagagaaaaaaaagaaagaaaacaaacaagaacaaagaacaaagtgttctgaggttgcttttattccaagaactctgtgagctccgcccagataccattggcgcctgcttgtgtccccaggggacctacacacaacagcaccagcaccatgagggcgctctcgacccacacaagccctggtccccgtcagtcaatgtgactgagtccgccattgaggccagtctggctggccccaagtggtccctctgagtccccaactccctggccagcaaggagtgaagctccatgccccttggtccacgcctctagagtctgagcatatcctgcagcctcgatctcaggaggcaacgcatgcagcccccctgcactcagaaagggggcttctccagtcgtggtcttcttctctgtccacaagtttccagatggcccctccttggagcccctgcccaggcagggaacggccacatcctcgggcagagccaagagtcaccgtctttcgtgggcctgggaccaggcccagccaggacgctaggaggctgcctctgctgccatgggctggatcaacatggtggtggcctgcagcgggtagtagcggccccgccaggtcttccagaagattcccttcttaagcttctgccgctgctgtgggatggagcggaagtactggccgttgaggttggaatggctgcaggtgccaaaccaccagcctcctgccggggtcaggggagagggaacatggtcaggtctttgagccaccgatggggctgaaaggagatagggatagggttgaggatgaggcaggttggggaccaggctgggctttggacttgacttttttttttttgagattgagtcttactctgtcacccaggctggagtgcagtggtgcgatctcagctcactgcaacctccgtctctcaggtttaagtgattctcctccctcagcctcccgagtagctgggattacaggcgcctgccaccacacctggctaatttttggtctttttttttgagactgagtctcactctatctcccaggctggagtgcagtggcacaatctcggctcactgcacctctgcctcccaggttcaagggattctcatgcctcagcctcctgagtagccgggattacaggcacccgccaccacgcctggctagtttttgtatttttagtagtgagggggtttcaccatgttggccaggttggtctcaaactccttacctcatgtgatccaccctcctcagcctcccaaagtgctgggattacaggtatgacccactgcgcctggcctaatttttgtatttttagtagagacagggtttcaccatgttggccaggctagttttgaactcctgacctcaggtgatccacccacctcggcctcccaaagtgctgggattacaggtgtgagcccccacacccggccttatttttaagtttaaaaacaattttttttgagacagggcctggctccattgcccaggctggagtgcagtggtgtggtgatggctcaatgcagcgtcaaccttacgggctcaagtgattcttgtacctgggcctcccaagtagctgggaccacaggtgtgagccaccatgcctgcattttttctttttcttttgaggcaggggtctcactctgtcacccaggcttgagtgcagtggcgcagtctcagctcactgcagccttatctcctaggctcaagagatcctcccaactcagcctcccaagtagatgggaacacaggcaggcaccaccatgcccagctagttttttgtatttttaattgagacaggatttcgccctgttgctcagattggtctcctgggctcaagtgatccactcgcttcagcctcccaaagtgctgggattgcaagtgtgagccaccgtgcctaatttttttttttttttgagaattgcttgaacccgggaggtggaggttgcagtgagccgagatcgcaccactgcactccagcttaggcaacagagtgagaccctgtttcaaaaaaaaaaaaaaaaaaagaatcctgtggagcaccattataaagatgtttgtggccgggtattgtggctcacgcctgtaatcccaacactttgggaggccgaggtgggcagatcacttgaggtcaggagttcaagaccaccctggccaacatggtgaaaccccgtctctactaaaaatacaaaacaattatctgtgcatggtggcgggaacctgtaatcccagctactcaggaggctgaggcaggagaatcacttgaacccaggaggcggaggctgcagtgagccaagatcacgtcacttgcactccagcctgggagacacagcgggactctgtctcaaaaaataaataagtaggccgggcgcggtggctcacgcctgtaatcccagcactttgggaggctgaggcaggcagatcacgaggtcaggagatcgagaccatcctggctaacacggtgaaaccccatctctactaaaaatacaaaaaaattagccaggcgtggtggtgggcacctatagtcccagctactcgggaggctgaggcaggagaatggtgtgaactcaggaggtggagcttgcagtgagccaagatcgtgccacaaagcactccagcctgggtgacaaagtgagactccgtctcaaaaaataaatacataaataaataaataaacaaacacataagtaaataaaagtaaagacggtcaagacccttttcaggatgggaaaactgaggccagataggctaagttagtggcccaatcacacacacggcatgtaaggaagaggtgggggcaggaaacagatgcaatgtggggttgaaggcaggacagagcagcagaaagataaggagggaagctgctggctgggtgtggcatggcagggcctgctcaccagagaggctcttggcgcagttcttgtccctgcggaggtcgtgatcctggtcccaagtggagaagggtacggagaggccgctgggtgggacggtggtggcgcccagctggccggccacgggtgcagtgagctgcaggctataggccgtgtcctcgccacccaggtgcacggagaactgcagcaactcggcgttgccatcccagtcccgcagctgcacggccaggcggctgttgcggtcccccgtgatgctatgcaccttctccagacccagccagaactcgcctggagtgggagaggccactccatgaggcagggccacttctgagggtccctcttcctcccctgcctctgtccccactagaaacacctaccgtggggatccccaaaccccgccttgtaggcttcccagggccggttgaagtccactgagccatcgtggcgcctctgaattactgtccagcctccatctgcccagaaaggtacaaggtcaccaggaagtccctcttcacagacgaccccactccctcatctggctgccaagcaccaaaccccctccaaacccaggaagacagcagctccctcactcatccctggaggactcgaggagggtgggtcagagggaggaatattatgggctggccttgggaagatctttgtcccaagaacccagcagggactgagtgtgggagggagtaggcagtggaaatctgcaaagcctctctgggccagctgaactgggtaaaaccccgtgttgtaacctcttgtaatggaaaggacttctcagtggaaaaaaaagctttctttttttttttttttttttttagagatggagtctcactctgttgcccaggctggatcgcagtgccgcaatctcagctcactgcaacctctgccttcggggctcaagcgattcttgtgcttcagccccacaagcagctggaatcacaggcacgcccggctaatgtttatgttggtagagatagggtttcaccatgttggccaggctggtcttgaacttctgacctcaagtgatttgcccgcctcagcctcccaaagtgctggcatttcaggtgtaagccaccgtgctcagcctttgtttttttttagaaacgaggttttgttgtgttgcccaggttggagtgcggtggctattcacaggtgtgatcacggctcacggcagcctttaactcctgggctgaagtgaccctcctgccttggcctcccgagtagctgggactacaggcatgtgccaccatgcccagcaagggctgaattttattttattttattttattttctcttttttatttttttgatggggggacggagtctcgctctgtcgcccaggctggagtgcggtggcgtcatctcagctcactgcaacctctgcctcccaggttcaagagattctcctgcctcagccacctgagtagctgggattacaggtgcacaccaccatgcccggctaatttttgtatttttagtagagacggggtttcaccatgttggtcaggctggtctcgaactcctgacctcgtgatctgtctgcctcaacctcccaaagtgctgggattacaggtgtgagccactgcacttggcctttttttttacttttacaaaattttttgtaaagatgagctctcactatgttgtccaggctggtctcgaacttctgggctcaagtgatcctcatgataggcctcccaaagtgtcgggattacagatatgagccactacacccagacaagggctgcattttaaagaaaagaggccaggagcagtggctaatgcctataatcccagcattttgggaggccaaagtcggcaaatcatttgaggtcaggagtttgagaccagccagaccaacatggtgaaacccagtctctactaaaaatacaaaaattagctgggtgtggttgctcgcacctgtagtctcagctactggggaggctgacgctggagaattgcttgaacccgggaggcggaggtttcagtgagctgagatcgtggcattgcactccagctccaagagcaaaactccatctcaaaaaaaaaaaaaaaaaaaaagaccagcttgggcaacatagcaagaccctgcctttaatttttttgttttgttttgttttcaatttaaagaaagacaacagggcctatggggagaggggcccctggtggactaacacaccctacctgaggtcatcttgcagttcaccaaaaatggcggagacccctgaggctggatttcaaatagtccactctgcctctccccaacctggaacagctcctggcaatccctgggcagccctgaagggagataaagtggagacttgaaacaggagggcagcccctggggggggtctcaggagccaggcatatctgggggcttaacagtggatgaccagggaagtaaaaggcaaatcttatctcatgaccacctctctgccatctgcctaacctcttccatggctccctatgtccttcctcagcatggtccacaaggcacctggaggaccagcccccgtgcccatcctcctcctgccatgctgtacccacaccctctctggcacacaggctttcttcccacccttgtaccacacaccgtcctgccacagggactttgcacatgctgttccccctgcctgggactctctttttttgttttgttttttgatacggagtctcgctctgtcgccaggctggagtgcagtggcgcaatcttggctcactgcaacctccgcctcccaggttcaagcaattctgccgcagcctccggagcagctgggactacaggcatgtgccaccacgcccgactagtttttgcattatttgtagagacgggggtttcaccatgttggccagactggtctcgatctcctgacctcgtgatccgccagccttggcctcccaaagtgctgggattacaggtgtgaaccactgcgcccggcgggactctctttcctcacttctctctctgggtcccagcttctggaaggacaccctgccttgcctcacccccagaccaggccagaacaccccaaatgggaattgagcaaggacttcccactcctggacactgaggtcatctaatggtctctcctctgactcaatggaggctccatgaggctggggacaaggagcagctctgcccacagcctggcaccagcatccacgcaggccccagcgcatagcagctgctcaataaagacttgaggaatgggccgggcgcagtggttcatgcctgtaatccagcactttgggaggcgggcggatcggtcaggagtttgagaccagcctggtcaacatggccaaaccccatctctagtaaaacatacaaagattagctgggtgtgatggtggacgccagtaatcccagctccttaggaggcagaggcaggagaatcacttgaacccgggaggcagaggttgcagtcagctgaggttgaaccattgcactccaacctgggtgacagagtgagactctgtctcaaaaaaaaaaaagacttgataaatgaataaaaattagctgggcgtggtggcggtaggcgcctataatcccatctacttgagaggctgaggcaggagaatcacttgaacccagtgggaggcagaggttgcagtgagctgagattgcgccactgcactccagcctggacaacagagcgagactccgtctcaaaaagcaaacaaaacagtcttgacaaatgaatgaatgaatgaatgaatgaggcagcaggtccagaacgggaagaactgtgctgagcaggagcatctcagaggctctgcctggggtcccagctcctagagggagaggaggcagggttgaggaaagaaagagggagggaggaggggaggatggcgttgagcacgtctggaggctcagacgctccagactgggaggaaccgcccccagcccagccggaaaagtaggggaaaggtcgaaatgagtctgcacggtgggggtgggggcgggcccagagtgaccaggaagacgctttccggcccctcaggcatctcccctttcccctactttcctcccatccagtaaggatgggcacgcggccaaaccaccagtgtggcttccatgaatgccagctgttcgccttcccagctctgaactttctcctacttggcgggcctgagccaagagtctgggagtcccgaacccacagaacccctgcccccttccaccgcatttcccagccaggacttgtgccttcccccgtcaccctccagaagcccctcatcctgggatggtggctttgggagggtggacaggaccctgaccacgctgagatgctagcctggcggggttgggggcgggcagcacggaggtgggaaggagcgggagcttggggaggagagaaccctcaggtctacagtgctggaagcctgccactgaccctagggtgtgagagggggatccaaactttcacccagttggctgtggacagccacagatgcagggaaggatgaggaccacagagaaaccgtgtggggccgtgaacttagagaaccgcgagtctgcatcggacacacgtggacatgctgtggttcgagatgaacggagatttgggaataaagcacctacaacttgtggtggcagcaaaagcccactttctgcggtggggagggggccggcgggggcggggagggaggaggagaacaagagaggaaggaggaagaggggtcagggacctggagcattggatttgtaagatacaagagtgtttctggtctgggagctgggggttcccagccctaattcccacataccccaagacattgtggagggcccaaatctacaaacactactacctggcaccccctcctccatgacaccctcccctagaaggttctaaccttcaggatggcaccccgaaccccatttctaccttctccagcacccctgcagctcaagtccctcaagacctctttctccacctctgttccaatcagtgatcagcagggcttcagggacagcccactggcttgcagaggagaagggttgggtggcctggctgggccaggtcagggctgaggaaggaggtgctcccatcagctttgacccagagactggtgagccctcagggactccaggccaggacatcttctccttaaggtggacctgacaaggagaggaccagcaatggcaagtggcggggtaggggtggccaccggagagcatcgaggggcagacactcacggtgcaggcggctgacattgtgagccgggtcaactggctgggccatctcgggcagcctctttcttcgggcaggcttggccacctcatggtctaggtgcttgtggtccaggaggccaaactaggatgggacgggaggagggtgtcaggtcctgcctggccccacgtccccagccacacgtccagttctcaccacctccctctcaacctggggtccagctatcagagggaccttttctcccttgatcctagggttacctggctttgcagatgctgaattcgcaggtgctgcttctccaggtgccgctgctgctgggccaccttgtggaagagttgctggatcctgctgttctgagccttgagttgtgtctggggaggggtgaaaaccttggtgaggacccagcttgcctaccccaacctcttaattcatccactcatccatccttccaaatctccatccgctgaggccaggcaagggagtctttcttttttcttttttttcccaatgacggggtctcgttctctcgcccaggctggagtgcagtggtgctgtcacagctcactgcagcctccaactcctggggtcaggcgatcctcctgttttcagcctcctgtgtagctgggactacagtcatgcagctctatgcctggcttattttttattttttcagacagagtctcgctctgtcacccaggttggagtgcagtggcgcaatcttggctcactgcaacctctgcctcccagactcaagtgattcttgtgtctcagcctcccaagtagctgccaccacacctggctaatttttgtatttgtattttattttatttattattattattattttgagatggagtcgagctctgtcgcccaggctggagtgcaatggcatgatcccggctcactgcaacctccgcctcccgggttcaagaggttctcctgcctcagcctccccagtagctgggattacaggcgcccaccaccacacccagctaatttttgtatttttagtagagacggggtttcactgtgttggtcaggctggtcttgaactcctgacctcaggtgatccactggcctcgccctcccaaagtgctgggactacaagcgtgagtcaccgcacctggctttatttttattttatcgctattatttttttgaggagtctcactctgttgcccaggctggagtgcagtgctgcgatctcggctcactgcaacctctgcctcccgggttcaagagattctcctgcctcagcctcccaagtagctgggattacaggcatgcacaccatgccaggctaattttttgtatttttagtagagacgaggtttctccatgttggccaggctagtctcgacagcaggtggaggctccgtgagccactgcgcccggtcgttttttaattttatatttattttattttattttatttattttgtgtgtgtgtgtgtgtgtgtgtagaagagacgggggtctcgctattttgctttaggtggtcttgaattcctggccttgagcgaacctccctcctcggcttcctaaggggggagcccatcccttgacgcagggaagcccagggagccacagttgcgcaccccgcccccacgccccactcctgtccatacccttccaagccaggagagccactaggggcgcggagaaccagccctggggacacgtacctgcaggctgtgaaggacctcagggtccacccggctctcaggggctaacgggaggtcggtggacccctcggttccctgacaggcggacccgcacgcgctcaggcgccgctccagcgcgctcagctgactgcgggtgcgctccgcgtgttcgcgcagcccctggccgagctgcaggagtccgtgcgccaggacattcatctcgtcccaggacgcaaagcgcggcgacttggactgcacgggtccgccctgagcgctcagtagcacggcggtggcggcgcagagcatcagggctgccccggccgtcggagcaccgctcatcctcttaggtagcctgggagcggggattcggggactctcggggacgttggggttccaggtgcgaggactggagacgcggaggaccgggggtaagacccgcttggttgcagaagccgctggaaagaatcggatcacagtcgtgtgaggatccgctcagctcggcttctccccgccgcgcccgaggacggtttttataagttgggtgcggagtgggcggaggagtcttggaggcggggtgcggggagtgctgggggcagggcctgtggccgggggtggggtcctgtcctctggaggcctggtagtctgcgggctgggggatgccctggggatgccaaactgtggctctcccgcccccgctccaggctcaggcaggccttcctctacgaaccgtgggagacgtgactcttctttcccccacggtgcccgcctctagtgtgaaattgcaagccccctattccgcccccgccttacccagtggcggagagggcgcacgcttgaggtcaagacttccagaccagcccggccaacatcgtgaaacccagtctctactaaaaatacaaaaaaaaattagccgggcttggtagtgcgcgcctgtagtcccagctactcgggaggctgaggcagtagaatcgcttgaacccgggaggtggaggttgcagtgcgccgagatggcgccattgcgctccagcctgggcgacagagccagagtacgtctcaaaatgaaagaagagaaaagaaaagaaaagaaagaaaagagagagaaagaaggaaagaaggaaggaaggacggaaaaagaaaagagagagaggtagggagggagggaagaaggagagagagagagaaaagagagagagaaaggaaagagagaaagaggaaggaaggaaggagggaaagaaaggaagaaggaaagaaaggaaggaaaagaaaaagagctgagttcagcggagcccggaactcaccaaaagtccttgccttgcggaggcttcgtgtgacctccatcccaagaccaggagagacttttctgggctcgcatgttccttcccgtgaaagggttcgtcatcgcagctgtgtttatgagattctttgacttccatttctcccctgagcccgaaattatgagtgccttagcggcaggacttggatcagggcctcacccccatagcctaccctctaccgccagggtctttaatgtcctgagctttgcctataataaagcaggaacttagagaacagaaagaggagacacaaggaagggaggaaccagggcggtcgcccatgactgtggtcgcagctacttgggagcctgaggtgggaggctcacttgagcccaggaggtagaggctgcagtgagccacaatggtgccactgcactccagcctgggcaacagagtgagatcctgtctctaaaaaagaaataaaataaaagtctgtggccaggcgcggtggctcacgcctgtaatcccagcactttgggaggccgggtggtgggaggggggggggggcggatcacctgaggtcaggggttcgagatcagcctggccaacatggtgaaacctcgtctctactaaaaataaaaaattagccgggtgtggtggcacgtgcttacagctactcgggagactgtgtcaggagaatcgcttgaactcaggagacggaggttgcagtgagctgagattgcaccacagcactccagcctgggtgacagagtgagactgtgtgtcaaaaaaaaaaaaaaaagtttcagacatggaagaccttcctctttctctccctcattcattcattcactcatgcactgaacgaaggtgctgctgccctctaagcccagcccctgtatgtttgaagttctcaggcaggtggagataccccaacattctgagcctggggtagggatagagttgggacaaaggaagtactgagtgaggctaaagggctggaccacattcattccacagggctaagtgttcattcaaacttgcaccgatctcctctgcctcttccctacccattcccctataccctgtcaggaaggggaggctggcacagaaaaccagcctgccaggaagaactcggggcaggttggctcagagcactggcaaggagaagggcattgactcagcagggctccaagccagctcattctctggaatctgaaactgcacacccaagggctgacgtgcaggctgccactcatacacttggccccgtcagctgggccagatgccaggacagcaaatccctcccagcagcagtggacaggaaagggagggaggaaaaccccagtgaggagtaggttcagatggtcaccgtctggcctgtccacccccaagcccccagcctctctctgagtagggacacagctatcccaggctatcccagaatgcaagctcctcctcttccccaccttcttaaactgagagaactgatcaattacttccccaacctgatgaccttttcatgatctgattttcagggacttctttggagccatgtgtcccacagcacaaaacacatcacagacccagggtcttaagggcacctgctgtgagcaatctacaaaagagtctatactgtcgcctcaagttggctctagattttattctaaaaactgctctttattttttatttatttatttatttatttatttatttatttattttttgagaaggagtctcgctctgtcgcccacgctggagtgcagtggcgcaatctcggctcactgcaagctccacctcccgggttagtgccattctcctgcctcagcctcccgagtagctgggactacaggcacctgccaccatgcccagctaattttttgtatttttaatagagacagggtttcaccatgttagccaggatggtctcgatctcctgacctcgtgatccgcccgcttcggcctcccaaagtgctgggattacaggcatgagccaccgcgcccagcctattttttattttatttatttatttttttgagatggagtttccctcttgtcgcccaggctggagtgcaacggcgcaatctccgctcactgcaacctctgcctcccaggttcaagcgattctccagcctcagcctcccgagtagcggggattacaggtgtgcaccaccacacctgactaattttttgtatttttagtgcaaacggggtttcactatgttggctctgctggtctcaaattcctgacctcaggtgatccacctgtctcggcctcccaacgtgctgggattacaggtgtgagccactgtgcctggcctagccttttttttttttttttttttgagacagagtcttgctctgttgcccaggctggagtgcagtggcctcatctcggctcactgcaagctccacctcccaggttcccgccattctcctgcctcagcctcctgagtagctgggactacaggtgcccaccaccacgcccgctaattttttgtattctagtagagggggtggggtttcgccatgttgcccaggctggtctcaaactcctaagcttaggctatccaccacctcagcctcccaaagtgctaggattacaggcatgagccaccacgcccagccctgttttatgtatttttttttttttttctgagatgggtctcactcacccaggctggagtgcagtgtcacaatcacagctcaccgcaacctcaaactcccaggctcaagtgatcctcccacctcagcctcccaagcagctgggactataggcatgtgccaccagacctgcctaatttctgtagattttgtagagacaggatttttgccgtgttgcccaggctggtcttgaactcctgagctcaagggattcactcgcctcggcctcccaaagtgctgggatgacaggtgtgagtcactgtgcctggccaaaaactgacctttagaatgtggcctcttacccagcaaagacaaagtcatcctgatcaattgttcctggagcacctactatatgccaggcactgtactggggcgatcacggtgggcaagaccgggtctccaatcccaacgcgtgggctactttggccaacatagttaaaaattgttaaaatgaccaattttatattatgtatatttctttttttctttttcttttttttcttttcttttcttttttttttcttttttttgagacagagtcttgctctgtcgccaaggctggagtgcagtggtgcaatctctgctcactgcaacttccacctcctgggttcaaatgattctcctgcctcagcctcccgagtagctgggattacaggtgcccaccaccacgcctggctaatttttgtattttagtagagacggggtttcgccatgtccaggctggtctctaactcctgacctcaggtgatccgcctacctcggcctcccaaagtgctgggattacaggtatgagccactgcgcccagcctgttatgtgtatttcactacaaatgtaaatgccattaagctaggcaaggtggctcatgcttgtaatcccagtactttgggaggccaaggtgggaggactgcttgagcccaggagttcaagattgggtaacatggcaagaccctgtctgtacaaaaaatttaaaaaattagctggggccaggctgggcacggtggctcatgcctgtaataccagcactttgggagtccaaggtgggcagatcgtgaggtcagaagttcgagaccagcctgaccaacatggtgaaacccggtctctactaaaaatgtaaaaattagccaggcgtggaggcgcgcgcctgtaatcccagttactcgggaggctggggcaggagaatcgctggaacccgggaggcagagggtgcagtaagcagagattgcgccactgcactccagcctgggcaacagggcgagactctgtctcaaaaaaaaaaaaaaattagctggggcccggcatggtggctcacacctgtaatcctagcactttgggaggctgaggtgggtggatcacttgagtctgggagttcgagaccagcctggccagcatggtgaaaccccatctctactaaaaatacagaaattagcaggcatggtggtgtgtggccgtaatctcagctatttgtgaggctgaggtgggagattcgcttgaacccaggaggtggaggctgcagtaagcggagatcgtaccattgcactccagcttgggtgacagagcaagactctgtctcaaaaaaaaaaaaaatagctaggcgtggtggcacattcctgtagtatgagctacttgggaggctgaggtgggaggatcatttgaacctgggaagtcgaggctcaaagctacagtgagccaagattgcacccctgcactctagcctaggggacagatcaagaccctgtatccaaaaaataaataaacacacatagagacataaaatataaatatatataatacacacagagacacatacatatgcaatacacataaagatatatatatacatatatggagagagccacacttacatacagagagatacatatatataacatacacaaacaggctgggcagggtgtctcacacctgtaatcctgacactttgggagactgaagtggcaggattgcttgaaatcagggatttcagaccagcctgggtaacaaagtgagaccccatccctccaaaaaataaaagattagggctgggcgtggcggctcacgcctgtaatcctagcactttgggaggccgaggcaggcggatcacctgaggtcaggagttcaagaccagcctggctgacatggtgaaaccccatttctactgaaaatacaaaaaaaaatcagccgggcatggtggcatctgtaatcccagctacttggggggctgaggcaggagaatcacttgaacccgggaggcagaggttgcagtgagccaagattgtgccattgtattccagcctgggtgacaagagcgaaactccatctcaaaataaataaataaatataaaaataaaaaaataaataaaataaaaaattagccaggtgtggtggtgcctacccgtactcccacacgtactcaaggaggccgatgcaagaggacaacttaagctcaggaggtggaagctgcagtctgctatgatcgtaccattgcactcccatttgggcatcagagtgagactctgtcccaaaaaaaaaaaaaaaaaaaaaagaggtctggcacggtggctcaggcctgtaaactcagctcctcgggaggctgagggaggagaatcgcttgaacctggaaggcagaggtggcagtgagctaagactgcgccattgaactccagcctgggtgacagagcaagactccatctcaaaaaaaaaaaaggccgggcgcgatggctcacgcctgtaatcccagcactttgggaggccgaggcgggtggatcacgaggtcaggagatcgagaccatcctggctaacatggtgaaaccccgtctctactaaaaatacaaaaaattagccaggcgtggtggcaggcacctgtagtcccagctactcaggaggctgaggcaggagaatggcgtgaacccaggaggtggagcttgcagtgagccgagatgaggccactgcactccagcctgggcaacagagcgagactctgtctcaaaaacaaaaaaaacaagaaacaaaacaacaacaacacacacacacgtatacgtaatacataagtgcataagtgcatagatagataaaatacactcacatagagacgtattcttatatatttatataatacactcatgcagggtgagataatacacacttttttgtacatcttctttttctgacccacttaaggatatattgcacacataacgtgtgccttttgccctttactaagaaaaaaaagtgtttatataaccgtggtacagctagcaatttcaggaaatttgaccctgacatagtactgttatctaatctatggtccatattccagtttcatcaattgtgtcaagcatgacctgaacagctgtggtttgtgtttctgtttgttttcctttgttttggagacagggtctcactctgtcattcaggctggagtgcagtggtgcgattatagctcactgcagcctccaactcctgggctcaagtgatcctcctgcctcagcctcctgagcagctgggactacaggcacatgccaccacaccaggctaattttggtattttttggtagagacagggtttagttacattgcccaggctggtctcaaacttgaactcctgaactcaggcgatcctcccaccccggcatcccacagacctgggattacaggcatgagccactgtgcctggccacagctgttttttgttttgttttgtttttttaaaaaaaactgagtctccctcttttgcccaggctggaatgcagtggcatgatctcagctcaccacaacctcagcctcctgggttcaagcaattctcctgcctcagcctcctgagtagctgggaatacaggcacacgccaccatgcccagctaatttttgtatttttagtagagatggggtttcactatgttggtcaggccggtctcgaactctgacctcatgatcctcccggatacactataatgtgctaggattacaggcgtaagccaccgcgcccggcctcacagccatgttttttatgagcaggaccctatccagaatcatccactgcatttcattgtcatatcctgttggtcctttttttttttttttttaatctgagacagggtcgttgttatgttgccgaggctggtctcaaatctggactcaagcaatcttcctgcctcagcctactgagtaactgggaatacaggtgcattcgctataccaggcagggcactggcattttttgagacacggtctcactttgtcaccaaggctggagtgcagcagtgagatcacagctcactgcagcctcaacctcctgggctcaagtgatcctcccacctcagcctcctgagtagctgggacaacaggcataagccactatgcctggccaaacactgatattttcgagatgtacacaccggttttttgtagcacgtcctccattttgcatttgtctgatgcagatgtttcttccccttaaggtgcctgttatgtatttttggcagtgatgttgtgtccttctcagtgtatgatatcaggaggcacatgatatctgtttgctcattggcaccatgaatggtgctaagatttaactacataagttgaatcctagatggtcaatgctgcaatggggtaagcacacaggcctagaagagtatagaaaagatgtcaatcccattaggtaaggattcctggagcaggggtcctaagactgagagatgcttgacagagtcctagacaaagtgtacaggaaatagatgactcaggttcaaggaagagcatgaaaaattctctctggcttgagacatgcaggattcttctcagacaagcccacaaggttgttaggactatgtaatggcacatcgtgtccagtgactggcctctaccgcccccagcaactaaccacagtcttcctgccacactgtactcacatccaggtcaccaagaaaggtcagcccaagagcaggacctcaaacactcagggcagaaaggatgactcagaatctgggctggtgctcagaagggaacggggttgcctttccaccctcccctattagcttttccccataattccttccagtctgggaacttgtacattgcagggcagacagctatgaagtcactaaggaaataataactgtagcagcgtacatttatttagtgccacctttacaccatcagacacttgtgtaatccattttatctcaacctcaagtcggtccctgaaaggagataaattgagcttctgagacctttaggaatttggacaaagtcacacagctcagaagggtcaagatttgaacctaggccaggcgtggtggctcatgtctgtaattccagcaatttgggaggctgaggtgggcagattacctgagatcaggagtttgagaccagccaggccaacctggtgaaaacttctctctactaaaaatacaaaatattagctgggcatggtggtgagtgctacctcccagctacttgggaggcggaggcaggagaatcgctctaacctaggaggcagaggctgcagtgagccaagatcgcacaactgcactccagcctgggtgacaaagccagaatccatctcaaaaaaagagataaaaaaaaagatttgaacctagttctctttagttccaaaccattgaatctctctttctgtcttttaagacggtggcgggggagggcacgtggggtggtggtgggatgtcttgctgtgttgccaaggctggattggaactactgggcccaagaaatcctcccatctcagcctgctcactagctggaattaacggtgcccaaaaccgtgacctcttttattttatttttcatttaattttgttgttgttttgtttttgagacggagtctcactctgtcgcccaggctggagtgcagtggcactatctcggctcactgcaagctccacctcctgggttcatgccattcgcctgcctcagcctcccgagtagctgggattacaggtgcccgccaccaggcccagctaattttttgtatttttagtagagatggggtttcaccgtgttagccaggatggtcttgatctcctgatctcatgatccgcccgcctcggcctcccaaagtgctgggattacaggcgtgagccaccgtacctggcctatttttaaagcttgtcattgttttgtaatttacgatttatttatttatttatttgagacagcgtcttgttctgtcacccaggctggagtgcagtggggcgatctcgacttactactacctatgcctcccagcttcagggggttcttatgcctcagcctcctgagtagctgggattacagctgctggccaccatgcccggctaatttttgtatttctagcagagactgggtttcaccatgttgatcttgaactcctgatctccagtgatccacccgcctcggccttccaaagtgttgggattacaggcgtgagccatcgcgcccagcctatttttatttttgggaaattatttttacaacaataagaaaaagctagagatagattcccccactaccccccaccccgaaaattccttctctgtatatacccggtttgacaaccgcggccccggggggtttaccctagatagcagcgccctctggtggtgaactcgagagcagctgttctggccgctcagacgcgctcctttcccgctgatcccaggcgcctgagaggaagttcaaggcctcctggcggctgcccgcccgctgtgggaggctcgagaagactgagtaaatcaagggggaagtggagatgatgacgacgatgatgatttttgagacagagtctcgctctgtcgcccaggctggagtacagtggcgcgatctcggctcactgcaacctacacctcccgggttcaggggattctcctgccttggcctcccaagtagctgggactacaggcgcacgccaccacacccgactaacttttgtatttgtagtagagatgaggtttcaccatgttggccaggctggtctcaaactcctgacttcaagtgatccacccgcttcagcctcccaaattgctgggattataggcgtgagccactgcaccccggttgagacagtcttgctcttggcccaggctgcagtgcagtggcgtgatcatagcttactgtagcctcaaattcctgggctcaatcaattctgccatctcagcatcctgagtagctgggactacgggaacatgctaccatccccagctaatttttaaaaatgtctgctgggtgcagtggctcatgcctgtaatcccagcactttgggaggtcgaggcgggtggattacgaggtcagcagatggagaccatcctggctaatgcggtgaaaccccatctctactaaaaatacaaaaaattagccaggcatggtggcaggtgcctgtaatcccagctactagggaggctgaggcaggggaattgcttgaaccctggaggcggagcttgcagtgagccgagattgcgccactgcactccagcctgggcgacagagcaagactctgtctcaaaaataaataaataaattttctagagacagggtcttgctttgttgcccaggctggtctcaaactctcagcctcaagcaattctcctgtcttagcctctcgaggcactaggattacaggcatgcacaccacaactggccaatgctgtcttttgaagctcctgactggggccaattagctctcatgtcaggggtgtcaatgttctgagacaggccgggcacaatggctcacgcctgtaatcccagcattttgggaggcagaggtgggcggatcacctgaggtcaggaatttgagaccagcctcgccaacatggtgaaaccctgtctctactaaaaatacaaacaattagctgggctgatagcaggtgcctgtaatcccagctactggagagactgaggctgaagaattgcttgaattcgggaggcggagcttgcagtgagctgagatcgcgccactgtactccagccttggcgacagagcgagactgtctcaaaaaaaaaaaaaaaaaaaaaaaaaaaactgttcagagacaggcgcagtctctctgggcagttaagcattccagatgggggcaggggtgccttggagtttccaggaggcccctaaaatggcaaaggagctgaaagtggctcccaaggggttcaatgtattctggagtgcccgggaacctcctccctctctcttttcttttctgactcaagcctcagcctgggacagggtgggagagagaagggtcacattttctaccatgaacacccagggtattaggaatgtgggggaggagggaagttgtttaagaggtctaagagcatcttcctcacccacgcaagcaaaattccttttctttctttctttctctttccttctttctttctttctctttctttctttctatttccgtccctccctctctctctttctttcttttctcccctctttctctctttcttccttccatccttccctccctccctcctttcttcctttttctttccttctttttctttctttctctttccctccctccctctttttctttcttcttttcccccctttctctcttccttccttccttccctccctccctcctttctttctttctttctttctttctttctttgtctctcttttctttctttcttttttttttgacagagtctcgctctgtcacccaggctggagtgcagtggcgcgatcttcgctcactgaaacctctgcctcagcctcctgagtagctgggattacaggtgcacagcaccatgcccggatacattttttagttttagtacagatggggtttcgccatgttggccaggctggtctccaacgcctgacctcaggtgatccgcccacctcaacctcccaaattgctgggcatgcaggcatgagccaccgtgcccggccccttttctttcttatacctctccccactggctagctaggcaggaatactcttcagaaattcttggtctgcagggagcttgaaatcacctttcaatctttccattcagtgaaaatttattgagtgtctactgtgtgctgagcacctgtggtgggattctgagtagctgggattacaggcgcccaccaccacaggctggagtgcaatactgcactctcagcccattgcaacctctgcctcctgagttcaagtgattctcctgcctcagcctcctgaagagctgggattacaggcgcacgccacaatgcccagctaaattttgttttttttttttgagacggagtctcgctctgtcacctaggctggagtgcagtggtgcgatcttggctcactgcaaactccgcctcccgggttcatgccattctcctgcctcagcctcctgagtagctgggactacaggcacccgccaccacgcccgtctaattttttgtatttttagtagagacggggtttcaccgtgttagccacgatggtttcaatctcctgacctcgtgatccgcctgccttggcctcccaaagtgctgggactacaggcgtgagccaccgcgcctggccaatttttgtattttcagtagagacgagggtttcaacatattggtcaggctggtctcgaactcctgaactcaagtgatccgcctgcctcagcctcacaacattctgggattacaggcatgagccaccactctggccgcaatttccaatctccttttctctctctctgtctctctctctctctctctctctctcacacacacacacacacacacacaaacacacacccctctgcttccatcataacaccttctataactctgaccctcctacctttctcttcttttttattttgagacagagtctctgtctttcaggctgaagtgcagtggtgtgatcttggctcactgcaatctctgcttcctgggttcaagagaagtgattctcatgcctcagcctctggagtagctgggactacaggcatgcaccaccatgcctggctaaattttttgtgtgtttttagtagaggaagggtttcaccatgttagccaggctggtctcgaactcctggcttcaagtgatctgtccgcctcagcctcctaaagtgctgggattacaggcgtgagccactgtgccagccataatgattttatgttatgagacagggtctcactctgttgcccaggctgcagtacagtggctcaatcatggctcactgcaacttcgacctcctgggctcaagcgatcctcctgcctcagcttcccaatgtgctgggattaccggaatgtgtcactgcacctggccaataatcaggtttttatcttgcctttcttctctaaaagtgtcactggaaaaccagatagtacataagaagaagtatcttgcataaaaaaaaaaaaaagaattcaactaacaaataaggacgaaatggccaggcgtggtggcacaagcctgtaatcccagctactagggaggctgaggaaggagaatcacttgaacctgggaggcagaggttgcagtaagctgagattgtgccactgcactccagcctgggtgacagagcgagattccatctcataaaaaaaattaaataagtaaataaagaaggaagaaacacaagagatatgacatcactattttgtaatctctaaggagttaattctcgatggctactggactgaggaaaggaggcacagccaaacatcacaagcctcctagtgaaagaacagaacgccatcagtagtcatgtcaaagtaatcaaatctgagtctgaccccagttctagaagcaaccgccaatttgcagggaataccaaggacagaagaacatcctgaactaactacacaatgagtgtaggatcagcaacatttagaccataggaaacacttcaggacaagcagccaattgtgcgatcctttttttttttttccttccttccttccttccttccttccttccttccttccttccttccttccttccttctttccttcctccttcccttcccctcccttcctcccttcctcccttcctccctttctctctttctctctttctttctttctttcacagggtctcactctgtttcccaggctggagtgcagtgatgtgatcacagctcactgcagccttgatcacctgggctcgagcgatcctcccacctcagcctccccagtagctgggactacaggtgcatgccaccatacccagctaatttttgtagtttttgtagagatggggggtctcactatattgcccaggataatctcgaactcctgggctcaaccgttcctgctgcctcggcctcccaaagtgctgggattacaggtgtgaggcaccatgcccaggcatgcaatgcttctattgtaagggaaagggagggatggagaggaacctgtgaattaaaagaggcttaggccgggcgcggtggctcacacctgtaatcccagcactttgggagtcccaggtgggcagatcacctgagatcgggagttccagaccagcctggccaacatggagaaactccatctctactaaaaatacaaaaattagccggacgtggtggcgcatgcctgtaatcccagctactcaggaggctgaggcaggagaatcgcttgaatctaagaggcagaggttgcagtgagccaagattgcaccactggactccagcctgggcaacaagagtgaaactgcatctcaaaaaaataaaattaaaaataaataaataaataaataaacaggcttaggccgggcgcggtggctcgtgccagtaatcccaacactatgggaggctgaggctggtcgatcacaaggtcaggagatcgagaccatcctgaccaacatggtgaaaccccatctctactaaaatacaaaaaattagctgggcatggtggcttgtgcctgtagtcccagctgctctggaggctgaggcaggggaatcggttgaacctgggagatggaggttgcagtgagccaagatcacgccactgcactctaacctggtaacagagcaagactccgtctcaaaaaaaaaaaaaaaaaaacgggcagggggagcttaaaagacatatcattttctttttgaatgggcaagactaaactccagtgtctacagattcacatttggataataaaactatacatgtgcagtggcgctcacctgtctcccagctactcaggaggctaaggatcatttgagcccaggagttccaggctgcagtgagcattgattgcaccactgcactccagcctgaacaatacagtgagactctgtctcgaaataaataaataagcaaacaaacagaaacctacacagggccgggcgtgttggctcatgcctgtaatcccagcactttgggaggccgaggcaggtggatcacctgaagccaggagctcaagaccagcatggtcaacatggtgaaaccccatctctactaaaaatacaaaaaatctggtcatggtagcgggcacctgtaatctcaactactcaggaggctgaggcaggagaatcatttgaacccaggagactgcagtgagctgagatcatgccactgcactccagcctgggcaacagagcgagattctgtctcaaaaataaataaataaataaacaaacaaataaataaaagtcacaaaacagtggttacttagggagtgaggggcagctgtgactaggacatagtccacggaggcgcttctggggtagctggcaagtgcagttggttggcccgggtggaggcgacgatgaccttcatctcagcactgggtttctgaaacttagcactcttgacattcaggccacataattcttggtccttggggatggcctgtgcattgcagggtggttagctacattcctggcctccgccctctagaggccaaaaacacccgcctcctcattacccaaaagtgctcctggatattgtcaaacattctcccatggggcaaaatcactcctggttgagaactaccccctggaggaactccttaaactatacatttgtggggttttttgttgttgttgttggttttgttttgttttttgtttttgttttttacttttaattgcatttattttaatgctgaatttactcccatgccataagtttttgtttcttcagtttcttctgggatatctttttctttcttttttttttttccgagatggagtttcactcttgttgctcaggctggagtgcgatggtgcgatctcggctcaccgcaacctctgccacccgggttcaaatgattctcctgcctcagcctcctcctgagtagctgggattacatgcatgcgccaccacgctcggctaattttatattttaagtagaaatggggtttctccatgttggtcaggctggtctcgacctcccgacctcaggtgatccacccgcctcggcctcccaaaatgctgggattacaggcgtgagccactgcgcccggccttgggatatctttttcttttgggcaacctcctcctctggcttaggaaaaatctgttccttttcagtaagaatcatctcagtgtggcagggagaactcattcatgggttaatccgaccggagttccgtaggtctggcgacgcatcttaggtactttgttcacttggatatgctcaatgaccagagaatctacatataacccttaagttcagcattactctctgcattttttttttttttgagacggagtctcgctctactgcccaggatggagtgcagtggcacaatctcggctttgcaacctccgcctcccgggttcaagcaattctcctgcctcagcctccctggtagctgggactacaggcacgtgccaccacacccagctaatttttgtatttttagtagagatggggtttcaccgtgttggccaggctggtctcgaactcctgacctcaggtgatccgcccacctcagcctcccaaagtgctgggattacacgtgtgagccaccatgcccggccactctctgcatttttaagcatgtacagcaaaaattcagcactttttctgggccactgactttgtgtccagccccactgcttggcctgggcacacctgccaactccaccattgtaatgttggaatggtacacacagtttctgtaaagtgacatctttcagatacttcgtggattttcatatatacatacccttgatggcctgggcagtttcatgagtgttctccaagtgaacatgaagatttgaacctcttgatttgcatgattttgtggggttctctgggtcaagtaaatagcgaaccattttcccagattacctcaggccacttagggaaagagtatacatttgttttatgtggtttcttgaatctgctgtgtgtgtgcatctatggacgctttattttacaactatatatatatatatatatatatatatatatatatatatatttttttttttttttttttttttttgagacagagtttcactctcgttgcccaggctggaatgcaatggctcactctcggctcactgcaacctctgcctcccaggttcaagtgattctcctgcctcagcctcccaagtagctgtgattacaggcatgcaccactacactgggataattttgtgtttttagtagagacggagtttctccatgttggtcaggctggtctcgaactcccgatatcaggtgatctgcctgccctggcctcccaaagtgctgggattacaggcgtgagccaccgcacccggccacaataaaaatattttagggctgggtgcggtggctcacgcctgtaatcccagcactttgggaggctgaggcaggcagatcacgaggtcaggagatcaagaccatcctggctaacacggtgaaaccccgtctctactaaaaatacaaaaacagccaggtgtggtggtgggtgcctatagtcccagctattcgggaggctgagacaggagaatggcatgaacccgggaggcggatcttgcagtgagtggagatcacaccactgtactccagcctgggtgacagagcaagactccgtctcaaaaaaaaaaaaaaattatatatatatatatatatatatatatatatatatacacacacacacacacacatatattttaaacattccaatggaggccaagtgcagcggctcatgcctgttatgccactatttagggaggctgaggcaggagaatcacttgaacccaggaatttgcgaccagcctgggcaacatagagagaccctgtccttacaaaaataagaaacctgctggacgtggtagcacatgcctgtagtcccagctactcgggaggttgaggtgggaggattgcttgagtctgggagttcaaggctgcagtgagccataggtcttgccacagaactccagcatcggcaacagagtaaactttgtctcaaaggaacaaagaagaaaattccaatggagtttctgtggggaaacgcgacagaattccacagttttaactgaaagaatcaaccaattaaaatagcccaggaattttgtttttttttaaaaagtatcagatgttaaaatacattttaaaatattactatattctggccaggtgctgtggcttatgcctgtgatcccagcactttgtgaggccaaggcaggtggattgcttgagccaaggagttgaagaccagcctgggcaaagtagtaaaagcccgtctctactaaaaataaaaaaaattagctaggcgtagcacacacttgtaatcccagctacttgggaggctgaggcaggaggatctctttaacctgggaggcggagtttgtagtgagctgagatattgtgccacagcactctaccctgggcaacagaatgagaccctgactcaaaaaagaaaaagaaaacattatttcagcaaacatttattaagcatctactgtgtactagggtcgctggataaagcagttatcaaaaccagtttcctgttcccatggtgctgacacttaatttagagacagagtctcactctgttgcccaggctggtcttgagctgctgggctcaaaagatcctcccacctcagcctcaggaggtgctaggattacaggcatgagccaccccacctggccttggtgccgacactttagtgagatggcaagcaggtaaaccaataaataaccagccaggcatggtggctcacgcctgtaatcccagcactttgggaggctgaggtgggcggatcacctgaggtcaggagttcgagaccagcctgggcaacatggtgaaaccctgtctctactaaaaatacaaaaattagctgggcgtggtggtgtgcgcctgtaatcccagctacttagaaggctgaggcaggagaatcgcttgaaccccaggaggcagaggttgcagtgagccaagatcgcaccactgcactccagcctgggacagagcgagactctgtctaaaaaaaaattaaattaaattaaaaaataaaccaaataaataactgagtgtttcgtttttgtctttttgttttgttgttttcttttgttttgagaactaggtcttgctatgttgcccaggctggtctcaactcctggctcaagctatcctcccatctatgcctccctaaatactggatttacaggcgtgagtcactgcgcctgccaataacagagtctgcttttttttttttttccagatagtaaaagtagctattaggttaatacaatagagtgatgagaaaaatactaactggggaggggctatgtcaggaatttagggggcagcaacacaaaagctgaacctcagaaagtagggaaggccgggcgcggtggctcacgcctgtaatcccaacactttgggaggctgaggcgggcggatcacttgaggtcaggagttccagaccagcccggccaacatggtgaaaccccatctctactaaaaatacaaatattagctggacgtggtggtgtgtgtctgtaatcccagctactcgggaggctgaggcaggagaattgcttgaacccaggaggcggaggttgcagtgagtgtcactgcactccagcctgggactccgtctcaaaaaacaaaaacaaaacaaaacaaaaaacagtaggggagcctcaaaaagtacctacgtgtacaggtgcaagggaaagcatttcaggtaggtggaacagcatgtgcagaggccctgcggtggggaagatccgggacctgatacttcacccaggcactgcgaaataagtgccagttatagaaatcccaccgggttactcttctactcatagttctcccatggctccctcgtgcctgtggatcaaatccaagctccttggcccggcgctgggcagagacttgacctctgctggtgcagaaatgccgccagccagcgctcggcgaccgtcactccagggcccgccctcagtcaccacccctacattccaggccccgcctgcctgtcccaccccaccgtcccactgggcggcttggagagcctcgggtgctggttggctggcgtggccgtcagttagggcgaaggccttgataatcagtccccggacttcgagggggcgggctcgggtgcgggcgcggctggggctgcggcttcaggtaaattgccagcttgcggggacacggatgggggacccctgggtgggtggattcggggacgcaccgggacccggcgctgcgctgcgtttccagccccactgagggctctgcccgctgcgacggggcgggcgtcgtgtcctctggccgggacccctcccacattggaagtcccaggtgggtagcgagcagagtggggggctctggaggcgtgggcttgcccccctctcgcccttcgggagctcactgcggggctcgttcgctccctaatgccacaaccggccctgggaccctttcccgggacggcctggggaccccagccagcccctcgcgctgggctgggtgtgggagcgtgtcacggaaatggtgttttggggagggacgcacggcccccggacccgcagacaatgggtagcggatggaaccgcccggcggcgcttcctgtaggaaactgctctgtctctgtgcggctaggacgacctgggggtggacgggtgatgatgactttaacacccaccttcctgccgccaccggtcccccacccacccacctcaagagtctgagagtcccagcagacatcaggggctgccagtactcagggcctcctggaaggcgccctctccccaggactgggatcctcactggcctgccgtggcccccaccactccggtttggtgatcacagctctgcgtcccaaaatagtccctggggcgggagagggggcgtgtggcgtcggctctgacggcctaatgagggggtctcaggcacagaatccggatctagctgtgacagtcagggcagggagcggaggagagggaaggcagctaaacgccccacttagtgaggccccagcccctgaagccgcagaggtggtgggcacctccgcccccaatcagagtctgacacaggtgtaggctgggagggacaagccccctgaggctccttggtggttcatgcctgttatcccagcactttgggaggtcaagtagggctgatctcttgaggtcaggagtttgagaccagactgaccaacatgatgaaacccgtctctactaaaaattcaaaaattagccagctgtggtggcaagtgcctgtaatcccagctactcaggatgctgaggcaggagagtcgcttgaaccctgggctcagaggttgcagtgagccgagatcctgccactgcactccagcctgggtgacagagactccgtctcaaaaataaaaataaaagaaagcattcaagtgtagtggccaaagcaaggactctggaagacctgcctgggtttaaaacctgcctctgcctgtttatgacaggacccaggcaggacactaaactgttctgtgtctcagtttctccatctgtacaataggggaagggacaatgatcataggaaatccaacctcagtggatttagctaggattttaaaaaataagtcaaggtcaggtgcagtagctcatgcttgtaatcccagcactctgggaggctgaactgggaagattgcttgagcccaggagttggaggccagcctgggcaatatagcaagacacctgtatctacaaaaaataaaattaggccgggcacggctcacgcctggtttgagaccagcctggccaacatggtgaaactccgtctctactaaaaatacaaaaattagccaggcatggtggtgcacacctgtaatcccagctgcttgggaggctgaggcaggagaatcacttgaacccgggaggcggagattgcagtgagctgagattgtgccactgcactccagcctgggcgacagagcatgactccatctaaaacaaaaaaccaaaaaatttaaaatattagcctgaattagccaggtgtagaggtccattcctgtagtctcagctatttgtgaggctgaggcggatcacttgagctcaggggttcaaggccacagtgagctatgatcgagccactgactccagcctgggtgacagagtgagcgagacattgcctctaaaaaaaaaaaaaaaaaaagtaaatatccataaattccttagactagaggctggcccatagtaaatatcaaaagcgttgttattatttgacattctggagggatccattcctttcttagcccagcctctggatccaactgcttcagctagtttaggtcttaggaatggcccacagctgtcttctgagatcccagggcctgggatttgggtgtgaccaggtcaccggaggaggacgctgaccccattgcgtcatacggccagctgtgtgagaagtagacccagaccccccaacccttgatctggactttttccacaacccagttcttccctggcaatttcctgaaaacaagtgatgaacggcattggctgtcctctgcgatgacccgctggcctgttgatccaccccttgcagctggtgtgaagggacgggaaacagctgcttggggactggaagaggccccctgcctggccttggagtgggaagggagaggtcagggacctcggccagacagaagtgggaaatggagttacggtttccccagcggtggagtagggtaatgagtcaggagggctggtgggtgctcagtgcttcatagcatcaggcacacaggtggtcccagggattcgagaagccagaaggggtggctgggagtgttgccatgtggttagcacagacgggccgtggcccagggagaggatgaagtgggtttggcagatgcctgtcagtggaggactggacaggtaaagggcagtcagaagctgtggcagggacctgctgacaagggttccgcagatgggcagagcccaatctgagggtgcttcccacaggcaactgatttaattgttctgtgcctcagtttctccatctgtaaaatatgaataataatactactttgcagtatgcaaagtgttgtatgggggctgtgtgtgtgtgtgtgtgtgtgtgtgtgtatatatatatatatatggttttttttttttgagacggagtctggctctgtcccccaggctggagtgcagtggcatgatctcagctcactgcaacctctgcctcccaggttcaagcgattctcctgcctcagcctcctgagtagctgggactacaggcatgcaccattgtgtccagctatggcgatgacatttaatcaggaagggcacaccgtaggcactttcccctccctgaaggttttccatgtgggctttccaaagcccatctttcccactccatgttcctgtgcttttcttttcttttcttttctttttttttttttttttttttgagacaaggtcttgctctgtcaaccaggctggaatgcagtggcatgatcataactcactgcagcctgcatctcctggactcaagagatactcctgcctcagcttcttgagtagctgggactacaggtgcatgccaacacatccagctaatttttgtgttttttgtagagatggggtttcgctattttatttatttatttagagacagagcttcgctcttgttgcccaggctggagagcaatggcttgtgagccactgtgcttggtggtttcactatttaaaaacaaacaaacaaaagagatagtggccaggcaccttggctcatgcctgtaatcccagcactttgggatgccgaggtgggtggatcacctgaggtcaggagttcgagaccagcctggccaacatgatgaaaccctatctctactaaaaatacaaaaaattagccaggtatagtagcagtggctgtaatcccagctactcaggaggctgaggcaggagaatcacttgaacccaggaggcagaggttgcagtgagccaagattgtgccactgcactctagcctgggcaacaagagggaaattctgtctcaaaaaaaaaaaaaaacaaaaagagatagggtctcgctatgttgcgcaggtgggtcttgactcctaggctcaagcgatccttctgctttggcttcccagagtgctgagatttcaccctgtgctttttgaaccaaagttctggattcaatatttgtccttgttaaatatcacattattatatgtggcccaatcttcctcactttcttacagcctccatcatgtcatccaaacagtcactttcccaggcagccccatgaatagtcacagctctgacaacccaggtgttttgtgtttgcattacaaactcttacaagccaaggatcaagcctgtgacactccgctagcgacattccagggagacaagtatccgttgatttgttgatttggatctttggtgcatccagcccgcaattccccatcattcctgcaagagtttcacaactgaccttggtaaaaatttggatgcacaattacatccttttttttttttttttttttttttttgagacggaatctcgctctgttgccaggctgaagtgcagtggcgccacctcagctcactgcaagctccgcctcccgggttcacgccattctcctgcctcagcctcccgagtagctgggactacaggcgcctgccaccacgcccggctacttttttatatttttagtagagatggggtttcaccgtgttaaccaggatggtctcgatctcctgacctcatgatccgccctcctcggcctcccaaagtgctgggattacaggcgtgagccaccgcgcccagcctagatgagtttttaatgatcctgtgaagggcttccaactctggtctttctttcctaaaggctcatagtccactacatagagcgtccatttctgattttccccagagattatcagaaaacccagcaggtctggaatgcctccccaactcccagctacccttgttttcttggtcaccttcttctttttgcttgatgtctttcctgcttcctcctgcccagcaggctgacatctgacacctggggatcattcattccatccaaagtttcaaggtcggctaggcacggtggctcatgcctataatcccagtactttgggaggtcgaggcaggcggataacttgaggtcaggagttcgagaccagcctggccaacatggtgaaacctcatctctaccaaaaatacaaaaattagccaggcgtggtggtgggcacctgtaatcccagccacttgggaggctgaggcaggagattcacttgaacccgggagggggaggctgcaatgagccgagattgtggcattgcactccagcctgggtgacagagcgagactctgtcccaaaaaaaaaaaaaaaaaaaaagtttcaaggtttctttagggaagaggaaggagaggccatgtgtggagggaggtggctgggtggaggagagctcttgggtcctgtttgcttagactcaaaggcaggccccagaggctccagccagagggacagcgcccagccccaccttcaccccttttgcagggtgcctctgacagctgctgcaggaaacatggccaagtttgccctgaatcagaacctgcccggtgagtgtgcaaaaagagagatgtgtgtgtgtgtgcgcatgcacagagaaacgcttgatgcccttgtgtgtggacgcagcctacagccctagagtgcagtcctctccaatgtcatgagcctgctttaaaccacctatggcatcaatcatggccgggtgcggtggctcatgcctgtaatcccagcactttgggaggccacggtgggcggatcacttgagatcaggagtttgagaccagcctgggcaacatggtgaaaccctgtctctactaaaaatacaaaaattagccaggcacggctcggtgtggtgactcatgcctgtaatcccagcactttgggaggccgaggcgggcagatcacaaggtcaggaggtcaagaccatcctggctaacacggtgaaatcccatctctactaaaaatacaaaaaattagccgggcatggtggtgcccctgtagtcccagctactcgggaggctgaggcaggagaatggcttgaacccgggaggcggagcttgcagtgagcagagattgtgccactgcactccagcctgggcgacagagcgagactgcgtctcaaaaaaaaaaaaaaaaaaaaaattagccaggcatggtggcgcgtgcctgtagtcccagctactcaggaggctgaggcaggagaattgctggaacctgggaggcagaggctgcaatgagccaagatcgcactacagcactccagtctgggcaacagagcaagactccgtctcaaaaaaaagaaaaaaacaaaacaaaaaacaccccacctatggcactaatcgcaagtggactataccccctgccaccccaggtagccctcaaaccagggaagtgtggcccttgtgcgtccattcctcttccccctgccttctttactctgctcgggacaccctggtctccatctcgctgtgactccagctgaccctcctccctcctaccccagggtatttccatgggctgttttcttctagaaaccttttcccagctgcttcctcctcatcgtgcagggcttcccctcgccaacctttttttttttttttttgagacagggtctcactctgtcacccagtctggagtgcagtggtgcaatctcggctcactgcaacctctgcctcccaggctcaagtgatcctcccacctcagcctcctgagtagctcaccattatgcacagctatgtatatatatgtatatgtgtatatatatatttttggagatggggtctcactttgttgcccaggtttgtctcgaactcctaagctctagcgatccacccgcctcggcctcccaaagtgttgagatagaggcgtgagccactgcgcccggccagggctacttttttttttttttgagaggttctcttctgtcgcccaggctggagtgcattggtgcgatctcggctcacctcaaactccgcctaccaggatcaagtgattctcctgcctcagcttccggagtagctgggattacaggcgcgcgccactaccgcccagctaattttcgtatttttagcagatactgggtttcaccatgttggccaggctggtctggaactcctgacctcaggtgatccgcctgtgccggcctcccaaaatgctgcgactacaggcgcgaaccacacgccgggccagggctccactccacaggaaagtcccctcacaggaaagcttccctggcaaccaaacgctaaatcgggcctcctccgtttattccctgttattattaccattgccgtaggcatcgtttggaaggatgcttatctgctttctacaggaggacagggatgtttgtcttgctcactgctgtgtcccccgggcctagaaacttgcttagcacagagtaggtgctcattaaacaagcgattgagttaatacttgggtacagataggtgtgaagcgtgggcatgggtgggggacacgctcggtttgtttagtatctcccgggtttccccgttctgatgcgccctccccgtgcccccgtcgtgcctccagacctgggcggcccccgcctgtgcccggtccccgccgccgggggcgcacgcagcccgagctcgccctactcggtggagacgccctacggcttccacctggacctggacttcctcaagtacatagaggagctggagcgtggccccgctgcccgccgcgccccgggacccccgacctcgcgccgtccccgcgcgccccggcccggcctcgcgggcgcacgtagcccaggcgcctggacatccagcgagtccctggccagtgacgacggtggagcaccgggcatactctcccagggcgcgccctcggggctcctgatgcagccgctgtcgccgcgcgcgcccgtgcgcaacccgcgcgtcgagcacacgctccgggagaccagccggcggctggagctggcgcagacacacgagcgcgcgcccagccccggccgcggggtcccgcgcagcccacgcgggtccggccgcagcagccccgcccctaaccttgcccctgcttcgcccggccctgcccaactgcagctggtgcgcgagcagatggccgcggcgctgcggcgcctgcgcgagctcgaggaccaggcgcgaacgctgcccgagctgcaggagcaggtgcgcgcgctgcgcgccgagaaggcgcggctgctggccgggcgcgcgcagcccgagccggacggggaggctgagacgcgcccggacaagctcgcccagctgcggcggctcaccgagcgcctggccacctccgagcgcggcggccgtgccagggccagcccccgggctgacagcccagacggcctggctgcagggcgcagcgagggcgcgctccaggtcctcgacggggaggtcgggagtctcgatgggacgccccagacccgggaggtggccgccgaggccgtgcccgagacccgagaagcgggtgcccaggccgtgccggagacccgggaggccggcgtggaggctgcccccgagaccgtggaggcggacgcgtgggtgaccgaggcgctgctggggctgcctgcggccgccgagcgcgagctagagctgctgcgcgccagtctggagcaccagcgcggggtgagtgagcttctgcggggccggttgcgggagctggaggaagcccgcgaggctgcggaggaggcagcggcgggggcccgggcccagctacgcgaggccaccacccagaccccgtggagctgtgccgaaaaggccgcgcagaccgagtccccggcagaggcgccctccttgactcaggagagctcgcccggatccatggacggagacagggccgtggcgcccgcgggtgagtcccgaccccgtcgctgggccctggcttactcggcgccggactcgaactcagtgccctcatctcatccccgccaggcatcctcaaatccatcatgaagaagagagacggcacacctggtgcccaacccagctccggacccaagagcctgcagtttgttggggtcctcaacggagagtgagcgcctttcccctcctgtggcagcttctgccgggacatagactggggttggaaccccagctctgcccctctactggcagcgtggtctgggcaatcctcagtttcctcatcgttaaatgggaacggccacacccacatcgcaggactccagaacgagcccacaggggaggtttagcagacacctcccaccctgcccccaggtacgagagctcctccagcgaggacgccagcgacagcgatggcgacagcgagaacggtggcgccgagcccccgggtagctcctcgggctccggggatgacagcggcgggggatccgactcgggcacccctggccctcccagcggcggggacatccgggaccctgagcccgaggcggaggcagagcctcagcaggtggcacaggggaggtgagcggcgctcgctagttgtttggagaggaggcggctgccctcctcctggtcggcgctgtccccgatccatcctgagtctctcctggcctcctctgcaggtgcgagctgagcccgcgtctgagggaggcgtgcgtagcgctgcagcggcagctgagccggccccgcggagtagccagcgacggcgtgagtgccccgggagcgcagcaccagggagtggcgtgggagcctccaaggacctctgacgcccacttaggggagcacaccgggttccatcccttcccgccaggcacctcgcctgaccccaggctctccgaagggatctccttcccaggacagcgccgatctttccttggtttccccaaaaaggcccggccccagccccactcccggactccccaagggcaagcgttcattgcctttccccgttccatgttctcccgcaaattcttccctggaaggaaaggacccccttcccccgtgtttgccctccgataggggtgtggccccagccctccatctgggttcgcatggctccccacctggacgaggagtgaccttccttacttgcctggaaacgccaaatgggtctcttcccagtcccgcccctccccagctcccccaccacggcgccgccgtggaccatcgccgatgttatcttggcccctgtcccttgcagggcgcagtgcgcctcgtggcccaggagtggtttcgagtgtccagccagcggcgctctcaggcggagcccgtggccaggatgctggaaggggtgaggcgcctgggacccgaactgctggcgcacgtggtgaacctggcggatggcaacgggaacacggccctgcactacagtgtgtcccacgggaacctggccatcgcaagcctgctcctggatacgggtcagagccaagggagggtgggtgggacaccaggaaatgggtggggggagagggcaggggctgacctaggctcaaagactctggagaggaaagcagagaatggctgtccagcacagggcaccactcctccttgagtttattttattttattttaattttattattttattttattttattttattttattttatttttgagacggagtttcacactgtcaccaggcaggagtgcagtggcgcgatctcggctcactgcaacctccgcctcccaggttcaagcgattctcctgcctcagcctcccgagtagctgggactacagatgtgcgccaccatgcccagctaatttttgtatttttagtggagacggggtttcaccatgttggccaggatggtcttgatctcctgacctcgtgatctgcctgccccggcctcccaaagtgctgggattacaggcctgagccactgcgcccagccaacctccttgggttttaaacctcttcctgtctgggttcccaaaggccttctgccctctgagccaggcatggtggctcatgcctttaaccccagcactttgggaggccgaggtgggcagatcacttgaggtcaggagttcgagaccggcctggccaacatggcaaaaccccatctctactaaaaatacaaaaattagctgggtgtggtggtacatgcctgtaattccagctactcaggaggctgaggcacgagaattgcttgaacctgggaggcagaggttgcagtgagctgagatcgtgctactgcactccagcctgggcgacagagtgaggctcagtctcagaaacaaaaacaaaacaaaacaaaaaagcagaaactagctgggcgtggtggtgggaacctgtaatcccagctattcgggaggctgaggtgcgaggattacttgaacccaggaggcagaggttgcagtaagccaagagtgagcaccactgcactccagcctgggccacaatgcaagactccatctcaaaaaaaaaaaaaaaaaaaaaaaaaaaaagaggccttttggccccaccatacccctagttctgccctgaggctcctcctactttgcagctggagggaatacacagttctggacttaggtaaacctcagtttaggggcattatttaatcttgcttgtgaaatggggttggcaaggcctccctccctgggtacctatgataatacaggtagtacgagatcagtaaatggccagcatgtgctctgtccctgaatctccagctggagcactcaccgagttcctgagccccagtgtccagcctggaggggaggtactcaccaggcagggctctgactcctcctgggatggggcactgtgccccacccacctccagctgcttgccctgataaactgggcacaaagggtctggtgggtggtaaacaaatcgctgtccaccaggagccccctccctccaggtaccctcctgcaggttcagaaacctctgagtcagcctttgggcacctctggtactaactgcaggttgaggcgggtcccactgcctgcccccaaccccctaaacacgcagatccctcccatccctgcaggtctttatgacctaggaaaggatatagctgctctggaagctggggcattgtaggagacaggggacagtgaatgaatctaagtgaattttttgggcatctcatgccttaaagggggctggggctgcggcaaggaagtaggcgtcgttggtcactgcaagaggccccaggctccttggcccctttatctcctacatttgaatcccccccccaccccttttttgttgttgttgttttgatatggagtcttgctctgtcgcccaggctggagtgcagtggcatgatctctctgctcactgcaacctacgcctcccgggttcacgccattctcctgcctcagcctcccgagtagctgggactacaggcgcccgccaccacgcccggctaatttttgtacttttagtaaagacggggtttcaacatgttggccaggctcaaactgcttacctcaactcatctgcctgcctcggcctcccaaagtgctgggattacaagcattagccgctttgcccggccttgtttgttttttcgaacagatcttgctctgttgcccaggctggactgcagtggtgcaatatcagctcactgcaacctccacctcccgggttcaagtgattcttatgtctcagcctcctgagtagctgggattacaggcgcgtgtaccacacccagctaatttttgtatttttgtatttttttttttgagatggagtttcgccctttttgcccaggctacagtgcaatggcacaatctcggctcactgcaacctccgcctcccagattcaagtgattctcctgcctcagcctcccgagtagctgggattataggcatgcaccaccacacccagctaattttgtatttttagtacagacagggtttctccatgttggttaggctggtctcaaactcccgacctcaggtaatccgcctgcctcagcctcccaaagtgctgggattacaggtgtgagccaccgtgcccagacaatttttacatttttagtagagatgggtttcaccatgttggccaggctggtcttgaactcctgacctcaagtgatcctcctgcctaggcctcctaaagtgctggtattataggcgtgagccagtgtgcccagcctctaattcccatttggctccacctctccagaccttcccctggttcttactcatctcccctctgcctgtacttgcttgctgtcacatacactaacgcccctgcattcaggggctgtttcctctttcatcccctggaatccagagtctggaggtacgtgggtgtgcactttgctcttcttctccacttccagacctttcaccctcttccttctcaaaccctaccttggagcatcttgtcactgactaggcccctcctcactctgcctctctggcttctacctctgacctcaagtagctcctcctttcttgaactttagctcctggccagttctccctctctccctccagcctaatccttgctgcaaagcaggtccactgtgcactggttaccccttcagcccattgcacctaggaatgtgcttttcctacctgcctgagtctggtaaggtagaatactcattcacataacaagttacacaaagcaggttccttatttacagataggcagcaagggacagcagaagcctaagattgacagtgagccaatcccccaaggctcaggaaggctgcccaaggtgtatggaatctggtctgcaggtgccccacttgcacggcaggtgagggaccctggaaagcggcccactctaggttttataccctggggaacaggaattgctgggctaatgcattaaaggacaacctgtttctagatggggacaggaacagagcctaggctgttccagtcagttcctccttatctcaagattgcatttccagagcattctatagttagtcttttttttttttttttttttttttttgaggccgagtcttgctctgttgcctggctggagtgcagtggtgtgatctcagatctcagctcactgcaacctctgcctcccgggttcgagtgattctcctgcctcagcctcccgagtagctgggattactggcaagcgccatcatgcccggctaatttttgtattttcagtagagacggggtttcaccatgttggccaggctggtctttaactcctgacctcaggtgatctgcccgcctcagcctcccaaagtattgggattataggagtgagcaaccgcacccagccggcacttgtcaatttcctttttttttttttttttgagatggagtctcgctctgtcacccaggctggagtgcagtggcgccatctcggctcactgcaaggtctgcctcccgggttcatgccattctccttcctcagcctccccagcagctgggactacaggtgtccgccaccacgcccggctaattttttttgtatttttagtagagatggggtttcaccgtgttagccaggatggtctcgatctcctgacctcgtgatccgcccacctcagcctcccaaagtgctgggactacaggcgtgagccaccgcgctcggcccacttgtcaatttcaacatcctcccccatgatccctgcaacctcctggctgctctccttccttgaccttgactctgccccacatcagctttacaggtataacatcagccccagaccttgatgtccctaatagttgtgcccgttacagaatctcacttctcagctccccacttcccgaccctcacctcccagcttctcggctcacaggctcccattccccaactccagtaatccttggaccttgcggggacaattacccactgctccctctccgtttcactgcccccaccccttgtctctttgcctctgtcatcctccttcagcctgttgtggattcttctccatacccctctctcacccgaccctacctgcctgcctgacaaacccacagcaaaccgtcaagtgttgaataaatgcctgctcccacagaactttcaggaatgtgtagttttgagtgtgtgtgtgtgtgtgtgtgtgtgtgtgtgtgtgtgtgtgtgtgtggtgggggtggtgagtgaagagtggagagagacgattatcaagtaaaaacgtgaaataatttcaaatgctagtaagggccgtagcagaagacaaccaggggatgaagtcaacaaagggtgattctttttaaatttttttgtaggcatggggtttcaccatgttgctcaggctgatctccaactcctgggcctaattgatcctccctcctcagtctcccaagtagcggggattacaggcgttctccaccacacccggctaatttttgtatttttagtagagatgaggtctcgctctgttgtccaggctgttctcgaactccagagctcaagtgatcctcctgccttggcctccagtgttctggaattataggcgtaagccactgtgcctagccagggtgattctttagttaagcaaggtcaaggtagctgcaagagaaaagggagagggagcaggaagataggtgggtccttggctagcctgcaaggaccccactctggttatttctgggtgctcctccctgaccacctgacgccttacacggtgtcttagtggaaggcatggacacccacacagcatgccacccaaacagggaacgtccccccaacccctttttacagacagctttgttccaggctggggtgtagtggcgtgatgcagcctcaacctcccaggctcaagcgatccttccacctcagcctcctgagtatttgggaccacaggcatgaaccaccacactcagctaattttttttttggcggggagcagagtgtcgctctgtcaccaggctggagtgcagtggtgtgatattggctcactgcaacctctgtctcccatgttcaagtgattctcctgcctcagcctctcaagtagctgggactacaggcgcacaccaccacgcctggctaattttttgtatttttggtagagacggtgtttcaccatgttggccaggatggtcttgatctcttgaccttgtgatctgcctgccttggcctcccaaagtgctgggattacagacgtgagccaccgtgtccggccaaattttttaagagatgggggggtcttcctatgttgctcaggctggcctcagactcctggcctcaagtgatcctcctgccttggcctccctaagcatttgggtgtacaggcgttagtcaccatgcctggcctccatttttgctgtcatttgacttaaccctttactcctcagtccctcatctcagctctccttcctcactaggttatccatctcatgaccccgaccccgctcctttccccaagcttctcattcatttccttaaactacctcaatcctcagagccttcagaatggcaggagacagggattaaaacagccactccaggaaatatcatccaaacaggcactgtgaggaacagggaccaggatggtaacagaactgatcccagaggaaactgagctcacgtttgtgtttcattcaggataggcagtgttgaccaggctgttttgcttcctagggctgccatcaaagtatcactgtgagctgcttcaaacaacaggtggccagacttctgaaatcaaggtgttggcaggtttttttttttttttctgagagatggagtctagctgtgtcacccaggctggagtgcagtggcgcaatctcggctcactgcaagctccgtcccccgggttcatgccattcttctgcctcagcctcctgagtagctgggactacaggcacccaccaccacacccgactaattttttttttttttttgtatttttagtagagacggggtttcactgagttagccaggatgatctcaatctcctgacctcatgatccgcccgcctcagcctcccaaagtgctgggattaaaggcgtgagccactgcacctggctttttttttttttttttttttttttacaacaggtggccagaagtctgaaatcaaggtgttggcaggtgtttttgtttgtttgtttgagacagggtctcactgtgttacccaggctggagtgcagtggcgtgatcttggctcactgcagctcccaggttcaagtgattatcctgcctcagcctcctgagtagctgagattacaggtgcctgccaccacgcctggctattttttgtgtttttagtagagatggggttcaccacattggccaggctggtctcgaactcctgacctcaagtgatcaaccacctcggcctctcaaagtgctgggattacagacgtgagccagtgtcctggcaaccaaattcattttgaattgttgctcttggccaggcgcggtggctcacacctgtaatcccagcactttgggaagctgaggcaagcgaatcatgaggtcggagttcgagaccagcctgaccaacatggtgaaaccgtctctactaaaaatacaaaaattagctgggcgtggtggtgcatgcctgtaatcccagctactcaagtggccaaggcagaagaatcgcttaaacctgggaggcagaggttgcagtgagctgagatcgtgccactgcactccagcctgggcgacagaatgagactccatctctaaataaataaatagttgctcctggctgctgtgtggaacctggagtggattcagagagaagggtggaggctggcactgttctttaggggagcaatgatggtggcttggcgggtggtggccatgaaaataaacatatccttttattattcagtcaacaaatgtttaactgagcatctactatgtgccaagtattgttctaagtactgagggatacagaagcaaacaaaaccaagtccctgcctgatttgaaacagggacttgatttgaaatagccactgggccagtggctcatgcctctaattccagcactttgggaggctacggtgggtggatcacttgaggtcaggagttcgagactagcctggccaacatggtgaaaccctgtctctactaaataatacaaaaattagctgggtgtgatggcacatgctgtagttccagctactccggaggtggagattgcagtgagctgagatcgcaccactgcactccagcctgggtgacagagcgagactatgtctcaaaaaaaaaaaaaaaaaaaaaaaaaagatgaaacaggaaggtccttcactgagcagatggtatttgagcaacaccttagtgagggaggaaccaggtagctattgtggggagaacgttgagaccaccccatatgcaggtgctgtgcccgaggcttgcagggaggtgagtggatcaagtcgggccgcggtgttggcatctccgtggacggcccccttttctctcccaggggcctgcgaggtcaaccgccagaaccgagccggctactcggccctcatgctggctgcactcacctctgtgaggcaggaagaggaggacatggctgtggtccagagactcttctgcatgggtgatgtcaatgccaaggccagtcaggtgcgtgggcgcccccactgtggctctcagccaggagtcacttccactttgggagtcaacctgtgacctcccttccctgagcctaccccagcctgttccctcttcctccccactccccagacggggcagacagccctcatgctggccatcagccatggccgacaggacatggtggcaaccctactggcgtgtggggctgatgtgaatgcgcaggatgcggatggggccacagcgctgatgtgtgccagtgagtatgggcgcctggacaccgtgcggctgctgctcacccagccaggctgtgaccctgccatcctggacaatgtaagaccccacaatggggctggcatcttggggggtgcccatggcttggctcagggatctgactgtccctaacgttccacaggagggcaccagtgccctggccatcgccctggaggctgagcaggatgaggtggccgctctgctacatgcccacctgagctcgggccagcccgacacccaggtgagcacagctctggaagaaacaaactttcccagctgcaaattcagtttgcagaggatagtaaatatgccctgagcctccctttctgctccccaaaggtggcaccaggggtgcagaaccagtgtctggattctcctatgtggctgcttttcttttttgggagacagggtctcactctgtaacccgggttggggtgtagtggtgtgatcagagctcactgcagccacaaactcctgagctcaagggatccttctgcctcagcatcctcaagtgctgggattacaggtgtgaaaccagagcgcctggcaggggctgggatttgatgtgaaagcagcaaaaccccagtgaggttgacactaccccaggtcatgagactgagtcctcaaggggggaagtaacctaaggtcacagagacctagctaagacctttcatgcatgcccctgggctcctgttacctactgccagggaggctcttatcaaaggaaaaaggagccctttggcatcaggcagggtggggaagggggtccagagcttcagaactggagactgggtgagtttgcagaacacattaacccccaacaccactatactctgatggccaagtgccaggatgttttagcactttcataatccaagttatctaatcagcccactcatcctgtacaggttgaccccaatttaccatggctccacttaccattttttatttatttttgagatggagtcttcctctgtcaccgaggctagagtgcagtggggcgactgcagctcactgcaacctccacctctggggttcaagcgattcttctgcctcagcctctcaagtagttgggactacaggcacgtgctaccatgcccagctaatttttttttttcatttgaagacaagagtctcgttctgtcacccaggctggagtgcagcggcacaatctcagttcactgcaacctccacctcccaggttcaagaaattctcctgcctcagcctcccaagtagctgggattacaacagctgtgagccatcgcgcctggcacaacttacaattttttgacttcatgatagcataaaagcaatgtgtgcttagtaaaaaccacacttcagcagagtattcaataaattacataagacattcaatactttattaaaacaggcttcgtgttagacgagtttccccaactacaggctaaggcgttctgaacaagcttaagatggaccatgctaagctgtgatgtttgggagattaggtgtattaaacacatttcaacttgcaatactttcaacctatgatgtactcaccggaatgtaacccattgtaaactgaggaacacctgtactcaccccactggaagggatgtgggaggaaggtcaagcgcctcttccaggtcagaaggggcagaggttggatacaaaccaggcagcctgggtccatggtaaaagaacctccactaagtgaggctggggctgaatcccacgtttcctgcctcaaggagattgcagcaggcccccctcttttcccctctctccagagcgagtcaccccctggctcccagacagccacacctggtgaaggagaatgcggtgacaatggagagaacccccaggttcagtaagctgcctcgtctggctcactacacctagctgtggggagatctcctcgtcagtcacctcagcctttggcgcacagaagggtccagggtcccctgctcagaggctaacactggccgaagagaaaggcaatttcagttggggtgactgtggcaggaaggggctcactctggccccaccaaggtgaggtggggaccaagtgatagagccctgatccacccactctctgaaacttctttgctaataaaacattcctactacgcttgtgttttgtttggggtagagggtgcaatcgacaaacacgaccccccgcctcaaaaaggaaaagcttcgtttggcaagaccgcacggccaggatttccagagtgcggaggatcggtgaccgcctgggagccactcaagaaacctggagaaaccctagtcgtataacccagacaagaacctgagttaacttgaaacacaaacgctttatttaaaggagcatctcagttacgtgtggcggacaaaaaaaaggagcagactgtgacagaccattcccatcggccaagtggtcgaacccgacatccaagaccctgtaaacagacccaaacatgagatgttgacaggccccgcagcaattggcaaactcccgcctccctcttgtcagtctctgtatgtagactctgcctcccaaaccctctcaccctgggcttaacgaagcctccctaccaccaaccaaaggtctatcaaaggggtgtcctctttgcacccaccagcgagcagccaagctcagcgcaacctccgggcttctcgctctgactccaaaagggtgagcacgtcgccctcgcgcacggggccttttacattgcggatgatggatcggctcgtgtcgtccatgaattccacgcgcacctacgggtccccaccggagtggaggaagaagtaagggcgggccgcggaaaggcaccgcggagtgggaagcagatatgaattcagagaacgtgtcggggccagaatacagatcgttaaagggaaccatcagaaccccgtgatgaaatgagaatcggctcccggattccggctggcaggggttagggcagggtagaggtcacatcagggtttaggtcgccggcagtcggccaaatgcccccacccgattacctgcgtgcactgtccctgagaaccggtcctgcccaggaccttggtgacctggaggaaagaagctgggttcagacccggcccgtttggctcctctaatccctccccctgcccccaaattcgggcccccacctcaccctggccagcttgataggctgcacacggctggtgtccatgatggcggcgcggcggcggtctggcggagaggagtcacgtgcttcggggagagcctttataggacgttctagcaccgcccactcccgtctcgcgataccacgccgcgtctttcccagcagccccagcggtggagacgtcaccggctgcgcccttcagtatcgcggacggaagatggcgtccgccacccgtctcatccagcggctgcggaactgggcgtccggggtgcgcggggcggacagggctgcaccatggggggcttcgggctccgtgtgtccgggacccgctcctgctcctcacctccctcctaagccgggacccttcgctctccccgaatctccctgggaacccccagctagtcaccccttcagcccgggaccctctcctggcctgggaaccactcaggcctgggatttccccagtccccgaccttcttagccttggatctgtgggcccggactctggctttgctcttcacctgcaggacccacatccgtttccccgagtgttcatcccctgccttcccttaaaatgcgcatccccggaccatccctggtcccttgccctctcctttcctctctcctggggtgccttgcaggccgacctctcctctcctcttcccacagcatgacctgcaggggaagctgcagctacgctaccaggagatctccaagcggtgagcaggccccgctcgctgcccagcctctggctctgtcctttctccaccaaaaacgaaatctgtgttcctttagacccctgaaacggagggctgacatcctgccaccagtcccctgccaggctgtggaggcagaggtttgcctttaaccttgctgaactccggaggacagccctcctgaaacagcgaggccgggcgtgcattctgactggcaatcaggctagatttgcagtgctcagcgtggccatgttagtcagtgttatccccaagctacagatgaaaaaagaggtccagagaggcgaaatcatttgcctcaagtcactcagaagctaaaaagtggcagcggggacttgaacccagaagtgtcctgatttcagactcatttatattaaaatattagttgatatttacaagcccccgtcatgtatgacctcagccttgggtttaactttgtgaaccaggaaagttcttatccacattctttcatggacgccacattctagggagaagcatagtagggaaacaaacacagcaggtagtattgttctggaatgctttgaagacaaaacaaaataagtggaagctggagggtggctacgtaaagtcagatgattgggaaagatctttctttggaaattgacagttgagtcccctgaatgatgggaaggacccattcaaagaataattattgaaaaaacattctgaccgggcgcggtggctcacgcttgtgatcccagcacttggggaggctgaggcaggcggatcacgaggtcaggagtttgagaccagcctggccaacacagtgaaacacagtaaaaccccctctctactagaaatacaaaaattagccgggcgtggtggcgcgcgcgggtagtcccagctactcgggaggttgaggcaggagaatcgcttgaacacaggaggtggatattgcagtgagctgagatcgcaccactgcactccagcctgggtgacagaacaacactctgtctcaaaaaaataaaaaagaaaaaacattctgagcagagggaacaggaagggctaagagtgtcaggctggacagagcctgagtggaaggaggccagtatggatggaacccattgagggaaagggataatggtataatctatgaagtcaaagggtaggcagaggtaaggcagtcattgaggattataatgaaaggaagaaaaatagcattaaaataatgaaatttatgtaaatgcctatatgttgtgactaattccaaatattagaagtatcaaactttgttttcaacttttttttttttttttttttgagacggagttttgctcttattgcccaggctggagtgcaatggcacaatctcagctcactgcaatctccatctcccgggttcaagcgattctcctgcctcagcctcccaagtagctgggattacaggcatgtgccaccacgcctgactaattttttgtatttttagtagaaacggggtttcaccatgttggccagtctggtctcgaactcctgacttcataatccgcctgcctcggcctcccaaagtgctgggattacaggtgtgagccactgcgcccggcttgttttcaactttaacgttaagttctggggtacatttgcagttttgttacaaaggtaaacgtgccatggtagtttgctgcaaagatcaaagatcaacctatcacttaggtattaagcccagcatccattagctattcttcctgatgctctctcccccccaacccccgacccccctagttggctttctatcagggtagttgtgggccagttgaggaaatggctttgtgaaagttttgacttttttaggatgacggcaccctctagtgattcatctggatgttttattggtctttttttttttttcttttttgagacagagtctcactctgtcgccaagctggagtgcagtggcggatctgagatcactgcaatctccgcctcccgggttcaagtgattctcctgcctcagcctcccgagtagctggggctacaggcgtgcaccaccacacccagctaatttttgtatttttagtagtgacggggtttcaccatgtttgccaggatggtctgatctcttgacctcgtgatctgcccgcctcggcctcccaaagtgctgggattacaggtgtgagccaccgcgcctggccttttttttttttttttttttttttttttgtaagactgggtttctgtgacccaggctggagtgcagtggcacaatcatagctcactgcagcctcgaacttccaggcctaagtgatcctcctggtccagcgtaccaagtagctgggattacaggcacatgttaccgtgcctggctaatttttaaatttttgtatagagacaaggtcttaccatgttgcccaagctggtcttaaactcctggcctctgactgggcatggtggctcatgcctgtaatcccagcactttgggaggccgaggcaggcggatcacaaggtcagaagtttgagaccagcctggccaacatagtgaaaacccatctctactaaaaatacaaaaattagccagcatggtggcacacgcctgtattcccagctacctgggaggctgatgcaggaaaatcgcttgaacctgggaggcggaggttgcagtgagccgagatcgcaccacagcactctagcctgggcgacagagcgagactccatctcaaaaaaaaacaaacaaaaaaaacactcctggcctcaagcaatccttccaccttggcctcccaaggtatgagccaccacatccagcctccttaagcaaagtctttcacataatatattgcttttaatattaaacattttttactttatgtttcttatttttaaaaaatacagtgactaacacttgttttaagaaaaaggccaggagtggtggctcacgcctgtaatcccagcactttgggaggccaaggtgagaggataacttaaggccaggaattcgacatcaacctgggcaacatagcaagacccccgactccacaaaaacaatagaaaaattgtttttagccagatgtggtagtgtgcgcctgtagttccagctacttgagaggctgaggcgggagcattgcttgagcccaggaggttgaggctgcagtgagctatgatcacacctcaagcgatcatatgattgcatatatcatccaggctgcagtgcatatgatcactgcctcagaaaaaaattaaattccgggaaacagttcccagacaaaaaagtgacttagaaacatggctaagtggaaacagatcaatttacggtttttgctgtcttctctcctccctctctctggaaagcccgtcttttgttttgagctttttttgttttttgagatggagtctcgctctgtcgcccaggctggagtgtagtggcgtgatctcagctcactgcaacctctgcctcccaccaccatgcttggctaatttttgtattttagtagagatggggtttgcagtgttggccaggctggtttcgaacacctgacctcaagtgatccacccacctcggcctcccaaagtgctgggattacaggcatgagccaccctgcccatccttgttttgagcatttcttttaaggcctcaggcttccaggtaaatccagcccagggtttagttcaagccaagaccgagctctgttcacccctctctgggctccagagaggagttgcctggccacatggtggcaggaaatgcagagatcttgacaggctccaaggctaaggtgttcttgaataatgggccttgatcctagcagggttctccagagacttcctgagataacaggaaacgcagggcgtccagagcctggctttaggggaaaaagccactcagagtggacaaagtcaagtgaggctggctgccaagctcagccgtggggtggggggcatggggacatgtcccgggccttgggagcctcagaaagggtcctctgtaccctccacatttgggacaggtggggtccctgggggtggcatcttcacatccagagcagggtccaccatctgcttctggccccaggacccctccccaggcatatgtccctgccagtgtaccaagggacacccccagcctgtggcttatcccagtggctggctgtagatcccacattttgtgactgaggtgacaggggcccacagcggggccatgacagtgactgtctctttgcttcagtgctcatcttttttcccctcagaactcagcctcctcccaagctccctgtgggtcctagccacaagctctccaacaattactattgcactcgcgatggccgccgggaatctgtgcccccttccatcatcatgtcgtcgcagaaggcgctggtgtcaggcaagccagcagagaggtgaggatctccagcgctgctcaccacagcccccatgccccctcctgcaacccactctgtctcccaacttgtggaaagggtgcttgtcaagatcctacttagtaagcatcagttgcgcaggaactgtgctgctgggagctttttgtccgagagctcatttactcgtttttagagacagagtcttgctctgttgcccaggatgaagtgcaatggcgcaatcatcactcactgcagccttgaacgcctaggctgaagtgatcctcccctccttccttggcctccccagtaattggtgttacagattagtgccaccatgctgggtcaattttttttttttttttttttttgagacggagtctcactctgtcacccaggctggagtgcagtggtgtgatctcggctcactgcaatctccacctcccgggttcaagcgattctctgcctcagcctctcaagtagctggggttacaagtgcccaccactacacccagctaatttttgtattttcagtagaggcggggtttcaccatcttggccaggctggtcttgaactgaccttgtgatccacccgactcggcctcccaaagtgctaggattacaggcgtgacccaccgtgcctggcctgttttgtttttgtttttgtttttgttttgagatggagtctccctgcgtcgcccaggctgaaggggtgggttgcccctccacacctgtgggtgttcctcgttaggtggaatgagagacttggaaaagaaagagacacagacaaagtatagagaaagaaatcgggtgaccaggggaccagcgctcagcatacggaggatccacccggcctctgagttcccttagtatttattcatcattattgggtgtgatgtgtgagagggggatgtggcaggatcataggataatagtggagagaaggtcagcaggtaaacacgtgaacaaaagtctctgcatcataaacaatgtaaagaattaagtgctgtgctttagatacatatacacgtaaacatctcaatgccttaaggagcagtattgctgcccgcatgtcccaccttcaggcctaaggcggttttcccctatctcagtagatggaatatacaatcgggttttacaccgagacattccattgcccagggaagggcaggagacagatgccttcctcttgtctcaactgcaacagggcattccttcctcttttactaatcctcctcatcacagaccctttaccggtgtcgggctgggggacggtcaggtctttcctttcccacgaggccacatctcaggctatcacatggggagaaaccttggacaatgcctggctttcctaggcagggaaccctgtggccttctgtggtgttttgtgtccctgggtacttgagattagggagtggtgacgactcttaaggagcatgctgccttccagcttctgtttaacaaagcacatcctgcactgcccttaatccatttaactctgagttgacatagcacatgtctcagggagcacagggttgggggtaagattacagattaaaatggagtctcttatgtctactttctacacagacacattaacaatctgatttctctttcttatccccacaccaggctggagtgcagtggtgtgatctcggctcactgcaagctctgcctcccaggggttcacgccattctcctgcctcagcctgcctagtggctaggactacaagtgcccaccactacacctggctaagtttttgtatttttagtagagacggggtttcaccgtgttagccaggatggtcttgatctcctgatctcatgatctgcccgcgttggcctcccaaagtgctgggattacaggcgtgagccaccatgcccggcctccatgctgggttaatttttaaatgtttcgtagagatggggtcttgctttgttgcccaggccgttctcaaactcctgggctcaagcgatcctcctgccttggcctcccgagtagctgggactacaagtgagagtcaccatgctcagcaagagctcatttagtccaacccaggggagggtagaagttagcgcctcagccaggactctgcatcctacaaaacagatgaagtccggggtccctccaagggtcctgtgagaaactgagacattactgttgatataattatgaattcttattttatttatttattttgagacagtctcactcttattgcacaggctggagtgcagtggcgcgatttcggctcactgcaacctccacctcctaggatcaagtgattctcctgcctcagcctcccaagtagctgggattacaggcgcatgccaccatgccaggctaattttgtatttttagtagagatggggtttcaccatgttggtcaggccggtcttgaactcctgacctcatgtgatcctctggcctcggcctcccaaagtgctggaattacaggtgtgagccaccatgcccagccatgtattcttctcagagacagaagtgtataaaccttgggctcctctcaaaaagcagtttggtccctggtttcaggtgtcttctcttaattaaatggggactctaatagcatctacttcagaaagctgttacgagggttagtcctcataattaatatttgtaaactcttggagcctggcacagagtcagtgtcctgcctacctcctaataactccaccagttagatggtgatgacccctcttgcagaagaggaaatcgaggctcacagaagccaagtgactggcctgggccacacaggcagcagtaagcagaagcaggatttcaaaccagttttcctggactcctgttggggtctgggctctacagccaactcacggtgtgggcagtccctcagccttcttgagccttggtttcttcacatataaaatagggatgctagacttgcagtgtgctgagatctgggaggtgatgaggtcaggcagggcctgctctgtacttaaaactctgtgaggtctgggcgcggtggctcacgcctgtaatcccagcactttgggaggccggggagggcggatcaccaggtcaggagatcgagaccatcgtggctaacatgttgaaaccctgtctgtactaaaaatacaaaaaattagccaggtgtggtggtgggcgcctgtagtcccagctattcgggaggctgaggcaggagagtggtgtgaacccgggaggcggagcttgcagctcactgagatcgcgccactgcactccagcctgggtgacagagtgagactctgtctcaaaaaaaaaaaaaagaactctgtgaataggccaggcgcagtggtgtgtgcctgtaatcccagtgactcgggaagctgaggtgtgaggattgcttgagttctagacttgtttgagtaacacagcgagaccccgtctctattagaaattttttaggctgggcatggtagctcacgcctgtaatcccagcactttgggaggccgaggtgagaggatcactaggggtcaggagatcgacaccagcctggccaacagggcgaaaccctgcctctactgaaatacaaaagttaggggcgctgtggctctcgcctgtaatctcagcactttgggaggccgaggcgggtggatcgcttgagcccagaagttcaagaccagcctgagcagcatggggaaaccccatctctacaaaaaatacaaaaattagccgggtgtggtggtgtgcacccgtaggcccagctacttgaagggctgaggcagaaggatctcttgaacctgggaggtcgaggaagcttcactgagctgagattgcgccactgcactccagcctgggtgacaaagtgagaccctgtctcataaataataaacaagaaagaaaatacaaaaattagccgggagtgatggtgcacacctgtaatcccagttacttgggaggctgaggcaagagaatcactcaagcctgggaggcggacgttgcagtgaactgagattgtgccactgcacaccagcctgggtgacagagcaagagtctgtctcaaaaagaaggaactcagtggagtggtccttgttgtcaccttctgattcactggagtccagcaccagagtgtggcaagataccttgttcccacacagccccttgccatgcccccagagatgtgtgcatttcccagggaggccacttctgccttttccatttccttgaggctcctgggaggtcctgtgcctccacccctggggcgcctcctccatcaccccaccctcctgcttcctttcttgcttaggctgtgaagtgtgtgagctccacaggctcaggtgggtggggtgagaggggagggtgctcgtcctggacttgccggcacagggtctcctgggggctccctcttggccagctctgggccagagatgcgttttgcagttgccatttgcgcatggattctcagccccaccagcctgagtcttcctgagggcggtgccccatcttcctggctctgcgcccacacagtagcgcctgccatgcagttcttgcccagtctgaggcaggaatagctggaggccattgtcacctgatcgcttggcccttttgccagcatcctgttttgaggggcagcaggaatgggggtgggggccttgtgtacgctggagaccaaaagtgggaagggaggagcccagctctccacagtgggttctgggcctgggggccacagcagggggttcatacagggctcaggggagagaggaggcttgctagctcccacctggcgttggctgatcctctgaggggctgcgttggaggggttggcattctggaacaccctgctgtctgtcctgcaggtccagaaagtccctgtgggtgtgtttgtcccggggcaggtgtgggctccctcagatctttccacactgttctttggaaaccctcactgaagtctttccctcctccagctctgctgtagctgccactgagaagaaggcggtgactccagctcctcccataaagaggtgggagctgtcctcggaccagccttacctgtgacactgcaccctcacggccacccgactactttgcctccttggatttcctccagggagaatgtgacctaatttatgacaaatacgtagagctcaggtatcacttctagttttactttaaaaaataaaaaaatagagacagagtctcaccatgtttcccaggctgatcttgaactcctggcctcaagcgatcctcctgccttgacctcccaaagtgctgggattacaggcatgagccaccacacctggcctgattttatttttattttttagaccttcccactgaggcctctgcttgaccttggtcaccctgtagctcaacggggaaggcaaaggacagtgagggctgcttacagggaaggcagacctagggcagatcaggaaaggcctccctgagccagaaaccattatgctggggctgtgggatgagaatgagttagctccagaaggaaggcagctggttcctggggaggagatagaaatctggctgcaggagccagagttttcgcgcttgtcacccaggctggaacgcaacggcacgatctcaggtcactgcaacctctgcctcctgggctcaagcaattctgcctcagcctcccgagtagctgggactacgggtgtgcaccaccatacccgctaatttttttttttttttgtagagatggccaggctggtctcaaattcctgacctcaggtgatccgcccgccttggcctcccaaagtgttgggattacaggtgtgagccaccacgcctggcccctgattttaagcaatacccagcttacttggattttggggtgaagtcagtgctgagtctcccaactctgttggcactccaggggtgggacagacactgtccctgggtgcagaggccctggagacagcactgccctttcccccaaaggccaggctctgaccttgagagtggtgggagtgggtgatccttctgggaggttggactcccaggaccgctggctgttggggagcattgattgtgaagaccagtcaggtggggtaaggggtgtatgtgcggacactcagtaggccagccacagacttctcacttcttttttttttttgagacagagtttcgctcttgttgcccaggctagagtacaatggcgcgatcacggctcactataacctctgcctcctgggttcaagtgattctcttgcctcagcctcccgagtagctgggattacaggcgcctgccacaagcccagctaatttttgtatttttagtagagacggggtttcgccatgttggccaggctggtctcaaactcctgacctcaagtgatccgcccacctctgcctcccgaagtgttgggattacaggcgtgagccaccgcgcctggcctaacttccatctcttgagggctcccacagccacttctcacatgaaccttcctcagcaccttcccactgaggctcctgcttgaccatggtcaccctgcagctcaacggggaaggcagaggacagtaagggctgctcacagggaaggcaaacctagggcagatcaggaaaggcctccctgagccagatcccattatgctggggctgtgggataagaatgaattcgccccagaaggaaggcagctggttcctggggaggagacagaaatctgcaaagggagggtgtccaagtctggctgcaggagccacccagtgaccctacgcaggggagtgtcatggcttccccagggcacagccccagacccttcagcagctaaaaaagatcagctgtggaccaagagggtgctgagaccgccctgccctctggaaggggaaaggccacggctacaggcagcaggtaccagtgtcccagagtgggtcctacaaaggctaacaccttcctggagaaggtgggattctgcttggggcaaaaggatgaatcagattcagaaaggtcaggagggaaggaaagactaggcagggtgtgcagaggccacaaggagggcaagaccctaggcaaggcatgccgctgacggcatctgaaccaagttttatgaccacaacttttttttttttttgagacagagtctcactctgtcacccaggctggagttcaatgatgtggtctcggcgcactgcaacctccgcctcccgggttcaagcgattctcccatctcagcctccctagtagctgggactacaggagcatgttaccacacccggctaatttttgtatttttggtagagacgggagttttactatgttggccaggctggtttagaactcctgacctcgtgatccgcctgcctcggcctcccaaagtgctggggttaacaggcgtgagccagcgcgccggccaacttttctaacaaatggggtctcactgtcacccacgctggagtgcagccccaagtgattctcccacctcagcctcctgagtagctgggactacaaattagagccaccatgcccagctaattttcttttttcttgaggcgggcggggacttgctgtgttgcccaggctgatctcgaactcctgggctcaagcgatctgcccgcctctgcttcccaaaatgctgggatcacacacgtgacccaccgcgcccggcctttattattaaatttaattaattaattgatttcctttcctttttcccccccaagcaacccgactccgagaatggacgtttcatttattcatttactcaccaaatgtttactaagagcctactatgagtcaagcactatgtgtcagatcctgagaataaagcagtgagcaacagaagatccctgccctccagtagctagcattctatggggactcggacaacaaaccagaataagtaaataaaataaattacctgtcggcgccacaaaagcagtgggatgagggaggaaatgcggagtgcctgaggggcgtggctgccatattaaagaagatcacgaggcagtaacatttgcagcagtcctcatttggaacgggaaataatgcaaatgaacaccaacaaattccttcccatccccagaagtttctaacttcaagcgggctccatacctttcaactgatctggtcactggggaaagtggggacgggcctctaattctcttttccctgctattctgacatttacggtacgcgtagccgcgggcgccgcagaactcaggggcttgggccccgccccaaccccgcgcgtgcgcgtgcgcagggataagagagcggtctggacagcgcgtggccggcgccgctgtggggacagcatgagcggcggttggatggcgcaggttggagcgtggcgaacaggggctctgggcctggcgctgctgctgctgctcggcctcggactaggcctggaggccgccgcgagcccgctttccaccccgacctctgcccaggccgcaggtgagtgacgccccgcagcgcgggctcccacccctcgcgaggcttcgccccgccgccgcgcaccgacaacgcctagtcactggctgcaccgcacgtcagttcatgacactcccccagcacgtggacttggacttcatcgcttgtgggaaggcgcgcactggtgctaggaagaccccatgctgggggaggggaggagggtgtctccacctgcctttaacggttttgctccggccctgcacaccgtctccacacctgctgtgccctgtcgtcccccattgtcacctccaagccgcccttcataccagcgtggtcaggaaagctcttagcaggctcagattgtccgaccgctaatcacgcaggacgggtcacctggtgcctctcgcacctttgccttccaaaccctcgcgcccaggccttgtgaccgttccgcaaccgtccctgccctcccagtctctcctcctttgtcctccatccttagagaacgcgaggtctctcccccccatgctactgcaggctctcgcagagactggggtcacaagttgaatatacccccgtggacgtgttcgccctggcctaagaggtattggtggccagtggggacgggctccctctctgatacccctagaggcagctggagggttggagtggcctccctgtgcactcaggcactcccaacttgcagccctgggctcaggctcacacactttcccagctcctttgtgcattccgcacttctaggtccctggactcatcccaaagtccctgacattcacgttaaatgttcctgggtttttttttgtttgtttttttttaaggaggcagcgttcacgttaaccaagtacaaaagtttttgtttttttttttttgagtctccctctgtcgccctggctggagtgcagtgcaatgttggctcactgcaccctccgcctcccgggtttaagcaattctcatgcctcagcctcccgagtagcttgggactacaggcaccgtcaccatgcccggctaatttttgtatttttagtagagatggggtttcaccatgttggccagactggtctcgaactcctgacctcaagtgttctgtccgcctcagcctcccaaagtgctgggattacaggacaaaactctatacacagtctcttttttctcaggatgttgaggtagggattcccagcataccccgtttacaggtgaggaaactgaggccaggagagaaagtcactggtcactgtaactcctgtcaggcttacaccctatgaggcggggactgctgtgctctactgtccactttgcagagggatacacactcccgcagtccagcgaagggaggtcagaggtgtcagggctgtggaagtctgcgcctgggtggagagccacacctggaggctgccagatctcccgggggcggggaaggaagcaggcaccggtttgtccacagctcttctgggatccatagagctcagggaccctgtggcaagtaggtgcaattaggcctgaaggccgaggaggggctggcagtggggagtggggggttggaggctcatggctggtgggtaaaggtggaagaggttaaaggccttggcagagtgaagctaagccagggtggcggatttgccacctcccctggccgcacccaggaggaagccgtaaaggccactcccttcctctgtcccttggcccaggttgcgggcccctccgtgcccctccaggtcggcaagcagctgagcttccctgctcagaatctaggacagccgggatcttctctggacccagcttggacccttatgtgacctgtgtccacttataatcaggcactgccctgggtttaggcggccaggtcacagccctgacctccacagaatgtccagtctgtgggtggacaggcatgaccagggctttaaggacagttgttagacatgggaggcagtgcttcctaggtctccaagagggacatgagaaccctcccaggaaatcagctgagatctgaaaattgaggggaaaacacagggtgtagggaggagagagggaaaggcaagtctctggtgtcctaatggaccttggggcctggggcctggggctctggtgaggagctgacacatttaggatggggagagtgataggtctgggaggaattcaggaggcggggcaacaggacttggtgactgagcagattttctacccagtgcctcagtttcccacccactgcctcagtttcccttttgctacgcagaggagatagaccctccctgctgacctgagcccgggagcctgacccagggcatgtggaaaaatggcccgtccctcagtctctttaaccactgagtttggaggtctccctggcagatcatctcgctatgaggagcctggtgaagactctgggatcagcgagacctgagttcgaagcccaactccgctaccagctcttttttttttcttttttgtggtgacggagtctcgttctgtcgcccaggctggagtgcagcagtatgatttcggttcattgcaacctccatctcccaggtttaagcgattctcatgcttcagcctcccgagtagctggcattacaggcgtgcactaccacgcccggctaatttttgtatttttaacagagacggggtttccatgtaggccaggctggtctcgaactcgtgacctcaagtgatccacctgcctcggcctgccaaagtgctgagattacaggcgtgagccactgcacccagcctctgccaccagctgtatggcctcctcttggttcctttctctgtaacctggggagtgcagtagcacctgcccagtggggctcttgagcccaggaactgctacactctgaaccccactcgtactaggggctcagtaacaagcagccgccagtgtggttcctatatcccgggacttcgcctgtctcctgcggatcacagccagtgactactgtgctcttggagaaaggtccagcctccagcttcccaggcttcatttgcatccatctcgcaggccccagctcaggctcgtgcccacccaccaagttccagtgccgcaccagtggcttatgcgtgcccctcacctggcgctgcgacagggacttggactgcagcgatggcagcgatgaggaggagtgcagtgagtggccacgccccttggcggggcttacagggggcggggcctgagggtggtttgtcaggggccaggcacgcggaggtggagcttgtgggaaaggcagggccgcagggatgggtgcgacttgggtctgtgggtcataagaagcggggtctaagatgggcttgggctgggcgcagtggctcacgcctgcaatcccagcactttgggaggctagggtgggaggatcgatcacttgatcctgggaggttgccgctgcagtgagctaggattgtgccagtgcactccagcctgggcaacagagtaagactgtctcaggaaaaaaaaagaaaaagaaaaaaaaaagaaaaatgaaagaaaggaaagaaaggaaggaaagagagagggagggagccaggtacggtggctcacacatgtaatcccagcactttgggaggccaaggcaggcggatcacttgaggtcaggcgttcgagaccagcctggccaacacagtgaaaccccatctctactaaaaatacaaaagttagctggatgtggcggcaggcccctgtaatcccagctagtcaggaggctaaggcaggagaatcacttgaccctgggaggcagaggtttcagtgagtcgagattgcgccactgcactgcagcctgggcagcaaagggagaccccgtctcaaaagaaaaaataaagaaagaaacaaacaaacaaatagaataaagtgggcttgtaggaaggtagagctagtggggtctcaggggaagagcttgcagggaggcctgtccttagaaagtggagttaacagttgcagggggcggagccttaggaagggagcatttttttgggctcagctgttcttagagggtggggcttgcaggggatggggtttcagggagtacctgggccttcttgggtgggcatttgggacctgaccaaccctgtgccccagggattgagccatgtacccagaaagggcaatgcccaccgccccctggcctcccctgcccctgcaccggcgtcagtgactgctctgggggaactgacaagaaactgcgcaactgcagccgcctggcctgcctagcaggcgagctccgttgcacgctgagcgatgactgcattccactcacgtggcgctgcgacggccacccagactgtcccgactccagcgacgagctcggctgtggtatgcacctgcggggctggggtggactcgtgggtagatggggacacccactgcctgctggggcgtggccaggctgggggcgtggacacatgcctttgcccgtgcctgcatccctgtgggggaatcaagacatcattaggggccgggcccggtggctcacgcctgtaatcccagcactttgggaggctgaggtgggcggatcatctgaggtcaggatttcgagacctgcctggcaaacactgcgaaaccccgtctctactaaaagtacaaaaaaatttgctgggcatggtggcacacacctgtaatccgagctactcaggaggctgagtcaggagaaccgcttgaacctgggaggcagaggttgcagtgagctgagattgggccactgcacaccagtctgggtgacagcaaaactctgtctcaaaaaaatttaaaaaaggccgggcacggtggctaacgcctgtaatcctagcactttgggaggccgaggcaggcagatcacctgaggtgaggtgttcgagaccagtctggccaacatggcgaaatcctgtctctactaaaaatacaaaagttagctaggcgtggtggcgtgcacctgtaatcccagctactcgggaggctaagacaggataattgtttgaactcaggaggcagaggtttcactgagccaatattgcgccactgcactccagcctgggtggcagagccagactccctctccaaaaaaaaaaaaaaaaaaagacataattacgggcagtcagcttcacccagcctggttggttgaggataaaccccaagggctcccctgggcatctggccccctcacgccttcagtgctctctcctcaactactgaacgcctgggcttattgcaggaaccaatgagatcctcccggaaggggatgccacaaccatggggccccctgtgaccctggagagtgtcacctctctcaggaatgccacaaccatggggccccctgtgaccctggagagtgtcccctctgtcgggaatgccacatcctcctctgccggagaccagtctggaagcccaactgcctatggggttattgcagctgctggtaagagggacttaccctcccatgctgggggcttagagctccggggattcaggggaggtgggtggggagggatgagctgcagaactcccatccccatgtgtatggagcttggtgggtgtgggggctcttgccttccccctccttactcctctgtccatctgttccccacagcggtgctcagtgcaagcctggtcaccgccaccctcctccttttgtcctggctccgagcccaggagcgcctccgcccactggggttactggtggccatgaaggagtccctgctgctgtcagaacagaagacctcgctgccctgaggacaagcacttgccaccaccgtcactcagccctgggcgtagccggacaggaggagagcagtgatgcggatgggtacccgggcacaccagccctcagagacctgagctcttctggccacgtggaacctcgaacccgagctcctgcagaagtggccctggagattgagggtccctggacactccctatggagatccggggagctaggatggggaacctgccacagccagaactgaggggctggccccaggcagctcccagggggtagaacggccctgtgcttaagacactcctgctgccccgtctgagggtggcaattaaagttgcttcacatcctccgcctgcctctgggtctctgtctcccttggcctgggcagcctggggtcgctgctgcagcccctcctccatgagagcccagcccatagaaggtgggacatggacacccagccctgtgtgcagctactgtgctgcttgctttttgggagcaggggcagcagggctggggtggggagtctgcgttaacatcaggattcttggaagaagagcagagcttgggcagtgccttcccattcccaggtctggggacccccacccactgtggcttcctcctcagtgcagtggaagccaggtttcctgggatggtctcagactcaccctgttttaattattttttaattatgtttttagagactgcgttttggccgggcacagtggctcacacctgtaatcccagcactttgggaggccgagaggtgggcggatcacctgaggtcaggagttcgagaccagcctggccaatatggtgaaaccctgtctctaccaaaaatacaaaaaattggttgggtgtggtggcaggcgtctgtaatcccagctactcgggaggctgagacaggagaatcccttgaacctgggaggtggaaattgcagtgagctgagatcacgccattgtactgcagcctgggtgacagagtgagactctgtctcaaaaaagaaaaaaaaggttttattatttatcctgggcatcatagggatctctgcaaatttttttttttttttttttttttgagacagagtttcgttcttgttgctgggattacaggcatgtgccaccccacctggctaattttgtatttttagtagataaggggtttctccatgttggtcaggctggtcttgaactcccgacctcaggtgatccgcccgcctcggcctcctaaagtgctgggattacaggcgtgaaccactgtgcctggcctatacatttttttttaactagctgtgggtggtggtgtgcacttgtagtctcagctacttgggaggctgaagtaggaggattgcttgagcctgggaggtccaggctgcagtgagccgtgatcaggccactgcattccagcctgcgtgtcacagcaagactgtctcaaaaaacaaacaaaaacaagtaatgtacttgaatcatcctgaaaccatccccacccctggtccgtggaaaaattgtcttccatgaaaccagtccctgctgccaaaaaggttggtgaccggtaaagttaattcacaccctgacttctgggtgacagggcaaagttcctcccttatcctcagcttctgaatctctgaatgggatgttgggggccacagtagcctccttgcaggggagtgacctccctgggaccgttagagatggactcagatggacctgttgcccaggttggagtgcagtagtgtgatcacagctcactgcagccttgaactgggatcaagagatctgcctgggctgggcacggtggctcatgcctgtaatcccagcactttgggaggccaaggtgggcggatcacctgaggtgaggagttcgagaccagcctggccaacatggtgaaaccacatctctactaaaaatagaaatattagccgggtgtggtggcaggcgcctgtaatcccagctacttgggaggctgaggcaagagaattgcttgaacctgggaggcagaggttgcagagagccaagatcctgccattgcactccagcctgggtgacaagagcaagactccatctcaaaaaaaagaaaaatcctcctgcctcagtctcccgagttttgggattacagtcacatgtatcacacccagctaattttttatttttgtaaagtcagggttggtctatgttgcccaggctggcctccaacacctgatctcaaggaattctcccacctcggccccccacagcgttgggattacaggtgtgagccactgcatccagccaggttttttctctaacgttttctctgtcacgagtcagcctcggcggacaacagggtatgtcagggatatgtgtgcccggctgtgaggctggtgtgggtgccacatgccacctaagtggacctctaggctctggaccgtcctgactgtcatgcattcttgttctcagtggagcaaaccgccccatgcccactggctccaaacacctgttgtcgcatcctctctcctggctctgggctgaccaggctcactgggggttcatttgttccatgtgacagtggctgccatcatctgggggccaggctggctggatgtcccatccagaaggtctgtcatgtctgggatagctgacctctccatgtggcctctccacgtggactcctgagcaaggtggccacactcctgccacggtgacttggggttccccaacacacaaagcagagagactgctgggtcaatgttgccgatgctgtattctgtggattcagtggagtccaggtcagcccagatcctgtgtgtgtgtgtgtgtgtgtgtgtgtgtgtgtgtgtgtgtgtgtgagtggggggaacacataagggcctgaacacccttttgagactatctcaaaaacattatttatttatttatttatttatttatttatttttgagacggagccttgctctgtctacctggctggagtgcagtggtgcaatctcggctcactgcaacctctgcctcccgggttcaagcgattctcccgtctcagcctcctgagtacctgggactacaggcctgcactaacacatcaggcgaatttgttttctatttgtagtagacacggggtttcaccatgttggccagactggtctcgaactcctgacctcaggcaatccgctcacctcggccttccaaagtactgggattacaggcgtgagccacagtgcctggccaaaaaaaactttttttatttttctttttttaaagtctccctcctccccctcgcctttttttttttttttttttttttttttttttttttttggtggagtttccctcttgttgcccaggctggagtgcaatggctccatctcggcaaactttgcctcctgggttcaagtgattctcctgcctcagcctcccgagtagctgggattataggcatgtgccatcatgcctggctaattttttgtatttttagtagagatggggcttctccatgttggtcaggctggtctcaaactcccgacctcaggtgatttgcctgccttggcctcccaaagtgcaggggttacaggcgtgaaacaccacgcccgcccccctcccctctgcctttttttttttttttttttttttttagagatgaggtctttctacgttgcccaggctggtctcttaactcctcagctcaagtgatcctcccaccctagcctcccaaagcactgggatcacaggtgtgagccatggtgtccgctgttacccactcttaaggggattgtttgagactaatgagtcctttctctgcgggttgccatttgcaccaacagaacaagaccaggttcagtaaagcaagatagaaactttattcgtcaatcaatgaatggagaaagggaggaactcctgctcaaagtgcctactccctgcaggtgtgatgaggggagttttaaagtttcctagggcatgtagatgcagactgggggtggggattcctggaaagaggtggggctttctagggggcactgaagtgttcagcctttcttttcttttgtacctggcattatatgtgcttagcaaagtgcacctctccccactgaagactttttttttttggtttttctgtttttgagacagagtctcgatcagtcacccaggctggagtgcagtggggcgatctcagctcactgccacctccgcctcccaggttcaagcaattctcctgccttagcctcctgagtagctgggattataggtgtgacccaccgcacccagctttttttttttttttttgaaacagcacctcactctgttgctcaggctgaagtacagtggtgcgatcgtagctcactgcagcctcgaccttctgagctcaagcaatcctcctgcctcagcttcccaagtaggtgggactacaggcatgcatcaccacgcccggctaatttttacattattttttgtagagagagggtctttttttttttttttctgagactgagtctcgctgtgtcgctcaggctggagtgcagtggcacaatctcagctcactgcaacttctgactctcgggttcaagcaattctcctgcctcagcctcctgagtagtacaggcgcgtgccaccacacccggctaattttttttttttttgtatttttagtagagacagggtttcaccatgttggccagggtggtctcaaactcctgacctcgtgatctgcccaccttggcctcctgaagtgctgggattacaggccaagagagggtcttaccatgttgcccagggtggtcttgaactctctgacttaagcaatcctccctcctcacactcccaaaatgctgggatgacagcttggagccattgtgccctggctgtggagattttactctgcccatggagtgaggattcaggcagatggagcactgctgaggtcagctctcatcttgtggctcagttgtggttaatggcatccggccttcatgcctgtaaactagcacagctgtgagcaggggttaatttctttttttttgagacagagtctcgccctgttgcccaggctggagtgcaatggtgtgatctcggctcactgcaacctctgcctcccaggttcaagcatttctcctgcctcagcctcctaaatagctaggattacaggcacacaccaccatgcctggctacttttttgtatctttagtagacaccaggtttcaccatgttggccaggctggtctcgatgtcctgacctcgtgatccacccgcctcagcctcccaaagtgctgggattacaggtgtgagccaccatgcccggccagagcagagattaatttcacaggttctggggctccctaaaagaatggatgttatagtccgggtgtggtggcttacgcctgtaatctcagcactttgggaggctgaggtgtgggggatcacttgaagtcaggagtttgagaccagccgcctttctcaccctcccaaagtgcttggatgacagctgggagccagtgcaccctggctgtggagattttattatgccagtggagtgaggaatcaggcctatggagcactgctgaggtcagctctcatcttgtggctcatttgtggttattggcacttggcctttgttcctgtaagctagcacagctgtgagcagcggttaatttctttttttttttttttgagacagagtcttgctctgccaccaggctggagtacagtggcgcgatctcggctcactgcaacctccgcctcccgggttcaagtcattttcctgcctcagcctcccaagtagctgggattacaggcgctcaccaccacgcccagctaatttttgtatttttagtagagacagagtttcactatgttggccaggctagtctcgaactcttgacctcaggtgatccacccaccttggcctcccaaagtgctgggattacaggcgtgagccaccatgccaggccggatacagggtctttaaaggggtgattaaggccaggtgtggtggctcacacttgtcatcccagaacttcaggaggctgaggtgggtggattgcacaaggccagcagtttgaaaccagcctgggcaacatagggagagcctgcctctactaaaaatacaaaaaattagctcggtgtggtggtgcacacttgaatcccagctactcaggaggctgaggcacgagaaatacttgagaacaggaggcagaggttgtagtgagccaaagatcccaccactgcactccagcctgggcaaaagagtgagagtctgtttcaaaaaaaaaaaaaaaaagcctaagtgtggtggctcacgcctgtaatcccagcactttgggaggctgaggcaggtggatcacctgaggtcgggagttcaagaccagcttgaccaacatagtgaaacccgtctctactaaaaatacaaaattaggtgggcatggtgacacatgcctgtaatcccagctacttgggaggctgaggcaggagacttgcttgaatctgagaggcggaggttgcagtgagccgagattgtaccattgcactccagcctgggcaacaagagggaaactccgtctcaaaaagaagaaaagaaaaaaaatttttttaattagcaggacttggtggtgtgcacccgtggtcccagctactcaggaggctgaggtgggaagattgcttgattccaggaggctgcactgagctgttagcgccactacactccagcctgggagacaaagcaaggccctgtctcaaaaaaaaaaaaaaaaaaaaaaaaaaagcagctgctgagaggtgacagcgtgctggcagccctcgcttgctctcggtgcctcctgggcctccgcgtccactctggccgcgcttgaggagctcttcagcccaccaccgcactgtgggagtccctctctgggctggccgaggctggagccagctccttctgcttgctaaaggtgtggagggagaggcgcgggcgggaacccgggctgtgcgcaaggggctcgtgggacagcgcgagttccgggtgggcgtgggcccccgcactcagagcggacagccggtgccaccggccccaggcagttgaggggcttagcacccgggccagcagctgtggagggtgtgccgggtcccccagcagtgccggcccgccagcgctgcactcgaattctcgcggggcttcagctgcctcccggctgggcagggctcaggacctgcagccccccatgcctgaggcttccccctgccctgggctcctgctccgcccgagcctccctcatgagcgccacccactgctccacgacgcctggtcccatcgactgcccaagccaagagggctgaggagtccaggcgtgtggcaagggactggtgggcagctctacctctgaccccctgcgggttccactgcctgaagccagctgggctcctgagtctagtggggacttggagagcctttatgtctagctgagggattgtaaatgcatcaatcagcaccctgtgtctagctcagggtttgtaattgcaccaatcagcactctgtatctagctaatctggtggggacttggagaacctttatgtctggctaagggattgtaaatacaccaatcagcactctgtgtctagctcaaggtttgtaaatacaccagtcagcaccctgtgtctagctcaaggtttgtaaatgcaccaatcagtgctctgtggggacttggagaacttttgtgtctagctcggggattgtaaacacaccaatcagcaccctgtcaaaatgggccaatcagctctctgtaaaacagaccggtcagctctctgtaaaatggaccaatcagcaggatgtgggtggggccagataagggaataaaagcaggttgccccagctagcagtggcaacttgggttgtctttcatgctgtggttgctttgttctttttctctttgcaataagtcttactgctgctcgctgtttgggtccacactgcctttatgagctgtaacactcactgcaaaaggtctgtagctacactcctgagccggaaagaccacgaacccaccagaaggaggaaactacgaacacatccgaacatcagaaggaacaaactgtggacacgctgcctttaagaactgtaacattcaccgcgagggtctgtggcttcattcttgaagtcagtgagaccaagaccccaccaattctggatacactgctacatcgggtcctcatccaatctgcctggtgtccctacaagaagaagaaatatggacactaagaaatacgaagggtgcatgcagagaagagagcatgtgagggcacacaggaggcggccgcggctctgtaagacaaagcaagggggctcagtagaaaccagctctgggccgggtgcggtggctcacgcatgtaatcccaggcgtgatcatttgaggtcaggatttagagaccatcccggaaatacggcaaaaccccatctctactaaaaatagaaaaattagccgggcgtggtggtgggcgcctgtaatcccagctactcgagaagctgagggacgagaattgcttgaacctggggctactctggaagctgaggcacgagaattgcttgaatctgggaggtggaggttgcagtgcaaccaagatggtgccactgcactccagcctaggtagcagagcaagactccgtttcaaaaatgaaaagcagaaaccaaccctgatgacatcttaatcttggacgtcagcctccagaaatgtaagtttctgtttttaacctacccaagctgtggtattttgttatggccaccctagcaaactgaagctagtatgatagctcagaaactctttttttcatttttttcttccttagagacagggtcttgctttggctcccaagctggagtacggtggtgcagttatagaattatagctcactgtagcctcaacctcccaggcttaagagatcttcccgcctcagcctcctgattagctgggactacaggtctgcgccactgtgcccagctaatttaaaacaaaacaaaaaaatgtttcatacagattggtcaacatggccagaccccgactggtaaaagctggttaaaaaagatacttgttgatggtcaggtgcagcggctcacacttgttatccaagcactctgggaggctgaggcatgaggactgtttgaacccaggtgttggagatcagcctgggcaatatagtgagatctcatttatactaaaaaacaaacaaaaaaaatagctgggcatggtggcacatacctgaagtttctgtagttgcagctacttaggaggctgaggtgggaggattgcttgagcctgggagatggaggctacagtgagctatgatcacccattgcactccagcctgggcaatggagcaagatcctgtctctagaaaacaacaataaaatatatctgttgaatgctactatgtatcagtgctgttcctggttctaaccatgaacaaaatagccctgaaaaaatagggctgagcccggtggctcacatttgtaatctcaggactttgggagatcaaggcaggtggatcgcctgaggactggagttcgagaccagcctggacaacatggcaaaaccccatctctactaaaataaattagcagctgggtgcactggttcatgcctgtagtcccagcactttgggaggctgaggtgggcagatcacctgaggtcaggagttctagaccatcctggccaacatggtgaaaccctgtctctcctaaaaatacaaaaattagctgggtgtggtggcaggcgcctgtaatcccagctacttgggagactgatgctagagaactgcttgaacccaggaggcagaggttgcagtgagccgagatcttgtcattgtactccagcctgggtaacaagagggaaactgtctttaaaaaaaaaaaaaaaaaaaattagctggatgtggtgtagtgcatgcctgtaatcctagctactcaggaggctgaggcagaagaattgcttgaacctgggaggcagaggctgcagtgagccgaaatccgccaatgcactccagcctgggtgacagcaagttcctgtctcaaaaaaaaaaaaaaaaaaaaaaaaaagctggtgcggagattcactcctgtaatcccagcactttgagaggtcgagaccagcctggccaacatggtcgaacccggtctactaaaagtacaaaactagccaggcatggtggtgcatgcctgtaattccagctactcaggaggctgaggcaggagaatcgcttgaacctgggaggcaagaggctgcagtgagccgaggtcatgccattgtactccagccagggcgacagagcgagactctgtctcaaaagaaaacgaaagagctgggcgtggtggttcacgcctgtaattccagcactttgggaggctgaggtgggtgggtcacctgaggtcaggagttcgagaccagcctgaccaacatagtgaaaccccgtctttactaaaaatacaaaaaattagccgggcgtggtggcagacacctgtaatcccagttactagggaggctgaggcaggagaatcgcttgaacccgggaggcggaggttgcagtgagccaagattgcaccattgcactccagcctgggcaacaagagcaaaactctgtctcaaaaaaaaaaaaaaaaaaaaaaagagaaggtgtttctggttgcagtggggagaacagaacctgcagggagaccagggaggggacaactgcactgatccccagaagtcaggaaggggctggacctagctggcaagtgcaggtggtcagtgataactggcttctaggtctgttttgaaggaaaaggcgatgggggctgtaggattggcagacacattggatgcaggtgggaggaggcgtggatgcctcagaactgtcagagcagagcctgggaagatggtgctaactgagagggagaggacgctcggacaaggcttgggtgggaaacccctaggagtccagattgggacctgcaacactggagcggcctgcgaggaccccttgtggcagaggctgagaaggcactggaccctagggtttgggctagaatgatgaatttgggaattggcccagttgggcgtctgtgggctggagaggagtgaatgcagccaaaccttagatgttttggagctaaggaagaatcagaaaacagatgaaaagttgggtgcggtggctcacgcctgtaatcccaacactttgggaggttgaagcgggcagatcccttgaggtcaggagttcaagaccaccctggccaacatggtgaaacccggtctcttgtaaaaatgaaaaatttagccgggtgtggtggcgggtgcctgtaatcccagctacacgggtggctgaggcaggagaatcgcttgaacctgggagaaggttgcagtgagcagagatcatgccactgcactccaacctgggcaacagagcaatattctgtacaaaaaacaaaacaaaatgaaaaagagatggaagcggggcatggtggctcacatgtttaatcctagctagttgggaggctgagatgggaggattgcttgagtcccggaggtcaaggctggagtgagctattattgtaccactgtgctccagccagggcaacagagtgagaccctgctgtatcttaaaaaggaaaaagggttgggcgtgatggttcacgcctgtaatcccagcactttgagacgccaaggtgggtggatgacttcagcccgaaaatttgagaccagcctgggaacatagtgagacctcatctctacaagaaatacaaaaattatttgggtgtggtggtgcctgcctgtagtcccagctactcaggaggctgaactaggtggaatgcttgaggccagaaggttgaggctgcagtgagccctgatcttgccactgcactccaacctgggcagcagagcaagatactaactcgagaaaaaaaaaaaaactcatagattaaagttcatagcagcaggtccggcagcaaaaattcacctctgttctcttaggatccctctaggcctgagaattattaagttgacataaaatgggttaacaggcagggcgtggtggctcacgcctgtaattccagcacttttggaggccaaggcagctggatcacctgaggtcgggagttcgagaccagcctgaccaacatggtgaaaccctgtctctactaaaaatacaaaaattagccaggtgtcatggtgggcacctgtaatctcagctacttgggaggctgaggcaggaaattgcttgaacccaggaagcggaggttgtggtgagccaagattgtaccactgtactccagcctgggcaacaagaggaaactccatctccccctaccaaaaaaaaaaaaatagggccaggcatggcacagtggctcacgcctgtaatcccagcactttgggaggccgaggcgggcaaatcacgaggtcgacaaatcacgaggtcaggagtttgagaccagcctggccaacatggtgaaaccccatctctactaaaaatacaaaaaattagctgggcgtgctggctggtgcctgttatcccagctactcgggaggctgaggcaggagaattgcttgaaccctggaggcggaggtcgcagtgagctgagattgtgccactgtgttctagcccgggtgacagagcaagactgtctcagaaaacaaaacaaacaaaaacaggttaacaggagaggatacagatttacttaatagaagttttgcatggaatagaagccctcagaagaaaatgaatttgagaggtcaaggcaggaggatcccttgaggccaggagttcaagaccagcctaggcaacatagaaagaccctttctgtacaaaaaatacaaaaattagcagggtatggtggcgtgtgcctgtagtcccagctactcaggaggctgaggcgggcggtggaggttgtggtaagctgagatctagtcactacactccagcctgggtgacaaagactctgtctgtctgtgtctctctctctctctcaaaaaaagaagggtctgggcatggtggctcatacctgtaatcccagcactttgggaagctgaagcagatggatcacttgaggtcaggagtttgagaccagcctggccaacatagcaaaaccctgtctctactaaaaatacaataattggccaggtgtcgtggcacgagcctgtggtcccagctacttgagaggctgaggcaggagaatcgcttgaacctgggaggcagaggttgcagtgagccgagatcgcgccactgcactccagcctgggcaatacagcgagactcagtctcaaaaaaaaaaaaaggaaaaaaaacaaaggttaattttatgccgtgtgagtttcaccttaataataaaaacaaaggagggaaaaatgcatcaacctatttgtgtgctgataggaatgctccaggggtgcggggaggttgttgaggtaggtgcttgtctaggcccatgaaggggtggaggagttggtggagaagggggcgtggttttgctgcatccagggcaaattgattctcacagggcaagaggaagagccactgcgtctgggtcctgatgcaggtctgcaggttgatggagggcagtggctctggaaggtctctcctgctgatttctgttttctcagagatgccacctggtctgtgacaaagattggtaaacaggaggatgatgtcagtattaagaggaaataacaggccgggtgcggtggctgacgtctgtaatcccagcactttgggaggccaaggctgtcggatcacttgaggtcaggagctcgagaccagcctgaccaacgtggcgaaatcccgtctttactaaaaatacaaacattagccaggcatggtggcctgtgcctataatcccagcttctcaggaggctgagacaggaggatcgcttggacccgggaagcgggtgttgcagtgagccgagatcgcccattgcactccggcttaggagacagagtaagactctgtctcgggcggggtggcgggggaaacagggaataacagtaggggaagttcctagtaatgcatgtttttccaagtcccagaaagaacatagcggcagatggcaagttgcccctaggtggtggtcgttccccatgtccaacacccagtcagcctcgggctaatccagggtcactgaccatgtgcttatctggcagttctccctggttttcatgcattttacttttgctttaaccttttctgtttccgatcgagtgaccatcattttttttctactgttaaatatacatatcaatacataatagaaaaaaatacaaaaagtacgtaagtattatacctaaaaataacataaaattgaccactttaacaattttaaggtgggcttcaaaggtattcagtatttttacaatgttgtgcactcatcaccaccacccatctctagaactgttgtttgtttttgttcttgttttttgtttttgagacagagtctcgctctgttgcctaggctggagtgcagtggtgctgtgatctcagctcactgcaacttctgcctcctgggttagagtgattctcctgccttagcctcccgagtagctggcattacaggcacgtgccaccacgcccagctaattttttgtatctttagtagagatggggttttcactatgtttgctaggctggtcttgaactcctgaccttgtgatccacctgcctcagactctcaaagtgctggggttacaggcgtcagccaccattcctggccaagaaatcttttttgtttgtgagatggggtctcattatgttgcccaggctggtctcaagctcctagcctcaagtcatccacctgccttggcctcccaaagggctgggatgatagaatttagccacagtgcctggcttcctctttttttttttttttttttttttttttttttttttttttgagatggagtcgtgctcggtcatccaacctggagtgctggagtgcagtggtgtgatcttggctcactgcaacctccacctcccaggttcaagcaattcttctgtctcagcctcctgtagctgggacaacaggtgcatgctaccatgcctggctaatttttgtatttttagtagagattcgagatggggtttcaccatattggttaggctggtctggaactcctgacctcaggtgatcgactggccttggcctctcaagtgctgggattacaggcatgagccattgtgcccggccacatctgtttttatcaaagtgaaattcatataacataaaattaaccattgtgaagtgaatgattcagtggcatttggtacattcacagtgcagtgcaaccatatctatctactgccagaatattttcatgaccccaaaaggaagccctgtactcattttggtgactcacacatgtaatcctagtgcttgggaggccgaggtgggaggatggtttgaggctaggagattcagatcatcctggacaacatagcaaggcctaatctctaccaaaaataaaaaaattagctgggtgtggttgtgtgcacctgtcatcctagctactgggaagcctgaggcaggaggattgcttgagcccaagtgttggaagctgcagtgatctgtgatcacaccactgcattccagcctgggcaacagagcaaaaccctgtctctaaaataaaaaatttaaaaataaaagaaattggatattctccccctttccctcttttttttccctcccccccagcctggccaatatggtgaaaccctgtctctaccaaaaatacaaaaaattggttgggtgtggtggcaggcgtctgtaatcccagctactcgggaggctgagacaggagaatcgcttgaacctgggaggtggaaattgcagtgagctgagatcacgccattgtactgcagcctgggtgacagagtgagactctgtctcaaaaaagaaaaaaaaggttttattatttatcctgggcatcatagggatctctgcaaattttttttttttttttttttttgagacagagtttcgttcttgttgctgggattacaggcatgtgccaccccacctggctaattttgtatttttagtagataaggggtttctccatgttggtcaggctggtcttgaactcccgacctcaggtgatccgcccgcctcggcctcctaaagtgctgggattacaggcgtgaaccactgtgcctggcctatacatttttttttaactagctgtgggtggtggtgtgcacttgtagtctcagctacttgggaggctgaagtaggaggattgcttgagcctgggaggtccaggctgcagtgagccgtgatcaggccactgcattccagcctgcgtgtcacagcaagactgtctcaaaaaacaaacaaaaacaagtaatgtacttgaatcatcctgaaaccatccccacccctggtccgtggaaaaattgtcttccatgaaaccagtccctgctgccaaaaaggttggtgaccggtaaagttaattcacaccctgacttctgggtgacagggcaaagttcctcccttatcctcagcttctaaatctctgaatgggatgttgggggccacagtagcctccttgcaggggagtgacctccctgggaccgttagagatggactcagatggacctgttgcccaggttggagtgcagtagtgtgatcacagctcactgcagccttgaactgggatcaagagatctgcctgggctgggcacggtggctcatgcctgtaatcccagcactttgggaggccaaggtgggcggatcacctgaggtgaggagttcgagaccagcctggccaacatggtgaaaccacatctctactaaaaatagaaatattagccgggtgtggtggcaggcgcctgtaatcccagctacttgggaggctgaggcaagagaattgcttgaacctgggaggcagaggttgcagagagccaagatcctgccattgcactccagcctgggtgacaagagcaagactccatctcaaaaaaaagaaaaatcctcctgcctcagtctcccgagttttgggattacagtcacatgtatcacacccagctaattttttatttttgtaaagtcagggttggtctatgttgcccaggctggcctccaacacctgatctcaaggaattctcccacctcggccccccacagcgttgggattacaggtgtgagccactgcatccagccaggttttttctctaacgttttctctgtcacgagtcagcctcgacggacaacagggtatgtcagggatatgtgtgcccggctgtgaggctggtgtgggtgccacatgccacctaagtggacctctaggctctggaccgtcctgactgtcatgcattcttgttctcagtggagcaaaccgccccatgcccactggctccaaacacctgttgtcgcatcctctctcctggctctgggctgaccaggctcactgggggttcatttgttccatgtgacagtggctgccatcatctgggggccgggctggctggatgtcccatccagaaggtctgtcatgtctgggatagctgacctctccatgtggcctctccacgtggactcctgagcaaggtggccacactcctgccacggtgacttggggttccccaacacacaaagcagagagactgctgggtcaatgttgccgatgctgtattctgtggattcagtggagtccaggtcagcccagatcctgtgtgtgtgtgtgtgtgtgtgtgtgtgtgtgtgtgtgtgtgtgagtggggggaacacataagggcctgaacacccttttgagactatctcaaaaacattatttatttatttatttatttatttatttatttttgagacggagccttgctctgtctacctggctggagtgcagtggtgcaatctcggctcactgcaacctctgcctcccgggttcaagcgattctcccgtctcagcctcctgagtacctgggactacaggcctgcactaacacatcaggcgaatttgttttctatttgtagtagacacggggtttcaccatgttggccagactggtctcgaactcctgacctcaggcaatccgctcacctcggccttccaaagtactgggattacaggcgtgagccacagtgcctggccaaaaaaaactttttttatttttctttttttaaagtctccctcctccccctcgccttttttttttttttttttttttttttttttttttttttggtggagtttccctcttgttgcccaggctggagtgcaatggctccatctcggcaaactttgcctcctgggttcaagtgattctcctgcctcagcctcccgagtagctgggattataggcatgtgccatcatgcctggctaattttttgtatttttagtagagacggggcttctccatgttggtcaggctggtctcaaactcccgacctcaggtgatttgcctgccttggcctcccaaagtgcaggggttacaggcgtgagacaccacgcccgcccccctcccctctgccttttttttttttttttttttttttttagagatgaggtctttctacgttgcccaggctggtctcttaactcctcagctcaagtgatcctcccaccctagcctcccaaagcactgggatcacaggtgtgagccatggtgtccgctgttacccactcttaaggggattgtttgagactaatgagtcctttctctgcgggttgccatttgcaccaacagaacaagaccaggttcagtaaagcaagatagaaactttattcgtcaatcaatgaatggagaaagggaggaactcctgctcaaagtgcctactccctgcaggtgtgatgaggggagttttaaagtttcctagggcatgtagatgcagactgggggtggggattcctggaaagaggtggggctttctagggggcactgaagtgttcagcctttcttttcttttgtacctggcattatatgtgcttagcaaagtgcacctctccccactgaagactttttttttttggtttttctttttttgagacagagtctcgatcagtcacccaggctggagtgcagtggggcgatctcagctcactgccacctccgcctcccaggttcaagcaattctcctgccttagcctcctgagtagctgggattataggtgtgacccatataatcccagcttttttttttttttttttttgaaacagcacctcactctgttgctcaggctgaagtacagtggtgcgatcgtagctcactgcagcctcgaccttctgagctcaagcaatcctcctgcctcagcttcccaagtaggtgggactacaggcatgcatcaccacgcccggctaatttttacattattttttgtagagagagggtcttttttttttttttctgagactgagtctcgctgtgtcgctcaggctggagtgcagtggcacaatctcagctcactgcaacttctgactctcgggttcaagcaattctcctgcctcagcctcctgagtagtaacaggcgcgtgccaccacacccggctaattttttttttttttgtatttttagtagagacagggtttcaccatgttggccagggtggtctcaaactcctgacctcgtgatctgcccaccttggcctcctgaagtgctgggattacaggccaagagagggtcttaccatgttgcccagggtggtcttgaactctctgacttaagcaatcctccctcctcacactcccaaaatgctgggatgacagcttggagccattgtgccctggctgtggagattttactctgcccatggagtgaggattcaggcagatggagcactgctgaggtcagctctcatcttgtggctcagttgtggttaatggcatccggccttcatgcctgtaaactagcacagctgtgagcaggggttaatttctttttttttgagacagagtgtcgccctgttgcccaggctggagtgcaatggtgtgatctcggctcactgcaacctctgcctcccaggttcaagcatttctcctgcctcagcctcctaaatagctaggattacaggcacacaccaccatgcctggctacttttttgtatctttagtagacaccaggtttcaccatgttggccaggctggtctcgatgtcctgacctcgtgatccacccgcctcagcctcccaaagtgctgggattacaggtgtgagccaccatgcccggccagagcagagattaatttcacaggttctggggctccctaaaagaatggatgttatagtccgggtgtggtggcttacgcctgtaatctcagcactttgggaggctgaggtgtgggtgatcacttgaagtcaggagtttgagaccagccgcctttctcaccctcccaaagtgcttggatgacagctgggagccagtgcaccctggctgtggagattttattatgccagtggagtgaggaatcaggcctatggagcactgctgaggtcagctctcatcttgtggctcatttgtggttattggcacttggcctttgttcctgtaagctagcacagctgtgagcagcggttaatttctttttttttttttttgagacagagtcttgctctgccaccaggctggagtacagtggcgcgatctcggctcactgcaacctccgcctcccgggttcaagtcattttcctgcctcagcctcccaagtagctgggattacaggcgctcaccaccacgcccagctaatttttgtatttttagtagagacagagtttcactatgttggccaggctagtctcgaactcttgacctcaggtgatccacccaccttggcctcccaaagtgctgggattacaggcgtgagccaccatgccaggccggatacagggtctttaaaggggtgattaaggccaggtgtggtggctcacacttgtcatcccagaacttcaggaggctgaggtgggtggattgcacaaggccagcagtttgaaaccagcctgggcaacatagggagagcctgcctctactaaaaatacaaaaaattagctcggtgtggtggtgcacacttgaatcccagctactcaggaggctgaggcacgagaaatacttgagaacaggaggcagaggttgtagtgagccaaagatcccaccactgcactccagcctgggcaaaagagtgagagtctgtttcaaaaaaaaaaaaaaaaaaagcctaagtgtggtggctcacgcctgtaatcccagcactttgggaggctgaggcaggtggatcacctgaggtcgggagttcaagaccagcttgaccaacatagtgaaacccgtctctactaaaaatacaaaattaggtgggcatggtgacacatgcctgtaatcccagctacttgggaggctgaggcaggagacttgcttgaatctgagaggcggaggttgcagtgagccgagattgtaccattgcactccagcctgggcaacaagagggaaactccgtctcaaaaagaagaaaagaaaaaaaatttttttaattagcaggacttggtggtgtgcacccgtggtcccagctactcaggaggctgaggtgggaagattgcttgattccaggaggctgcactgagctgttagcgccactacactccagcctgggagacaaagcaaggccctgtctcaaaaaaaaaagaagctgctgagaggtgacagcgtgctggcagccctcgcttgctctcggtgcctcctgggcctccgcgtccactctggccgcgcttgaggagctcttcagcccaccaccgcactgtgggagtccctctctgggctggccgaggctggagccagctccttctgcttgctaaaggtgtggagggagaggcgcgggcgggaacccgggctgtgcgcaaggggctcgtgggacagcgcgagttccgggtgggcgtgggcccccgcactcagagcggacagccggtgccaccggccccaggcagttgaggggcttagcacccgggccagcagctgtggagggtgtgccgggtcccccagcagtgccggcccgccagcgctgcactcgaattctcgcggggcttcagctgcctcccggctgggcagggctcaggacctgcagccccccatgcctgaggcttccccctgccctgggctcctgctccgcccgagcctccctcatgagcgccacccactgctccacgacgcctggtcccatcgactgcccaagccaagagggctgaggagtccaggcgtgtggcaagggactggtgggcagctctacctctgaccccctgcgggttccactgcctgaagccagctgggctcctgagtctagtggggacttggagagcctttatgtctagctgagggattgtaaatgcatcaatcagcaccctgtgtctagctcagggtttgtaattgcaccaatcagcactctgtatctagctaatctggtggggacttggagaacctttatgtctggctaagggattgtaaatacaccaatcagcactctgtgtctagctcaaggtttgtaaatacaccagtcagcaccctgtgtctagctcaaggtttgtaaatgcaccaatcagtgctctgtggggacttggagaacttttgtgtctagctcggggattgtaaacacaccaatcagcaccctgtcaaaatgggccaatcagctctctgtaaaacagacctgtcagctctctgtaaaatggaccaatcagcaggatgtgggtggggccagataagggaataaaagcaggttgccccagctagcagtggcaacttgggttgtctttcatgctgtggttgctttgttctttttctctttgcaataagtcttactgctgctcgctgtttgggtccacactgcctttatgagctgtaacactcactgcaaaaggtctgtagctacactcctgagccggaaagaccacgaacccaccagaaggaggaaactacgaacacatccgaacatcagaaggaacaaactgtggacacgctgcctttaagaactgtaacattcaccacgagggtctgtggcttcattcttgaagtcagtgagaccaagaccccaccaattctggatacactgctacatcgggtcctcatccaatctgcctggtgtccctacaagaagaagaaatatggacactaagaaatacgaagggtgcatgcagagaagagagcatgtgagggcacgcaggaggcggccgcggctctgtaagacaaagcaagggggctcagtagaaaccagctctgggccgggtgcggtggctcacgcatgtaatcccaggcgtgatcatttgaggtcaggatttagagaccatcccggaaatacggcaaaaccccatctctactaaaaatagaaaaattagccgggcgtggtggtgggcgcctgtaatcccagctactcgagaagctgagggacgagaattgcttgaacctggggctactctggaagctgaggcacgagaattgcttgaatctgggaggtggaggttgcagtgcaaccaagatggtgccactgcactccagcctaggtagcagagcaagactccgtttcaaaaatgaaaagcagaaaccaaccctgatgacatcttaatcttggacgtcagcctccagaaatgtaagtttctgtttttaacctacccaagctgtggtattttgttatggccaccctagcaaactgaagctagtatgatagctcagaaactctttttttcatttttttcttccttagagacagggtcttgctttggctcccaagctggagtacggtggtgcagttatagaattatagctcactgtagcctcaacctcccaggctcaagagatcttcccgcctcagcctcctgattagctgggactacaggtctgcgccactgtgcccagctaatttaaaacaaaacaaaaaaatgtttcatacagattggtcaacatggccagaccccgactggtaaaagctggttaaaaaagatacttgttgatggtcaggtgcagcggctcacacttgttatccaagcactctgggaggctgaggcatgaggactgtttgaacccaggtgttggagatcagcctgggcaatatagtgagatctcatttatactaaaaaacaaaaaaaatagctgggcatggtggcacatacctgaagtttctgtagttgcagctacttaggaggctgaggtgggaggattgcttgagcctgggagatggaggctacagtgagctatgatcacccattgcactccagcctgggcaatggagcaagatcctgtctctagaaaacaacaataaaatatatctgttgaatgctactatgtatcagtgctgttcctggttctaaccatgaacaaaatagccctgaaaaaatagggctgagcccggtggctcacatttgtaatctcaggactttgggagatcaaggcaggtggatcgcctgaggactggagttcgagaccagcctggacaacatggcaaaaccccatctctactaaaataaattagtagctgggtgcactggttcatgcctgtagtcccagcactttgggaggctgaggtgggcagatcacctgaggtcaggagttctagaccatcctggccaacatggtgaaaccctgtctctcctaaaaatacaaaaattagctgggtgtggtggcaggcgcctgtaatcccagctacttgggagactgatgctagagaactgcttgaacccaggaggcagaggttgcagtgagccgagatcttgtcattgtactccagcctgggtaacaagagggaaactgtctttaaaaaaaaaaaaaaaaaaattagctggatgtggtgtagtgcatgcctgtaatcctagctactcaggaggctgaggcagaagaattgcttgaacctgggaggcagaggctgcagtgagccgaaatccgccaatgcactccagcctgggtgacagcaagttcctgtctcaaaaaaaaaaaaaaaaaaaaaaaaagctggtgcggagattcactcctgtaatcccagcactttgagaggtcgagaccagcctggccaacatggtcgaacccggtctactaaaagtacaaaactagccaggcatggtggtgcatgcctgtaattccagctactcaggaggctgaggcaggagaatcgcttgaacctgggaggcaagaggctgcagtgagccgaggtcatgccattgtactccagccagggcgacagagcgagactctgtctcaaaagaaaacgaaagagctgggcgtggtggttcacgcctgtaattccagcactttgggaggctgaggtgggtgggtcacctgaggtcaggagttcgagaccagcctgaccaacatagtgaaaccccgtctttactaaaaatacaaaaaattagccgggcgtggtggcagacacctgtaatcccagttactagggaggctgaggcaggagaatcgcttgaacccgggaggcggaggttgcagtgagccaagattgcaccattgcactccagcctgggcaacaagagcaaaactctgtctcaaaaaaaaaaaaaaaaaaagagaaggtgtttctggttgcagtggggagaacagaacctgcagggagaccagggaggggacaactgcactgatccccagaagtcaggaaggggctggacctagctggcaagtgcaggtggtcagtgataactggcttctaggtctgttttgaaggaaaaggcgatgggggctgtaggattggcagacacattggatgcaggtgggaggaggcgtggatgcctcagaactgtcagagcagagcctgggaagatggtgctaactgagagggagaggacgctcggacaaggcttgggtgggaaacccctaggagtccagattgggacctgcaacactggagcggcctgcgaggaccccttgtggcagaggctgagaaggcactggaccctagggtttgggctagaatgatgaatttgggaattggcccagttgggcgtctgtgggctggagaggagtgaatgcagccaaaccttagatgttttggagctaaggaagaatcagaaaacagatgaaaagttgggtgcggtggctcacgcctgtaatcccaacactttgggaggttgaagcgggcagatcccttgaggtcaggagttcaagaccaccctggccaacatggtgaaacccggtctcttgtaaaaatgaaaaatttagccgggtgtggtggcgggtgcctgtaatcccagctacacgggtggctgaggcaggagaatcgcttgaacctgggagaaggttgcagtgagcagagatcatgccactgcactccaacctgggcaacagagcaatattctgtacaaaaaaaaaaacaagacaaaatgaaaaagagatggaagcggggcatggtggctcacatgtttaatcctagctagttgggaggctgagatgggaggattgcttgagtcccggtggtcaaggctggagtgagctattattgtaccactgtgctccagccagggcaacagagtgagaccctgctgtatcttaaaaaggaaaaagggttgggcgtgatggttcacgcctgtaatcccagcactttgagacgccaaggtgggtggatgacttcagcccgaaaatttgagaccagcctgggaacatagtgagacctcatctctacaagaaatacaaaaattatttgggtgtggtggtgcctgcctgtagtcccagctactcaggaggctgaactaggtggaatgcttgaggccagaaggttgaggctgcagtgagccctgatcttgccactgcactccaacctgggcagcagagcaagatactaactcgagaaaaaaaaaaaaactcatagattaaagttcatagcagcaggtccggcagcaaaaattcacctctgttctcttaggatccctctaggcctgagaattattaagttgacataaaatgggttaacaggcagggcgtggtggctcacgcctgtaattccagcacttttggaggccaaggcagctggatcacctgaggtcgggagttcgagaccagcctgaccaacatggtgaaaccctgtctctactaaaaatacaaaaattagccaggtgtcgtggtgggcacctgtaatctcagctacttgggaggctgaggcaggaaattgcttgaacccaggaagcggaggttgtggtgagccaagattgtaccactgtactccagcctgggcaacaagaggaaactccatctccccctaccaaaaaaaaaaaaaaaaaaaaaaaaaaaaaaaaaaaaaaaaatagggccaggcatggcacagtggctcacgcctgtaatcccagcactttgggaggccgaggcaggcaaatcacgaggtcgacaaatcacgaggtcaggagtttgagaccagcctggccaacatggtgaaaccccatctctactaaaaatacaaaaaattagctgggcgtgctggctggtgcctgttatcccagctactcgggaggctgaggcaggagaattgcttgaaccctggaggcggaggtcgcagtgagctgagattgtgccactgtgttctagcccgggtgacagagcaagactgtctcagaaaacaaaacaaacaaaaacaggttaacaggagaggatacagatttacttaatagaagttttgcatggaatagaagccctcagaagaaaatgaatttgagaggtcaaggcaggaggatcccttgaggccaggagttcaagaccagcctaggcaacatagcaagaccctttctgtacaaaaaatacaaaaattagcagggtatggtggcgtgtgcctgtagtcccagctactcaggaggctgaggcgggcggtggaggttgtggtgagctgagatcgagtcactacactccagcctgggtgacaaagactctgtctgtctgtgtctctctctctctctctcaaaaaaagaaggggctgggcatggtggctcatacctgtaatcccagcactttgggaagctgaagcaggtggatcacttgaggtcaggagtttgagaccagcctggccaacatagcaaaaccctgtctctactaaaaatacaataattggccaggtgtcgtggcacgagcctgtggtcccagctacttgagaggctgaggcaggagaatcgcttgaacctgggaggcagaggttgcagtgagccgagatcgcgccactgcactccagcctgggcaatacagcgagactcagtctcaaaaaaaaaaaaaggaaaaaaaacaaaggttaattttatgccgtgtgagtttcaccttaataataaaaacaaaggagggaaaaatgcatcaacctatttgtgtgctgataggaatgctccaggggtgcggggaggttgttgaggtaggtgcttgtctaggcccatgaaggggtggaggagttggtggagaagggggcgtggttttgctgcatccagggcaaattgattctcacagggcaagaggaagagccactgcgtctgggtcctgatgcaggtctgcaggttgatggagggcagtggctctggaaggtctctcctgctgatttctgttttctcagagatgccacctggtctgtgacaaagattggtaaacaggaggatgatgtcagtattaagaggaaataacaggccgggtgcggtggctgacgtctgtaatcccagcactttgggaggccaaggctgtcggatcacttgaggtcaggagctcgagaccagcctgaccaacgtggcgaaatcccgtctttactaaaaatacaaacattagccaggcatggtggcctgtgcctataatcccagcttctcaggaggctgagacaggaggatcgcttggacccgggaagcgggtgttgcagtgagccgagatcggccattgcactccggcttaggagacagagtaagactctgtctcgggcggggtggcgggggaaacagggaataacagtaggggaagttcctagtaatgcatgtttttccaagtcccagaaagaacatagcggcagatggcaagttgcccctaggtggtggtcgttccccatgtccaacacccagtcagcctcgggctaatccagggtcactgaccatgtgcttatctggcagttctccctggttttcatgcattttacttttgctttaaccttttctgtttccgatcgagtgaccatcattttttttctactgttaaatatacatatcaatacataatagaaaaaaatacaaaaagtacgtaagtattatacctaaaaataacataaaattgaccactttaacaattttaaagtgggcttcaaaggtattcagtatttttacaatgttgtgcactcatcaccaccacccatctctagaactgttgtttgtttttgttcttgttttttgtttttgagacagagtctcgctctgttgcctaggctggagtgcagtggtgctgtgatctcagctcactgcaacttctgcctcctgagttagagtgattctcctgccttagcctcccgagtagctggcattacaggcacgtgccaccacgcccagctaattttttgtatctttagtagagatggggttttcactatgtttgctaggctggtcttgaactcctgaccttgtgatccacctgcctcagactctcaaaagtgctggggttacaggcgtcagccaccattcctggccaagaaatcttttttgtttgtgagatggggtctcattatgttgcccaggctggtctcaagctcctagcctcaagtcatccacctgccttggcctcccaaagggctgggatgatagaatttagccacagtgcctggcctcctctttttttttttttttttttttttttttttttgagatggagttgtgctcggtcatccaacctggagtgctggagtgcagtggtgtgatcttggctcactgcaacctccacctcccaggttcaagcaattcttctgtctcagcctcctgtagctgggacaacaggtgcatgctaccatgcctggctaatttttgtatttttagtagagattcgagatggggtttcaccatattggttaggctggtctcgaactcctgacctcaggtgatcgactggccttggcctctcaagtgctgggattacaggcatgagccattgtgcccggccacatctgtttttatcaaagtgaaattcatataacataaaattaaccattgtgaagtgaatgattcagtggcatttggtacattcacagtgcagtgcaaccatatctatctactgccagaatattttcatgaccccaaaaggaagccctgtactcattttggtgactcacacatgtaatcctagtgcttgggaggccgaggtgggaggatggtttgaggctaggagattcagatcatcctggacaacatagcaaggcctaatctctaccaaaaataaaaaaattagctgggtgtggttgtgtgcacctgtcatcctagctactgggaagactgaggcaggaggattgcttgagcccaagtgttggaagctgcagtgatctgtgatcacaccactgcattccagcctgggcaacagagcaaaaccctgtctccaaaataaaaaatttaaaaataaaagaaattggatattctccccctttccctcttttttttccctccccctcttcttggtatcagcctgaattagatgagaaataactgttacttgaaatgttgataaaacttgattggggccgggcacggtggctcacgcctgtaatcccagcactttgggaggccgaggcgggcagatcacgaggtcaggagatcgagaccatcctggctaacatggtgaaaccccatttctactaaaaatagaaaaaaattagccaggcgtggtggcggacgcctgtagtcgcagcttctcgggaggctgaggcaggagaatggcgtgaacctgggaggcggagcttgcagtgagcagagatcgcgccgctgcactccagcctgggcgacggagcgagacgctgtctcaaaaaaaaaaaaagcaagactccgtctaaaaaaaaaaaaaaaaaaaaaaaccccaaaaactttggttgaaaaatcctctgggttttgtcctttagcggaaggtagtttgtttcttcccttccccttcccttcctctctttctctcatttttttctttcaacagggtctccctctgtcaaccaggctggagtgcagtggcaccatcatgactcactatagccttgacctcctgggttcaagcgatccttcagcctcagcctctcgagtagtggggactacaggcacacaccaccatatccagctaatttttatttatttttattttttaaattttagatggagtcttcctctgtcgccaaggctggagtgcagtagcgcaatctcggctcactgcaagctccgcctcccgggttcaggccattctcctgcctcagcctcccgagtagctgggactacaggtgcccgccaccacgcccaactaattttttgtatttttagtagagacagggtttcaccatgttagccaggatggtctcgatctcttgaccttgtgatccacccacctcggcctcccaaagtggtgggattacaggtgtgagccaccgcgcccggcctaatttttaaattgttttgtagagaccaggtttcgctatgttgaccagatgggtcttaaacacctgggttcaagtgatctgtctaccttagcctcccaaaatgttgggatcacaggcatgaaccatattgtctgccccctcccccaagttatttccatttcattaatatttatggatttagtaaagttttttggtacctcttggtgcaagttttgcattttatatttttccataaaggtattcttttcatcttcatcttttcttttagttttgagacggagtttcgctcatgttgcccagactggagtgcaatggcgtgatcacagcttactgcaacctccgcctcctgggttccagtgatttttctgcctcagcctcccaagtaggtgggactacaggcgggcaccagcaggcctggctaattttttcagatggagtctcactctgtcgctcaggctggagtgcagtggcacgatcttggctcactgcaagctccacctcctgggttcacaccattctcctgcctcagcgtcctgagtagctgggactacaggtgcccaccatcaggcctggctaattttttgtattttttagtatacacggggtttcactgcattagccagggtggtctcgatctcttgagcttgtgatctgtcctcctcaacctcccaaagtgctggaattacaggcatgagccaccctgccccgccagtttttgtatttttagcagagatggggtcttgacatgttggccaggctggtcttgaactcctgggctgaagcgatccacctgccttagcctcccaaagtgctgagattactggcgtgagccactgtgcctggcatatacccacttttaatcgcatgcagattaaggggcagtttatgtagaaacttttagggaagggggtactaatcattggggcattgcctggaaaggggcagtaattccttgatgttagcatggtaatgtgaaattgacacggcacactggcaggcatgtctcatcgaaagctgcttccccctcccttttccttcacctgttttagctagtcctcaatatggtctggtgtctgagccccacctctgaagtcaaatcttatcttctacctcactaggacttgcctaggagttgcactgatagcctagactgactttcaaatttacttagagacccagagcactttagcccatggtgggtcgcaaagtttgcaggaactcaaattccactgggatccataatttccctcttgttagggctggtttaaatgccccctctatagggaccagccctacagggcctgtgggtttttctcctcgtgtgtggagatgagagatcgtagaaataaagacacaaggcaaagagaaggaaagacagctggggcctggaggaccactaccaccaagacgcagagaccggtagtggccctgaatgcctggctgcactgttattttttggatataaggcaagggggcagggtaaggagtgttgagccatctccagtgataggtaaggtcacgtgagtcatgtgtctactggacagggggcccttccctgtttggtagccgaggcagagagaggggacagcttatgtcattatttcttggagaggtcaacggcttaatactttcacttaattctgctactgttttctagaaggcagagccaggtgtacagggtggaacatgaaagtgaaacaggagcgtgaccgctgaagcacagcatgacagaggctagactgttaggcctctggatggctgttggcaggtggggatggtgggggcttgactgatgtcaggccttccacaagaggtggtggagcagagtcttctctaactcccccaaggaaagggagactccctttcccggtctgctaagtaacgggtgccttcccaggcgccggcattaccgctagaccatggagccctctagtggccctgtccgggcataacagagggctcgcactcttgtcttctggtgtaactatttttattttatatatattttttattttactggaacaacttgtgccctcagtctcttgcctcggcacctgggtggcttgccgcccacaccctctatgggtgggcatcagctgagtgtggtcgggtttttctttctgctctaaaaggacagcgctgggttccatgcctcacaattgctgccccctccctctccccaacacacaaaggcactctccacaccatgctgccaggggtggcggagaggtggtgtcagagattcaggactttcagtgtgtttcttcagtgtgtctttcagtgatataaagttaaaaccgggtactgtgagtgctcacctgatttttggttcttctttttttttttttttttttttttttttttttttttttttttttttttttttttcggagacagagtcttgctctgtcgcccaggctggagtgcagtggcgcgatctcggctcactgcaacctctgcctcccgggttcaagtgattctcctgcctcagcctcctgagtagctggaactacaggcatgagccactgctcccggctgggatttttggttcttgggaaagtgcttttttgtgtgtagctgttaaattggtgtccttgttggagggatggttggtggagccttctattctgttatcttgtgctgccttctacatcctgggtttttgatatagatatgtcatagactaataatgggcagttttattctctttatttctcctactgatatctttttttgttttacggtttttttttttttaattggcggaatttcactcttgttgcctgggctggaatgcaatggcgtgacctcgcctcactgcaacctccgccacccaggttcaagtgattctcctgcctcagcctcccaagtagctgggattacaggcatgcgccaccacacccggctaatttttttgtatttttagtagagatggggtgtctccatgttggtcaggctggtctcgaactcccgacctcaggtgatctgcctgcctcggcctcccaaagtgctgggattaacaggcgtgagccaccgcgcccggccttttttgatttattgttaactagaactcccagaataattttgaataagggtggcgatagcagctattgtcttatttcttaccttaagggttatgtacccaacaattaaatatgacattaaatataacatttgacatgtatgatgctttatttttgttttttagtgttggggccttccactattcctcaggttggagtgcagtggcaagatcacggctcactgcagccttgaactcctggttcaagtggtcctcctgccttgagctcctgagtagctgggactacaggcacataccaccatgcctgatttttaaattttgtgcagagatgggggtcttgccatgttgccaggctgatcttgaactcctgggctcaagtgatcctctcccttggtctccagaagtgctgggattacaggtatgagccaccgcacctggcctgtctctatatttttttctgtgacttcttttatttttctttattaatcttgccagatgttcgtctgttagtcattcaaataactaacttttaggtttgatgatcctaattttaacacttatcctgttttttcttttattgagcttattttactgttctttaaaatcttcttaaatgcttagctaattatttttgagctttttcttttttttttttttttttttttttttttgagtctcaccctgttgcccaggctggagtacaatggcacaatcttggctcattgaaacttctgcctcctgggttcaagcgattctcctgcctcagcctcctgagtagctgggattacaggcacgtgccaccactgctggctaatttttttttttttttttgtatctttagtagagacggggtttcaccatgttggtcagactgatctcaaactcctgacctcatgatccaccccccttggcctcccagagtgctgggattacaggtgtgagccaccacgccaggctgcttttttttttttttcgtttctaatataagcctgttaggctgcaaacttcctccaaaggattgcttaagctacactccacaaacattgacatgtaatatttttatatttttgctattcatctttttttttttttttttttttttggagacaaaatctcactctgttgccaggctggagtgctggcatgtctcagcctcccgagtagctgggattacaggcatgtgccaccacacccagctaatttttgtatttttagtagagacggggtttcaccatgttggccaggatggtctcgatctcctgacctcgtgatccgcccaccttgacttcccaaagtgctgggattacaggcgtgagccactgtgcccggcctttgctattcatctataggagtgtattttctaatcttcattatgggctctctttcaacccatgaggttcctattatttgtttttttggaggaaatgggaattattggatagggaaacaccaggtaaatggaataattataatctttgcttcatgagacactgtagttgatacatacaaatccctttcttcatgcatttattaagatgaaatttacataacgaaccatcttaaagtgaacagttcagtggcatcgagtgcatttgcaatgttgtagaaccacgactttagttccaaaacatttccaccgctgcaagataaaactccgtacccattaaacagtttcttcctatgccttcaccctgaagcccccggcagctataaatatacattttatttttataggtttacctcttctggatatttcatataggtggaatcataaaatgtgtgaccttttatgtctgggttcttacactgagcataatgcttccagggttcattcacatgcagcatatgtgagtgctgtattccttttcatggctgagtagtagtccattgtatggatggactacaatttgttattggacatttgggttgtttctatggtgtttttttctccccccacccctccagacagggtctctctgttgcgcaggctggagtatagtggcatgatcatagctcacagcagtcttgtactcctgggctcaggcaatcctctcactcaacttcctgagtagctgggagtatacgtgcatgccaccacaccctgctgatttttctatttttttgcagagaccatgtctcactatgttgtccaggctggtcttgaactcctgtgctcaagcaatcctcccacttcgacctcccaaagtgttgggattacaggagtgaaccattgtgatcagctgtttctacctttattgtgactagtgctgctatgaacattcatgtgtaaatatttgagtacctgcttccaattcttttgggtctattcctaggagtggaattgctggatcatatagtaattctatttaatttcttgaggaaccaccaaacgattttccacagtgatcattttacatttccaccagcagtgaatacagttgtttcattttttccacatccttgccaacactttttttttttaagacagagtttcgctcttgttacccaggctggagtgtagtggcatgatcttggctccctgcaacctctgcctcccaggttcaagtgattctcctgcctcagtctcccaagtacctgggattacagacatgtaccaccatgcccggctaattttgtatttttaggagagaggggtttctccatgttggtcaggctggtctcgaagtctcgacctcaggtgatccacctgcctcagcctcccaaagtttggggattacaggcatgaggggattacactgcacctggccaacacttcttttattatacccactcttgtggatgtaaagtggtttctcattgtgtttttgatttgcattttcctaatgactaacaatgttgaatatcttttcatgtgcttattggccatttctttttgggaattttttttttctttttctttttcctttagatggagtcttgctcttgttgcccaggctgaagtgcagtggcgcgctctcagctcactgcaacctctgcctcccgggttcaagcgattctcctgcctcagcctcccgagtagctgggattacatgcacgtgtcaccatgcccggctaatttttgtatttttagtagagatgggtttcaccatgttggccaggctggtttcgaactcctgaccgcaggtgatccacctgccttagcctcccaaagtgctgggattacaggtgtgagccaccacactcagtcgagaaatttctattcaagtcctttgcctatttttttctttttttgtggagaagggagtcttgctatatttcccaggctggtcttgaattcctggactcaactgatcctcttgcctaagcccccaaagtgctgggattataggggtgagccaccacacctggtctctttgcccccccccccttttttttttttttttttgagatggagtctggctctgttgccctggctggagtgcagtggcatgatctcggcttactgcaacctgcacctcccaggttcaagtgattctcctgcctcagcctcccgagtagctggaattacaggcaccccctaccacgcctggctaatgtttgcatttttagtagagatggggtttcactatgttggccagtctggtctctaactcttgacctcaggtgacctgcctgccttggcctcccaaagtgctaggattacaggcatgagctaccgtgcccagtcacccattttttaaattagggtttttgttgttattgagttgtaagagttatatatcttggatgctagaacctcttcagatatatcatatgcaaatattttcttccattttgtagcttgtcatatccctttaaaaattgtatttaatgagtgtgtcacttcacttcaaaaacttcacctctctcacgcctgtaattccagcactttgggaggctgaggcgggtggatcatttgaggtcaggcgttcgagaccagcttgaccaacgtgacaaaaccacctctctactaaaaatacaaaaattacccgggtgtggtggcacgtgcctatagtcccagctactcgggaggctgaggcaggagaatcacttgaacctgggaggcagaggttgcagtgagccaagatggcaccagtgcattctagcctgggtgacagaaagagactccatctcaaaaaacaaaaaaaacttcacctcacttcaaaaactagaacagtgatagtaattgatatctatctgaatcccattcccttaccttcccagatcaaaggtaatttactaatttgaattttgtgtttatattttattacagttctactagctaggtattcatgcctatatattatctcatttgggttgcttttgagctttataaaaggtcaactattatacacaatgctgaatggtttttccagtgttggtaacaatttatattcccccgataatgtgagattattgaccccccacattctctccaatactttgttgtccaatttcttgtttatctgagacagtcttgctctgtcaaccaggctggagtgcagtggcgcgagatcttggctcactgcaagctccgccttctgagttcacgccattctcctgcctcagcctcccgagtagatgggactacaggcgcccaccaccacgcctgggtaattttttgtatttttagtagaggtgaggtttcaccatgttagccaggatggtctagatctcctgacctcacgatccgcccgcttcggcctcccaaagtgctgggattacaggcgcgagccaccacgcctggcttttgttttgttttgagatggagtcttgctctgttgaccaggctggagtgcagtggcgtgatcttggctcactgcagcctccacctcccgggttcaagcgattctcctgcctcagcctcccaggtgactgcgattacaggtgtgggtcaccctgccctgctagtttttgtatttttagtagagatggggttttaccatgttgccaagtctggtcttgacctcctgacctcaagtgatccccctgcctcagcctccaaaagtgctgggattccaggtgtgagccaccaggcctggcctctgtttatttttggagctcttgaagagacagtgacctccccaggctaacccttgggaagtctgtgggatttcagcccactccctccactgtcccaaggaaggatccagggaccacaaaggtgggcaatctaccggacttaagaaaggactgcagagacaggcctggtctgtgacctacctgtgagcttgggcaaaggacttgacctttcagagctagtctgcaagggggtctttgagaggctgacccaagggtaccctaagggtggagggaggggcttgtttgagtcactggctggcgagtcaggggctcatctgggaacagcgtggggagcgggtggtctctgagctctgttgctgtctggggcccctggggccctgcatccttgggtggcagtgagtatcccgtaggtggggtatgtaagcagaggcctggctccctcgggggtctctggggatgaagaaggaactttgatagggacccaagttctcaggcagaaaatttggctccatttgttttaattggacccttttcagcctggggctccccccagcccccaggccacagcctggaggtgtctctggccagccacagcatccagctgctggctcccagatctgtccagttgcccagagggaagaagggtgggtgggcagaaggaaggggctggagacagatcatcagccttcccacccaccccgggtggggccctccctgtctccagaaaggtggcccaggggcgccagtccagtcaccccagaaatatccaaggcactggcgggggggcaaccccttacagccagccccgcccggctatgtggctgttgtgtgcctgttggtcagacgcccggccacccggctccgagggccatcagtgggggctggcctgggccctccagctgccccgttctttagctgcagaggttcctgggccgccgccgcctcctcactggagtctgattcttctacatcactacgaatgtccttctccatctggggaacagagagagggatggagctcagagcagggaggaaggaggagcttagggctggggcccccggggaggtccagccatacctggcccttcttcatgaagctatagagcatgcgcagaatgaggcaagaccagaacacgtgcagcagctgcagcaacatcagaagcccgttgaagaagtagtagccgaagaaggggcccctgttgctgatggactcgtagtatgtggtgtagaggatcctacagccagggggagaggaggaggctggggtttgaccagccgctgtagcccccagtcctaagaatttctaactggcatggccttccctgctccataaccacctatggctccctagtgccccccaccccatgatacctaacactcttgagctgggcacgcgaggccccctctcgcttgtactaaatgagcagaacacacacacgagctccctgactggccattcatgactatgaaccccacccaagcgggtacttatgaactcagctgctttcctgggtggcactctggcagcttctctctactcctcagacccccatcacctccccttcatcagcaggcgactgcctactcacctcataggggaggggcttcatgtcaggaaggcaggcggtggggcctcatctcccaggaagacacagggagcagggctccatctcccagagtttaagaggggcggggcctcatctcccaaggagtaaaaaaggggtggggcctcatctcccgggtagccggacagaggtggggctttgtctcccacggaggctgggaggggcggggcttcattttcactgtgcaacccaagccagttggaaagaatgttccccagcactgctccttccctcgaactcctccttgcttgttgcctgggacactgtcctggagcccagctcccaccacatcctcttctcaaactcagctgtggttcttgtttttttttttttttttttttttttttgagatggagtcttgctctgtcacccaggctggagtgcaatggcgtgatctcggctcactgcaacctctgcttcccaggttccagcgattctcctgcctcagcctcccaagtagctgggattataggcccctgccaccacgcccagctaatttttgtatttttagtagagaggtggtttttgccatgttggccaggctggtctggaactcctgacctcaagtgatctgttcacctcagcctcccaaagtgctgggattacaggcgtgagccgccgcacccagccttcctgctggttctttatcatcaactccaatcccactgttatttcacacaagaaagaaaaaaacaaaaagctcactctttactctgcccctctgggcaccaacttatttcttttccctgtaggcttttttttttccttggaactccttgaaagtactggctgggctgggcacagtggctcacgcctgtaatcccagcactttgggaggtggaggcgggtggatcacgaggtcagaagttcgagtccagcctggccaacatggtgaaacccccatctctactaaaaaaaaaaaaaaaaatacaaaaattagccaggtgtggtggtgtgtgcctataattccagctactcaggaggctgaggcaggagaattgcttgaacccgggaggcggaggttgtggtgggctgagatcacgccattgcactccagtctaggtgacagagcaagactccatctcaaaaagtactggctgtagctgctgtgtttctcctaccccccaatcagctgtagggtgaccagcgacctcgccttcctcactccacagtgctcagccctgcagccccaccagctggcacaacaggttgccagcagccctccctcctccctgggccccttccctctctggctccccgcaccccaccatctccccatctcacagccacttctgcctaatctcctcaggccttgaaaccaagacaggtgggagccatggaggatggcagccagaggagggatgtaatctgactctcatgctccatgggccctgttcttcctctctcgacctgcaaacatcaggaagcccgaggactgagactctctgtccatacctggtccctaggtgatgccatccaggctgctggctgcaaataccagccatggactgacaactcctacattacctctttccccagaagcccagactggcatgcccactgccttctccatgtctcctctgaggccacagacccctcaaacccagcagggctgagctcctgctgcctcgagcagttccttctgtgcttgttcccacctcctgatcccagaggcatccccttaagtctgcccacttctctcgcctaccctgggtcccctcactcctgcccacacttcccatgatgtttcccctgcagctgccaaagggcacccagaacacctaggtcagattgaatccctctgcttataacctccatggctcccatctcccccggggtcaaagccaaagtcctgcccacagccctcaaggacctgcacggcctactccatctcctgcctaccctccccctcacccactctgctccagccacacaggcctccttgctcttcctctaacatgccgggcatggtcttgcctcaggccctttgcacatgctattctctgcctggaacacacttcccctctgatcaacgtggttctgtccctcacctccctcccatctctcggtacaaacgctgccagcgaggcattacctgccattctaattccaactacccacctctcccatacttcctgctcccttcctgacttttttttatttagagacagagtcttgctctgtcgcccaggctggagtgcagtggtgtgatctcagctcactgcaacctctgcctcctgggttcaagtgattctcctgccttagcctcccgagtagctgggattacgggcgtgtgccaccatgcccagctaattattgtgttttcagtagagacagggtttctctgtgttggccaaagtggtctcgatctcctgacctcaggtgatccagccaccttggcctcccaaagtgctgggatgacaggcgtgagccatcacacctggccaatttgatttaagacaaagtctccctctgtcacccaggctggagtgcagtggtacaatcttgattcgctgtagcctctgccttctgggtttaagtgatcctcctgcctcagcctcccgagtagctgggattacaggtatgcaccatcacgtccggctaatttttaatttttaatagagacaaggtttcaccatgttggccaggctggtgtcaaactcctgacctcgtgatcttcctgcctcagcctcacaaagtgttgggattacaggggtgagccactgtggccagcctaacttttgtatttttagtagagatggggtttcactatgttggccaggctggtctggaactcctgacctcaagtgacccgcccgcctcagcctcccaaagtgctgggattacaggcatgagctaccacgcccggcccgtcaaatttattttcttgttagtaaatctctccttcgcatgctgtgcagttcacgtggctgcctcacttaccatctgctcccacccatgcaatgtctgctcacaagggccgggatctttgaactgtggcctctgctgtgttaccagcacactcaagaggcccccacaaatatttactgggcagactttggtgcgctggcagccctgacccttcctcccactgcatggtccaggcacgctgagtaataataattctctgtctcacctctgcgcctttgcatatgccgtgccctgtgcctggcacacccttccctgcctcctcctggaactctcccagccaagatccccagctccttggggcagggtaccaatggtgaggcagtcctggaatctcagacacgccctcccacctccctgacccccatgggagggctgactcactgggtgggaaagaggaccagtcgggtgtagaagaagacaaaggagaagatgaggaagagagcgtcgcacacttgctgatactgcatgtagttgaccatcttacaggcctggaaagggcagcagggagaaatgggctcaggaccagggccctggtctcaaagagaaggtgctataggatgggaccaggtgagttggggtggggccttgtttccaggaactacctaccttttcaggaaaggtaaagagtgtgaatataggctgggcatggtggctcacgcctgtaatcccagcactttgggaggctgaggcaggcagatcacctgaggtcaggagttcgagaccagcctggccaacatggtgaaactccatctctactacaaatacaaaagttagctggcatggtggcaagtgcctgtaatcccagcttcttgggaagctgaggcaggagattacttgaacctgggaggcagaggttgcagtgagcagtgtgtgccattgcactctagcctgggcaagagagtgagactccgtctcaaaaaaaaaaatgtgaatacatgcgtgtgtgcacatgtgtgtagctttatcctccaaggagggagctgagaggggcagggctttatctcccaggaagatggggggcagggcctcatctcccaaggaagctgagaaggcgggggcctctgcccaaggaagccaagaagggtggggcttcatcacccaggaagacagagggggtggggccttatcagcctggaagacagagggggcagggcctcatcacccgagaaagacaggaggggtggggctccatctcccaggaaggttgggaggaatgggacctcatctctggggcacctgggagggctgggtacagcagctgggaagggtcaggcaggggtcgggcccacctccagcaggtagtcagaggaatcgtgtaacagcagcaccagagagccaatgcgcagcaggttggcactgtaggagaaggtcatcaggatgaccgccacgaagtggtgtatcacctgctccttgaaatcctgcagtagacggtgggtcatagtggggacgaggcttgatgctggaaggtcccccaccctatgggccaagaagtgggtcctttcagggggttggtgtggcctctgggcccatggcctctatatctcctgcaggaggcaccagggagctctcaaggtgcggttgtaaggctgccctaccccccagcaccccagcatcccggccagagactgggtcttccagactcttatttggcctcaccttgcgcttgacatcaaagggcagcctgattagcagtgagaggtagaaacccagctccaagaggtaccaccagtacagggatggcttcagagtctgcagcaggacaggacaaggttagctgtggggagcgaaggctccaatcgggcaggggtatggctccgggcccactccgtttgctcaaaaccaggatacttgaatcccaatgagtgagctccccatccctggaggtaatcaagggcagtggtttggtggaagctcctgcttggttttctggcccctctctattccccagaggaatcaaagagcgtgggactcagtggggaatgacagtgtagtgtcagggttcgggtcccatgcccatggctgcagcaactgtgatcatcgccctcaccctccaagcattcacacacactctgccactcacctggtttgggtacctgtcccagcacattactggtgcccacagccatgactcctgcagggaaatgggtgtcaggctgtgcagaggtgagaatccaacctcccaccctgggtctgcggtctctttggttctccttccacagtcacatagatgctaccttcacccagccctgctttttcctgcttctcactctcgactggggggctcattcactgcagaaccccaacttttggtgcatagtaaatccaaatacctgttgagtgaacattcaccaccatcttgcaaagctcgctctctcctcagctgcatgttttcctctctggctgcaccactccacacccccactcctgccagatctaggccaggtggatggggcaggtgagcagtcagctatactctggtatactcacgtggtacaggaccgagaggccgcccacgaaggaggacaggtagaagagaaacctccagctgtggatggggagggagctgtgaaaatagcagacacccgccccgccccaccccggcccgcttccctgcaccccagaagccccatcctgggcttacctggcctcacagaacttcttggtcagctggggtcgatcctggttccggcgtctccggaaccatcgctgggtctgctgcagcgtgaggccacactgggcggccaggagagacagctggggctggggagggggtgatgaggacaagggtcacagaggccctgtggtggcttcccccatgtccccagacaggacttggctctgccctctccactgcaggcccacatcttgcctacagggtgaccatgtctatatggaggggcagtgttgggggtcccagcgtggggccctgcagaacacttgggccctaagagaagcaaatcctgttcatagggcaggcaggtcgctgacggggatgggattaagagagatgctggcgtgcagcatcccctacccccggataggcttccctgcgtccctccagaacggtcagttctcacctccaacctagacaggcagttgagaccttgccccagccccaagccctacctgaagagggaaattgacaagtaaagggggagtcacgtctagctctgcggaagctgccctgtcgcctctagggtatgtggtcttcaccattccccaccccactcaggacgcagccacgcctccacagcacagaccctgtccagcgggcagccacaccagagacgggaatggagggagggtcacagggctgcttctgttactccattccctatcagctcagaccttccattcctccccaggataggagagcaagcaactactctcactctcctagaatctgtccattgtgcaactgtgcccactaaggctcagggaggctgggaggggaggggccccatctcccaaggaggctgggaaggggggggtcctcatctcccagggaggctggaagggtggggctccatgtcccagggatgctgggaggggtggggcgtcgtttcccagggaggctggggggtagagccctttcccagggaattgaggatgaagagtggaaagtaggggcattgcaggggtgcctgcagccaccttggcttctcctgccccaacaaatgggccacacaccatccccacgccccacccccagggcagtagtgcgggtcggagggcatggggggctctcacctccttgggcctgtgcccttccgtgaggaagtgtttctccagcgtggcgttgggcttcacttgcctcctggtctgatccctcacacccagccaccggctcaggggcaggccaatgaatctgggtgcaaaggagacagagcctatcagcccaggtgaagagatgggactgcctgtgtgtgggggcagacatgctgccggtgggataaccaagtctcggaggggcaaagttacaggctcagagagcacagctggcacatggcagggtgtgtaagacttttttttttttttttttttgagacagagtattgcactgtcacccaggctggagtgcagtggcgcgatcttggctcactgcaagctccgcctcccgggttcacgccattctcctgcctcagcctcccgagtagctgggactgcaggcgcccgccactacgcccggctaattttttgtattttttagtagagacggggtttcactgtgttagccaggatggtctcgatctcctgacctcgtgatctgcccacctcggcctcccagagggctgggattaccagcggtgagccaccgcgcccggcctaagacttggtctttcttttccatctgatcagagggtttggaggcccagagtcagaaaggctcgtggggcaggactcgattttccacttattcctggcctcatcccctggggccctggaggggtggcctggctgctgcgttagaccaaacataagaaaggcagctgactcatgcctgttatcccagaactttggggctgaggtgggcggatcacgtgaggtcagaagttcgagaccagcctgaccaatatggtgaaacactgtctctactgaaaatacaaaatcatctgggtgtggtggcgtgcacctgtaatcccagctactcgggaggttgaggcaggtgaattgcttgaacctggaggtggaggttgcagtgagccaggattgcatctactgaaaatacaaaaaattagccgggcgaggtggcgggcccctgtagccccagctatttgggaggctgagctgaggcaggagaatggtgtgaacccaggaggcggagctggcagtgagtcgagatcgcaccactgcactcaagcctgggtgacagagcaacaagactctgtctccccaaaaaaaaaaaaaaaaaaaaaaggcagctggacctttgtctgtagggtgagggtgtgcagaccaactcttggggtacccaggtacctttgcccaatcccaaaccagggacaagagtctcttcactgcctgtctcactgtggcctgggtcctggtctgaccccccgccagtctaggggctccccatgggcaggggctggggctgttcccgctccaagcccctcctcccagcatcccccattccggggtagaggcttggagatcagggaccctggtcaatggccacgttgcccacaagagggcgcgccaacaccacaggtggggaccgaattttatatccaccatccctcctaacatcctgcctcatttggtgaaaggctcagagcagcctagcaaggaactcattgcagaataaatcatgatgcggagagaatgagcgcttattatctgctaagcatggggccaagtccatgtgatacattggctcgtctaaccctaactcagttcctattgtcctaatgggtaaactgaggctcagagacatgcccaaggtgacactgtgagcaggtgaaagacctgaaatttgaactcaggattctggtttttgttcctgcctcctgcctcttaaagtctcattttggaggtggagggcgggaggattgcttgaactcaggagttcaagaccaacctgggcaacatggtgagaccttgtctctactaaaaatacaaaatttagctgggttgtggtgtcacttgcctgtaatcccagcactttgggaggccaaggtgggtggatcacctgacgtcaggagtttgagactagtctggccaacatggcaaaaccccgtttctattaaaaatacaaaaattagtcaggtgtggtggcacatgcctgtaatcccagttacttgtgaggctgagataggagagtcgcttgaacctgggaggcagaggttgtagtgaactgagattgtgccactgtactccagccaaggtgaaagagcaagactctgtctcaaaaaaaaaaaaaagttagccagccatggtggcatgcctacagtcccagctactggtggggatgaggcttttgttctttttttttttagatggagttttgctcttgttgcccaggctggagtgcactggcatgatctcagctcactgcaacctctgtctcctgggttcaagcaattctcctgcctcaacctcctgagtagctgggactacaggcatgtgccaccacacccaactaattttttgtacttttagtagagacagggtttcaccacgtttgtcgggctggtcttgaactcctgacatcatgatccgcccaccttggcctcccaaagtgctgggattacaggcatgagccactgcacccagcctaatttttgtatttttttttttttaatagagatgaggtttcaccatgttgcgcagtctggtctcgaactcctggactcaagtgatccacccacctcagcctcccaaattgctgacattacaggaatcagctaccacgtctggcctagattcaaaaaaaaattttttttaagggctaaaacccctgcgtttgaaactggaaaaccctccgcccaccccactgtccttcacagaggccctgggatgcctttgggatgggataacaccccagctcacatttttttttttttatggagtcttgctctgttgccgaggctggagtgcagcggcacaatcttggctcactgcaacctccacctcccaggttcaggcgattctcctgcctcagcctcctgagtagttgggattacaggtttgcgcccagctaatttttgtatttttagcagagacagggtttcaccatgttggccaggctggtctcgaactcttgacctcaagtgatccacccgcctcagcctctcaaagtgctgggattacaggcgtgagccaccgtgcccggcctcccatccctgttttatgaagatgctggcatacccagctgcaggctgcaggcagtgcagtgttcctataaaccagctgcagtcagtgttcctataaaccagccatcagaggccagaagtgtgggtggtggcggctgggggcaggctggagccagggaacgcgctttggtgcaaagccagcttctactcgggacatgctgcaatggcaaattgcacacagggcacgagcacatactggagcgactgcgggggcaatggattgcggcagggcagacactcacctctcaaaggcaaggcgcatggccaggaggaccagcgccaggggcagggctgccaacaagtcctgggggtgggggtagacacggccatcccggtcttctagctctgtccacgtgacattgggtggtaaccagaacctgtcctgccaaaaccactcgttgaaactggacagcattctgtggacacaggttccagttagctgggaggtctgcaagcagaatgggtggggcaagtggggcctgagaggctggagcctcagaactcctactcgggcccctatcagcgcagttgacaaccaggaggcaggactggaagatggaactccccttgcctgggactttggaactgtcctctggtcccagaagagccaccacttcattctcatcactcccactccattgcctggtcagtgttaaaaggcagagttgggctgtgtgtcctcaggcaaatgacttgacctctctgaacctcaagttcatctgtaaaacagagtagtaggccgggcgcagttgctcacgcctgtaatcccagcactttagaaggccaaggtgggtggatcacgaggccaggagttcaagagcagcctgaccaacatggtgaaaccctgtctctactaaaaatacaaaaatgagctgggcgtggtggcacatgcctgtaatcccagctactcaggagtctgaggcaggagaatcacttgaacctgggaggcggaggttgcagtgagccgagatcgtgccactgcactgcagcctgggtgacagaacaagactccatctcaaaaacaaaacaaaacaaaacaaaaaaacagagacagtaatacccaggcttctcaacctaaagtgcttggccgattgatctttaacaagagtaataataacacagcccaaaatagtagttattactctgcacttaactgatgccaagatggtagccagaagtcaagggagtggctgcttggggtcagaaacttgagtcgtggccgggcaccatggctcatgcctgtaatcccaacactgtgggaggctgaggtgggcagatcacttcaggtcaggagtttgagaccagcctggccaacatggcaaaactccatctttactaaaaatacaaaaattagccgggcgtggtggcaggcgcctataatcccacctgctcaggaggctgaggcaggagaatcgcttgaacccgggaggaggaggttgcagtgagccgagatcatgccactgcactccagcctgggcaacagagaaaaactgtctcaaaaaaaagaacttgagtcctcaaacgtccaggaaggtttctttccactgcaggaagctgcctctgaagcagcccccaaagatgaaggatttaaagaaatccagaggccgggctcagtggctcactgcctgtaatcccagcactttgggaggccgaggcaggtggatcacgaggtcaggaattcaagaccagcctggccaacatggtgaaaccctgtctctactaaaaatacaaaaattagccaggcatggtggtgtgcgcctgtaatcccagctactcgggaggctgaggcagagaattgcttgaacccgggaggcggaggttgcagtgagcagagatcaggccactgcactgcagcctgggtgacagagcaagactctgtctcaaaaaaaaaaaaaaaaaaaaaatccagagttcctttcctggccatctatggaaggtaggctcctctctaggtgggaatttcaggggggtctcttgctatcccagagcccacaaagcaagagggtaagagagcctactgcataactgagcttgcctgataatggagtggcggtcgaggtggggcagctccggccagcgtgtcccagcctgcttgaggagcccaaagagctgctcccttccctgagatcttgagccaagggtccagcctaccacagtggttcccactcagaaagtttgttcgttcattcgtctgtccacgcatccccctgtccatctatctaccgatccatccctctatccacccatccaaacatctgtccacccacccatcatccatccacccatcgtccatccacccatccaaacatctgtccacccacccatcatccatccacccatccaaacatctgtccacccactcatcatccatctacccatcatccatctgttcgcccatcaaaacatctgtctatccacccattattcatcatccacctatccactcatctacccatcatccatccatccacccatccaaacatctgtccatccacccatcattcatctgttaattcatcaaaacatctgtccatccacccattatccatcatccacctatccactcatccatctacccatcatccatatgtccacccatccaaacatctgcccacccaccatccatccacccacccatccaaagatctgtccacccacccatcatccatcaacccatacaaacatcatctatccacctacccattcatccatccacccatcatccatccatccatccaaacacctgtccatccacctatcgtccatctgtcatccatctacccacccattcatccatctccccatccattcatccatccatctgtccacccacccatcatccatccactcatccaaacatctgtccacctgcccatcatccatccacctacccattcacccatccatccatcatccatctgtccacccatctaaacatctgtccacccagccatcatccatccactgatccaaaaatctgtccatctacccatcatccatccattcatcatccatctgtccacccatctaaacatctatccgctcatcatccatcactcacttgtgtgtccttccacccacccatccttctgtccatcttttcttccatctatccatttccccttccatccatccatttatccatctgtcgttgcatctatccgtctgtctgtccatccatccatccaggcaagagatattctccaattgacttgtacatgtcaggtcagggctgggccttggcgacacagcaggggaataaagccaacacattcctgcccagctcacagaccaacagagaaggcagccaataaacaagtaaacagattcataaatgaatgagatgccaaagtataacgggccgggtagataacagagtggcgtgattttaaatgtgatcaaggagaggctctctaaggaggcgccacctgagctgggacttaaagatgaggtcgtcaggccaggtgcggtggctcacacctgtaatcccagcactttgggaggctgaagcgggtggatcatctgaggtcaggagttcaagaccagcctggcccacatggtgaaacctcatctctactaaaaatacaaaaatcagccaggtgtggtggcatgtgcctgtaaccccagctacttgagaggctgaggcaggagaatcacttgaacctgggaggcagaggttgcagtgagttgaaatcatgccactgcactcaagactgggcaacagagcaagactccatcttaaaaaaaaaaaaaaaaaaagatgcggaggtcaggccaggcaaagtggttcatgcctgtaatcccaacactttgggaggccgaggcaggtggatcacttgagctcaggagttcaagaccagcctgggcaacatagcaagaccctgtctctacaaaaaatttaaaaagtagtcaggtgtgctggcacgtatctgtagttctagctattcaggaagctgatgtgggagtacgacttgagcccaggagtttgaggctgcagggagctacgatcacaccactatactccagcctgagggacagagcaagaccctatgagaaaaaaaaagatgagaaggttgtgggtttttcacacaagaaggtggggctgggggaggggctttctagataaatacgcagcaggtgcaaaggccctgaggcaggaccatgcctgggatgttggagcaacagtgaggaggtccgtgtggctggtgcagtgagcaagggggagagagggaggaggggagggcagggaggtgatgaggggcagcacagagcctgcaaggcatgggggccgcagggaagaatctggattatttcccccaacattttgagatggagtctcactctgccgcccagcctggagtaccgtggcacgatctcagctcactgcaacctccaccttgagggttcaagcaattctcgtgcctcagtctcccgagtagctgggattacaggcatgcgccaccatgcctggctaatttttatatttttagtagagatggggttttgttatgttggccaggctggtctcaaactcctgacctcaagtgatctgcccgcctcagcctcccaaagtgctgggattataggcatgagccaccgcgcccggccttcccccaatgttttataataaacatttcaaacctacacaaaagttgaaagaattttacagtgaatacctgtattcccaccactagattctcccctttgcattccattctgtttattccatcacccatctgcctctgcccatccatccctctatccaccatcagtctatctgcttgttcccgatgcatttcaaagtaggcagctgacctcaggccacatcgcccctacacatgtcagcacacagatcattaactagggttcaatatttgcttatgggtttttcctttcaaggtaaaatttacccaagtgaaatgcagactttttgtttttttagacagggtctcactctgtcacccaggctggaatgcagcgatcatggctccctgcagccttgacctcccgggctcgggtggtcttttcatgtcagcccccgcagagccaggaccataggcacacaccaccatgactggctaatgttttaaatttttgtgtagagagagggtctccctatgttatccaggctggtctcaaacccctggctcaagcgatcctcccgccttggcctcccgaagtgttgggattacaggcatgagccactgcgcctggcccgcacacatctttaagggtacagtcactgagtttggacaaaactatgtacctgactaatccagtctcctatcacaaatatttcctctagaaacttccctcatacctcttcccagtcaacctccacccctgtcctgtcatccaaaagtaacaaccattccagtttttttgtttttttgttgttgttgttgtttagacagggtctcactctgtggcccaggctggagtgcagtggtgccatcatacctcactgcacacttgacctcctgggctcaagcaatcctccccactcagcctcccaaattgctgggattataggcatgagccaccttgccctgccccccaccagctttttttttttttttttttttttttgtcatcaaagcttagttttgtcagttcttcatgataaccttgccatgttacaaaataaaaataggccgggcatggtggctcaagcctgtaatcccagcactttgggaggccaaggtgagtggatcacttgcgatcaggagtttgagaccagcctggccaacacggtgaaaccccgtctctactaaaaatacaaaaattagccaggggtggtggtgggcacctgtaatcccagctactcaggaggctgaggcaggagaattgcttgaacccgggaggcggaggctgcagtgagccaagattgtgccactgcactccagcctgggtgagagagcgagacttcatctcaaaaataaataaaataaataaaaataaaaataccataaccccagtgtttaggaggctgaggcaggaggattgcttgaacccaggggtttgagaccagcctggacaacatagcgaaactgtctctacaaaaaatacaaaaattagccgggcaaggtggcatgtggccataatcctagctactcgtgaggcagaggcaggaggattgcttaagcccaagagtttggggctgcaatgagctgtgatcatgccaccacacttcagcctaaatgacagagtgatacctgtctccaaaaacagagtaaatcaataaaaaataaaaatatataaataaaataaaaaatagacccaggtgcagtggctcatgcctgtaattccagcacgttgggagactgaggcaggagaattgcttgaagccaagagtgttttttttttttttttttttttttgagatggagtctcgctcggtcgcccagcctggagtgcagtggcacgatctcagctcactgcaagctcagcctcccgagtagctgggactacaggtgcccgccactacgcccggctaattttttgtatttttagtagagacagggtttcaccatgttagccaggatggtctagatctcctgacctcgtgatccacctgtcttggcctccgaaagtgctgggattacaggtgagagccaccgcgcctggccaaagccaagagttcaagaccagcctagggggcagccgggggtggtggctcacccctgtaatcccagcactttgggaggccaaggtgggcaaactgctttccaaggcaggactgcaccatcttacactcccagcaggagaatgtgagggttccgttgcccttggttctattttgaataatgcagggattctcaggtgttggttgccatgcagggcgtagcattttggaggccagaagagggtgctctggcatgtccagttgagataaggtagagataaggggattccagagacattttagaggtggggccccccaagagccaaatgctttccaaagtggagccagaaaagagaagggttgggagaggaaattggcaagatattggtcaaaggatatgacatttcagttagcagcagtagtaagtccaagagatctgtacatcatgatgattttagttaataatatagtatatactggaaaattgctaagagactacattttctgcagggaggcaatctctcactctgtcttccaggctggaatgcagcggtgcaatcatagctcactgcagcctcgatctcctgggctcaagccatcttcctgcctcagcctcccgagtagctgggactacaggctccagccaccacacccagccatttcctgccttttctggctttagaggctgcctgcaccctccagctcctggtcccttcctccatcttcagagccagcagtggctagttgggtctttctcccaccttgtcattctgacagtgtctctcctgcctccgtcttcttcattttaagacccttgtgatgacactgggttcacccagatgatctcccatctcaagctcagctgattaacaaccttaattccatcttcagcctcaccccacttggccactgaagctgtcagccttccagtctgaagaactggatgaaccagaatggatgagctgatttcaggacaggagtcaggctaagtgtcagacaacacaaattgtgggtgtgggggagggcagctaaaatgttcccgtgggcgtgtggaggaggcaggagctactcaggtttggggcacaggcttggggtgggtggggcctgggtaggacttgtcagtgagtggctgctgttgaaatccatgaagatggatggaatcctctatctatcagcaaggggtcaacaagaccctgttttgggggaaaaaaaaaaaaaaggaagagactgcacatgaaggggcaggctaagtaccatgctatggggcaactgacatttaggcatcagtgaagtattagaagctgttgctagcattggatactctggttggggaggggcactagaagtcagtgacccaacaagcagtcaagggtgtgggatagcagctagtctagacctacaacgaggcccaggcatcccagacagagtagacacatgaacagctgggtggatgtggggacttcagcccaggtggttgatttctcaagaaaaagaaatcatcttcactagcagacaaggttggcttgatcccgtgtgcccgtgggggctcaaggacacatggccagcttggcactcttggtcccaactgtactcagctctcacagccaaagccatgaccactgcagggtatctgcaatcccctatttttttttttttttttttttttttttttagagacagggtctcactttgtcacccagactggagtgcactggcctgatcatagctcactgcagcctcaaactcctgggttcaagccatcctcccacctcagccttctgagtcactggtgcagctttctcagagaccctgctacctttctgacagaccccaaggtgcagatggaaggggactaggtgtcctaggaaggcccaggcatccagacccccagctccatgttttcccctcacccaagggtcttggatgcatccttgcacaccttggtacattcaagtcatgatgagtgtaggggatgagggagaaccacaggagcaatggcttctcacaatctcaagccttgcctctgctgatgtgcccagcttcaatgcccaccagtttactgactgatactctgctcccaccagaccatatcgtttcacacatcctagcctttacaaatactggcctctgcctagaatgctcatttagtatttgggtgctgaagacacaaaatggtggggaaaacaagcaacatctctgccctgaagagcttaaacgctttctttctctgtttggcaaactcctatgcatccttcaaaacccagctcagttgtcacctcctcctgaaagcagcccaattgccctgctttggatcctgttaaagcaccctcccgcaaccctgtcttactgtgatgtcaggagctggccagtgtttttgcagggagggttggagaaggaagcataaccagttctaaactctcctctcctctgctgaatcatgcccattgcttcctgagtggcacagaaaggggaacagatgcactttctaaaccagggagctctccaaggaggcttcagactgatatgccctgattgcagaggtctggccccagaggtcctactctctcactaacctcaccaacctgtctctgtctcgtcccttccctcttctccctcttaaagcataaataaaagatgctgtggtttgagaaaagaacagggtctggagcccagcagactggctggagtcctagctgcaatgcttcaaagccctgggagcctcaatttcgtcacctgttggtgggacaggtgccctccctgaagggtggttaagcagctcagagaccttgcacctggggcattgaggcagagtctggcatatgggaggggctcaggcatggctataaccaggcacctcaggccagcaaggctcaacttctcctgagggaagggaggaaatgaggctgagggatgtgttcctcaatttctagcttttctcttttggatccagttcttctgtttgttccctgtcatcctctgtcttcctgggcctcagttgtcccatctgaaaaatgggtacagctagattccctccttgttctaccaggctattgtgaggctcagggcaggcgggcagtttataaacactccatgctgatatcacaacggatctgattcctgattcctgcctcacccgtttaccaggcatggaacgtggcctatctgtgcctcagttttatctgtaaaatggaacaaacaatagcccctcttccacatggagtggttcggaatggcacctgaggtggagtgagcacctagtaaaatttagaggaccgagtgcagtggctcacacccagcactttgagaggccgaagtgggaggattgcttaaggtcaggagttcgagaccagccagggcaacatagcaagacaaaaaaatttaaaaattaggtgggcatagtgacacacacctgtaatcccggctactcaggaggctgaggtgagaggactggttgagcccaggagtttgaggctgcagtgagctgtgatcacaccactgcactccagcctgggtgacggagcagatcctgtttcggaaaaaaaccccccaaaaaacagcttagactgtgatagttactgctagacaggaggtgggggcaggatggggagtggtctggaaagaaggggtgctggcctatggaggcttctagatggttcttccaagcccttaggacggtttccagcatctgaggtgcctaaggctgctggaagctttccttgcccctgccaccttcccttaaagctgcagctgaagtgtttgggctgggctggacgacagcagcttcagggtcatctgcagagccaccgcgtgggtggcagggccagtgtgaccagcctcttctcccctcaccccacccgcccccaagcctggctgctgtttgaagcctccctggccccactcccagcttggcccctgccacctgggaaccaaactgataatccttcttagtggctaaaaatagccccagattgggggaaagagagagaatggggctttgtactgacacgggaggtgggttagggggcatgagtagaggatccctgcccctcttcaggggtctgagtgagaaggactggttcccacggcttccccgaacccccaaggaccctggcactgctcagcagatcagagctatgcacataggtttgttttgttttgctttcaatctagctggaaatacaggacttgtccatggttgtgaaaaaggcaattaattcagaccccagatgtctgggcctcccagagatgaaaacacacacacacacacacacacacacacacttgcatacattgactcactcacccgcccctgcagcctggcccgctgcctggggtcacctgattcctgcggccagaggctcaggcgggagcacgtgacatgctggaaggaagggggctgtttgcagataaccacagcctgcctctgcaccgggtcctggctgtcccttccagacggacctgtctcttccactctgagcctctctgagcagaggtcccacagggtgttagtgaccagagatgctgccggttgaggtaccactccccccaaagaccccaaggtggaccccaagttcaaggttccgccttacctgagccccttatttctgcacacattcctgccctctacattctggccctgctgcctccccacctctgcctccccagcttaatccatagcaactgctgcttgctgggcttccaactcaccaagctcacttgtaccatgtttgcaccccagacagtcacatacatgtctgactgtgttatcattcttatttcagctcaaatgtcacctcctccaagaagacttctcagactaccaccaaagaggccaccatattattctgtctcctgatcctgtgtagttccttcaaccctcttgtcccagttgatctgtttcattggggtgtcttcttcaccccaaggcataagtttcatgaaagaaaagaatgttgtttgagtcactgctgtatcctcagagcctcagacagggctggacacattagatgccacataaatgtttgctacatggatgaatgagtagaatagacagatggacaggtgggagggtgcaaggatgttagctcaggtggtcaaactctctagaaaaataacccacccttaacaggcatggttggcttgatctccataaacattcccataaaggaaacgtgggaactgggaagcccaaggctcaaagcaagaaatgactagagacagatcacaggtcactcagtcagcaagggggacagtcaaggatagaagcttccttgggtgaggagggggctgctctgctcccacagtgggctcagggttcatacggtcctgcggaggcctccccaggcctacctctgctgattaaagtttccccaaaaagcaagctcctccttctacttgccctctaagctttcggggtactagaagctaatcatgcaatttttcttttttctttttcttttttttttttgagacggagttttgctcttgttgcccaggctggagtacagtggcgcgatctcggctcactgcaacctctgcctcccgggttcaagcaattcttttgcctcacccacctgaataactaggatgacaggtgtttgccatcatgcccgggtaatttttattttagtagagacggagtttcaccatgctggccaggctggtttcgaactcttgacctcaggtgatccacctgcctcagcctcccaaagtgctgggattacaggtgtgagccaccacacctggccacaatttttctttcttaaagagatggggtctcattctgttgcccagactggagtgcagtggcaccattgcagctcactacagccttgaactcttggacttaagtgatcctcccgcctcagccttccaagcagctgggactacaggagcatgccaccacacccagctaatttttgttatttttttgtagagatagggtcttggtatgttgcccaggctggtcttgcactcctggtcttgagccattctcccactatggcttcccaaagtgctaggattaccgacacaagccaccacactcgggctcagcgtgcaatttcttaatgtctatgcccctggaagctcaggagcctccgtaagctgggccatgtcccctgggtatccccagcctcctcccctattgcatcttcttggaaccattccctggcaaccacctctcctgtcagccccctcaaaacctacaaccaatactggaccatgaggatcccccagcaggtgcccacccaactctggcctggtgcctgctgtgggaaggaagtaaagaggggcctccacctccttacccttctggaatcatctgtctcttctgcagttctattcaagctctggttacctcagccccatgccatccagatggtatgattcccaagaccagccccaagcctccaggcctctgcatcagtgccctttttccaacatgcctccgccctcttccctgggccagttcccacttgcctttcaagtcctggatcagattaaaatccctatttaagaggcctcccctgctcttcctatgctaggcagagtcccctccccagccaatacccctccctgcccctagacctttcttctgagccagccctggctccctggaggttggagtattcaagtctgcctctaagtctctccccagttagtgatggtcaggccagggtgagatctccaggggcccccagcatcccagagtaaagtggggaggtccgtgagggaggagagaggatctggtctctggggggttggagggaaaaaatgagcagtccccagccccagaggtggagtagtggagcagggattgtggggggggattaccatctgattgttactcgcacagagacaggattaagtatacacgtgggagtgtgagggggcccacttgggctattaatggtaaaaaaataaaaataaaaacagcattacggaggtataatcaacaggcaagaagctgtacgtgtttaaagtgtgagatccaacacttttttttgttttgttttgacacggagtctcgctctgtcgcccaggctggtgtgcagtggcgcaatctcggctcactgcaagctccacctcccgggttcacgccattctcctgcctcagcctcctgagtagctgggactacaggcgcccaccaccacgcccggctaatttttttgtatttttagtagagttggggtttcaccatgttagccaggatggtctcaatctcctgaccttgtgatccacccacctcagcctcccaaagtgctgggattacaggcataagccaccatgcctggcctacttttttctgtttttttgagatgcagtctctatgcccaggctggagtgcagtggaatgatcttggctcactgcaacctctacttcctgggttcaagtgatcctcttgccgcagcctcccaagtagctgggatcacaggcatccaccaccatgcgtggctaactttttttgtgtttttagtggaaatggggtttcacaatgttggccaggctggtcttgaaatcctgacctcaggtggtctgcccgcctccgcctcccaaagtgctgagagtacaggcatgagccacggcacccagcagttccaacacattttgacatatgtacacacccatgaaatcaccccctcaatcaagataatgaacagaaagctggaggctgagtgagctacacctagtccagcagcctttaccaggtccaaggtaacaggatctttatctataatcgtctctgtgttcctggggcagataactgtgagagaactaacagcaaggtgacttgcaagctaagaaataaacagatttctttcttttctccttttcgtttttttttttttttttttttttttgagacagagtctcgctctgttgcccaggctggagtgcagtggcctgatctcagttcactgcaacctctacctctctggttcaagcgattctactgcctcagccacactgagtagctggaattataggtccatgccacgatgcctggctaatttttgtatttttagtagagatggggtttcgccatgttggccaggctggtctcaaactcctggcctcaagtgatccatctgccttagcctcccaaagtgctgggattacaggcatgagccaccacgcccagccctgttttttctttctttctttttttttttttttttttttagaagacagggcctggttctgttgctcaggctagagtgccgtggcgagatcacggctcattgctacctctgcgtcttgggcctaagtgatcctcccacctcagcatcccaagtagctaggactacaggcgggtgccaccacacccagctaatttttgtacttttttgtagagatgggatttcaccatgttgcccaggctgggctcaagcgttcctcttgccttggcctcccaaagtgctgggattgcaggcatgaaccaccacgcccagccataagcagaaatttgacccaaactcttgggaaagtttaagaaacacctagcatatacagagttccccctccaaagaaaaccttactaacgcatatgtcatgttaggaaacgtctttctcgatttgaactaacaaaactctggtacaccaaatgacaagtcatgaaataggacatgtaaaaccttttcaactagaaggcatttttttgtttgttttgagacagagtctcactctgtcacccaggccggagtgcagtggcgcgatctcggctcactgcaagctccgcctcccggtttaccccattctcctgcctcagcccccggagtagctgggactacaggtgcccgccaccatgcccagctaatttttttgtatttttggtagagacggggtttcaccgtgttagccaggatggtcttgatctcctgacctcgtgatctgcccgcctcggcttcccaaagtgctgggattacaggcgtgagccaccgcgcccggcctgttttgtttttgttttgggatagggtcttgctcttgttacccaggctggactacagtggcacgatcacagctcattgcagcctcaacccacctggggctcaggtgatcctcccacctcagcctcctgagtagctggaaccacagacacatgccaccagcctgcctaattttaaaattctttatagagattggggggagggtctcactatgttgcctgggctagtctcaaactcctaggttcaagcaatcctcccacctcggcatcccaaagtgctgggattataggcatgagccaccacacccagcctgaactagaagttgtattttttatttattttttgacagggtttccctatgatggccaggctggtctcgaactcctgacctcaggagatccacctccctcggcctcccaaagtgctgggattataggcattagccaccatgcccggcctgaactagaagttttaaaacagcaaatggggaaaaaaaagcaaaaagatggccctgtaatcccagcacattggaaggccgaggcaggtggatcacctgaggtcaggagtttgagactagcctgaccaacatagtgaaacctcgtccctattatgccaggtgcggtcgttcacgcctgtaatcccagcactttgggaggctgaggggggcagatcacgaggtcaggagatcaagaccatcttggccaacatggtgaaaccccgtttctactaaaaatacaaaaattagccaggcatggtggtgtgtgcctgtaatcccagctactcgggaggctgagtcaggagaattgcttgaacccaggaggcagaggttgcagtgagccgagatcctgccattgcactccagtctgggcaacaagagtgaaactctgtctgaaaaaaaaaaaaaagaaagaaagaaagaaaaagagaaagatacaatatggataaatcttgaggacgttatgctgaatgaaataaacctgtcacaagaggacaaatcctgtatgattccacttatatgaggtctctagaatagtcccattcatagtgacagaaagtagaatggggccgggcgtggtggctcatgcctgtaatcccagcactatgagaagccgaggcaggtggatcacctgaggtcaggagttcgagaccagcctggctaacaaggtgaaaccccacctctactaaaaatgcaaaaattagctgggcatagtgatgcgtgcctgtaatcctagctacttgagaggctaaggcaggagaattgcttgaacccgggaagcagaagttgcagtgagtttagatcaagccactgcactcctgcctgggggatagagcaagactctgtctccaaaaaaaaaaaaaaaaaaaaaaaaaaaatagaatggtgggtgccaggggaagggaaatggggagttaaaattgaatgggtaaagtacagcatttcagttttggaaaacaaaaaggttctggaagctgggggctgtggctcatgcctgtggtgcagctactcgggaggactgcatgagcccaggcgttggaggctgcagtgagctatgactgcactactgtactccaaccttggagacagagggagactgtcttatttatttttttgagatggagtctcactctgtcgcccaggctggagtgcagtggcgcaatctcagttcactgcaagctctgcctcctgggttcacgccattctcctgcctcagcctcccgagtagctgggactacaggcacctgccaccatgcccggctaattttttgtatttttagtagagacggggtttcaccgtgttagccaggatggtctcgatctcctgacctcgtgatccgcccgcctcggcctcccaaagtgctgggattacaggcgtgagccaccacgcccagccgactctcttattttgagacgaggtctctgttgctcaggctggagtgcagtggtgctatctaactgcaaccttcaccacccaggctcaagtggtcctcccacttcagcctcctgagcagctgggactacaggcgtgtgccaccatgcccagctaatttttgtgtttttgtttgtttgtagagacaggatttcgccatgtcacccgggttggtctcaaactcttggaatcaagcgatccacctgctatggcctcccaaagtgctgggattacagacgtgagccaccgcgcccggccccacaattaaaaaattttttaattttaaaaattactaaaggaggtatggggtggaggaagagctatgttcaatggcttgggaggattatggagttaaaaaaaataaaagcaaagtacagagagacactaatggcctgataatttatacaatggaaaaccacaagaattctccttctggtaatggtgaagtcagccacatcaggccagctctttcatagataacaatgataaacactgagctaaatataaaaaaacaactacctgggccaggcacggtggctcacacctgtaatcccagcactctgggaggccgaggcaggcggatcacctgaggtcaggagtttgagaccagcctggccaacatggtgaaaccccgtctctactaaaaatacaaaaaattagctgggtgtggtggtacgtgcctgtgatcccagctactcgggaggctgaggcaggagaatcgcttgaacctgggaggcggaagttgcagtgagctaagatcacagcactgcactccagcctgggtgacagagcaagactccgccccccaaaaaaaaattagccgagtgtggtggcttttgcctgtaatcccaggctgaagttggaggattgcttgaggccaggaatttgagaccaggctggacaacatagagagaccctcatctcttaaaaaaaataaaataaaaagattcaggctggctgcagtggcttatgtctgtaaccccagcactttgggaagtcaaggcgggaggatcactcaagcctaggagtttaagaccagcctggacaacatagtgaaacctcacctccacttcaaaaaaaaaaaaaaaaaaaaaaaaaatcagcgaggcatggtggtgtctccctgtagtcctagctactctctaggaggctgaggtggaaggatgacaagcctgggagatctaggctgcagggagctgtgatcacaccaccagcactctaacctgggcaacagggtgagaccgtgtctcaaaaaaaaaaaaaaaggtttaaataaaaaggttttaataaatatgttgcactaacaacatttgtatactcaatagccacatgtagccagtggctaccactttgcagaattcagatatggaacatttccatcattgtagaaaattctaggccgggcacagtggctcatgcctataatcccagcactttgggaggccgaggtgggcagatcatctgaggtcgggagttcgagatcagcctgaccaacatggagaaaccccgtctctactaaaaatacaaaaaaattgccgggtgtggtggcacgtgcctgtaatcccagctactagggaggctgaggcaggagaatcgcttaaacctggaaggcagaggttgcagcgagccgagattgcaccactgtattccagcctgggtgacagagcaagattctgtcttaaaaaaaagaaaagaaaaaagaaataaaattctactggacagtatcactctaaagaggaaaaacaagtagcaatcggaagggaatctataaatggaagaaagaaatggcactgggtgaatttctcatttttattgctattcattggagataaaaactggcttaaagattaagaggatagggccgggtgtcgtaactcatgcctataattccactgcttcgggaggctgaggtgggaggattacttgaggctaggagtttgagaccagctttggcaagatagtgagaccctgtctctaccaaaaaaaaaaaagaaaaagctgggtgaggtggtacatgcctgtagtcccagctactcaggaggctgaggtgggaggatcctttgagcccagaagctatgattgcaccactgcactccagcctgggagactgtctctaaaaaaaaaaaaaaaaaaaaaatgctgggcacagtgcctcatgcttgtaatcccagaactttgggaggccaaggcaggcggatcacgaggtcaggaaatcgagaccatcctggctaacacgatgaaaccctgtctttactaaaaatacaaaaagaaaattagccgggcatggtggcgggcatctgtaatcccagctactcgggaggctgaggcaggagaatggtgtgaacccaggaggtggagcttgcagtgaaccgagatcacaccactgcactccagcctgggcgacagagcaagactccatctcaaaaaagaaaaagaaaagaaaagagccagagatggaaagccccatattctacattaaaagtctgtgtacatctcttgctgactcttagcccatggatattgaacgtattccaactagccttgctgaggctaacagaactaggccaagatttcatctgctacccaccacaggagaaacagactttggagtctgagtccagccaggttaactgcctgataaaaaaatagttaaattttaaaaaatcattgctcttcaaaggaacataacagaatccagagactctacaacatatcttccacaatatccagcactcaatccaaaatttcttgacatctcacaaaattggaaaacatggcccatgctcaggaaagaaggaagttaaaggagactggctctgaggtgacccagatgttggaattagcagaaaggtgtttgaggcagctattatgtctgtaatcccagcactttgagacgccaaggtgggtggatcactagagttcaggggttcaagagcagctgggcaacatggtgaaacaccgtctctacaaaaaatacaaaaattagctgagcgtggtggcataagcctgtagtcccagctacttggggggctgaggcaagaggatcacttgagcccaagaggttgaggctgcagtgagctgtgattgcaccactgcattccagcctgggcaacagagtgagaccctgtctcaaaaacaaacaaacaaacaaaacaaaaaacaaatggaaattataaaacttaaaaatatacacaatctgaaatttaaaaattcactgtttgggcttgatagcgcattggagatgataaaagaaagtgctaacaaatttaaagacagattgatagcaaatatccaaactgaagaacagagaagaaaaaagtttaagtaaaaatggatagtggtaatggttgcacaacactttgaatgtactgaatactactaagttgcacacttaaacatgtttaaaatggttaattttatattacatatattttacctcaatttagaaactgtatagagccttggtattttctggatgatatcaaaagatctaacttatggctgggcacagtggctcccgcctgtaatcccagcactttaggaggctgaattgggcggatcacttgggtccaggagtttgaaaccagcctggccaacatgatgaaaccctctctctaataaaaatacaaaaattggccaggcgtggtggcacatgcctgtaatcccagctactcgggaggctgaggcaggagaatcatgtgaacctgggaggcagaggctggagtgagccgagatctgagatcgcaccactgtgctccagctcaggcgagactccgtctcaaaaaaaagaaaaaaaaagaaaaaaaaaggtctaacttgcatgcaatgggagtactagaaggagaaaggaaagagaatggggcaggtgaaatatttgaaaaaataagaaagaacaccaaaggattttgatttttttccctatggctacatatatgcacataaacacacagaagaaggctgtaaggccagatgtggtggctcacacctgtaaccccagcactttgggaggctgaggcgggaagatcacttgagctcaggagttcgaggccagcctgggaaacacagtgagaccttgtctctactaaaattaaaacaacaacaacagcaaataacaactagctgggtgtgttggcacatgcctgtagtcccagctactttaggggctgaggcaggaggatcacttgagcttgggaggttgaggctatagtgagtcctgaacatgccactgcattccagcctgtctgacagagtgagaccctttctcaaaaaacaaaaaaggctgggcatgttggctcacacctgtaatcctagcactttgggaggccaaggcaggcagcagatcacctaaggtcaggatttcgagaccagcctggccaacatggtgaaaccctgtctctactaaaaatacaaaaaaatagctgggcgtggtggcaggcacctgtcatcccagctactccagaggatgaggcaggagaatcacttgaacccaggagacggaggttgcagtgagctgggatcgcactgaactccagcctgggtgagagcgacacacgaagaagaagaagaagaaaaaagaagaaagaagaagaagaaaaaagaagaaagaagaagaaggctctaagggtatagtccacatgcatgtgagttgttatactagggagctggtccgggttgggatgggagccagtgaacctgtcttgtgttttactgatcatagctcactgcagcctccacttcctgggctcaggtgatactcccagctcagctccccaagtagctgggattacaggtgtgcactaccttgcctagctactgttttaattttttgtagagatggggtttcaccatgttgccaggctggtctcaaactcttggactcaggggatccgcctgcctcagcctcccaaagtactaggattacaggcatgagccaccacacctggcattcatggatttttttttttttttagatgaagtctcaccggcccaggctggtgtgtgcaatggcgcaatctctgctcattgcaacctccgccccaggggttcaagtgattctcctgcctcagcctcccaagtagctgggattacaggcatgtgcccctatgcccagctaatttctgtatttttaggagagacaaggtttcaccatgttggccaggctagtcttgaactcctgatctcaagtgatcctctcaccttggcttcccaaagtgctgggattacaggcatgagccaccatgatcggccttcactgatttttttttataaggagtgggtttaagggtgacttcttaaaaaaaaaattttttttttgagacggagttttgctcttgttgcccaggctgcagtgcaacggcgggatctcagctcactgcaacctccgcctcccaggttcaagcaattctcctgcctcagcctgctgcgtagctgggattacaggcacctacaccacacccagctaattttttatatttttagtagagatggggtttcgccatgctggccaggctggtctcaaactactggcctcaggtgatctgcccacttaggcctcccaaagtgctgggattataggtgtgagccaccatgctcggctgacatatttaaaaattttttttaattgtggtaaaatactcaacatttaccattaatcgtgtttaattatacagttcagtggcattaaatatttcacatggttgtgtaaccataaccaccatccagctccagaattctttcatgttgtaaaactgaaactctggcagggcacgttggctcacacctgtcatctcggcactttgggaggccgaggcggacggatcgtgagactctggcagggcacagtagctcacacctgtcatctcagcactttgggaggccgaaatggacggatcatgaggtcaagagatcgagaccatcctggccaacatggtgaaaccccgtctctactaaaaatacaaaaattgtctgggcgtggtggcgggcgcctgtaatcccagctactcgggaggctgaggtaggagaatcgcttgaacccaggaggcagaggttgcggtgagccgagatcacgccactgcattccagcccagcaacatagtgagactccgtctcaaaacaacagcaacaaaaacctgaaaatccatgcctaataatcaataattccctgttccctctcctttggcacccaccattctactttctctctgtgtgaatctggtgacgctaggggcctcatgtaagtggaatcacacagtatctccccttttgtgactggctgatttcatgtaccataatgtcctcaaggttcacccacatgacatgttacatccttcccttttaaggctgaatcaggctgggtgcagtgactcatgcctgtaagccgagcactttgggaggctgagacgggtggatcatttgcgatcaggagttcgagaccagcctgggcaacatggtgaaaccccatctccactaaaaatgcaaaaattagctaggcgtggtggccagcttacttccaagtaagtcccagatacttggaaggctgaggcatgagaattgcttgagccaagatcaaggcagaggttgcagtgagccgagatcgcaccactgcactccagcctgggtgacagagtgagactctgtctcaaggaaaaagaagaaaaaaaacctgaatcatattccagtgtatgtatatatattaagggtgactttttaaatagaaaattatagtacatgaaaatgaaaagatttccactgaaggtgtgtttgatacaggagacagggttgatacaggagagggggcatttttggtagggaatgagccctctacccccacctcactacttaagaaaccaattctcttttttttgagacagtttcgctcttgttgcccaggctggagtgcaatggtgcaatcttggctcacggcaacatcaacctcccaggtttaagcaattctcctgcctcagcatcccaagtagctgggactacaggcatgcaccaccacatccagttgattttgtatttttagtagagacagggtttctccatgttggtcaggctggtctcgaactcctgacctcaggtgatccgtctgcctcggcctcccaaagtgctgggattacaggtgtgagccactgcgcctggcctaatttttgtgtttttagtagagacggggtttcagcatgttggccaggctggtctcgaactcttgacctcaggcaatccgcctgcctcagcctcccaaagtgctaggattacaggcgtgagccactgtgcccagtctggtcttgaactcttttgctcaagcaatctgcccacgtcggccttccaaagtgctgggattacaggcatgagccactacacgggccaagaaaccaattttccatcaagatcagcccctttggtgatgtccctgcccaccttccagggtggagataattgtgaaatctgggttatgctctgatgggatccttccttcactcaacctgctctaacatctgcccctcctcccaccagctgttggctgggcccctgtgctgctccctggtgacagcatacatggaggtagattcatatagggccaagcaggtgcaaagccagactgttctgtgggagagcaggcttttgcccacacccacaccaggattatcctaaggcaccagtgaccaatagcgttggtaccatcccaggtattatccatcagacgcttacccagggacaagcccttacctccctgcattggaaatatcagtcacaccctgaggaagatactgttaccattctttttttttaagacagagtcttgctctgtcactcaggctggagtggagtgcagtggtgtgacttcggctcactgcaacctctgcctcccggattcaagcgattctcccgtctcagcctcccaagtagctgggattataagcatgcgccaccacacctggctaatttttgcattttttagtagagacggagtttcaccatgttggccaagctggtcttgaactcctgtacttaaatgatccgcccgccttggcctcccaaagtgctggaattacaggcgtgagtcaccttgcccggtcaccattctcatttcacagatgaacaaactgagtcttggagacatgccggatcacctacacagggtcacatagctgacaaatggccaggcagtaatttgaccccagctctgtggcaccaggcattccagacagacatgggcccagagacactcagctcatcagcagtagcctcagaattatcagaaaacacggccgggtacggtggctcacgcctataatcccagcactttgggaggcggaggtgggtggatcacctgaggtcaggagttcgagaccagcctggccaacatggagaaaccccatctctactaaaaatacaaaaattagctgggcttggtggcgggcacctgtaatcccagccactcgagaggctgaggcaggagaatcgcttgaacccgggaggcggaggttgcagttagccgagatcgctccattgcgcactccagcctggggggccaagagtgagactttgtctcaaaaaaaaaaaaaaaaaaaagaattattggaaaacaggacttgccttcctgcttctattcactgtccactgccacctctctgtccccaccctactactccagcctttggcttttggccatcagtcgcagcctcccatggccaatcccaagtggtcaattcctctaagcatgaaactgggaccctctagtagcatctcctccccttgtccatccctccttcccagaatcatgacctcctggttcccctcctctctgctgttttctctaatttgtgctggtttttctccctaaattatgccagtcctggatcccctcacaccatctgctctccctgggaaattcacctgcctggaagctgcggccagcacgtccatgctgtcagtttccagatttctgctgctcccaggtcaccatcccgccaaagccaaacctgctgccccaatacctcccgtctgcgcgctgtccagacacgtcagggctgaagtcatctcccacagagccttctttcctcctcccctggcttcttggccaagatcccaccctccacccagtcttcagggacaaaattctgagagtcatctctgactccatctcacaccctctcggcactcagctcctcattaagccctacgattacgtccgtctttcccgcgacagtccctcctctgcccgatttccacggctcccatttcttgattgaatcatggtggccgcctccccactcagcacccaggtctttcttcttgcctgcaaatcagacccgcagctttgaatcctgcaagtgctcccactggcctggcacggtgctccccagcaaatggaccttggcacatgccattccctaccagtaatgccctcccttcagcctgccaaattcctcccagctcttcacgactctgttcaacagacacttcctctaggagggccgaccaatcgccgctgggctgggttaggggacactcccctcctgggttctcctacctcatctttctcagaacttttggggcaacaatttttttttttttttttttgcgatggagtctcgctctgtcacccaggctggagtgcagtggcacaatctctactcaccgcaatctccgcctcccaggttcaagcgattctcctgcctcagcctcctgagtagctgggattacaagcgcgtgccaccacacccggctaattattgtatttttagtagagacagggtttcaccatgttggtcaggctggtctcgaacccctgacctcgtgatccgcccgccttggcctcccaaagtgctgggattacaggcatgggccaccgtgcctggccttttttttttttttttttttttaaagacggagtcttgctgtcacccaggctggatggagtgcagtggtgtgatctcagctcactgcaccctccacctcccaggttcaagcaattctcctgcctcagcctcccaagtatctgggactacagacacgcaccatgatgcccggctaattttttttgtatttttagtagagacggggttttaccatgttggtcaggctggtctcgaactcctgatttcaaatgatccgcccgcctcggtctcccaaagtgctgggattacaggcatgagccactgcacccagccacgggcaactgttttttgtgtttttgtttttgagacagggtcttgctttgttgcccaggctggagtgcagtggcatgatcaaggttcactgcagtttcgacctcccaggctcaagtgatcctcccacctcagctttctgagtagctgggattataggcgtgcactgccacgcccggctaattttgtctttgtttttttagacagagtttctctcttgttgcctaggctggagcacaatggtgcaatcttagctccctgcaacctccgcctcccaggttcaagtgattctcctgcctcagtctcacaagtagctgggattacaggcgtgtgcaaccatgcccagctacttttgtatttttttagtagagacagggtttcaacatgttggtcaggctggtcttggactcctgagctcaagtgatcctcccacctctcagcctcccaaagtgctgggattacaggcatgaaccactgcacccggcccggccaattaaaaaagaaaatttttttgtagagaccaggtctcactatgtttcccaggctagtctcaaactcctgggttcaagtgatcctgatgcctcaacaggatcccaaagtgctgggattacaggtacatgccgccatgcccagctaatttttttttttggcagagacagggtttccctatgttgcccaggctggtctcaaactcctggcctcaagtgatcctcccacctcaacctcccaaagtgctgggactatagatgtgagccactgcacccagccagggacaactatcttcccccatatcctggtgattaggacctctccattttcccagcacctgacacacaacgggtagcaggaaactgtccaccgactgcacaaatgagtaaaaggctcaactgagaccgggcacccaggattccagagaacaaccaagctccagtttcaggctttcccaccaccctcatggccacctgtccgtcttccacctgtgctgtgaggcactcactgctctccttcaaaaggctcgtgctggccaggcacagtggctgacacctgtaatctcagcattttgggaggccgaggcgggtggatcatctgaggtcaggagttcaagatccgcctgaccaacatggagaaaccccgtctctaccaaaaatacaaaattagccaggtgtggtggcgcatgcctgtaatcccagctactcgggaggctgaagcaggagaattgcttgaacccaggaggcggaggttgccgtgagccaagatcacaccattgtactctagcctgggcaacaagagcaaaactccgtctcaaaaacaaaaataaataaataaaaaaggctcatgctggccaggcacagtgactcacgcctgtaatcccagcacttctcggaggctgaagcaagaggatcacctgaggtcaggagttcaagaccagcctggccaacatggtgaaaccccatctctacaaaaaaatacaaaaattagctgggcatgatggtgggtgcctgtaatcccagctactcaggaggctgagacaggagaatcgtttgaacccgggaggccgaggttgcagtgatccgagattgcgccactgcactccagtctgggtgacagagcgagactccatctcaaaaaaaaataaatagggccgggcgcggtggcttacgcctgtaatcccagcactttgggaggctgaggcgggtggatcacgagatcaggagattgagaccatccttgctaatacggtgaaaccccgtctctactaaaaatacaaaaaattagctgggcgtgatggcaggcacctgtagtcccagctactgggaggctgaggcaggagaatggcgtgaacccgggaggcggagcttgcagtgagccacgatcatgccactgcactccagcctgggcgacagagcaagcctctgtctcaaaaaaaaaaaaaaaaaaaaaaaaaaacataaaaaaataaataagtcagtaagtaaatataaaataaaattttaggctgggtgtggtggctcatgcctgtaatcccagcactttggtaggctgaggagggcggatcacttgaggtcatgagttcgacctcagcatggtgaagcctcgtctctactaataatacaaaaaaattagctgggcatggtaatcccagctacttgggaggccgaggcaggagaatcgcttgaacctgggaggtggaggttacagtgagccaagatcgtgccactgcactccagcatgggtgacagagcaagattccgtctcaaaaaaaaaaaataagaaaaaaaaaagttaaaaggctcacattgtttgtttaccgaaatacatttattttcagaagacactttctctccctccctctctccctgaaagagcaagccagcattggcatcacgtgcagaggctagccgtgaaaacaaatacaatgaacacaaaacaaagtgcagtcttgaccagttcccgatgttggcaaggctgccagcccaggccctcgggcactccagattcaaggggaggttaccaagtgtctgttaccatgccttgaaggacacagcagcagaaccaggtacagtggctcacacctgtaattccaatactttgggaggctggggtgggaggattgcttgagcctagcagttcaagaccagcctgagcaacatagcgagaccctgtctctgtttaaaaaaaaaaaaaaaaatacacaggccgggcacagtggctcacgcctgtaatcccagcactttgggaggccgaggcgggcagatcacaaggtcaggagatcgagaccatcctggctaacagggtgaaaccccgtctctactaaaaaaaatacaaaaaaattagccaggcaccgtggcgggcgcctatagtcccagctactcgggaggctgaggcaggagaacggcatgaacccaggaggcagagcttgcagtgagccgaggttgcaccactgtactccagcccgggtgacagagcgagactccgtctcaaaaaaaaaacaaaaaaaaaaacacaaaacagcagtggtaacagaagccctcagccttgatgccatgggaaggcggcagagatttcgggagggaccgattctgggagttctcctggcaacacaggctgcccttggaggttgtcccatccctggaggtcactcagaggctggctggcctcttgcaggtgacagcagccagagtggggaagctgggtcagaacaggtagggaggctcagccggacgcggtggctcatgcctgtattcccagtactttgggaggccgaggcgggcagatcacctgaggccaggagttccagatcagcctggccaacatggtgaaaccccatttctactaaaaatataaaaattacctgggcatggtggcacatgcctgtaatcccagctgctcaggaggctgaggcaagagaatcacttgaacctgcgaggtggagattgtagtgagccgagatcgcaccactgcactccagcctgggtaacagagcatggtgctgtctccagaaaagaagagagagggaggctgaaggtggagggtggcagagacaggagcctcggggaggggtgctgaggtccgggtagggtatcttcaaggggtgggggtggcagattgggatgagtatctggggtagatctgggaactgcctgcttgggcaggaataaggggacacacagccgaggggtgggagggggcgaggagagccggtgggcaaattccaggcatggaattctaagatggcatcatccgagagggaggaaaacaacagggtgagggcagcagccgtggagctccagggtccccaggtatgtatccacttaacaaattttttttttttaagagacaacaggattccactctgttgcccaggctggagtgcagtggcatgatcatagctcactgcagcctcaaactcttgggttcaaatgatccccctgcctcagcctcctgaatagctgagactacaggcacccatgccactatacccagctaattttttttttttgaaacagagtttcgctcttgttgcccaggctggagtgcagaagcacagtcttagctcattgcaacctccacctcccgggttcaagcgatttttctgcctcagcctcctgagtagctggagttacaggtatgtgccaccacacctggctaatttttttgtatttttagtagagacgggatttcaccatgttggtcaggctggtctcaaactcctgacctcaggtgatccatccgccttggcctcccagagtgctgggattacaggcataagccactgtgcccagccctcacccagctaattttaaaatatatattttttatagagatagggtcttactatgttgcccaggcttgtctcgaactcctggcctcaagccatacttgagcctcagcctctcaaagtgttgggatgacaggtgcaagccaccgtgtccggcctccaggcatccatctgaacctacatgggcctgcagtcctgcctgggtctcagaggagctgggggcagtgggttgagacagtagcaaactgtggacctcagagcctgctcctatcctgcagggtggctcaggcagctggagttctctgtgaaatcaagtcaccacctttttttgcgggagatgaagtctcgctctgtcacccaggctagagtacaatggcacgatctaggctcacggcaacctccgcctcctgggttcaagtgattctcctgcctcagcctcccaagtcgctgggaatacaggcgcccgccaccatgcccagctaatttttgtatttttagtagagatggggttttaccacgttggccaggctggtctcgaactcctggcctcaagtgatcctcccgcctcggcctcccaaagtgctgggattacaggcatgagccacggctcccggcctcaagtcaccatcttgatacccatccacccagtgaagcaagaagccacagagagcccctgcagagcacacgtcttccatcagccctctgggttggatgggttggcacagagaagggcccccagtggggaggcagaggctacctatcgtccctttaaggaccggaggtgtttgtgtaactggaggcaaagcacttcctctcagatgacggtccaggaccgcccctcctctgggatacacacagatggagtccatccctctctcagcagtggctctgagtaccagcctgtcccttccccatctcaagatctcctcggaggctccccatggctcctgacctggcattcgaggcctttgtgacctggccgaacgcactgccctgtcctggcctccctgtctgccctcccgcagccaccctgactccgaggttctcagcctagggtctccacgggtggattcccagagtctgcttcaattttaggaatgttgctccgatgccattcccggatgccaggcctttgcctgggccgctccctctaaatcactgttcagcattccgttatctgatgcctggcatggttaaaccttcaagtgggcagcttgcctgtggctgcctccaggaagtcttgaagactcccagcctgggtcaagagcctctccttggtcatgcacagtggctcatacctgtaatcccagtgctttgggaggccaaggtgggcagatcacctgaggtcaggagttcaagaccagcctggccaatatggtgaaacctcatctctactaaaaatacaaaaattagctgggtatggtggcacgtgcctgtaatcccagttacttgggaggctgaggcagtagaatcgcttgaacccgggaggcaaaggttgcagtgagccaagattgcaccactgcactccaacctgggcgacagagtgagactctgtctcaaaataaaagcaaaaacaaaaagaaggccaaatgtagatcccagcactttgggaggatgaggcgggcagatcacttgagatcaggagttcgagaccagtctggccagcatggcaaaaccccgtctctacaaaagaatacaaaaattagccaggtgcggtggctcacgcctgtaatcccaacactttgggaggccgaggcgggcggatcacgaggtcaggagatcgagaccatcctggctaacagggtgaaaccccgtctctactaaaaatacaaaaaaaatagccaggcgtggtggtgggcacctgtagtcccagctactggggaggctgaggcaggagaatgacatgaacccgggaggcggagcttgcagtgagccgagatggagtcactgcactccagcctgggtgaaagagcgagactccatctcaaaaaaaaaaaaaaaaacattagccaggtgtggtagtggacacctgtaatcccagctactcaggaagctgatgcaggaggatcgcttgaactcgggaggcggagattgcagtgaaccgagattgcgccactgcactccagcctgagcgacagagcgagactctgtctcaaaaaaaaattaaaaaacgagcctctccttgccttcagtgtctctgattgttttccttgtaccctggttaatctgccttgtaactgcccaaagacacgtctgtctccccactgaatgaggggtctctgggagggcagtaaacaagtccaattcctgtctcagcccatcactcactcccactcaggccccagccctaatgtcgccttttcagaggggtcctgactgcccaaaataaagtaacgtctccttgctcttcatcacatttctggaaaattctaggagtgggtgggaaagtcataaatgtcctgtctcagagtctgaccctctggaggcctcagattggcccccagctccttccagactccagcaaggtccccgggaagctgacatgtgttaagtgccaggtccctctgtcatctgtactttgcaactggggaaagtgaggcatggagtcatccaaagtcataaagtagggagtagagtctgggacttggacccaagcctgcctgtctccagaacctgcctgttacctgccacccgaggtacgctacccccaacgccatccgccccccaagtccaacctctcaggctgcagccataaggacccaggatggctgacatcacttcacatttatcgggtgcccactgcataccaactacacactgggatcccagcagagaacagagtagacaagaaatttcactccatggagccaatattctggacatggtggagatgagggagtggcaaagactctatatcttaattttttttcagaaatggggtcttgctatgttgcccaggctggtcttgaactcctgggctcaagtgatctgcccaacttgcctctcaaagtgctgggattacaggcatgagccacctgatctggccctgcattttgataatttgtttgttttgttattgtcaggtggagagaaaaataaggcaggaaaaggaatgaggagtcaggcagtgggggctgtaattttctttttttttttttttccaagacaaaatctctctctgtcgcccaggctggaatgcagtgccaccatctcagctcactgcaacctccatctcccaggttcaagtgattctcctgcctcagcctcccaagcagctgggattacaggcgcccaccaccacgcctggctaatctttgcatttttagtagagacggggtttcaccttgttggccaggctggtcttgaactcctggcctcaggtgatctgcccacctcaggctcccaaagtgctgggattacaggtgtgagccacggtgcctggcagggctacaattttaaagagggaggtcaggaagccctccctgagaaggtagggaggtgagggaggaaaccctgatgatagaacattctagaaagggggaagagccagtgcaaaggccctgaggcagggccaggcatcctggactcgaggcacagagaggtggcttatgcctgccctcaccaacatcccagatggagaaacaaaacccagaggaccacctccctcccgtcctgttaccgtctgggtgccatcaccctaaaaagcccagcccctattcccctgtccctgctgtggctcatcacacctgccagatcacagaggagtgccagggacaagggatgccccctcccagtttggacggggatggaggggacagtccgggtcacagtgccgtggctcaacagaacctcagatctaggctccagcatccaagtgtctaaattccctcccagtgaagcccaggttcgtggtgggagtggggagggtgcccaggctcttgtggggtacagggagaggggaccgagttctctctcttttgcctgggaagggagcgactgcaggctagaggctggcccatcccccagacacacccgctgcttgttttttgtttttttttttttgagacagagtcttgctctgttgcacaggctggagtgcagtggtgtgatctctgctcactgcaacctccgcccccctggttcaagcaattctcctgcctcagcctcctgagtagctgggactacaggcacacaccgctgcacctggctaatttttgtatttttagtagagacagggtttcgccatgttggccacgctggtctcgaactcttgacctcaggcgatccacccacatcggcctcccaaagtgctgggatcacaggtgtgagccaccgcgcctggccctgctgcttggcttttgctgtttgtcctctaggcccctgatcgaggctaccatccctgcatccctagggctcccccatcacctatctgagaacgtcctggctcctccatccagctctggctgcttgcccactggctgctgccgttgcttcttcctcctcgtcctccccctcctcttcctttttctcctcctcctcctccctctcctccccctcctcttcctttttctcctcctccccctcctccctctcctccccctcgtcttcctccctttcctcttcctcctcccctcccacctcctccccactgcccttcatctcctctgcttccatacgctcatcagtacccttccctggctacttccctctcccagttcagctgagccccattgtgtggaggggaggaggagaagtcttggccactgcgtagtcctcctctccttcctcctgccagcttcctcagccttcaaggttcgagcaccccagcacaggtgaccactgcacatacaggacgacaaagtaaccgtgcaaaagcagtagggtcccataacctttcactcctcaagtccccttgagcaaggactctccagggtatgctgtggttggactgggggttcccaaggaccttcagtctcttcatctactcctctctctactctatgactccttgcttagtttgctccagccaccccagcctcattgcattcctccaacacaccatgcctgttccagcctcagggcctttgcacctgctgggccttctgcccggagcactcttcctccagatgtctagctgctccttcaagcctcatccttgtccccatcaccttctccctgcggggacatcagctccgtaaggcttcctgtggctgtctgtccccagtgcctcccactgcagacacttcctaagtctgtgctgaatgaacaaatgacagacagacagacagacaggggtgggaggaaagtggggccaggcacagggcagaaggggtccccagggcatagctgataggaaatgatcactcttcagacacagtgtcatgggaccctggattaaaatctgtctctgggagtccaggagggggtagggagggaaagctgagctgagctccaggcggttcagtgtgtgtgtgtgtgacagcatcctattaacaaaggtataaagtccagactcagggaggggaaggtctcttctatgctactctgttttttgtttgtttgtttttgagacagtgtcttgctctgtcacccaggctggagtgcagtagtgcagtagtgcgatcttggctcactgcaacctctgcctcctgggttcaagcaattctcctgtctcaacctcccaagtagctgggattacaggagcatgccaccacacagggttaatttttatatttttagtagagacggggtttcactatattggccaggctggtctcgaactcctgacctcaggtgatctgcccgcctcggcctctcaaagtgctgggattacaggcgtgagccaccgcgccgggcctctctatgctactctggtcagagccatgatgggtctgaggggcctattcaaggatggcaaagaaaagcctgcgcttggccaggcacagtggctcatgcctataatcctagtgctttgggaggttgaggctggaggctcgcttgaggccaggagttcaagaccagcccgggcaacatagtaagacccctgtccatgtgtataaaatttttttttaaggattagctaggcctggtggtgcatgcctgtggtcccagctctcaggaggctgaggttgagctcaggaggtcgaggctgcagtgagttatgatcatgccactgcactccaacctgagcgacagagcaagattctgcctttgaaagaaagaaagaggccgagtgcagtggctcatgcctgtaatcccagtactttaggaggctgaggcgtttgagctcaatagtttcagaccagcctgggcaactggcaaaactctacaaaatcactacaaaaaaatgcaaaaattagccaggtgtggtggcttatgcctgtagtcccaggctgattgcttaaacttgggaggtggaggttgcagtgggcgaagatcgcaccactgcaccccagcctgggcaacagagccagaacttgtcttgaaaaaacaaaacaaaaacaagaaagaaaagcaaagaaaagagcttgtactgaaaggcatggggaacagaacagggttggtaaagagcagccacaaaagaaagtgagacgggctgggcgcagtggctcacacctgtaatcccagcactttgggaggccgaggcaggtgcatcacctgaggtcaggagttcgagaccagcctggccaacatggtgaaacccaccccccttcatctctactaataatataaaaattagccaggtgtggtggttcgcacctgtaatcccagctactcaggaggctgaggcaggagaattgcttgaacccgggaggtggaggttgcagtgggccgagatcgcaccattgcactccagcctgggcgacaagaacgaaactccattccaaaaaataaaaaaaataataattaaaaaaacagtaagatgcctgctactgaattatcaaacaggggtttcaagaccctttcctcctatgacagccccagctcccttggctcccagcttgccacccactcctggttttccttctgccctctttctgctgtctcccaagctcccagcttgctttaaagcccatcctacgccgtaccacctgggtgtctagcagcatggcaatttccagatgctgagaacagattgctgacttacacctaaagcttctcccccatgagcagctgctccctcccccggcctctccatatctctccaagatccacccaagtctcacccgtccacgccttcacctggtccagccccaccattactcccctggcctggtgcagtcccttccatcctggtctccaggctcctgccttcgacccctgcagtctgttccctgagctctaaataatgccaaatgcttgttcaaggctggcaggctggctctgcccttcttcctctcccctcttctggatcttacaaccctggctttgtggttgtttcatccaagcaccctggcagtttctctcctctgcaatttgcccactggtctcttggcctggttaactcctccttacccttagcgacccagccaactgtcacctcctccaggaggccttccctgactcctccttaggctgagtcaggtgactcctctggactccccctgaccccaggcatgactctgaatttttttttttttttttttttttggagatagtctcactttgttgcccaggctggagtgcagtggcgcgatctcggctcactgcaaattctgcctcccaggttcaagagattctcctgcctcagtctcccatgcagctgagattacaggtacatgccaccacgcccggctaatttttgtatttctagtagagatggggtttcaccatgttggccaggctgctctcgaactcctgaccttaggtgatctgcctgcctcagcttcccaaagtgctgggattacaggcgtgagccaccacgcccagcccctccgtgatattttaatagcctccagctctgtgatattctcgtgatattttaatagcctgtttagcacgtattcacaaccagccaggcactgtgttcagctctttacctataggtcatgactgctattatcccattttacaggtggagaaactgaagcaggaagtggtgaagtcagtagcccggaggccctcaactcaaagtggcaggacagggctggggggtggtcaggctcaagcccagccagtcggaaagggagaagcttgtggtgctcagagaaggggacagggcagcgagctcccaaggcacctgcctttctgtgccatcccacgggtgggaggagggaacctgggcccacttctgctgccaactacaggcatcccagtggctcctgagccaagacattctgtgccacgcactgggtcaaccgctttattcaacctgcagacagccctgggtcaggaggtggacactgttgtgaatttctcagaggagaaatggaagcccatacatccccctgaactcccaccgggcgttagaaccctctccggttccttaggggtgtggctgccaccgagatctgcctagcctcggctttcatcgatccatgaacactcccaggctcagatactactgacccattttacagatgggtaaactgaagctcagaaacctttccctgggggccctacagccagttcaacgaccaaggccgccccccaccccccacaccccaggctcaaagtacctctgctggcagtgggtgagctggaaaaacaggtaaggaaagtcctcaatgcctcttcctccacgcctggctgggcctgctggggcccaggtgcactgaatgaggcttctaatcagtcccccagctccacttctgtgtttattcacagcagctgctcctggaaggcagacccatttgaggctgggggaggccgagggcttcaaagacaattccacagtccaggaaccctatccccatataacagacccaggtcgccccagtggggtcaccctggcctctgcgctcagatgcctgagaccttgcctgagctcagactggagtcgatgggagcattcccccatctggtaggttttgcaaaccacaacagcctctccccctgcccaccttcctgtgtcccccagagcagcttctcctcaagtctcccaacccagcaatgaaagcctcttctatatactcctaactacccaggagaaacatcggtcccccacgctccacttgcaaacagacagaattagacgatgttactctgccaaagcgaattttcagttcacccacttcctatcacaccttccagccaggtcaagccagaagcccccttccaagtatccccatctctcctacccacagcggctacgggatgttcttaagacacaatccgatcacgccatgcacctgctgttccaagcctccctggtccccaccgccccgagaacgggttccacactctcctcgccgcttcccaggccccggccaacctctctccacctcagaccctccctctccgcgtttcagccaggctggcctcttttctgctccgcacacactcccggctaggccctgggcctaaaaagccctcgctggctggtccaaccaggccaaatgacattatccccgcctgggcacctccacctcaccccggccgcctgatgggttagctcgggcttggaatgacgtgtttaagcggttctcagaagccgtctacgcggccgggctgcggactccgaggccagggccccagctgcgtccccagccctggcacgtcggggaaacggggcgctcccccggctcacacatccggattcccccgcgtcacgaggccaggatcgcccctactcgctccagcccgtttcacagccgcgtcctcgggcacccgttgcgccccggccctcgtgggggagcgcggatagctcggggagacggccatgatgggaagccccgagggggacagtccccggcggggtgatgggggctggagcccagctgcgagtgggggccgggctggggccgccatggccgcggaggcggggccggggaccgccgtgagggtggcgttcggggcggtgttcgcggcgcggggtgctcgcttacctgggggtgcaggcggccgggcgcaccgagggccggcggcggggctggggacggcgcgcctagcgggctacccggagcagctgcagacacgcgccgcccgccccaggcagccggactctgctcctggccgggcctcggcccccagcaggggaaaaaaggcttgagtggggggagcccggggcggggccgtgggggcggggcctgggcggggcacgcgccccggaacggtggggcctggcgcggggctggggccctggagaggcggggcctggcgcggggcgggggacttggaggggcagggcctggagcgggcgccgggtcctccaggcgcttgcccccctcgacgcaactaggcctctccctggcccccgaccccgcacccgcaccccatccccgcccccgtccccgcccccccattctcgcccccgcccccgttcccgctccgcccatctctgccccgcggcgcgcctggcccgggtccagcctagcgtttctagtctgcgccttatctctcccctttgaacccagtattgtccgctgcgcgctccgtccggccccggcttcacccctgttcgctgtctgtctccccggccccctcccaggtcccctcttctgcccgagatgctctggctctgctcatctgtccacacccccacactcccggggcgccctgagcctctggggcgcgcagttggatggtgcacaggggaggcccagatttctccaggcctcagcggccaccctgggtaccccgagtctggggccctgttggagggccagtccaggggttcgcccgaggcgcgcgcgggggccaaccgaggcggtgagggcaccgggcaaaggctgcgatttggtggggtgcaggggtcaggcgacagagctggggagataagatgggagataggccgggtgggtggtggcgcagccctggttttggctgagggcagcagcagtgggggctgggtcccccgcttgcctggtagaaccgaaaatgacccagtctcagcagcgcgcaggggcagggagcctgggcgatccctgaacagaggacagccccaggggttttcatagtcgctggcccaccgcatgtactctgggcaagtggcttcgcctttggacaataagcctctgtaaaatggggataataaacctttctctgactcagctcagcagacccaagacccatggggtgaagttggggcctccctgccacagggccctaggcaagctgagatttgatttcctcacacagacaggggcgcggggggcggggcggtcagggaggcaggagacctctgttgcaagtgtggaagaacctgtccctccaagttcagactcctggcgtttgcacttggccttccctctgctacactgtttctcttttcttttttctttttctttttttttttttgagacggagtcttgcattgtggcccgggctggactgcaatggcatgatctcggctcactgcaacttctgcatcctggtttcattcgattctcctgcctcagcctcccgagtagctaggattacaggcgcccacaacacccggctaatttatatatatatatatttttttttttggagagacgggggtttcacaatgttggccagactgatctcaaactcctgacctcgtgatccaccagccttggcttcccaaagtgctgggattacaggcgtgagccagcatgcccgaccttctcttttctttttttaaaaaaatctgttagaggctgggtgcggtggctcacacctgtaatcccagcactttgggaggctgaggcgggtggatcacctgaggtcaggagtttgagaccagcctggccaacgtggcaaaatcccatctctactaaaaacacaaaaattagcctggagtagaattacgtgaacccaggaggcagaggttgcagtgcgtggagatcgtgccactgcactccagcctggacaacagagtgagactctatcaaaaaaaatttcgttaaagatgggagtctcactctgttgcccaggctagaatggaatgtcatgatcccagctcattgcagcctgggactccagggctcaagcagtcctctcacctcagcctccagaggagctaggactatagatgcctgccaccatgcccggctaatttttttttgttttaaataaaaaaactttggtaggcagggtgtggtggctcatgcctgtaatcccagcactttgggaggccgaggcaggtggatcacgtgaggtcaggagttcgagaccagcctggccaatatggcgaaaccccttctctactaaaaataccaaagttagctgggcatggtgttgcgcacctgtaatcccagctactcgagagtctgaggcaggagaatcacttgaacccaggaggcggaggttgcagtgagtcaaaatcgtgccgctgcactccagcctgggtgacagagcaagactctgtctcaattaaaaaaaacaaaaaaaaaaactttggtagaggtggggtcttgctatgttgcccaggctggtctggaacgcttaggctcaagtgatccttccgcctccgctttccaaggtgctgggattacaggcaagagccactgtgccccagcctctttcccttttcaaatgcatacatacttctccctgagcctcagtcccctcctccttcctccattgcctgctttaccccacccccaccatattcacctgtttattttctcctctccttccctccaagagcttgtttgcacacctggaaaagaaagataataaagcaactcttctcagttgttgtgactagggagttattgaatatcacatgtcgcatactccagggtgctcagagcatggcatttgtttgtattaataataatatatgaccgggcttggtcgctcacacctgtaatcctagcactttggaaggctgaggtgagtggattgctggagctcaggagtttgagacaagcctcggtaacatggcaagagccccatctctaccaaaaatacaaaaattagccaagcgtggtggtgtgctcctatagtcccagctactcagaaggctgaagtgggaggatcacttgagcccagaagtcaaggctgaggtgaactatgatcatgccactgaactccagcctgggcaacagagtgagatcctgtctcaattaaaaaaaaaaaaaagagacaccagcctgggcaacatagtgagaccccggtatctacaaacaataacgataatataatacaggatacatggtggaatggtggagtccacgccccagtggagaagccccaggactccggagaagtggagtaggggagctcaaaagaggacctgggcaggccagggctggagagagatttcaggtggaaggtaccacatggggcaaaggttgggaagctggaggaagacacctggggtcagccaggcaggaagggacccaggctgcaccttctgcagttgggcagcttctcgcctgtcctcaccttccaccccgatccctgaccatggagctcaggccggaccccaagcttgagagtgagtgggtgttcaaggcaggcttcctggaagaggtgacatctgagccctgagaaatgagcgggtgggggaactatactgagaggaagtttcctgggaggacagcagggctggcccagccacaataagccctcctgggttctctccagggagaggcaccaatggacttactgatttattttgagatggagtctcactctgtcatccaggctggagtgcagtggcacgatctcagctcactgcaacctctgcctcctaggttcaagtgattctcctgccttggcctcccgagtagctgggattacaggcgcacaccaccacgcccggctaatttttgtattttttgtagagacggggtttcaccatgttggagaggctggtcttgaactcctgacctcgagtgatccctcaagggattatgggcatgagtcaatgcacctggccaacaattggacttaaaattaggaaagaacagagtgggaggctgggaaggtgtcactctaccgtgggcagctggatgggaggacctggggcctggttcgggggtgatgaataggagaagagggagggattccagggggctttagaggtaaaattaccagaactcaggcgatgaggggaggctagtggtggcagtgagggccacctcctctgctcgcctttctccaagggtcccccctgctccatgcctaaatatcctcatctacccgaataggtacttggcacctgatctctcccacctgccacctgtcccctgcccagcttcccagggcacttggcaacccagcatgagtccagcaagcaggctaaccggttctcattgatgatgtctcctgccaagccaggccctgcacccacctgaggttcctagtggttgagtggaatcacagccctagaaccctgggtgaggagagggcagtggcaaaccttgtcctggagcagtgacaacctggtcagtgccagggcctgtgcaaagtgatgtaaaaagatggatatgaccggccctctctgtgaagcaggtgcacttaaacttcccattttaggccagctgtgatggctcaagccttgtagtcccagcactttgggaggccaaggtgggaagatcgcttgagcccaagaggtttttcatttttttcttttttgaaacggagtctcacttggttacccaggctggagtgcaacctctgcctcctgggttcaagcgattctactgcctcaggagcagctgggatcacaggggtgcaccaccatgcctggctaatttttgtatttttagtagagatggggtttcaccatgttggccaggctggtctcaaactcctgacctcaggtagtccgcccgcctcccaaagttctgggattacaggcatgagccaccacgcccagcctaaagaattttaagaattagctggcatgtacctgtagtcctagctacttggaaggctgagtcaggaggattacttgagtccaggaggtcgaggctgcagtgagccatgattgcgccactgcactccagcccgggtaatagagcgagaccctgtctcaaagaaaaaaaaaaaaagaaaaatcccattttagagatgagcccagagtggtgcaggaagctacacaaagccacacagccacaaggtggatgaactgggaggaggtgcttttaacctagctctgcctgccattatctccattcagcaaagaagaaaaaccttggccgggcacggtgactcatgcctgtaatcccagctacccaggaggctgaggcaggagaatcgcttgaacccaggaggcggaggttgcagtgagatcgcaccactgccctccagcctgggtgacaaagtgagactccatctcaaaaaaaaaaaaaaaaaaaaggacaaaaccacaaaaacaaaacctggagccagctgcattgtcaccagctatcccacgttctggggactgaggaatttcctgcaacacagaatgtcaagcctccgagtccaagcctgcacgtgtatttctagatggcctgaagcaactgaagaatcacaaaagaagtgaaaatgcctggttcctgccttaactgatgacattaccttgtgaaattccttctcctggctcagaagctcccccactgagcaccttgtgacctccgcccctgcctaccagagaacaaacccctttgactgtagttttccactacctacccaaatcctataaaacagcctcaccccatcttccttcgctgactccttttttggactcagcccgcctgcacccaggtgattgaaaagctttactgctcacacaaagcctgtttggcggtctcttcacatggatgcgcatgacatggaatttttagggctaatgtcaggacagtcccaagcaaaccatgacgcttggtcaccctaccaatgtaatgcccaaccttgtttttactaaccctgtttttagactctccctttcctttaatcacctagccttgtttccacctgaattgactctcccttagctaagagagccagacagactccatcttggctctttcactagcagcctcttcctcaaagacttaacttgtgcaagctgactcccagcacatccaagaatgcaattaatcgataagatactggggcgagcaatatctgcagttcccaggaattcgtctgattgataacgcccaaagccccgcgtctatcaccttgcaatagtcttaaagcccctgcacctagaactgtttactttcctataaccatttatccttttagcttttttgcctactttacttctgtaaaattgttttaactagaccccccctcccctttctaaaccaaagtataaaagaaaatctagtcccttcttcaaggccaagaaaactttaaacgttagccgtctcttggccgccagctaaataaacggactcttaattcgtctcaaagtgtggcgttttctctaactcgctcaagtacaacaccaagaggtgagatgacttgcccaaggtcacacagctaccacaagcgcccctgtgccagcactcgcctatttaagacaccatcccctctcctagactcgatggggaggactttagggtaaccctggaagcagttgggtttttttctctttgtgtcaaaatatcctttctaaaaaacatttcaatagtttttggggtacaggtggtttttggctacatggccaaataaccactaaagaattgattagtggtgatttctgagactttggtgcacccgtcacctgagcagtatacactgtacccgatatgtgtgtgtgtgtgttttgagatggggtttcactcttgttgcccaggctggagtacagtggcgccatctctgctcactgcaacctccgcctccggggctcaagtgattctcctacctcagcctcctgagtagctgggattacaggcaagcgccaccacacctggctaattttttttgtatttttagtagagacggggtttctccatgttggtcaggctggtgttgaactcccaacctcaggtgatccacccgcctcggcctcccaaagtgttgggattacaggcaggagcaaccgcgcctggccgatatatggtcttttatccctcacctccctccccaccctttccctctgaattcctgttttctttctttccttctttttgtccttccttcctgccttccttccctctctatctccctctttcttgcttgctttttttttttttttgagacggagtctcactctgtcgccaggctggagtgcagtggcgtgatctcggctcactgcaagctctgcctcccaggttcacgccattctcctgcctcagcctcccgagtagctgggactacaggcgtccaccaccacgcccagctaattgtttgtatttttagtagagacggagtttcactgtgttagccaggatggtctcgatctcctgaccttgtgatccacccacctccgcctcccaaagtgctgggattactggtgtgagccgccgcgcccggcctctttttttgagacaggatctccctctgtcacccaggctggagggcagtggcacaatcatagctcacagaagcctccacaactcctgggctcaagtgatcctcctgcctcagcctctagaatagctgggactacaggcatgcaccactacacctagctcatttatgtatttatttattttctgtagagatgggggtctccttcctgcctttttctttcttgggaaactgagtgttttactttgtgttgcttggtaacagctttagagatataattttcataccatccagtttgcctatttcaagttttcaagtcgaaggtttttgatccattcacagagttcagcagttctcaccatcttgttcttcttttatttgacaaatattaattgtatatacttaccaggtacagtgtgatcttttgatatatgcatactttgggaaccactttgctctttttctgtttcgttttgtttttctttttcttttctttcagagatagggtctcattctttcgcccaggctggagtgcagtggtgtgatcatagctcactgcagcctcgacctcctgggctcaagtgatcctcccacctcagcctcctgggtagctgggactacagtgtgcactatcatggccagctaattttttaaagttttgtagagatggggtctcactgtgttgcccaggctggtctcaaacctgtggcctcaagtgagcctcccactttggcctcccaaagtgctgtgattacaggtgggaggcagtgcacctgtccccatattgttctttttagcggctacataggatgccacggttgagccagactttgcttatcagtttcctattgatggactaggcgattttcgttgtttgttgttgttgtttggttgcatttttggagacagagtcttgctcttgtcacccaggctggagtgcagtggcacgatctcggctcactgcaacctctgcctccccagttcaagtaattctcccgactcagcctccccagtaggtgggatcataggtgcctgccaccaagcccggctaattattgtggttttagtagagacggggttttgccatgttggtcaggctggtctcgaactcctgacctcagatggtctgtccgcctcagcctcccaaaatgctgggattacagacctgagccaccacgcctggtctaggcggttgtttttgatccaagcaacgatgaattgaataacctgccgtagaggtcatatgtcaacccagcatgaagagatctcatcagtaaattcctagaagtggaattacttgtcaaagggtgtgagcaggtgtatcgtggataactattgccaaaggtttctccacaaaggactcatcctccacatgttatcaaacattctaatctttgctaactgagaggtttaaaagtatgtagttctcatttgcatttttattttttattttatttatttatttatttttttgagacgaagtctctctcttgtcccccaggctggggtgcaatggcgtgatctcggctcgctgcaacctccacctgcctggttcaagcgattctcctgcctcagcctcccaagtagctggcaccacaggcgcctgccaccatgcccggataatttttatatttttagtagagacggggtttcaccatgttggccaggatggtcttgaactcctgacctcaggtgatctgcccacctcggtcttccaaactgctgggattacaggcatgagccaccgcgcctggcctgcatttttattatttcgagtgaggttgaacatctctgtgtttaaaaactggatctcagagccaggcacggtggctcatgcctgtaattccagcactttgggaggtcaaggccagaggatggcttaaggtcaggagtttgagatgagcctgggaaatagttaggttctgtctttcttttttttggagacggagtctcgcactctcgtccaggctgctggagagcagtggcgcgatctcagctcactgcaagctccgcctcccaggttcacgccattctcctgcctcagcgtcccgagtagctgggactacaggcgcctgccaccacacccagctacttttttgtattttttttttttagtagagacggggtttcaccgtgttagccaagatggtctcgatctcctgaccttgtgatccacctgcctcagcctcccaaagcgctgggattacaggtgtgagccactgtgcccagcctggttctgtctttctatatacacatttgtaagtggatcttgtccagacgtggtggctcatgcctgtagtctcagctactcaggaggctcagggaggacgatcacttgagtcaggagtttgcagctgcagtgagctatgattgcaccagtgccctctagactgggcaacagagcaagacactgtctctaaagtaaaacttttttttttttttgagatggagtcttgctctgtcacccaggctggagtgcaatggtgtgatctcagtttactgcaacctccacctgccgggttcaagagattctcctgcctcagcctcccaagtagctgggattacgggtgcccgccaccatgcttagctaattttttctatttttagtagagacagggatttaccatgttggccaggctagtctcgaactcctgacctcgggtgattcacccgcctcagcctcccatgagccaccatgtctggcctttaaaataaaacatttttaaacgtggacctctagtctttccctggaaacgttttttttttgtttgtttgtttgtttttctgcaggcgacagcctttttgttattgatttatagagcctctttacttttactgtggtaaaatatatatagaagctctttttagtattaaagaaattacttcttattctgtgagcttcaatcttcttcctccattttttttttttgttgttgttgttttttgagatggagtcttgctctgtcacccaggctggagtgcagtggtgtgatcttggctcattgcagcctctgcctcctggattcaagagattctcctgcttcagcctcccgagtagctgagattataggcgtgcaccaccatgcccagctaatttttgcatttttagtagagacagagttcaccattttggtcagggtggtttcgaactcctgacctcaggtgatccacctgcctcagcctcccaaagtgctgggattacaggcttgggccaccatgcccagccctttggtgacttttatgtttattttattcttagaaaggcctttcctgtgcattcagttgtacatcagcccccgacctaccccaaaaaaagcctttgcggctaagccccatggctcatacctgtaatcccagcactctgggaggctgtgggagcattgcttgagaccaggagttcaatgctggagtgagctgtgagctgtgattgtaccactgcactccagcctgggtgacagagtgagactcttgtctgaagaaaaataaaaattaaaaataatttgaggccgggtgcggtggctcatgcctgtaatcccagcactttgggaagctgaggcgggtggatcacgagttcaggagatcgagaccatccttgctaacatgttgaaaccccatttctactaaaaatacaaaaaaattagccaggtgtggtggcaggcgcgcctgtagtcccagctacttgggaggctgaggcaggagaatggcgtgaacccaggaggtggagcttacagtgagccaagatcgcgccactggactccagcctgggcgacagagcgagactctgtctcaaaataataataataataataataataataataataataataatttgagtgtatttcagtgtggggaagggctttttttttttttttttttttttgagacagagtcttgctctgtcatccaggctggagtgcagtggcgcgatctcggctcactgcaagctccacctcctgggttcaagggattctcctggctcagcctcctgagtagctacgattacaggcacgagccaccatgcccggctcatttttttttgtatttttagtagagacaggtttcgccatgttggccaggctggtctcgaactcctgatcttgtgatccgcccaccttcacctcccaaagtgctgggattacaggcatgagccactgcacctggccggctttttgtttcttttctttctgttgttttgtttttcagagatagtgtcttgctctgtggcccaggctggagtgcaatggtgagatcatagcttactgcagccaggacctcctgggttcaaataatcctcccgcctcagcctcctgagtagatgggacacaggcataagccaccacgtcaggccatgcatgaccttcttagaaggccagcaatcattggatcatatcacactttaatccaggataacctcatcttaacttggttacaactgcaaagactctgtttctaaataaggttaaattcacacgtgcccagctttaacaaatctccttggaggacacaattcaaaccacactacctacaagcatttttttttttttttttgagacagagtctcgctctgtcgcccagactggagtgcagtggtttgatctcggctcactgcaagctccgcctcccggattcacgccattctcctgcctcagtctcccgagtagctgggactgcaggcgcccgccaccacgcctggctaattttttgtatttttactagagacgggttttcaccatgttagccaggatggtctcgatctcctgacctcgtgattcacccgtctcggcctcccaaagtgctgggattacaggcatgagccactgcgcctggctgcatttttttttaaatgtgttcatttttccaaaaattgactctctagaatcatgctggaaagttaaatgtaaactattgcatacaaatttgcagaggaaaaaaatgccttcccttcaaaaaaaaaacctttcaatgaattatttctttttttggttttgagagttagcttgtaatctccattatagcccgcatcttgttaactacagcatggaatggattcattgtcatattggtactttccagaagatacagttctttcccatcaatgctttttgcctctgttctggggttttcgtgcgtgtttaattagagggggcttcttttctgggatcagtgagccaaagctaatgaacaggctccttggtcaatccaggtcagtactgggggcgtttgatggggaggtgtgggtgagaacaggatgttcgaggcatgagtaggatcccaaagaggaagtgtccctcagctgagggggtgggtgagtgtgaagaggagctgtggaggagagaaggggctccactgaaacaaaagttgggccggtgtagtgtggctcatgcctgtaattcccatgctttgggaagccaatgtgggaggattgcttaagggcaggagtttgagaccagcctgggcaacatagagaccccatctctacaaaaacaaacaaacaaaaccagacctggcggcacgtgctttcggccccagctacttgggaggctgaagtgggaggatcgattgagcacagttctaggatgcagtgggctatgatggtaccactgcattccagcatgggtgaccctgtctcaaaaaaacaacaaggccaggtgcagtggctcatgcctgtaatcccaacactttgggaggccgaggcaggcagatcacttgaggtcaggagttcgagactagcctggccaacatggtgaaacctcctctctactaaaaatacaaaaattagccaggcatggtggagggttcctgtaatcccagctactcgggaggctgaggcaagagaattggttgaacctgggaggtggagactgcagtgagccgagatcgcaccactgcagtccagcctgggcaacaagagcaaaactccatctcaaaaaaataaaaataaaaattaagccaggcgtggtggctcatgcctataatcccagcactttgggaggctgaggcgggtggatcacgaggtcaggagatcgagaccatcctagctaacacggtgacaccccgtctctaggaaaaatacaaaaaattagccaggcgtggtggtgggcacctgtagtcccagctactccggaggctaaggcaggagaatggtgtgaacccgggaggcggagcttgcagtgagccaagatcgcgccactgcactccagcctgggtgacagagcgagaatccgtctcaaaaaaaaaaaaaatagagtgaccagggctgcagggtgggaggtgagtggagagaacggagcaaaacagagtccggttccgagatgagggtgtctggagtctgggggacccagggaagggaggagggggaggcagaggatgggaaggtctaccccccaggcctggactatgctgggcaggcgggcctggctcggtgcccatctctgggcagggagcacagggtgaaagcagatctggagggaagatgtggcattggatgttagaaggtgcagatctccagggggctgtgggaggtgcacatagaggaagctcagagtgtgtgtctgggctggagacaggatgtccttggtgtctgctcagaagggaggtgcacggtagttgaaggccccttgggtaaagacaggaggaagtatggggagaagctagtcccagctgcaaggcagacacctggttggggtgtgtttcatctctcatgccactgtactccagcctgggcgatagagtgagactctgtcacaaaaaaaaaaaaaaaaaaaaaaaagacagggtctcactctgttgcccaggctggagtacagtggcataatcatagctcactgcaacctccagctctcaggctcaagccatcttcagcctcccaagtagctgggactacaggttcatgccacattttaaattttgttagagatggggtcccactaagttgctcaggctgcagacactatttgaaatgaactcatctgatcctgcaacagccttgtgaggtgggtcctcttaattcctctttgacaggtgaggaaaccgaagcccagagaggttaggacactggcccaaagtcacacagcctgtgagccgctggaaccagaacctaggagctgtgtttctgctttcgtgcagacagatgcattttcctttaatacttcactttttagatgcagaagggcaggatcagggaggtggagcgacttgcccaaggtctggcagtgagttagtggccttccaagcctgtgtgtctgagcaaggctatgggctctagttgagaacgggcaaaaacagcggtcttgaaggaagcctgcctgatatccgtgtcagtgaggatgtgggctgccgggctgggcggtggaggagggtggctggagataggctggggcatgtcaagtctgaacatttagagtatgaactagacataagacagccctgactgggcacggtggctcatgcctgtaatcttagcactttgggaggctgaggtgggcagattgcctgagttcaggagttcgataccagcctgggcaacacggtgaaaccctatctctactaaaatacaaaaaattagccgggcgtggcggcgtgtgcctgtaatcccagctactcgggaggttaaggcaggataattgcttgaacccgggaagcagaggttgcagtgagccgagatggtgccactgcactccagcctgggtgacagagcgagactccatctcaaaaaaaataaaaaaataaaaaaataaaaaataaaagaaatagccctaaccccacccccttgtgacatccccaactaggctggacttcccccatgtctgcaacaggctggggcatcctccggaaatgagtgcgggagggaggccagggctgggccagcagagttgggggaggggatgggagtgcagggctggggacacaggaagaggctgcaggaaaagaggggcagtgtccaagctcagggtctcgggacctttggggtttctgccttgtccccctgcaactctggaggagcaagaggcctggggtttctcagttctttccagcccaggagtcccctggggtggctcagggagtggggacttccctggaggaaaggaccatggagtgagcatctaaacttttgcatttgactcagagctttgtctcttattttgtaaaaccccagtgtatgtgtgatatgtgtgcactgactacaaaaaaaaaaaaaagaaaaaagaaagaaaagaaacctaggccaggcacggaggctcgtgcctgtaatcccagcactttgggaggccaaggtgggcggatcacctgaggtcaggagtttgagactagcctggccaacatgagaaaaccccatctctaccaaaaatacaaaaattagctgggcttggtggcgggtgcctgtaatcccagctactcaggatgctgaggcaggagaatcgcttgaacctgggaggcagagactgcagtgagctgagatcatgccactgcactccagcctgggcaacagagcgagactcagtcttaaaaaaaaaaaaaaaaaaacgaaaaacccaaaaaacctactatccccatatataaccaatttgtgctgtgcaccaacaagaacctgctttaaatttccattgcaatttacaacccccatattataccaggcaaggttagtggctgttgaaaataccaccaggacagggctatctaaagacacattcagtagtgcattaactgtacaaaaaaaaaaaaagacactgtgtagtttcaaaacaaatcttacacagccttacatttcaattttttcttttctttcttttttttttttttgagactgggtctcacactgtcgcccaggctagtgtacagtggcgtgatctcagcttgctgcaacctccgcctcacaggttcaagcgattctcctgcctcaggctcacgagtagctgggactacaggcacaagccaccacgcccggctaatttttgtattattagtagagatggggtttcactatgttggccaggctggtcttgaactcctcaccttgtgattcacccacctcggcctcccaaagtgctgggagtacaggcatgagccactgtgcccggcctcagtttttttctttaaaaagagtgaattgtgtacaagggggttaaatgcttaatggaaaagaaaaatgaaagaaagaaagaagaaaaagaaagaaagaaagaacgaaggaaaaaggaaggaaggaaggaactgctagaaccaacttattcatcatcgtcttcttaatcttcccagcccaaagcctcctgggcccctagatccgggtaggggtgggagggagggtctgaaggagagggatgcttcccagagcagaggcattcaagctgaatctcaaagaacaagaatgtgccaggggcagtcaggcaattatgcaaagctgactgcaggtgcaaaggcccagaagttggaagctgcaccttcagggcccaaggttaatgatgtgagaagcagcaagagcaggtagagatcaggctgcaagacaaccagagctgaagtagagaaagtccttgggagtctcaataaagactttgatctaatcttgggggtaatagggagccatgggagagtttagagcaggaaggaacatagtcttagttgtgtgccccaggaattcccctggttgctttattttcttttctctttttttgttttttatttgagactcagtctcgctgtgttgcccaggctggagtgctgtggcacgatcgtggctcagggcaaactccaccttctgggttcgagcaattctcctgcctcagcctcccaagtagctgggactgaaggcatgcacaaccatgccaggctaatttttgtattgttactagagatggggtttcactatgttggccaggctggtctcaaactcctgacctcaggtggtcctcccaccttggcctcccaaagtgctgggattacaggtgtgagccactgtgtgggtccttccttcctccctccctcccttccttccttccttccctccctcccctccttctcctcctcctccttctgcttcctcttcctcttcttcttcctcttcctcttcttcttcttcttcctcttcctcttcttcttcttcctcttcctcttcctcttcttctttctctctctctcttctttctttttcttgagacagggtgtatttgtctttgtccagtctggagtgcagtgttaccattgtagctcactgcagcctccagctcccaggctcaagtgatcctcctgcctcagcctcctgagtagctgtgattacaggggcatgccacctcatctaatttttaagtgatcctcctacctgggcttcccaaagtgctgagattataggcaagagccaccatgcctggccattcctggttgttttctatcggaggggctgtaggagagggggcaggtaggagaagtgaagtcacccagtgcagcgtgggtaaggtctaaacaggacagaggggtggaaggaagataggataattttttttttaatttttagaagcttttgtttaaatatagcacacataaggcccagcatggtggctcatgcctgtaatcccagcactttgggaggctgaggtgggtagatcgcttaagcccaggaatttgagatcagcctgggtaacatggcaaaaccccatctctatcataatacaaaaattagccaggcatggtggtgcacacctgtaatcccagctactcgaggggggctgaagtgagaggatcacttgtgcctgggatttgtagtcagtggagattgtgccactgtactccagcctgagtgatagagtgagaccctgtctcaaaaacaaacaaagaagaagaagaaaggaagaaaagtgtagcacacttttagtaaagaaaacaatgcataaattcataaatgtggccaggtgtggtggcttatgcttgtaatcctagtactttgggaggccgaggcaggcagatcacctgaggtcaggagttcaagaccagcctgaccaacatggtgaaaccctgtctctactaaaaatacaaaaattagctgggcatcctgtaatcccagctacttgggaggctgaggcaggagaattgctggaacccaggaggtggaggctgcagtgagccgagatcacacccctgcactccagcctgggcgacagagcaagactccatctcaaaaaaaacaaaaaccaaaacaaacaacaacaacaagaacaaaatcataaatatatgccttaaggaatttttatcatgtgaatgtagggtatagccaggacctagattaggtcaagaacagaacataggccgggagctgtggctcacacctgtaatcccaacactttgggcggccgaggcaggtggatcacaaggtcaagaggttgagaccatcctggccgacatggtgaaaccctgtctctactaaaaatacaaaaaaattagccgggcatggtggtaggcacctgtagtcctagcaacttgggagactgaggcaggagaatcacttgaacctaggaggcagaggttgcagtgagccgagattgtaccactgcactccagcctggctgacagagtgagactctgtctcaaaaaaaaaaaaaaaaaaaaaaggccgggcacagtggctcacacttgtaatcctagcactttgggaagccaggcaggtggatcacgaggtcaggagattgagaccatcctggcgaacatggtgaaaccccgtctctactaaaaatacaaaaaaattggctggacatggtggcgggctcctgtagtcccacctacttggtaggctgaggcaggagaatggtgtgaacccgggaggcgaaacttgcagtaagccgagatcaagccactgcactccagcctgggcgacagagtgagactctgtctcaaaaaaaaaaaaaccaaaaaaaaaaaaaaaaaaacaacagtccaggcgcggtggctctcgcctgtaatcccagcactttgggaggccgaggcgggtggatcacaaggtcaggagatcaagaccatcccggcgaacacggtgaaaccctgtctctactaaaaatacaaaaaaattagccgggcatggtggcaggcacctgtagtcccagctactcgggaggctgaggcaggagaatggcgtgaacccgggaggcggaacttgcagtgagtggagatcatgccactgcactccagcctggccgacagagtgagattccatctcaaaaaaggaaaaaaaagaacagaacatcaccagcccctagaagtcccccattgtaccctgccctgctactctccacaaagggtaaccccattttttttttaagagatagggtcttgctgtgtcacccaggctgtagtgaagtggtgcgatcacggctcactgcagccttgacctcccaggctcaagtgatcctcccacctcagccccctaagtagctgggactacaggcacacacgccatcacgcccagcaaatttttgcatttctttgtagggatgggtttcactatgttgcccaggctgggttggaactcctggcctcaagcaatcctcatgccttagcctcctaaaatgctgggattataggtgcgagccaccgtgcccagcccttatcttgatttttaacagtctagaatcactctgtctgctatttgaacattatataaatgaaaacaagcaggacgtttcctttatgtttggtttcttttgtgtaacaccaggtttgtgtggttcatccatatttttgtaggttacagttattgttccttgccattttttttttgttttgttttcagacagtctcgctctgtcacccaagctggagtaccatctcagctcactgcaacctctgcctcccacgttcaagtgattctcctgcctcagcctcccaaatagctgggaccacaggactgtgtcacgacgcccggctgatttttgtatttttagtagagacagggtttcaccatgctggccaggctggtctcaaattcctgacctcaagtgatcctcccgccttggcttcccaaagtgctgggattacaggcatgagacaccgcgtccagcccgttgccatttggtatagcaaggtttctcaactgctgttgacatttggagctgaataatctttgttcctacacattgtatgtatttagcggcatcccaggcctctactcacagcgtgacagtaacactcctcccttcggttctgacaacgcaaaacatcgctagacattgccaaatattcccttagaagcgataagatcaccacccagtcgactagacgtggtggctcacgcctgtaatcccagcactttgggaggccaaggcaggtggatcacctgaggtcgggagttcgaggccagcctgaccaacatggagaaaccccatttctactaaaaacacaaacattagccaggcgcggtggtgcatgcctgtaatcccagctactcagaaggcttaggagggagaatcgcttgaattcgggaggcggaggttgcggtgagctgagatcacaccattgcactccagcccgggcaacaagagtgaaactccgtctcaaaaaaaaaaaaaaaaaaaaaaaaaaatcaccacccggttgagaaccgctgtcttcccttttgtgaacttaccacagtttatttacctaaacttttttaggcatttgggttgtttccaatttctggctgtgataagcacaggtgctgtgaacattctggccagtttctggatgaatgcaacaatgtatattctttaagtttatacttaggagtagaaatgctgattcatattgtgtaggtgtttgttcagctttctggatattgccagggttttccaaagcggttgtaccatttcacacgctctccagagtgtgggagtataacttgatattaaattttctttttttttgagatggagtcttgctctgtcgaccaggctagagtgcagtggtgtgatctcggctcactgcagactccgcctcctgggttcaagtgattcgcctgcctcagcctcccgagtagctggaattacaggcacccgccaccgcacccgactaatttttgtattttttagtagagacggggttgcaccatcttggccaggctggtctcgaactcctgacctcatgatccactggcctcggcatcccaaagtgctgggattacaggcgtgagccaccacgccccgctagcattttgggtttcatgtgcatttctctgatgactcatgaggtcagccctctttcatttatcagccatttggagatcaccttttgtgaaagactcatttgtcctttggagtttttgtccttttcattttctttctttccttccttccctccctaccctccctttctctcttcctcttccttcctttctctgtcttccttccttccttcctttctttctttccttctcttttttcttttatttgacagagtttcactcttgttgcccaggctggagtgcagtggcacaatctcagcacactgcaacctccggctcctaggttcaagtgatgctcctgcctcaacctcccaagtagctgagattacaggcgcccaccaccatgcacagctagtttttgtgtttttagtagagacggggtttcaccatgttggccaggctggtcacaaagtcctgacctcagaggatcaaccttccttggcctcccaaagtgctgggattacaggcatgagccactgtgcctggcctccttttcatttatcgctttccttccttctttccttccttccttccttccttccgttgctctctctctgtctctctctctctgtcacccaggctggagtgcagtggtgcaatcatagctcactgcagccttgacctcctgggctcaagtgatcttcttgcctcagcctctcgaattgatgggactacaggcacctgccaccatgtccagctaattttttgtagagacaggagtcttgctatgttttccaggctggtgttgaactcctggactcaagtgatcctcccaccttggcctcccaaagtgctgggatgacagtcatgagtcaccccacctggacccacatataactttttttcttttttctttttttgagacagtctcactctgtcatccaggctggagtgcaatggcacaatcctggctcactacaacctctgcctcctgggttcaagggattctcatgcctcagcctccagaatagctggaccacaggtgcgtgccaccacacctggctaatttttgtatttttagtagagacagggttttgccatgttggccaggctgttcttgaactcctgacctcaagtgatctgccagcctccacctcccaaagtgctgggatgacaggccactgtgccgagcccctcacatataacttttgactcctcaaaacttaactactaggttgggctcggtggttcacacctgtcatcccagcactttgggaggctgaggcaggaggaatgcttgagtccaggagttcaataccagcctggacaacatagcaagactccatctctaaaaaaactaaaaattagctggccatggtggtgcatacctgtggtcccagctactcaagagcctgaggtgggaagatcacctgagcccaggaagtcgaggctgcagtcagccatgtttacaccactgcactccagcctaagtgacgggataaaaccccatctctaacaaaacaaaaacaaaaacaaaaacaaaaacaaaaaaggctgggcgcagtggctcacacctgtaatccctagcactttgggaggccgaggcgggcagatcacctgaagccgggagttggagaccagcctgaccaacatggagaaaccctatctctactaaaaatacaaaattagccaggcgtggtggcgcatgcctgtaataccagcaacttgggaggccaaggcaggagaatcacttgaacccaggtggtggaggttgcagtgagccaagatcgcgccattgcactccagcctgggcagcaagaacaaaactctgcctcaaaaaaaaaaaaaaaaaaaaaaaagaaaagaaaaaaagaaactatcagaacgtccatcaatgagggagtagagaaatgaaaggagaacgaaatgtaatggtaaggtaatggaatattaaacaggagtgaaaaggaataagtaactctccctgtctgtgtgtctctctttctctctcttgccttgctctcactctcactctctccagctctactctatgtcaatataaatgtatcttaatgtggtgctgtttcaaaaagaaattcaagttgtgcaatgttagtttagtgtgatactgtttatataaatttgaaacataatagcactctgggttgcttatggatacaattccacttaaaaacagatacagattaaggaagtaatggcctttttttttttttttcccctgggtacttgtaggtttcaaatgtgtctccctgcagggaccaaagagagcaggtcactataggtcagtggccaggggagtccaggggtcagagtgggatgtgactgaatgatcagtatagccaagggatcagtatgactgaggtagccagagagaccacgtagaaggtagactttttatttttcttttgagacaaggtcccactctgttgcccaggctggagtgtagtggcatgatcatagctcactgcagcctcaatttcccaggctcaagccagcttcccacctcagccttccaagtagctgggactacaggtgtgcgccaccatgcctggcgaatttttcttttcttcctttttagagagagtttcctgctatgttgcccaggctgcaggctggtctcaaactcctgggctcccaaaatgttgggattacaggcgtgagccattgtggctggtggaaggtagctttttttcttttcttttcttttgccagaatctcactttgtctccaaggctagagtgcagtggcatgagctcagcttactgcaacctccgcctcccaggttcaagcgattcttttgcctcagcctcctgagtagctggaattacaggcatgggccaccgtatccagctaatttttgtatttttagtagagatggggtttcaccttgttggccaggctggtcttgaactcctgacctcaggtgatcctcttgcctcgtcctcccaaagtgctgggattacaggcgtgagccactgcccagggccggaagttagctttgatgcacccatttgtcctggagccccaggaacaaggtgtgctctaccagaaagagtgcagatgggatgtggattctggaaatcatatgtaggatttgcaacctcgtgcatggttctgagtatctgtagcttgcagcaggtctagatatgccaacccttgattcagagctcaaaagtcatcagggtcttatgggccagctgaggacagccaggggtcaggcaccaggattttcttttttttttttgcattaaatcaattttttaggctggatgcagcacctcatacctgtaatcccagcactttgggaggccgaggcggcattgcttgaacctaggagttggagtccagcctgggcaatgtagtgagaccctatctataaaaaaaaaaattaaaatctggctgggcgctgtggctcatgcctgtaacgccagcactttgagaggccgagtccagcggatcacataaggtcaggatttcaagagcagcccggccaacgtggggaaaccccatctctatcaaaaatacaaaaatgacctaggtatggtggcgcatgcctgtaataccagctacttgggaggctgaggcataagaatcacttgaatctgggaggcagaggttgcagtgagctgagatcacactactgcactccagcctgggcgacagagcaagactgtctcaaaaaaaaaaaaaaaaaaaaaaaaagaaaaaaaaaaaaagaaaagaaaaagaaaaagaaaaagaaaaaaaaaaagaaaaaaaaaatgctggatggggtggctcatgcctgtaatcccagaactttgcgaggctgatgcaggtggatcacctgaggtcaggagtttgagaccagcctggccaatgtggtgaaaccccgtctctattaaaaatacaaaaattagccaggcatggtggcgcacacctgtggttccaggtcctcggggggctgaggcaggagaattgcttgaacccaggggatggaggttgcagtgagccgagatccactgcactccagcctgggtgacagagcgagactctgtctcaaataaaaaaaaagaaagaaagaaagaaagaaaaagaacaacttcatcaccccgtaaaattcccttacactgcccgttaggagtcacatccttccttccttctccttgacaaccactgatcggctctctgtcgccataatttagcctttccgggactgttgtataaatggaatcagtcacacactggatagccttgtgagactgggttctttctttcttttcttttttttttttggatggagtttcattcttgttgctcaggctggagtgcaatggcacgatctcggctcactgcaacctccacctcctgggttcaagcgattctcctgccttagcctcccgagtagctgggattacaggcatgcgccaccatgcccagctaactttgtatttttagtagagacggggtttctccatgttggccaggctggtctcgaactcccgacctcaggtgatctgcccacctcggcctcccaaagtgctgggacttacaggcgtgagccaccgcgcccagcgagactggcttctttcactcaagcagaggaaaacagtatttgttttcccatgggcttttttttttttaagacaaggtctggctctgtcactgaggctggagtgcagtgatgcaatcacagctcagtgccaactccacctcccaggctcaagccatccttctgcctcagcctcccgagtagctgggactacagatgcacaccaccacacctggctaatttttgtattttctttcttttttttttttttgtagagatggggccttgctatgttgctcagggtggtctcaaactcctgggctcaagcgatcctcctgccttggcctcccaaagtgctgggatgacaggcgtgaaccactgcacccagcccataaacgttctgatttatagcagttcaggtttgcagcaaaattgagtggaaagtacagagatttcccatatatctaccctgctccccaagcccagcctcctccttatcaatgtccgccactagagtggtgcattggttatacttgatgaatctccagggacccgtcctcatcaccccgagtccacagcctacattagggctcactttttttttttttttttttttgagaaggagttttgctcggctagttatatgtttttttagccaggctctttctctgtcatccaggctggagtgcagtggcaccatcacagttcactgcagtgtcgacctctccagctcaagccatccccctgcctcagcctccctgagtagctgggattacaggtgcaccatcatgcctggataattaaaaaatttttttaggctggtcacagtggcttacacctgtaattccagcactttgggaggccaaggtgggcagatcacttgaggtcaggagttcgagaccagcctggcaaacttgttggaaccctgtttctactaaaaattcaaaaattagccgggcgtggtggcacgcacttgtagtcccagctactcaggaggctgaggcagaattgcttgaacctgggaagcggaggctgcactgagctaagatagcactactgcactccagcctgggtgacaagagtgagattctgtgttagaagaaaagaaaagaaaaaatatattgtaatttaaattaatttatttagagacatggtctttctctgtcccccagtctgacctggaactcctaggctcaagcaatccttccacttcagcctcctgagtatctgggaccacaggcttgtgccactgtgcccagcaagagctcatttattttaattaatgagttcccattgtctgaaagtaccactgtttatttattcattcaactcccgaagggcatcttggttgcttccaagttttatgcaattatgaataatactgctgtaaacatccgtgtgcaggttttgttttgttttgtttttttggttttgagacagagtctcactctctcgcccaggctggagtgcagtggcgccatctcggctcactgcaagctctgcctcctgggttcacgccattctcctgcctcagcctcccgagtagctggtactacaggcacctgccaccatgcccggctaattttttgtatatttagtagagacagggtttcaccgtgttagccaggatggtctcgatctcctgacttcgtgatcctcccgcctcggcctcccaaagtgctgggattacaggcatgagccaccgcacccggccagtttgtttttttttttttgagtcggagtctccctgtgtcgcccaggctggagtgcagtggtgtgatctcggctcactgcaacctctgcctcacgggttcaagtgattctcctgcctcagcctcctgagtagctgggactacaggcacatgccaccacgcgcagctaatttttgtatttttagtagagacagggtttcaccatattggccaggctggtcttgaactcctgacctcgtgatctgcccgcctcggtctcccaaagtgttgggattacgggtatgagccactgcacctggcccatgtgcgggttttcttgtagacatgagctttcaactcgtttgggtaaatatctaggagtgaaattaattggttatatggtaagagtatgtttagttttgtaagaagctgtcacactgtcttctagagtggctgtactgtttggcatttctctcagcaaagagtgagatttcctgttgctatataggaaacatcttttttttttttttttttttttgagtcagtcttgctttgtcacccagggtggagcacagcggtgtaatctcagcttattgcaacctccacttcccggactcaagcacttctcatgcctcaccctcccgagtagctggcattacaggcatgcaccaccacgcccggctaatttttgtatttttagtagagatggggtttcaccatgttgcccaggctgatctcgaactcctggcctcaagtgatccacccacctcggctcgcaaagtgctgggattacaggcgtgagccaccactcctggccatataggcaacaaaatttttaattacggcaacatctagaaaaaaatgttttatcctatatcctgcatttttctttttctttcttttttttttttttttgagatggagtctcactctgtcacccaggctggagtgcaatggtgccatctcggctcactgcaacctctgcctcccaggttcaagcaattctcctgcctcagcctcccaaatagctgggattacaggcttgtgccaccacactctgctaattttttgtatttttagtagatatggggtttcaccatgttggccaggctggccttggacaccttgcctcaagtgatccgcctgctttggcctcccaatatcctgcttttttctgtaaaaatagtatgaaaatattttacatattgttaaagaaaatctacaaacatttttcataactgcatattggatcttatcacgtgattgtacacagcgtaccggatacctcaggctttgcactaactgaatattaaaataacaataacagaagcattgttatatgtaaatatttgcctatttctcatatttctttctcatggattcccagcagtggaaatactggctggaaaaaggcaaacacgttatgattcttggtacatgttgccaagagctcaccagaagcctgaaatttatgctaaaagcagcaagctggccgggcacagtcgctcatgcctgtaatcccagcactttgggaggctgaggagggtggatcacctgaggccaggagtttgagaccagcctggccaacatggcaaaaccccatctctactaaaaatacaaaaatgagctgggcatggtggtgtgtgtctgtaatcctggctactagggaggctgagacaggagaatcacttgaacctgggaggcagaggttgcagtgagccgaaattacgccactgcactccagcctggacgacaaagcaaaactctgtcaaaaaaaaaaaaaaaaaaaaaaaagctgcaagctggggtaagagtcttcaggaaaaaaaaaaaaaggttagattaaaatagacaaaagatgtctcattctcttttcttttttagagatagagtcttactgtgttgcccaggctggggtgcagtggaactatcatagctcacagaagcctcagcctcctgggttcaagtgatcctcccacctcagcttcccaagtaggtgggattacaggcatgtgcgaccatacccagctaatttttattttttgcagagatgtggtctcactacattgcccaagttggtctcaaactcctgggctcaagtgattctctcaccttggcctcccaaagtgctgggattacaggcatgagccacagcacctggctaagaattcctctttaagttttaaagagagacaactcagtacattgcttgaccattttgccctctgctcttaagcttagaaaatgctttcacatctcagagatttaaaatccatttccagctgggcacagtggctcacgtctgtaatctcagtactctgagaggccaaggcaggcaaatcactagagaccaggagtttgagaccagcctggccaacatggtgaaaccccgtctctactaaaaagacaaaaattagctgggcaaggtggcacatgcctgtaatcgcagctactcgggaggctgaggcaggagaatcgcttgaacccaggaggcagatgttgcagtgagccgagattgtgccactgcactccagcctgggcaatagagtgacactccatctaacataataataaataaatccaaagaacttagtaaactcctttggtgtcacaaagctgtttgatgacagaatcagtattataacctggaagttcaaactctggcttggcgctttttcttattttatagctagtctttgaggtaagatttgtactgttaattcattctgcctacccatccacacacaaaaaattatgaggtcaaaaataaataatttgaaatagagcaaaagtagaggaagtagtgaaggaagaaaggattctggaattccataaaagttttgtgttttctttgtttgtttgttttttgagatggagtctcactctgtcacctaggctggagtgcaatggcgcaatctcggctcactgcaacctctgtctgcctcctgggttcaagcgattctcctgcctcagcaacctgtgtagctgggattacaggcgcctgccaccatatctggctaatttttgtatttttagtacagacagggtttcaccatgttggccaggctggtctcaaactcctgacctcaaatgatccacccgcctcggcctcctaaagttctgggattccaggcgtgagacaccgcgcctggcctgtttcttttcttttctttttttaattgagacagggtctcgctctgtcacccaggctagagtatggtagtgccatctcagctcaatgtggcctcaatctgggctcaagcaattctcccatcaggctcctgagtagctgagactatagttgtgcactactatgcctggctttgctgctttttgatctgataacagaaaatggcctgtatcagcgacataatcagaagtagataacaaaaccagctggttaaaaggaaattgcaaaagaataatacacctctttggtcaggtgtggtggctcatgcctgtaatcccagcactttgggaggccgaggtgggtggatcacttgagttcaggagtttgagaccagcctggccaacatggtgaaatcccgtcttcaatataaatacaaaaattagctgggcgtggtggcaggtgcctgtatttccagctaatcgggaggctgaggcagcagaattgcttgcagccaggaggcggaggtttcagcgagccaagatcacacctttgcactccagcctgggtgacagacagagactctgtctctaaatcaatcaatcaatcaatcaatcaaccaatcacctctttcacatgcccctaacactgatcatgaagggggtcaactcactgaactacaagaaattgattatggttacagaaaatgtcataagttgtatgtttgtagagcattatctgcacacacacatattcacttttccatgcttgttattcagatagcagctgcattacatttatatcatcccagctattggcttagtagccaagaatctatatagagttatagggcagtgataaagatacggttttagaaggcatttactatagatttttttttttttttttttttttgagacggagtcttgtcctgtcacccaggctggagtgcaatggcacgatctcagctcactgcaacctccacctcccgggttccagcaattctcctgcctcagcctcctgagtagctgggattacaggcaggtgccaccacgcccagctaatttttgtatttttagtagagatggggttttgccgtgttggccaggctggtcttgatctcctgacctcgtgatctgcctgcctcagcctcccaaagttctgaaattataggcatgagccaccgcaccctgcctaggttgttacctttttttttttttttttttttgagatggagtctcgctctgttgcccaggctggagtgcagtggcgtgatctcgggtcactgcaagctctgcctcccaggttcacgtcattctcctgcctcagcctcccaagtagctgggactagaggcgcctgccaccacgccctgctaattttttgtatttttagtagagacggggtttcactgtcttagccaggatggtctcgatctcctgacctcgtgatccgcccgcctcggcctccgaaagtgctgggattacaggcgtgagccactgtgcccggcctagatagttacctttaattaaagtaacttttagctgggcatgtacctgtattctcagttacttgggaggctgaggcaggaggaccatttgagcccaggagttcaaggctgtagtgtgccatgatcctgtctgtgaataaccaccgcactccagcctgggcaacatagcaagactttctctctctctcaaaaaggtaacttataattttcgtaacttttgaactccttgagcccaggagtttgagaccagctctggcaacatattgagacctcatctctacaaaaactttaaaaattaactgggtgtggttgtgtgcacctgtagtcccagctactcaggaggttgatgcaggaggatcacatgagccgcagtggtcgaggttgcagttagctataatcatgtcactgcacgccagcctgggtgacagaaagacccagtcttttttttctttttttgatggagtcttgctctgtcgcccaggctggagggcagtggcacgatcttggctcactacaacctccgcctcccgggttcaagcaattccctgcctcagcctcccgagtagctgcgattacagacatgcaccaccacgcctggctaatttttgtatttttagtagagacggagtttcaccatgttggccagggtggtcccgaactcttgacctcaggtgatccacccgcctcggcctcccaaagtgctgggatcacaggtgtgagccactatgcccaaccgaccctatctcatttatttatttattggatttatttatatatatatttttgggggatggagtctcactctgtcacccaggctggagtgcactggagtgatctcagctcattgcaacctccatctcccgggttcaagcaattctcctgcctcatcctcccgagtagctgggactacaggcgtacaccactacatctggctaattttttgtatttcagtagagacggggtttcaccatgttacccagcgtggtctcacacttctgagctcaggcaatctgcctgcctcggcctcccaaagtgctaggattacaggggtgagccaccgcacctggcctggaccgaccctatctcttaaaaaaaaaaaaaaggccggcatggtggctcacgcctgtaatcccagcagtttgggaggctgaggtgggcagatcacgaggtcaggagatcaagaccatcctggctaagactgtgaaacccagtctctactaagaatgcaaaatattagccgggcatagtggcacctgcctgtagtcccagctacccaggaggctgaggcaggagaatcgcttgaacctgggaggtggagcttgcagtgagccgagatcatgctattgcactccagcctggatggcagagcaagattctgtctcaaaaaaaaaaaaaaaaattgtgttggccaaaactttcacaacacccatcccaaaatacttgttctgcgtggtatgcagatcaactgtctcttcagacaagcacttctttaacctttacttcatcaaaatggaatatttctttgaaattccacaccttttaaaattcctaaatcctcagacagctttcttagttggttcatctgaagtctcatcatctttggtacaacaatctctaatgagaacaggtttcaataaaggaggtgactcaatcaccatcttgtttttgagatagagtcttgctctatcacccaggctggagtgcagtggcacgatctcagctcgctgcaaccccgcctcctgggttcaagcaattctcatgcctcagcctcccaagaagctgggattacaggcacatgccaccatgcctggttaatgttttttgtatttttagtagtaacatggtttcaccatgtcggccaggctggtcttgaactcctggcttcaggtaacccacctgcctcagcctccgaaagtgctgggattacgggcatgagccaccgcgcctggcctcaatcatcttgtttaactatttctcaaaagctctgatctgcaaaggaagattaatttcaggtctgaactggccaacagaaaccaccaaatgtcctggggtcatctttttctgaagtcagggaatgttcagaaatgcccgcataccacgtggtggatgaacaatactagcgtaattcccagctttccacagtgagaggatatggttcagtgtccaagaagaattcatcatgagtacatacatcactgcaagaaccgaagagtccacaaataaaccgaaaactaaatagtagtagatgaactttgctttactgaggattcctggtaacgaaggctgtgttattttattcaacattttgtgcccatgcctgtagtctcagctacttggaaggctgaggtgggaagatcacttgggcccaggaagtcgaggctggagtgagctgcaatggtgccactgcactctagcctgggcgacagagtgagactctgtctcagaaataaacaagcgaacaaacaaacaaacaacataggctgtgtgcagtggctcatacctttaatctcaccactttgggaggctgaggtgggtggatcacttgagatcaggagttcaagaccagcctggccaacatgatgaaaccctgtctctaccaaaaatacaaaaattagccgggcgtggaggcttgggcctgtaatcccagctacttgggagcctgagacaggagaattgcttgaacccaggaggcggaggttgcagtgacctgagatcgcaccactgcactccagcatgggcaacacagcgagactgtctccagaaaataataataataataataataataataataataataataataacaacctgcttcaagatacttactttttctgcagggctcttgaaaccacaccataaaactcattctccttctccactagcattgcagtatggattaaaaaaattcaaataggccagacgcggtggctcatgcctgtaatcccagcattttgggaggctgaggtgggcagatggcttgaggtcaggagttcaagaccagcctggtcaacatggtgaatccccatctctacaaaaaaaaaaaaatacaaaaattagccagacatggtggcgcatgcctgtactcccagctactcaggaggctgaggcaggagaatcacttgaacccaggatgtggcagttgcagtgagctgagatcatgccactgcactgcagcctgggtgacagagtgagacactctcaaaaaaaaaggccgggcgtggtggctcacgcctgtaatcccagcactttgggaggctgaggcagacggatcacgaggtcaggagatcgagaccatcatcctgactaacacggtgaaaccccgtctctactaaaaatacaaaaaattagctgggcatggtggcgggtgcctgtagtcccagctacttgggaggctgaggcaggagaatggcatgaacccaggaggcagaacttgcagtaagctgagatagtgccactgcactccagcctgggcgaaagagcaagactccgtctcaaaaaaaaaaaaaaaacagcaatcactatttgattttttccatttttttgctggttgacactgactttttctttcttgatagcagcagattcctcaaaggatgattaccaaagatttacataaatttccacatacaattagctcacgaaagaacaatgaattaaattacctcaacaactcaaagaccagtcccctcccatggggccccatcttccgaagaccccccaaactaggaagcccttcattgtttctctcctctatgagctcctccacacactgtcatttctttttctttctgtatttttattattaagacagggtctcactctgttgcccaggctggagtgcagtggcccagtcatagctcaatgcagctttgaactcctgggctgaagcgatcctcccacctcagcctcccaagtagctgggactataggtgcatgccaccatggctggctaattttttttttttttttttgagacagagtctctctctgtcgcccaggctggagtgcaatggtgggatcatggctcactgcaacctctgcctcccagattcaagctattcttctgcctcagcctcccgagtagctgggattacaggcacttgccatcatgcccggctaattttttttctgtatttttgtagagacagggtttcaccatgttggccaggctggtcttgaactcctgacctcaggtgatccacctgccttggcctcccaaagtgctgggattacagacgtcagccaccgtgcccggccatcttggctaatttttaaagattatttttagagatggggtctcactatgttgcccgggctggtctcaaactcctggcctcaagtgatcctcccgtctcggcctcccaaattgcttggattataggcatcagccattgcgtccagcttctcttctaattttctaggctatttatagggtccacaatggatcatgccagcccctctgctaagggttatccaccaacatctcatttaacctacactatcctctccagaagcaaatattgcattggtgcaaaagttattgcggtttttgcaattaaaagtaaaggcaaagctgggcacagtggctcacacctgtaatcccagcattttgggaggctgaggcaggtggatcacaaggtcaggagttcaagatcagcctgaccaacacggtgaaaccccatctctactaaaaatacaaaattagctgggtgtggtggcgcgcacttgtaatcccagctactcgggaggctgaggcaggagaatcgctcgaacccgggaggtggaggttgcagtgagccaagatcatgccactgcactccagcctggcaacagagcgaaactctgtctttaaaacaaaaaggtaatggcaaaaaacgcaattatttttgcaccaacctagtattatttctctcatgtcacagatgagaaaactgaggcttagggggaatctctaaatttgtctagtgtcatgtggccagagacataattcatacctggacacctcactccggacgctgttcacagccctactcctctttggtgggtaaatactccgggaaaggcacgattttctcctagtgtgaattcagggtaggcaaaatagcctcatccagtcacaagaggcccctgacctgcctgagaaaggtgctgcaaaccccgtgctctgtggcttcccccacccttgtgtttttggtctcccaggggaaactgaggcagcctgggcagtggccaatgatcccagacattagcagaaagaaatcccgaattttccttggcagagggaagcctcaggacccacaaagcaggaacctgtgacttgagggcaattcccggagctcccaaccccgctgacacccctgtgaaatatggcatagcccacgcccagaatcccactccctatgacctgtaactaccgtcttttcttttcttctcttttcttttgaaacagagtctcgctctgttgtgcaggctggagtgcaatggcaccatctcggctcactgcaacctccgcctccctgcaacctccgcctcccaggttcaagcaattctcgtgcctcagcctcctgagtagctgggactacaggcacctgcaaccaagcccggcaaattttttgtatttttagtagagacggggtttcaccgtgctagccaggatggtctccatctcctgaccttatgatccgcccgcctcggcctcacaaagtgctgggattacaggtgtgagccaccgcgcccagccttgtcttgtcttttcttgtcttttgaaacagagtctctctctgttgtgcaggctggagtgcaatggcacgatctcagctcactgcaacctccgcctcccaggttcaagcaattctcctgcttcagccttctgagtagctgggattacaggcgcctgccacctcacctggctaatttttgtatttttgtagagatggggtttcaccatgttggtcaggttagttttgaactcctggcctcaagtgatctgactgcttcagcctcacaaagggctgggattacaggcttgagccaccgtgcctggcactactcccacttctataaccccttcatctctctgatccttttatcctcatgacagctttacccaagcccctgaacaggagcagaaaatccattcatttaggccgggtgcagtggcttatgcctataatcccagcactttgggaggccgaggcgggtggattactggaggtcaaggagttcaagaccagcctggccaacatggtgaaaccctttctctactaaaaatacaaaaattagccagatatggtggcgggtgcctgtaatcctagctactcggaagggtgaggcagtagaatcacttgaacctgggaagtggaggttgcagtgagctgagatcgtgccattgcactccagcctgggcaaaaagagcaaaactctgtctcaaaaaaaaaaaaaagtctgggcgcggtggctcatgcctgtaatactagcacttcaggaagctgaggtgggcagatcacttaaggtcaagagtttgagaccagcctggccaacatggtaaaaacccgtctctactagaaatacaaacattagctgggcatggtggcacatgcctgtaatcccagctgctcgggaggctgaggcaggagaatcacttgaacctgggaggcagaggttgcagtgagccgagatagtgccactgtactccagcctggacaacagagcgagactccatctcaaaaaaaaaaaaaagaaaagaaaaagaaaatccattcatttaatgcatgaacagatatgaattgagctgtgtaaactcaaagtatctgagtcaggtctcaatcaatttaggaagtttatttagccagctgggttcagtggctcacgcctgtagtcctggcactttgggaggccaaggcaggaggatgtcttgagctctggagttcgagaccagtccgggcaaaatggcgaaacccagcatctacaaaaaacacaaaagttagccgggtgtggtggtgcatgccttcggtcccagctgctcaggaggctcaggtgggaggattgattgagcccaggaggttgaggctgcagtgagctgaaatcatgccactgcactccagcctgggtgacacagcctgggtgacactccagcctaggtgacactgtctcttagaaaaaagtattttttttgttttgctttttttgagatggagtctcgctcttgttgcccaggctggagatggccaggttgctcttgaactcctaacatcaggtaatccacccacctcagcctctcaaagcgctgggattacaggaatgagccaccacacctggctgaaaaaaaccttatatttagagatggagtcttgctatgccacccaggctggtctcaaactcctggcctcaagcgatcctccctcctcagcttctcaaagtgacatgattacagacgtgagccacctcaaccagcagccttttttttttttaatggaatcttgcttggtcacccaggctggagtgcagtggcacaatctcagctcactgcgacctccacctcctgggttcaagcgattctcctgcctcagcctcctgagtagctgggattacaggcacctgccaccatgcccagctaattttttgtatttttagtagagacagggtttcatcatgttggccaggctggtctcaaactcctgacctcaggtgatctgcctgtctcagcctcccaaagtgctaggattacaggcatgagccactgtgcctgacctgcttcttattttattttatatttatttatttatttttttgagacagagtctcgtcaggctggagtgcatggcacgattcggctcactgcaagctccgccttccgggttcacgccattctcccgcctcagcctccccagtagctggtactaaagacgcccaccaccacgcccggctaatttttctgtatttttagtagaggcggggttttaccgcattagccaggatggtctcgatctcccgacgtcgtgatccgcccgcctcggcctcccaaagtgctgggattacaggcgtgagccaccacgcccggcccctgcttcttattttaaaatgtagcaggaggccagacacagtggctctcacctgtaatcccaacactgtggggggccaaggtgggagaattgcttgaggccaggagttcgagaccagcctgggcaacatagcaagatcccatttttacacgctggccatgatggtgtatgccccatggtcccagctacttgggaggctgaggtgagaggattgcttgggcccaggaagtcaaggccgcagtgagttgtgattgcaccactgcataccagcttgggcaacagagcaagaccctgttctcaaaaaaaaaaaaaaaaaaaaaaagagagagagagagacctggggcagtggctcacgcctgtaatcccagcactttgggaggccgacgcaggcagatcacctgaggtcaggcgtttgagaccagcctggccaacatggtgaaaccccatctctactaaaaatacaaaaattagccgggcatggtggcggctgcctgtaatcccagctactcaggaggctgagacaggagaatcactgaatctgggaggcggaggtggcagtgagctgacattgcaccactgcactccagcttgggcaacagaagcagactccgtctcaaaaaaaaaaaaaggaggcggagagagcaggagaaaatgtgggtaagagcctttattatagtttccatgggacaggcacagtgaggcagatgaaagttgccacgggctattttgaataatttctccaggctctggggcatacgtgctgtccctaattgcctggcacatggccctaaagtaatcaggtcagggcaacaggcttggattgtcacagctctgcaaaaaaggtggttgtggggtgtgagctttccataggaaccgtgtgctcttggacaagccagttgtttgcaaactctccaacaaattagctaaccctgaagaaatcggcaaaccctgggagaagctgtctttccggcattagcaaggcccaagatgccaaaacatcaggaaacagagaaactcctggcctcaagtgaacctcacagaaagaccagtcccctcctgtggggccccgtcttctgacgacccccaaactaggaagcactttattgtttctcttctctgtaggctcttccacatgttgtcatttctttctctttctgtatttttatgtattattatttgggtcagggtctcactctgtgcccaggctgcagtgcagtggtgcaaccatagctcaatgcaggcttgaactcctgggctcaagcaatcctcccacctcagcctcccgagtggctgggacttacaggtgtgtgccactagtccaggcttttccctttcaccttgctttccctagggtctgttcccctgccctacctggctcctgtgtccccagagagctggccaagcagcaagggaaaggggtttcccccttcatgtgttactacggctaagggacagaacccaagttagccacccacctgcacatttgacctcgccacagggtctggcagctgcaccctccacagacacttggatcagatctcggttctgttgctctgtgacctcctgttgcaatttgctggaaagcaagtgaatcctgtgccaagacacactggcacacatctgtgattgcatgccaggtccccaggaggctaaggtgggaggattgcttgagcccaggagttcgagaccagcctgggcaacatagtgaggccttgtctctacaaaagataaacaaaattagtcaggtgtggtggcatgcacctttggtgttggctattcaggaggctgaggtgggaggatggcttgagccctagaggtctagacttcagtgagctgtgatcatgccattgtactccagcctgggcaaaagagcaagacccggccgggcgcggtggctcacacctgtaatcccagcattttgggaggctgaggcgggcatatcacctgaggtcgggagttcaagaccagcctgaccaacatggagaaaccccatctctactaaaaaatgcaaaattagccaggcgtgttggcgcaggcctgtaatcctagctactcaggaggctgaggcaggagaatcactggaacctgggaggtggaggttgcagtgagctgagatggtgccattgcaccccagcctgggcaacaagagcaaaactccgtctcaaaaaaaaaaaaaaaaagtaagaccccatctctaaacacatatagatacacatataaaatacaaaatatatataaagaataaaaatcgtattagaaaatctaagctggccgggcacagtggctcacgcctgtagtcccagcactttggaaggctgaggccagtggatcacctgaggtcaggagttcaaggccagcctggccaacatggtgacttcccagctctactaaaattacaaaaaattagctgggcatggtggtgggtgcctataatcccagctacttgggaggctgaggcaggagaactgaacctgggaggtggaggttgcagtgagccgagatcacgccattgcactccagcctgggcaacaagagtgaaactccatctaaaagaaaagaaaagaaaatagcagcagctgcctatacaaccaaaggaccaatgagacttttttttttttttggggatggcgtctcaccctgtcgcccaggctggagtgcggtggcacaatctcggctcactgcaaactccacctcccgggttcatgccattctcctgcctcagcctcccgagtagctgggactacaggtgcccgccaccacgcctggctaattttttgtatttttagtagagacggggtttcaccgtgttagccaggatggtctcgatctcctgacctcgtgatcctcccgccttggcctcccaaagtgctgggattacaggcgtgagccactgcgcccggccaagatcacctagattttcttctagaagttgtagagttttgtagagttttttctccttcccttcctcctccctcctcctccctcctccctccttccctctccccctcccctcctccccctccccctccctccctccctccttccctctcttcctcccttcctcccttcctttctttccttccttccttccttccttatttttgttttctctcccttccattctccaccttcctcttgcaccatcacctatagctttgtatttgacatataggtctacaattctttgtgtttgtttgcatggtataatatatatggcatacaatttaccctttttttttttttttttttttttgagacagagtcttgctctgtcgcccaggctggagtgcagtggtgcaatctcggctcactgcaacctccgcctcctgggttcaagcgattctcctgcctcagcctcccgaatagctgggaatacaggtgcgggcgccaccacgcccagttaatttttgtatttttggtagagatggtgtttggccatgttggcaagggtagtctcgaattcctgacctcaagtcatccgaccgccttggcctcccaaagtgctgggattataggcatgagccaccgcgcccagccacaatttaccattttaacctgtcaacgcaaagagtcaaactttaaaatattcgaagagatttattctgaggcaaatatgagtgatcatagcccatgacatagctctcaggaggtcctgggaacatatgcccaaggtggttcgggagcagcttggtttgatacattttagggaggcaagagacatcaatcaaacacatctgagaaatacgctggtttggtacagaaaggtgggacaattcaaaggaggtggcgggtcttccaggctataggtaaatttgaacattttctggtggacaattggttgagtttgtctaaaggcctgggattaagctgggcatggtggctcacctctgtaatcccagcacttctggaggctgaagtgggtggatcacttgaggtcaggagttggagtccagcctgaccaacatgatgaaaccctgtttctatcaaaaatacaaaaaaattagccgggcatggtggcaggtgcctataatcccagctactctggaggctgaggcaggaaaatctcttgaacccgggagatggaggtttcagcgagtcgagatcatgtcactgtgctctaggctaggcaacagagtgagactctgtctctaaataaataaataaataaataaacaaacaaacaaaataaagacctgggattaatagaaaggaaatgttcaggttcagataaaagattatggagaccaaggtttgtttgtttgttttgagacagagtttcgctcttgttgcccaggttggagtgcaatggcacgatattggctcactgcaacctcggcctcccgggttcaagcaattctcctgcctcagcctcctgagtagctgggattagaggaatgggccaccatgccagactaattttgtatttttagtagagatggggtttctccgtgttggtcaggctagtctcgaactcctgacctcaggtgatctgcctgcctccgcctcccaaagtgctgggattacaggcgtgagcgaccacacctggcccaaggccatttcaaaatatggtaaagaaacatgttttggggtaaaatacttttattttcttctttgccacataatgttatggcagagtcaggttggaaagtaagtgacgatatataggattaaataaaacccatctgatgaggatttatggtttgtggggcaggccccttagataggaatctgggcaagataaaaaatatcggagcttagttctcaaaccatttttaagtatgcaactcagtggtattaagtacattcgcgttgttttgcaaccatcactgtcagaagtatgtaaaccagagcgactccgtcttgaataagggctgggtaaaatcagcctgagacctactgggctgaattcccaggtggttaagtcattctaagtcacaggatgagacaggaggtcagcacaagatacaggttataaagaccttgctgataaaacagattgcaataaagaagccagctgaaacccaccaagaccaagatgacgacatgagtggcctctggttgtcctcactgctgcactctcaccagtgccatgacggtttacagatgccgtggcagcatcaggaagctaccctctatgctctaaaaaggggaggcatgaataatccaccccttgtttagcatatcatcaagaaataaccataaaaatgggcaaccagcaggcctcggggctgctctgtctatggaatagccattcttttattcctttacttttctaataaacttgctttcactttatggacttgtcctgaattctttcttgtgcgagatctaagaaccctctcttggagtctgaactgggagccctttcccataatatcttcaccattcatctccagaactttttccaaacgggaaatctgtacctattaaataatagcactggccgggtgctgtggctcacacctgtaatcccagcactttgggaggccgaggcgggtggatcacgaggtcaagagatcgagaccatcctggccaacatggtgaaaccccgtctctactaaaaatacaaaaaaattagccgggcgtggtagcgcatgcctgtagtcccagctactcaggaggctgaggcaggagaatctcttgaacctgggaggcggaggttgaagtgaaccaagatcatgccactgcactacagcctggtgacagagtgagacactgtctcaaaataataataattatgataataataacactccatccctcttcccccagcccctggtaacctccattctactttctgtctctgtgaattttccaattctaggtacctcactatggtcccttttgtgttcatttttttgttttttttgagtctcactctgtcacccaggttggagtacagtggctcgatcttgactcactgcaacccccacctcccaggttcaagtgattctcctgcctcagcctcccaagtagctgggattacaggtgcccactaccactcctggctaatttttgtatttttagtagagacggggtttcaccatcttggccaagctggtcttgaacccctgacctcaggtgatctacccatcttggccttctaaagtgctgggattacaggtgtgagccactgtgcctggtctgtgttcatttttgttttgttttgtttttagatttttaaaaagttttaaaattttttgtagagaggggttctcacttgttcaaggccggtctcgaactcttgggctcaagcaattctcctgtttcagcccccaaaagtgctgggattacaggcgtgagccactgcacctggctgcattcattttttacgaaaggtgtaaagtctgtgcctattttttgcgtatggacatctgattgttctagcaccatctgtggaaaatgtaaccacaccagaccaatctggttcacctttttttttttcttgaagacagagtctcactctgtcgcccaggctggagtctagtggcgcagtctcagctcacagcagcctctgcttcctgagttcaagtgatcctcctgtctcagcctcctgagtagctgggattacaggtgagcaccaccacacctggctaatttttgtatttttagtagagatggggtttcactatattggccaggctggtctcaaactcctgacctcaggtgatccgcccgcctcggcctcccaatggttcaatttttttttttttttggagtctcgctctgtcacccaggatgaagtgcagtggcgtgatctcagctcactgcaagctccgcctcccgggttcacgccattctcctgcctcagcctctggagtagctgggactacaggtgcccgccaccacacccggctaattttgtttttgtatttttagtagagacggggtttcaccatgttagccaggatggtctcggctagtctcgatctcctgacctcgtgatctgcccgcctcggactcccaatgtgctgggattacaggtgtgagccaccgcgcccggtcccaatggttcaactttttattttttattttttttcaagaaggagtttcactcttgttgcccaggctggagtgcaatggcaggatctcggctcaccacaacctccgcctcccaggttcaagcgattctcctgcctcaacctccctagttgctgggattataggcatgtgccaccacgcccggctaattttgtagttttagtagagacggagtttctccatgttggtcaggctggtcttgcactcccgacctcaggtgatccgcccgcctcagcctcccaaagtgctggaattacaggcgtgagccaccacgcccggtcagttcaacttttatgtagcagagttgtgagttgtttttcagttgccacggacccccaggtagaaggtcgcataacctgagcatgtccaggtgaaccaactgtgtaaccacaggcagaacctaagtgctcccactgaggagagaggggtggagactgaattaagaagcagacactgcatgacaggacccaggatccaatcagagtgagccctgacatcatcccatggccggatccaatcagatcatgcctcccggcatcacctcagtgcaagatccaatcagaacacgcctcattaccctatgcttataaaagctgccccagcctgcagctcccggagacagatttgaatgtttcttcctgtctccgtgcagtcgacttgcaataaagcttttattttctgaaaagctggtgccatgtattggcctgtatgtgcattgggcagggaacacattgattgcatagacagcaaaaagactgtcctttctccgttgaattgcctgtgagcttttgtcaaagatcaattgattatattggtgtggatttatttctggactttctgttctgttgatctgtgtgtcttcttttgccaatactgtcttggttattgcagatttccagaacgtcttgatattgggtagtgacagtcctccaacttggttcttctttgatattttgtaggctattctcagtctttgtctttctgtatcaattttaggatcagtttgtcaatatctacaacctggcaacatctattaaaattaaaaatataggccgggcacggtggctcacgcctgtaatcccagcactttgggaggctgaggcaggcagatcacgaggtcaagagagcaagatcatcttggccaacatgatgaaaccccatctccactaaaaatacaaaaattagctgggcgtggtgccacgcgcctgtagtcccagctactcgggaggctgaggcagagaactgcttgaacctgggaggaggaggttgcagtgagccaatattgcaccactgcactccagcctggtgacagagcgagactcggtctcaaaaaaaaaaaaaaaaaaaaaaaaaaatatatatatatatatatatatatatatatatatagagagagagagagagagagagagagagagagagaaagagagagagagagagagatccttcacccagcaacctcattgctagaaatctttcccttggaaagaaaatcgtcagcacgtatgggcataggtataaaaattaatttttgtagagacagggcctcgctctaatgcccaggctggagtgcagtggcgtgatcatggctcactgcagcctcaacctcccaggctcaagtgattctctcacctcagacttccaagtagttgggactacagatgccatcatgttcggctagtttttaaaaatttttttgtaaagacaggagtctcattacattgtccaggctagtcttgaactggtctgaagcgatcctcctgcctttggcctccgaaagtgctgggattacaggtgagagccactgcacccagccaaaaaattcttgttgcagcattttttgcttactttttggtagtggtggggaataaaacctgttaaccaagtgaaaactcatcagtggggatgtggttgaataaatgaaggttcatccacaccatagatgattatcaagcaattaaaaagaatgaattcagattttagtaggtggtctaagaagtttccagaaagtcctgtgaataaaaaagtatgttcaatatgattccatatttatgaaacaatgaccccatcctctctttttggtctatgtatttatgaatatctaccttcgtttaatgaacaaagagaacaacctggtagattgttaacttgaagaatgaccaaagtaagaggaaataagagaaaaagagagggtagttcaacccctgatgactgttgaaaaaaatagtaacttctttttctaaatcagtgctgtccaatagaaatataaatgcaaggtcaggctcagtgactcatgtccataatcctagcactttgggaggctgaggcaggaggatcgcttgggcccaggagtttgagatcagctgggacaacatgatgaaaccttgtgtttacaaaacatacaaaagttagccgggtgtggtggcggcacttgtaatcccacctactcgggaggctgaggtaggaggattgcttgagcctgggaggttgaggctgtagtgagccatgatcacaccactgcattccagcctgggcaacagaacgtgatcttgcctaataaaaaagaaataaaataaaaactaatgcaaccgacatagacaatcttaactcttttagaacccacattttatttcatatatatttacttatttatatatatatttttgagacggagtctcactctgttgcctaggctggagtgcagtggtacgatcttagttcactgcaacctccgcctcccagtttcaagcgattctcctgcctcagcctcccgaatagctgggatttcaggtccctgccactatgcccagctaattttttgtatttttagtagagatggggtttcaccatgttggccaggctggtttcaaactcctaacctcatgatccgcccacctgggcctcccaaagtgctgggattacaggcgtaagccaccgagtggcctagaacccacattttaaaaagtaaaaagaaacagatgaaattttaataatataatttacttagtccagtgtacccaaaatatcagcatttcacccctgtcattgctatttgaggcatcttacattctttctcttgtatgaagtgcttgcgattccgtgtggatttcacacttatatctccatagaactggttcaaatgctcaaaagctccctgtgaccagtggccacctaacaatctatgggaagacttgagtgccccctagtgacagatttgattaacttcctcttggcaatgaggtcctcaaaggtaaatcagatggcgtcgctccctgcctagaacccaccgtggctccctgctgccgccaggtcatgtccacgctcctggttttcaagactcctttcaatctgagtcctgctcgtctctccacaagcaacttccactccttccttccggtcatatcagatttgctcaccattcattcatttactgatccatcgattcagcgtttattgagtgccaatgaaggccctggcacatgtgcgttttctgaagatcagtgatattcaggtttctgggtctgacaatttgcacttaaccaactttatttttgagtgtcagtcttcttgtctgacttaactaatggcacccttaaggtttcagagggcagagtggaaagctgcaagtgcacccttagcccgcaaggatgagaccagagggagagaggctgggcgggcattggggccccagataaatgggtgcagatggcagaactggcagtgggtgccagagtcctctcttctcccagcagggctaatcctaatccagttgaagtctgacctcaaagcccaccttggcatctcaaaatgctgggattacaggcttgagccactgcatcccggcctctcttgctttctttccctccctccctccctcccttctttccttccttccttccttccttccttccttccttccttccttccttccttccttccttccttcctctctttctcctctctctctctctctttctccattcttttgacagagtctcactctgtcgcccaggctggagtgcagtggcatgatctctgctcactgcaacctccgcctcccgggttcaagcaattctcttcttcagcctcccaagtaactgggattacaggtgcccaccaccacgcctggctaattttttttgtatttttagtagagatggggtttcaccatcttggccaggctggtcttgaactcctgacctcatgatccacctgcctcagcctcccaaagtgctgggattacagacgtgagccactgcgcatcttctctcctctcctctttcttcctttttcttctctctctttctctatctctctgtctttctttttatttgaaagggtcttgctctgtctcccagtccggagtgcagtgatgtgatctcggatcactgtagcctctacagtgacatctggggctcccagacatctggggctcaagtgatctcatctcagtctcctgagtagctgggactacagactcatgccaccaggcctggctaatctttgtgttgtttgtagagacggagcttgccatgttgccccagctggtctctaactcttgcactcaagggatctgcctgccttggcctcccaaagtgctgggattacaggtgtgatcccccgctcccggctcgacatggaaatattgccaagatgtaataagaagttaaaagaggctgggcgtggtggctcacgcctgtgatcccaccactttcggagaccgaggcaggcagatcatgaggtcaggagatagagaccatcttggccaacatggtgaaaccccgtctctattaaaatacaaaaaaaaaaaaaaaaaattgccaggtgtggtggcgtgtgcctgtagtcccagctacttgggaggctgaggcaggggaactgcttgaacaggggaggcggaagttgcagtgagccgagatcgcgccactgcactgcagcctgggtgacagagagaaactctgtcacaaaaaaaaaaaaaaaaaaaagtaaaataaaataaagggccacctagtgtgtgattccatttacgtgaaacgtctaggccaggcacggtggctcatgcctgtaatcccagcactttgggaggtcaaggcagatggatcacttgaggccaagagttcaagaccagcctggctaacatgatgaaatcccgtttctactaaaaataccaaaaaaaaaaaaaatagccagacgcggtgccgtgtgcacctgtaatccctgctactcggaaggctgaggcagggaaacattcgaacctgggaggtggaggttgcagtaagccaagatcatactaccgcactccagcctgggtgacagagggagacttcatctcaaaataaaataaaataaaataaaataaaataaaataaaataaaataaatacgtgcaatgtccggaacaggcaaatccacagagaatagaaagtggattagtgtttgccagggactggggtatggggaatggggagcaactgctaatggggacaggatttcattctggggtgatgagtacgttttggaactagatagagggggtggctgcacatactgcgtgtactgaacgctactgaattgtacacttgaacatagtaagtgctatgttgtgtgaaattgatctcagtaaaagaaaacagtaaaaagaagatggtaattgagagggattgatttagtttgcaagaaaaaaatatattttttttacaaagatgagaaaaagcaaatacagaacaagatacaaaggtgctaacatttgtgtttattagaaagagaaagaggccaggcaccgtggctcacgcctgtaatcccagcactttgggaggcggaggcgggcagatcacatggtcaggagttcgagaccagcctggccaatatggtgaaaccccgtctctactaaaactacaaaaattagggtgtggggtgggcgcctgtactcccagctactcaggaggctgaggcaggagaatcgcttaaacttgggaggtggaggttgcagtgagctgagagtgtaccactgcactccagcctgggcgacagagcgagactctgtctgaacaaaaaaagaaaaaaaaagaaagaaagaaagaaagaaagaaagaaagaaagagaaagaggccaggtgtgacggctcatgcctgtaatctcagcactttgggaggatgagttgggaggatcacttgatcccagagttcgagaccagcctgggcaacatagtgagactctatctctaaaaaaaaaaatttttttaaattagacaggtagtatgtgcctgtagtcctagctactctggaggctgaggtgggaggattgcttaagcccaattcgaggctgcagtgagctgttatcttccccactgcactttagcctgggtgacagagggagaccctgtttttttgtttgtttgtttgtttttaattatttttacaaagaggaaatagggcaaatacagaacaatgtataaaggtgcaaacatgtgtgtttattagaaagagaaataatatattgtatatggaccctagacaggtcccccagctagaacatcaaggcaatggggtgagggtgtggctgggggcccaaggccacggggaaggttccagctttgtggcctgggttcagatttgcctgtattctttcctggtggtggggtcccagtgggcgatgtggtggctctgtgcctcagtttcctcatctgtgtaatgggatgatatcagagcctgtcttcagggtctcttgtgaggatccagcttgatctcttcctcagagctttcctgggtcctctgcggcttccctccccgctccaagcctcattcctgggcacgtggccaaactcctggcgttgtatgcaatgctttgactcccagctgcttcctgtgcttatacaaagagggctctgtccccaagccaccctggcctaggctggcccagcgcactccacacaccatagactgcaggcatctccccgtccctcctcccatctccttgtccccagccttgaccctgtgctcctgggcacaccctgcccactcctgtctccatgccttcctcgagctcatgctaatgaacatctggggtctgctggctctgggtgcacacagtcaagtcccgcctatgagggggggctccatggctgctcagaaagtcaaacggagggtggggctggcgtgactcacagtgaccttaacgggatgacagtggcagcagcggggggggacagttctgggggacattaatagtgtgacaatgtgacagcaacaggtgacaacgtcacaggaactgggaatgatgggaaggcaacaggtgacagcaacaggtgacactgtaattttaaaacccactaggggccaggtgcagtggctcacacctgtaatcccagcactttgggaggccaaggcggacatatcatgaggtcaggaattcgagaccagcctgaccaacatggtgaaaccccatctctactaaaaatacaaaaaaaaaaaaaaaaaaatagccgggtgtggtggcacacgcctgtaatcccagctacttaggaggctgaggcaggagaattccttgaacccaggaggaggaggttgcagtgagccaagatcccaccactgcactccagcctgggtgacagagcaagactgcatctcggggcgggggcggtccggggaggacaaaaaccaaaaaaagagaacatccactaggggtcaggcgcggtggctcacacttgtaatccccacagtttgggaccgaggcaggtggatcacctgaggtctggagttcaagaccagactggccaatgtggtgaaaccccatctctactaaaaatacaaaattagccagacgtggtggcaggcacctgtaatcccagctactcaggaggctaaaacaggagaatcacttaaactgggaggtggaggttgcagtgagccgagatggcaccactgcactccagcctgggagacagagcaagactccatctaaaaaaaaaaaaaaaaaaaaaaaaaggaaaaagaaaaagaaaaaaaaaaaactagatggtgatgtgtgcctgtagtcccagctacttgggaggctgaggcaggagaatggcttgaacctgggaggcggttgcagtgagctgagattgcaccactgcactccagcctgggcgacagagcaagattctgtcaaaaaaacaaaaacaaaaactttaaaacaccagatccccattggagcccccatggacctcattttactgagggtggggggaactggtgccagcatctcggatcactgagcagcatcagggcttagggtgccagatggtaatgaatggtgtcttcctggggcccgatctgcatgtgatgtgtgtgaatgtggttggctgcggcaccaccacgcttggtcactctttctgctgagcccggttgttgctgatgccagtgaattgtgatgttaagaaccctgacattctgggtaatggtatgaccatgagccggggactgtgtcacagcagaaaggtgaaggtgtaaaggtgacaggagacatgcatgtcccaggtagcggagcaaccagaaaagagcagggtgtcacatggacaggtgacaatgagacagggtcatagggacaagtgactgtagaataggaacatggtgatgatgatgatatacatacatatttagagacaggttcatgatctgttatccaggctggagtccagtggcaacatcatagctcactgcagcctcaaactcctgggttcaagcactcctcccacctcagcctcccaagtagctgggactacaggtacatgccaccatgcccagctaatttttctatttttttgtagagatggggtcttgctatgttgcccaggcttgccttgaactcttggcctcaaaggatcctccaccttggcttcccaaagtgttgacattacaggcgtgaggcacagcgcctggctgatgatgcagttttgacggagagaccatgcatgtgttttgtacagtcctgggtggggggactgtgatatgcggtaggatttaaagcctaaatgtcccttctttttttttttttgagatggagtctcgctctgtcgcctaggctagagcgcagtggcgtgatcttggctcattgcagcctctgcctcccaggttcaagcgattctcctgcctcagcctcccaagtacctggaactacaggtgtgtgcccccgtgcctggctaatttttttatttatttttattttatttattttttttttgagatggagtctcgctctgtcgcccatactggagtgcagtggcaccatctcggctcactgcaagctctgcctcccgggttcacaccattctcctgcctcagcctcccgagtagctggaactgcaggcgcccaccaccatgcccagctaattttttgtatttttagtagagacggggtttcaccatgttagccaggatggttttgatctcctgagctcgtgatccgcccgcctcagcctcccaaagtgctgggattacaggtgtgacccaccgcgcccagcaattttttatatttttagtagagatggggtttcactgtgttagccaggatggtcttgatctcctgacctcgtgatatgcccaactcggcctcccaaagcgttgggattacaggcgtgagccaccatgcccagcctaaatgtcccttcttaacagtgtgatgtaataagggtacagtggggggtgacactgtctgtgataccacatcaataactggcaataacataacagaccagggtggcaccatgggaagtctgaaactacagcacgcggtgtggacagtagcttgggttgggggctgtgaacaaccaatgcccactatctgccgttttcgagcacttcagttgcggtgacttccaacagctccacatcctggtcttgccacaccctccggcttccttctcccctctcttctggagggcaggtagggagacttctaggactgagtcgctccctggcccacagttcttccaggaaagccctcctccagacttagccatggcaacagtggctgtgcagtgtccctgggatgggacaatctctccccaccttttgcacctatgctgggctgcttctagggcacccggtgcttgtccccgtgcccatgtaagattcatttgttgcagaacaaatctgggtggaccttggcagaggagcctggaaagaggtgtccaaggtggccggggaaactggtttgtccacaatagcccctgggcccaccctccaacaggaaccccacccccctgtctctgctgggccacctccatcctggggttccctccccagtccaccctccccatgccccagcaccccacctgacccttctcacagggtccacgggcccctcccttggccaggatgactggatcttgtccctgaagtcggcgtctgtcccatgctccccgagcccagccctggggccctcaatgctccccggacacagtctaagacctggaagtggagccttgggagaacctcccctttctgtgagtccaccgtgtctcccctcagaggtggggggggagcctgctgagggctcctcggtgcttctagcctcttcttatgtttcctgctttcctcttgctccctccccttctcctctctcctaaagttccaacctcactccatccaggcatgtttgttctaagttctctccttctccaggcctttgcctgttctgtttcctccagcaaactcctatgcaactgtcaaaacctacttcaaaaatccccttctgggccagactcggtggctcacgcctgtaatctcagcactttgggaggccgaggcaggtggatcacgatgttaggagttcgagaccagcctggccaacatggtgaatccccgtctctactaaagatacaaaaaatttaccgggcatgatggcacaagcccgtaatcccagctactcggaaggctgaagcaggagaattgcttgaacctgggaggtggaggttgtagtgagccaagatcgtgccattgcactccagcctgggtgacagggcaagactttgtctcaaaaaacaaacaaaacaaaacataaacaaaatcctctccctccctgcaaattgtgagtttaccctattgaactcccaaagctgacttgctgaatatactcccaccatagcacttccggaatggagacagggtctccaatttttggagatagggtcttgctcagttgcccaggctggagtgcagtggcacaatcataactcactgcagcctcaacctcctaggctgaagcagtcctcctgcctcagcctcctgagtagctgggactatagatgcatgccaccaggcctggctaattctttttaattttttttttttttttttttttagagatggggtctcactatgttacccaggttagtctcgaactcctggtttcaagcccactgggcttacttatttattagattccggaagtactgtggtggggggatattcagcacaatcagctttgggagttcaatagagtaaactcacaatttgcggatagggagggaatttttgaactggactttgacagatgcgtaggagtttgctggatggagtaacagcttcaggcccaacgcacagcttctgacagatccccatgttaagggtctattctcaaaggtatgaaggtagtggaaaagcctagaaatttttgtttggagtactgacaacagatagggagccaaaattcttgtctggtccctttggtaggtggacaaacaggttcaaagagatttgaaagtttacaccgtttgaattgttaacctcttcattttgagaaccagatgaaaaacctgggcccttctccctgggaaatacagctttgcccaatgttttgtcaacatatttaggggcccctgatctcagcctagttaagaatccaggctccaagagccaggtgagtttccaacgtcactctcgcaattctccttgctcgagggagggggtggcggcttgggaggccctgagagggccgcccaggtgagtcccgggacttctctgcccaggctgtcgtccaggccctccaaaagtcagagccccacctccaccttagtctcgatccgaaaacgcggccccggcagcccctactaggcgcccccagcccgccctcacatccctccagtccatcggagtttttcactcggagccccggaccctcccccgagccgcagcctctctccccgccccggatcggagccccccgtccccgccccgggagctaagaggtgcaaacgcgccctcctccaactcctcccgcccccaactcccccccgagtggcagctctgggctgggaacgcggcggggtcggcctctcggctttgcgttcccgccccgggtccccggcgccgcaggagcccgccctgcagcgctgagtcccgcgcgtccgcctgccgtgcccgcctccacgcgcgccgcctcgcaggtaggtgaaggcgcggggccagcggcggggcgagatcgcgggcgctgaagggtggagaaggcgggggcgggggggccggcagggggagggggagaggattcctttgttcgcagccgggcagccccgggcccagccccctcccctctccgccttctagtggcgcccgccgcagtggggagtgggggcgcggggacccggcgggaggggctcggccggggcgcggggcccctgaccccacaggtgagggcggagccaagcgtggtcgcggccgggggccctgccgggtggagatcgcgccccgcgggctccgggggcgccccctccccgtcggcgaagcttggtatccctcgctgtttggccctcagcctccacaccccgtgccgggcgcgccttctctgctcattcattccacaaactccagggtgtggctcgcagaagcagcggtgtgtaggggggaccgaggcaaatcaggccagagactccccccacctaattcccccacccgacccgaggcagggggctggggcggagggagtgggggaggagggcttgcaagccccgaggctgcttggagtccacggagcctcagagtgcggactgacccggacaactgagaagaaaaagagggcgcccctctccagccagccaaccctccaacgttgacaggggtctctcccttctccggggcctttggacaaccaggttggcccagagaggggcgtggccaagaccacacagcagggctccccgcccattctccacctagggccggttcctttcctccctggaacctgaatggaacaggaaggccacttggtctggcttctctccctcaagtattttgcctccaccctccaaacggtcgtctcctgtcccggtcttctccctcccgtccttcatggcccaggaaagacccagccaaggggggcaggagcgagttccgttcctgatcttcttcccctccttcttctcttcgtgggcttaagctccggcttagcccctcactcatggtgtgatggccttagtttgtgcatctgtgaaatgggcacagaagcggtcccttccctgctgggcacagggttactctctgcattgggaagttccagcccctgcctgggccccctgcccagggaggcatccagccctgacctgggagcagtgaacagtcagaggaggcttcctggaggaggtgtgatgttagaaaagggtcttgcggctaagggtgcacagcccaggcaagaccggcgtgggatgtggaggcgaggggacacagggccaggtggggccaggcattgcaggagtgggggtatctgtgtcacagagggacagtggggttgttgccttccacgacttaccatcttcctcctaccctggacgctctctgggctccaccgtcccagctagaactttgggaatctcctcaatgccctccacctcccacgacatgagcctcccattcctctcctctctctcccatctggacagcccccagccttctgacaccctgtttcccccccgggaccctgctgcccttccccacaccacctaacatgcatttctgaccttgctcctcccactcaaagcttttcaagggctcttcattgtccttgacgaatgagcaaaagctgcatgacactgctatgcccactcctgcaacgcctggccccacctggccccacctggccctctctcccctcccttccacttcccactcccgtcttgccttggctgtgcaccctcagccccaagacccttctctaacatcacacctcctccaggaagcctcctctgactgttcaccgcttcccggttggggctggatgcctccttgggctcccagaggccccggggctgccccatttggcaaccaccctgccctcctcgttgtgttgggtcccccatggctagggtggggggctcatctagggctgactctgcttcctctccgcagcctccaggggacacgccatgactctggagggtctgtatttggcaaggggccccctggcccggctcctgctggcctggtcggccctgttgtgcatggcaggtggccaaggccgctgggacggggccttggaggctgcaggtcctggacgtgtgcggaggcggggcagcccaggcatcttgcaggggtgcgtggtacctgggatgctgggagaccccttcggtgtggattgggctgtcctggggccagcggaatacccggggggatgtccacacgggcaggggctcaccagacccatctcgctgtccccgaaggccgaatgtgtgcggctcccggttccatgcctactgctgtccaggctggaggacattccctggcaggagccagtgtgtcgtacgtgagtgctaccgccgtctggaggtgggggggcacaggccggggacactcttacctgcctgcaggttcagctctgtttacacggggacttagccagggacctctggctgaaccacaggaatggcccttgcatctgcgtctgtcctcagggttccaggccaacctgccatgttcatttcctttgccctacaacctccttgtgtctgtctgtctctctggttcccttgctttgtctctgcctctctctattcatctctgctcatgtctctctctgttggtttcttttctttattattattatttttagagatgggggtctctgtgttgctcaggctggtctcaaactctggcctcaagcgattttcccatctcagcctcccaaagtgctaggattccaggtgtgagccactgcacctggcctctctctgttggttactgtctctctatctaactgattctctctctctctgtttctctgagtctctctctgtttgtctctctctggcctcaccctctctttctgtttctgtctctggaatctgactccacttcccaggagacacccaacctcagtatccaggaccccagcacctccagctctgtcctcacagctcagcagctctggcccaaagagcattctctccccatggctctagcagagtccccaacccacagcctgggtcacacaccctgcccagcccagcccgagagtggggggacatcccatgaaaacaggggtggggtgtgctatgagcagagccggggatgcagatgaccagcagcgtccactgaggtgttccggccagcccggacaccaatggagcagggacggcccaggctcggtcctggtcttgactgccacccgctgcactcatccagccatctgtaggcgcgcctgcggtgaaggcttctgctcccagcccaacctgtgcacctgtgcggatgggacgctggctcccagctgcggggtgagccgaggtgagcgggaagcggcctcttgcgggagggagaagaagttcacagggttctggttgccacgaggagcctgggctgcttttgttgaaggacaggagcggggctgagcatgcctagtcctgcagccttcctaggagggcatctcggggcccatctccacattactatgcgtcctgccttcctgtccccagggtcagggtgcagtgtgagctgtatgaatgggggcacctgccggggggcgtcctgtctgtgtcagaagggctacacaggcaccgtgtgtgggcagcgtgagtatccccatgggactcccctctttgcacacctgggactgtgatcccagagtattagtctctgctgccacctgcccactgcccagggttccttcttcctggactggagattgcaggggacgtttattgccacagtctcttttttttttttttttttttgagacagagtctcgctgtgtcactcaggctggagtgcagtggcaagatctcggcttactgcaagctccgcctcccaggttcacgccattctcctgcctcagcctcccgagtagctgggactacaggtgcccgccaccttgcctgactaatttttttgtatttttagtagagatggggtttcactgtgttagccaggatggtcttgatctcctgacctcgtgatccgcccgcctcagcctcccaaagtgctgggattacaggcgtgagctaccgtgcccggcccttttttttttttttttttttttttgagatggagttttgctctgttgcccaggctggaatgcagtggcaccatctcagctcactgcaacctccgcctcccaggtttgaacaattcttctgtgtcagcctcctgagtagctgggattaaaagagccggccaccatgcctggctaatttttgtatttttagtaaagatggggtttcactatattggacaggctggtctcgaacccctgacctcaggtgatccacctgccttggcctcccaaagcgctcggattacaggcgctagccactcagctcagcctcagtcttattcaacctgggccagatcctggggattcctgggtgaagacaggcttgctgtgaaccccagctctctctgctgctgggggacctccagccatcaccctctctcctccacagccatctgtgaccgcggctgccacaatgggggtcgctgcattgggcccaaccgctgcgcctgtgtgtatggcttcatgggacctcaatgtgagagaggtaccaagcatgcgcgggtgggaggtagacaggggactcgatggaggaaagggggtttcctggaagtccctgagacatggccaggccttgaaaggaaccagctggcctccttcccgcatttggggcagtctgaggacatttctttcatttgctcatctgttctccaaaacatctgctattcactggctctgagcgagcacctgtgttggagtctggtaggaaagagagaggatgtgccagtctgaggggcagggagaagaaactgcaagcagaagattcttatctgggggtgtcaaggctaagacaagggttggggcagccctggagcatgtgaaggacagagaaaccatctgctccatggaagggagtcagggagggcttcctggaggaggggacccctcagctggatctggtagggtggactggacttcatgagatgggcaaaccccctctttattgcaccctaattctctcttttttttttgagacaaagttttgctctttcgggctagagtgcagtgatatgatctcggctcactgcaacctctgcctcccaggttcaaccaatcctcccgcttcagcctcccgagtagctgggattacaggcatccccacgctcagctaatttttgtaattttagtagagatgaggttttgccatgttggccaggctggcctcgaactcctggcctcaagtgatctgcctgtctcagcctcccaaaatgagccaccacacccagtcaccctaactcttaaaaatgatcccatttttaagacggctaagataggtggggtcacctgctgagaggttgttaccaaaattaagagggtggatgtaccaggagtttgagatcaacctgggtagcatagtgagacaccccccctctctaaaaaaagtaaaaaattagcctggcatggtggtgcatatctgtagtctcaggctgaagtgggaggattgcatgagcccaggagttcaaggctgcagtgagccgtggtggtgccactgcattccagcctgggtgacagaaccagaccctctgtctcttaaaaaaaaaaaagaaagaaagaaagaaagaaagaaaagaggccaggcactgtggctcatgcctgcaattctagcattttgggaggccgaggcgggcagatcactcgaggccaggagtttgagaccagccatggccaacatggcaaaagccatctctactaaaaatacacaaaaaaatgtaactgggtgtggtagcgcgtgcctgtagtcccagctacttggaaggctgaggcatgagaattttttgaacctgggaggcagtgagccaagatcgcaccactgtactccagcctggaagacagagcgaaaccctgtctcaaaaaaaaaaaaaaaaagaaaagaaaagaaaaaaggagaacggacacagtgatgtctttcttgtgagcagtgaggtgtggcagggacggggagagaagaaggagggagtcaggatgaacccaagacctggtgaaaactggagggaaggtagtggcgcaccctggcagggaggaggaggactctgagctcagtgttggccgagggacttgcaagttgtctgggaagcagctggacactcaggcctggggctgagatggcggcgtgggctgccccatccatggggactgaagcccagggtgccgctgaggatccccgtgagagaaggaagggccagcagagacagccacctgggcatttaagcctggacagaaaaaaccgagcccacaggaggctgagaaagagaaagagaaccggagtgggtggcgtcagggacatccaggcttgtgagattttcagatgcagaggcatctgggtgcctaatgtggtgtttcagcccaggaaggtgaggatgggcacgacccggggactagaagctggaggggctggggaagtgacctgggtttgagggtgggcttctggaaactgcagaattagaacatgggcttgttggaggcgggccaagctctgggtggcagaagagtgagggggagggggagtgggggagctgccaggaattacgttttggcttggggcatcaggacagctggggggtgggggtctctgtgaagcccctcctccttacggggcctgagttgggggtgagtttggcttcttctcttgggagcggctgcccttgtttgagagctaactcctttattggaaacatctgggagaagagagccaagaagtcacatctgggctcatgtactggggttgggggaaccaatgcggtcaccttgggctgggcctgatggggattggggatgtgatgttgggggtccagagaatttaggcagataacagatccttccccaaatctgggcgatatggcagggccaggcgtgtgctcaaggactagacatgctttttagctgggcatccgtgggtccctgcccaggcctgaagggaggataggcctggggaaggagtcccatcagttcagacagggtgttcacacaggccctgagctttattggcttggaggtgctggtctcttggaagttggtcaggaaatgctttgaagaaaaagggttttgaagggtgaataggagttcgttaggtagggaaaggggaggaaagatattctatttagtaagggagcagcataagtaaagcctggtctgtgggtgcaggggccgctgagaaggtgttagagacgcagagatctccagacaggggcagccctcagccaggtacccacatctgtctgccctgcagattaccggacgggaccctgctttggccaagtaggccccgaggggtgccagcatcagctgacgggcctcgtgtgcaccaaggcactttgctgtgccactgtgggccgtgcctggggccttccatgtgaactttgccctgcacagccacacccctgccgccgcggcttcatccccaatatccacacgggggcctgccaaggtgaatagtggggtcagggctgagtgggaggccttagctgccttggttcttccctccgatgggcctctcactcccctgccgggctttgtccttgcagatgtggatgagtgccaggctgtgccaggcctgtgccagggaggcagctgcgtcaacatggtgggctccttccattgccgctgtccagttggacaccggctcagtgacagcagcgccgcatgtgaaggtgggtgactggagggggacaacctgagacctcctctgtgactcatgacctggggggctcaggctcccctgcaggaaggcagaggggtcaggctggtgaggtgcccagttctgaccttgtccctgtttatgtagatgtgaatgagtgtctcagcctgtccggcctctgttctgggggtgactgcaccaacactgtcgggagctacgtgtgcacctgttcccaaggttttgccagcagcctggatggcacccactgcctgagtgaaccgaggggctggagcgggagagagtgggtaggagagagaccccttgttcagctgtctgtctctctcttttttttttttttttttttgagacagagtctcactctgttacccaggctggagtgcagtggtgtgatctcagctcactgcaacctctgcctcccagttcaagagatcctcctgcctcagcctcccaagtagctgggagtacaggcgcacgccaccacgcctagctaatttttttttttttttttttttttgagacggagtctcgctctgtcgcccaggctggagtgcagtggcgcgatctcggctcactgcaagctccgcctcctgggttcacgccattcccctgcctcagcctcccgagtagctgggactacaggcgcccgctaccacgcccggataatttttttgtatttttttagtagagacggggtttcaccgtgttagccaggatggtctcgatctcctgacctcgtgatccgcccgcctcggcctcccaaagtgctgggattacaggcgtgagccaccgcgcccggctggccaactccagactttctaggtctccaccactgggggccatcacagctggcattgggggtagctgtggatacatcccctggactgcggggggtcctctctcagctgctaaagaccagtccttggattggacaaaccagcctctgaacataggctttggaatcagtctggggctcccacccagagctgctcacagaccctgtggccttgggcaagtgacttaaccgctctgtgcctcagtttccccatctgtaaaatggtagataatagcagtacctagctcaatgaagattgagtaagatatcatttggggagtaatttgcagagggctggtacctagaggatacttaatacacattcatggacaccaggtaatgttggggctgtggccacttagctcacagtatgtacttacagcaatgacaggatcatttttgttaaaattcttttaacacattcttactctgtcccccaggctggagtgcaatggcacgatctcggctcactgcaacctccgcctccggggttcaagtgattctcctgcctcagcctccccagtagctgggattacaggcacccaccaccatgcccggctaatttttgcatttttagtagagacggggtttcactgtgttggccaggctggtctcaaactcttgacctcaggtgatccacccgcctcagcctcccaaagtgctgggattacaggcatgagccactgtggctgagcatttttgttgaaattcttatattctgtctctcttgcttgagggactgttgcctgttgggtcccctgagattgggaaatcgagtttcccgtcctcctcttgcttttgcagctgtgtgactttggaggagtctgttgatctctcctcgtctgggcaggcccagtcccctttgaggggctatgataaggctgagaacgaaaaaccctgactcccacgcacgtacctggggggcccccaggtgcaaggggaggggaccagggaggtagaaacatttgcatgttttcccagctcggggcaggtcaggggtggctctcagtggccctcccagctgctgggaggagttttttaaactgtgggccaccagccaaggtttgtgcatttttaagcctaaaaatatgctctttaagccagagcctgagaaatctgatcgctgcataaagccattgaccttgagggcgcagtgggaagtggaagagtgttggtggttctcatacctggggagcctgtctgcctcagtcaccccgggggctgtagccgtcaatccacccctcgactccttggggcccctctctgaaattcacagtctcgtaggcttctgcataatgcctgaagccagcaagcaaagacacacagctgcagatctccgtgtccctgcctggtatcccactggggtagtccttccccgccaatgggtcttccttagtgtggttggatgcctgcagcgacggggagctcactacctctgtgcgataacttggaatcttggtaacaagagatggcactgagcgagcattggccatatgtcaaacttttctatttatttatttatttatttttgaggcggaatcttggtctgtggcccaggctggagtgcagtggcacaatcttggctcactacaacctctgcctcccaggttgaagtgattctcctgcctcagcctcccaagtagctgggattacaggtgtgcgccaccgcacccggctaatttttgtatttttagtagagactgggtttcgtcatgttggccaggctcttcttgaactcctgacctcatgatctacccgcctcagcctcccaaagtgctgagattacaggcgtgagccactgcgcccggccctttattttttttgagacggagtctcgctctgttgcccaggccggagtgcagtggcatgatctcagctcactgcaatctttgtctcctgggttcaagcaattagtgattctcctgcctcagcctcccaagtagctgtgattacaagtgcctgccaccacccttggctaatttttgtatttttagtagacatgaggtttcgccatgttggtcaggctggtcttgcactcctgaccttaagagatcctcccgccccagcctcccaaagtgctgggattacaggtgtgagctactgcatctggactatgtcagacttttcatccaggtaatacttttcccgggtgaggtggatgctccaagcatccccattttatggagaggaaactgaggcacagagcggcaaacagacccgtcctacaggcagtgctgctacagctggaatttggatccaggtctggtcactgatgtcctgtgctcatgggctcaccctctgatcttttgcagactaccgggccggcgcctgcttctcagtgcttttcgggggccgctgtgctggagacctcgccggccactacactcgcaggcagtgctgctgtgacaggggcaggtgctgggcagctggcccggtccctgagctgtgtcctcctcggggctccagtgagtaagagctgcagcctgcagggctgtgggtgaggaggggacaggggagggccaagggcctggcctcaaccctgcttccttgcagatgaattccagcaactgtgcgcccagcggctgccgctgctacccggccaccctggcctcttccctggcctcctgggcttcggatccaatggcatgggtccccctcttgggccagcgcgactcaacccccatggctctgatgcgcgtgggatccccagcctgggccctggcaactctaatattggtgaggcctggggcttgggaggaacattccaagacttgaaggatggtcctggatctggggagagagctccaaacaggggacggtgtccaggcctcagagagagggttagggctttggagggggaactcctggcctggctagtagggatgacagtgctagtagtggatggggatggaggtaactggagaatctggtcctcagagttaggttttgggctggacacagcgactcatgcctataatcccagtactttgggaggccgaggtggaaggatcacttgaggccaggagttcgagaccagcctgggtgacatagcaagaccctgtctctacagcaaattgaaaattagctaggtgtggtgatgcccaccagtagtccctgccactcaggaggaagaggcaggaggattgctggagcccaggagttggaagctgcagtgagctgtgattgtgtcactgccctccaacctgggtgacagagtgagaccctgtctctaaaaataaataaataaataaataaataaataaataagtcagagttcgggctttgggtggggagtttgggcctggtgtgggggtctgtcatgtaggatttaggcctggggtgggttcttgccccataatgaggatttgggcccagagtgggagtctgggcatctctgggaccaggttagagggatctaggctccagattgaagggatctaaggctccattttggagggatctaggccccaggttggagggatctaggctccaggttggagggatctaggctccaggttggagggatctaaggccccaggttggagggatctaaggccccaggttggagggatctagggcccaggttggagggatccaggtcccaggttggagggatctaggcttcaggttggtgggatctaagccccaggttggagatatctaggccccaggttggagggatctagaccccaggttggaggaatctgggttccaggttggagggatctaggcaccaggttggaggaatctgggttccaggttggagggatctaggcaccaggttggagagatctaggccccaggttggagggatccaggtcccaggttgaagggatcgaggtgccagtttggagggatctaggcttcaggttggagggatccaggccccaggttggagggatccaggccccaggttggaggtatctagaccccaggttggagggatccaggcccaggttggagggatccaggccccaggttggagggatccaggcccaggttggagggatccaggtcccaggttggagggatccaggccccaggttggaggtatctagaccccaggttggagggatccaggcccaggttggagggatccaggccccaggttggagggatccaggcccaggttggagggatctaggtcccaggttggagggatctagatcccaggttggagttctgaatctaaggcaggactctccatgagaaagagggcaggatctgagccagggcagggtcccagccttagagggggtatctgggcctagagaggtgaagcccaggctccagactggggcggggccagccactgctcagatgcctctgccggccccacccgtaggcactgctaccctgaaccagaccattgacatctgccgacacttcaccaacctgtgtctgaatggccgctgcctgcccacgccttccagctaccgctgcgagtgtaacgtgggctacacccaggacgtgcgcggcgagtgcattggtgagccgcggccaggtggaagggggggcggttctcactgccctgctcgtgctagggctcagggtcctctcccctcagatgtagacgaatgcaccagcagcccctgccaccacggtgactgcgtcaacatccccggcacctaccactgccggtgctacccgggcttccaggccacgcccaccaggcaggcatgcgtgggtacggctgtccatccaagagtaggggtgatgttgttgggggttctggcccaggcttggagggtggggagcacctcttgactgcccgcctgccttccccgcagatgtggacgagtgcattgtcagtggtggcctttgtcacctgggccgctgtgtcaacacagagggcagcttccagtgtgtctgcaatgcaggcttcgagctcagccctgacggcaagaactgtgtgggtgagttgggggtgggcgggtgggcaggggcttccgggccccactagctgccttttacagccacctcaaatcttcactgtgcccccaaacccacctccctccctacgacgtctcctctgctcacctctgaacccagcagcccacctgagactcttcttatcccctgaccaccctgactctccccttcatttcctccttcctgaatttattccgtgaatcacaaaaaaggaccttttggagccagtcttggtgccttatgcctgtaatcccagcactttgcggggctgaggcaggagaatctcttgagctgaaaaggttgaggctgcagtgagctgtgatcgtgcccctgcactccagcctggctgatagagcgagactccatctcctaaaaaaaaaaagaagtccgagtgtagtggatcacgcctgtaatcccagcactttgggaggccgaggtcaggagttcgagaccagcctgaccaacacggtgaaaccccatctctactaaatacaaaaaaattagctgggcgtggtggcagacacctgtaatcccagctactcgggaggctgaggcaggagaattgcctgaacccaggagacggaggctgcaatgagccaagatcacaccactgctctccagtgtgggtgacagagagagactcagtctcaaaaaaaaaaaaatttttttttatgccaagcttggtggctcacaactgtaatcccagtactttggaaggcaggaggatcgcttgaggccaggagttcaagatcagcctgagcaacacagcaagaccctgtctctacagaaaacccaaaaattagcctggcatggtggcaggtgcctgtagtcccagctactcaggaggctgaggcaggaggatcacttgagcccaggagttcggggctgcagtgagctgtgattgcatcactgcactctagcctaggtgacagacctagaccttgtttcaaaaaatatatatatatatatgtaaaatatatatatttatatttatttatatatttattcatttattcattttgagtctctatctcccaggctggagtgcagtggtgccatcttggctcactgcaacctctgctgcccgggttcaagtgattctcctgcctcagcctcctgagtagctgggattacaggtgtgcgccactgtgcccggctaacgtttgtatttttagtagagatggggtttcaccatgttggccaggctggtctcgaactcctgacctcaggtgatccgcccgccttggcctcccaaagtgctgagattacaggcgtgagccattgcgcccggccatgtatttatttttttgtgattgggtctcactgtgttgcctaggctggactttaactcatatcccagcagacagactaatatgcaagcaaacacagccacagacaaccacagcttctttgcctcccacaccccagggaggggccctggggggctcaagcaatgtccccgcctcagccacttgagtagctgggactacaggcatgagccagcatacctggcttcttcattctttttcatggccgaataatgttccattacatgaatagaccacagtgtgtcgatccattcagtaggacactggttcgttttcactttttgctgttaggcataatgcttctgtgaatgctcatgtgcatatttttgtggtggcatttcatgcatttatttattttatttatttatttattttgagatggagtctcactctgtcacccaggctggagtgcagtggcgtgatcctggctcactgcaacctccacctcccgggttcacatcattcccctgcctcagcctcccgagtaactgggaccacaggcacccaccaccacgcccggctgattttttttttctttttttttttgtatttttagtagagatggggtttcaccatgttagccaggatggtctcgatctcctgacctcgtgatctgcccatctcggcctcccaaagtgctgggattacgggcgtgaaccaccgcacccagccacatttttttttttaaatgtatgttcagtcctttattgtttaaaactgacattttggaaaacaactcatttctgcccctgccaccttccattaaattagaccatggtcttactaactttatttccatttcctttttatgaaattgaagtaagattcacacaacctaaatttaatcatttaaaagtgaacaagaggttgggcgcggtggctcacgcctgtaatcccagcactttgggaggacgaggcgggcttatcacgaggtcaggagttcaagactagcctggccaacatggtgaaaccccgtctctactaaaaatacaaaaacaattagccgggcgtggtggtacatgcctgtaatcccagctactcaggaggctgaagcaggagaatcgcttgaacccgcgaggcggaggttgcagggagctgagatcacaccactgtgctccagcctgggcgacagagcgagactctgtctcaaaaaaaaaaaaattgttgtcttttaaaaaatatttaaacattttaaaatgaacaattcactgatatttaataaatttccaatgttgtgcaaaaaccaccacgtttattcagctttgagcaattatttatgcagcacctactgtattgcagcctgagtaagacaggggtcgtgccccggggaactcaacgtcccagcggacggactaatatacaagctcacacagtcacagacaaccacagcttgtttgcctcccacactccagggagggatcctggggggtcagccctggagcctggaggagggagagagagggtcccagtgtggtccctgcctggacccagcctctgctgttgtccccagaccacaacgagtgtgccaccagcaccatgtgcgtcaacggcgtgtgtctcaacgaggatggcagcttctcctgcctctgcaaacccggcttcctgctggcgcctggcggccactactgcatgggtgagcctggagccagactggccagcggaggggagaagggagatggggaagcagagggacggcgaggaagaggagagggaccggacggggatgggacgagcatgagagaaggagaagagaaggggcagggagaaaaagaggaggaggagggaaaaggggagaagcgaagaagaagaaaaggaagaaaagaagaggcaggtgccgtggctcacgcctgtagtcccagcaccttgggaggccgaggcagatggatcatttgaggtcaggagttcaagaccagcctggccaaaatggtgaaaccccatctctactaaaaatacaaaaattagccaggtatggtggtgggcacctgtaatcccagctacttgggaggctgaggcaggagaattacttgatcctgggaggtagaggttgcagtgagccgagatcgcgccattgcactccagcctgggtgacaagagtgagactccgtctcagaagaaaaaaaaagtgatgcattataaggtggggaggggccaggttcatctgtgatcccagcactttgggaggctgaggttagaggatcacttgaggacaggagttcgagaccagcctgagcaacatagtcagacgccatttctacctaaaaaaaaaattagctgggcatggtagcatgcacctgtaatcccagcactttggaaggctgaggcagaaggatcacttgagctcaggagtttgagaccagcctgggcaacatgatgagactccgtctctataaaaaatttttaaaaattagccgaacatggagatgaacccctgtagtccctcctactcgggaggctgaggcagcaggatcacttgagccctggagttggaggccgcagtgagctatgatcacgccactgcactccagtctggaagtcagaccctgcgtttaaaaaatttgtttaaaggtggagagaaagatagaaagatggggaataatgggagaggagaagaggaaggagacaagaggaggagaggacagagacacagacaacaggaaactggaaagacaagaaactggaaaggaaagaaatagaatggctgggaagatggaaatgttgggagatggggaggggagagaggaagggagcacgctggaacccatccccgtgccgccactgcttctgcagacattgacgagtgccagacgcccggcatctgcgtgaacggccactgtaccaacaccgagggctccttccgctgccagtgcctgggggggctggcggtaggcacggatggccgcgtgtgcgtggacacccacgtgcgcagcacctgctatggggccatcgagaagggctcctgtgcccgccccttccctggcactgtcaccaagtccgagtgctgctgtgccaatccggaccacggttttggggagccctgccagctttgtcctgccaaagactccggtgagcatccggctgcccggtccccatcgcctccttggtctgaatgcctccatcggttctcgcttctggtggggggtcatggctgccatggagtgggggctcttcccaaaaagaggctgaagggagttgctccctccccggggttggagttgtgtcttagtcccaaactcttgcccaagaccagagggcctcatccttgcctgtggctgaatccgagccatggctaagctccctgacccgtctcactctgtccctccatccccagctgagttccaggcactgtgcagcagtgggcttggcattaccacggatggtcgaggtaagtggagcccagcccctccaaacagcagccagcctgcccctaccagatgtggggagagctgtggtgggaggctgtaggagttggcccggggttcccgtaacaaagtgccccagaccagacggcttcaacaacagaagctgattctctcacactcctgcaggccagaggtcggagatcaaggtgcgggcagggctggttcccttggaggctttgagggagaatctgtcccggacctctctccagcttctggtggtggctccagcaatctttggcatttcttggctcatagaggcgtcaccccatctctgcctccatcttcacatggtgttctccctgtatgcgtgtctgtgtccaaaactccccccacccttttttagaggtgagatctcactctattgcccaggctcgagtgatgtggtgcaatcacggctcactgcaaactcgacctcttgggctcaagtgataccacctgagtagctgggactacaggcactcaccaccatgacctgctcatttgtttttcttccttttcttttcttttcttttcttttcttttcttttcttttcttttcctttcctttcctttcctttctttctttctttctttctttctttctttctttctttctttctttctttctttctttcattctttctttctttccttctctctctctctctctttctttctctttcttttctttctttctttcttttttttttgacagagtcttgctctgttacccaggctggagtgcagtggcgtgatcttggctcactgcaacctccacctcctgggttcaagcaattctcctgcctcagcctcccaaatagctgggattacaggcatgcagctccatgcccggctaatttttgtatttttttttttttagtagagatgagattttgccatgttgcccaggcttgtctcaaacttctagcctcaagtgatccacccaccttggcctcccaaagtgctgtgattacagacacgagctgccatgcccagccaatttttaaaacatttactttatggccagatgcggtggctcacgcctgtaattccagcactttgggaggctgagggaggtggatcacttgaggtcaggagttccacaccagcctggccaacatggtgaaaccccatctctactaaaaatagaaaaattagccagccgtggtggcaggcggctgtaatcccagctacttggggggctgagtcatgagaatcacttgaacgagggaggtggaggttgcagtgagccgagatcgcaccactgcactccagcctgtgcgacagagtgagaccctatctcaaaaaaaaaaaaattgctttttatagacatgggtctcgctatgttgcccaggctggtctcaaactcctgggctcaagcaatcctcccacctcagcctcccaaagtggtgggattataggtgacagccatcatatctggcctataattgcttttatttttatgacagtgccactgtatggatgtctgctccactatttccaaactggagataatttggcccctgccccaccgaggtcatttgacaatgtctggagtaatactggggcggtgggtgctactgacatctcatgggtggaggccacgggagctgctcgacatcctaaaatgcgtgggatggcccctcacagcaaaaaatgatctggccccaaatgtcagcagtgtccaggctgagaaacctcggtttagagcagaatgaggccgggtctgggctggagctatggccttggggaatctgacttctagagacccctggtgcgccgcgacacaccctcctcctgcctcggacacaccctccttctgctgctgctgacacaccctcctcctgccgcagacatcaacgagtgtgctctggatcctgaggtttgtgccaatggcgtgtgcgagaaccttcggggcagctaccgctgtgtctgcaacctgggttatgaggcaggtgcctcaggcaaggactgcacaggtgagcatgccacctggcgggcggatgtgtgggcagcctctcccactgcagacccctcacccctctctcccacccccaccccacagacgtggatgagtgtgccctcaacagcctcctgtgtgacaacgggtggtgccagaatagccctggcagctacagctgctcctgcccccccggcttccacttctggcaggacacggagatctgcaaaggtactgggtcccgggctcacgtgggtttgcacacacacatatgctccaacatacttggcatgtggcgtgtgcacgcacaggcatgcacacgctcaaagatgcttacatgttacctctattcacacacgcatgctatatgtagtgtgcacacacacatatatgcacacgctcagatactcacatgttgcatgaggtgtgtacacaagacacacatgcacacgctcagaaacatcctgtacacaaccacactcagacatgcacgttgcatgtgtcatgcatacatacacccagacacgctgcacatgccgtgtatacacagacacacattcagacatgctgtgtgcatgtgtacacagacatgcatactcaaagacacttgcatatgtacctacattcacacatacacactcaaagacacatatatactcacatttacatacacacgtattctttttttttttttttgagacagagtcttgctctatcacccaggctggagtgcagtggcacgatctcagctcactgcaacctctgcctcctagttcaagcgattctcctgcctcagcctcccaagtagctgggattacaggcgtccgtcaccaagcccagataatttttgtatttttagtagagacagggtttcaccatgttcgccaggctggtctcgaactcctgacctcaagtgatccacctgcttcagcctcccaaagtgctgggattataggcgcgagccactacacctggcccatacactcattctcacacttcccacacttgcagtcccagtcacacatggttgtacacactcaggggcacacagttatacacacatcccagaagtcctactcgaactacagagtttggagagcttctaggtggatggacatatctgtgtgctggcagggcggcatgccgagagcaggcacggaagttccacatctcctcccagataccctgcaccgtgcatctcttccatctggctgttcatcatttgtaatatcctttattttttttattttatctttttgagacagagtctcgctctgtcacccaggctggagtgcaatggggcgatctcggctcactgcaacctccacctcctgggttcaagcaattctcccgccgtttaagagattatcctgtctctgcctcccaagtagcccggactacaggcgtgtgccatcacgcccagctaatttgtatttttaatagagatggtgtttcatcgtgttggccaggctggtctcgaactcctgacctcagtgatccacccgcctctgcctcccaaagaggtgggatgacaggcgtaagccacagcgcccagcctgtgatatcctttataataaactagtaaacgtaagttaagtatttccctgagtcctgtgagcccctctagcggatgatcaagcccgaggagaaggcagaaattctggaggccccgatttgcaactggcatctggtgtggaagacagtcttgtgggactgagccctcaacctgtggagtcagactttaactccaggcagaaagcgtcagaattgaattatagggcaccctgctggtgtcggagaattgggcagcttggcaaaagcaaacaaacaaaaaaccccatgtctgatcactgatgtattctgtgttgtgttgaaggtgagagtaagaatacagttttggctgggtgcagtgactcacgcctataatcccagcactttgggaggctgaggcgggcggaccacctgaggttgggagtttgagaccagcctggccaacatcatgaaatcctgtctctactaaaaatacaaaaaaagttagccaggcatggtggcacatgcctgtagtcccagctacttgggaggctgaggcacgagaatcgcttgaacccgggagacggaggttgcagtgagccgggatggtgccactgcactccaacctgggtgacagagcgagactctgtctcaaaaaaaaaaaaaaaacaaaaaaaaaacagtttggcatttcctgtctcttacagcatgtacacacacagctcagcacacacatgtgcttgcatgcacatttgattccagtgccctctgcatgcttgtgcatctgggtgcaccccgtgccaccggttgcggcggccccttggggaggaggggtcctggccaggtaaggcaactcctcctgcagctcaggacctggtggggggctgtccccacagatgtcgacgaatgcctgtccagcccgtgtgtgagtggcgtctgtcggaacctggccggctcctacacctgcaaatgtggccctggcagccggctggacccctctggtaccttctgtctaggtgagcggccccggagcccgacggcgttccagaggctgggcgtctatgggtcagggtgcaggtgtagggccggcaggtgagacaggtgacccgcctcttctccccagacagcaccaagggcacctgctggctgaagatccaggagagccgctgtgaggtgaaccttcagggagccagcctgcggtctgagtgctgcgccaccctcggggcagcctgggggagcccctgcgaacgctgcgagatcggtagtatcctccttgaggcctcccaggcacccatgggaaaagccctccatggggcgggtccccccttgggctggcatgagaaaatgactcctctcttcactcttgttctcccagttgcagaccctgcctgtgcccggggctttgcccggatgacgggtgtcacctgcgatggtaactgcctgcccgtgtccagctcaccccctactccagagcccgcacacaaccaggcgcaccaccctcatgggtgccacctccggccccgccctggagtcttttgcgatggggacagacgttctccctacctggtccccaggccttcttgaaagtccccagtccccgtgtccccgtccccttccttcctcctcaaggacaacttgagaccccaggggaatggccagccagcacccttcccctccctggaccctccggctttccctcctccttacccagatgtgaacgagtgtgagtccttcccgggagtctgtcccaacgggcgttgcgtcaacactgctgggtctttccgctgtgagtgtccagagggcctgatgctggacgcctcaggccggctgtgcgtgggtgagtccaggcgaggtccgcatacagggccacacgttcttcctttgttccctccacccgcagtgacttgaggaacaggagagatttttttttttttttttgagatggagtctcgctctgtcgcccaggctggagtgcagtggcgcaatctcggctcactgtaacttccgcctcccgggttcaagcgattctcctgcctcagcctcctgagtagctgggattacaggcacataccaccacgcccagctaatttttgtatttttagtagagatggggtttcaccatgttggctaggatggtctcgaacttctgacctcaggtgatctgcccgcctcggcctcccaaagtgttgggattacaggcgtgagccaccacgcctggcctgaacaggagagatttcaggcatcctttgggatcctctgcctctggctaacatatcatgaaagacatttgggtgggtttttttttcttttttcttgagacagggtctcactctgtcacccaggcaggagtgcagtggcgcaatctcatctcactacaacttgcacttcctgggttcaactgatttttgtaccttgatctcctgagcagctgggactacaggtgtgcaccaccacacccgctaatttatttatttattggtatatctatatatatttttgtagggacagggtctcactctcttgcctaggctggtctcaaactcctggcctcaagggatccccctacctcagcatcccggagtgctggaagtccagccaggatttatctttgaggacagtattaggttcacagcaaatatgaacacatagcccccacctccacacacgtacagcctccccaactctcaacatcttgcactggggttagaaggtgcatttgttacgatggatgaaactgcacgggtacagcattgtcatctctaagtccatagagcaccttagggtttacccttggtgtattggacattctatgggtttggacgaacgtataatgacgtatgttcaccattgtagtgtcatacagggtagtttctctgccctaaaaatccttagtggccgggcatggtggctcacgcctgtaatgccagcactttgggaggccgaggcaggtggattgcttgaggttaggagttcaagaccagcctggtaaacatggtgaaaccccatctctactaaaatacaaaaattaggtgagcgtggtagcggtgtctgtaatcccagctactcgggaggctgaggcaggagaatcgcttgaacccgggaggcggaggttgcagtgagctgagattgtgccgctgcactacagcctgggggacagagcaagactccgtctaaaaaaaaaaaaaaaaattggccaggcacggtagctcacacctgtaatcccagcactttgggaggctgaggcgggcagatcacttgagttcgagatcagcctggccaacgtggtgaaaccgagtctctactaaaaaataacaaaagtcagccgggtgtggtggcacacacctgtaatcccagctcctcgggaggctgaggccggagaattgcttgaacctgggaggtggaggttatggtgagctgagattgtgccactgcactccagcctgagtgacagagcaagactatgtctcaaaagaaatcaatcaaccaatgaatcaatcacgtaaaaaaaatatggatagaggggcttagaacagtgctacagaacagtacacatagtaccctcccagacagtgcctggaggaagtcacccctttccactctggccctcgacctgactacgtccgggagaaagtttccgatgggagtgactgagcggcacgcctgtcccgcagtgggcacagtgtggcaggggtggggacgcagtgactgtcccccgtgcagatgtgagattggaaccatgtttcctgcgatgggatgaggatgagtgtggggtcaccctgcctggcaagtaccggatggacgtctgctgctgctccatcggggccgtgtggggagtcgagtgcgaggcctgcccggatcccgagtctctggagttcgccagcctgtgcccgcgggggctgggcttcgccagccgggacttcctgtctggccgaccattctataaaggtgcggttggggaaggggtcaggcccctggaaggatggggaggggcacggcataggcaaaagcctggagatgggaagtgtgtttgggggaaaaggggatgtgggtaaggcgaggcactaagaacccagggagggcttggtgtatggatcctgagcttggggacgtcagggtggtttgatgcccctgtacttcagatgtgaatgaatgcaaggtgttccctggcctctgcacgcacggtacctgcagaaacacggtgggcagcttccactgcgcctgtgcggggggcttcgccctggatgcccaggaacggaactgcacaggtaggtgccacctctgcctcttggagagagcgtgatccttggcagggataggggcctcaaataagacgtagagacaacacctgttctttttcttcttcttttttttttcgagacggagttttactcttgttatccaggctggagtgcaatggcacgatctcggctcactgcaacctccgcctcccaggttcaagcgactctcctgcctcagcctcctaagtagctgggattacaggcatgtgccaccatgcctggctaattttgtatttttcagtagtgatagtgtttctccgtgttggtcaggctggacttgaactcccgacctcaggtgatccgcccacctcggcctcccaaagtgctgggattacaggtgtgagccactgtgcctggcgaacacctgttctttgggcacttcttgtgtctgcctctgtgctgtgtgacctagggcaggtgattgccctccttgggctgcagggaccctgactataaaagaaggggctgggctgggcgcggtggctcacatttgtaatcccagcactttgggaggctgaggcgggcggatcacgatgtcaggagatcgagaccatcctggctaacacggtgaaaccctgtctctactaaaaatacaaaaattagcccagcgtggtggcaggcacctgtagtcccagctactcgggaggctgaggcaggagaatggcgtgaacccgggatgcagagcttgcagtgagctgagatcatgccactgcactccagcctgggcgacagagactccatctcaaaaaaaaaagggggcgctgggccaggtgcgatggatcacacctgtaatcccagcactttgggaggccaaggcagatggatcacttgaggtcaagagttcgagaccagcctggccaacatggcaataccccgtctctactaaagatacaaaaattagctgggcctggtggcgggcgcctgtaatcccagctactcgggaggccgaggcaggagaatcacttgaacccgggaggcggaggttgcagtaagccaagattgtgccattgcactccagcctgggtgacagaacgagactgtgtctcaaatataaataaataagtaaataaaacataaaagaaggggctggcaaaggtgacctttagaggcctccagggccagcatggtggctcacgcctgtgatcccagcacttttggaggccaaggtgggaggattgcttgagcccaagagtttgagactatcctgggtaacacagcgagacctccatctctgcaaaaaataaaaaaattattattgcattaactgtagtcccagctattcgagaggctgaggtagaaggatcccttgaggccctgggaggttgaggctgcagtgagctgtgatcacaccactgcactccagcctgagtgaaaaacaaacaggccaggctcagtggctcacacctataatcctagcactttgggaggccaaggcgggtggactgctttaggtcaggagtttgagaccagcctggccaacatggcgaaacaccatctctactaaaaatacaaaattagccgggcatggtggcacacacctgtaatcccagctactcgggaggctgaggcaggagaatcgcttgatcctgggaggcagaagttgcagtgagccgagattgcatcactgcactccatcctgggtgacagagcaagactctgtctctaaaaaagtaaataaataaataagtaataaaaataaaataaaataaaacaaacaaacaaatctaccatcaaaataaagaaaatggagaactcccgtctgtgagaaaactgcctgcccttgtcatgtttagtttggggttcctccatttcctcggctccttttgggggcttctgttctgcctgtcatatctacagattcgatgaccccatacggcaccccatcatgcctgcatcatgcctcccctcttggcctgtgcctccttatgtctgcagatgggcttcctctagcccacacctccatcaaaggacagggacccccctgcctcgtgccccatgatgcggcccacatggcgcctccggcctctgccccctctccccacagatatcgacgagtgtcgcatctctcctgacctctgcggccagggcacctgtgtcaacacgccgggcagctttgagtgcgagtgttttcccggctacgagagtggcttcatgctgatgaagaactgcatgggtcggtgactgccgggcaggggtgtggtgggcgccctgggcagggagggcattgaggagagggagggtggggacggctgttgctgtgtggacgtggatggagggggcaggaggagggaggagctgtaaattagctgaggtacagtgagtctgggctccatgaggcctcgtccttaggagagagacctggggcctgagacctgggggtggccggcacactggggtgtggtctcccagggagggtgtgtagcttgggtagaggacagggaccctcagagaagcctgggaaatactgccggttatgaggcctctcgtccccatcattgacttcgttattcatttgatgagcatttcacatgcatcctctgagctagaggcactgcagggagctctagctccagggagccctctttccttggagctcacagcctaacaggaagacagacatgaataacatgaatcgctgaggaaatgcaaaactgggctgggtgcagtggccctcgcctgtaatcccagcattttgagaggctgaggcagtaggattgcttgagtccaggagttcgaggccagcctgggcaacataacaagaccctgtcactataaagttttttaaaaattagctaggcatggtggcgcgtgctactcgggaggctgaggagggaggatcccttgagcccaggaggttgaggctgcagtgaaccataatcgcacttttgcactccagcctgggtgacagagtgagaccctgtctaaagaaaaaaggaaggaaggaaggaaggaagaggaaaaagccaggcatggtggctcatgcctgtaatcccagcactttgggaggctgaggtgggcagattgcctgagttcaggagtttgaaaccagcctgggcaacatggtgaaaccccgtctctattaaaatacaaaaaattagctgggtgtggtggcgtgcacctgtaggtccagctactcaggaggctgaggcaggagaattgcttgaacccaggaggtggaggttgcagtgagccgagatcgcgccactgcactccagcctgggcgacagagcgagattctgtctccaaattaaaaaaaaaaaaaaaagaaagaaagaaagaaaaagaaaagaaaagaaaaaaatgcaaaattgccactgtcagaagcccttaaaagggccacatgatctgatgagagatggctgagacaggattgcttgagaccaggagtttaagaccagcttggtcaacatagagaggccccgtctctacacaaaatttaaaaattagccgggcatggtggtgcctgcctgtagtcccagctactcaggaggctgaagtgggaggatagtttgaacacaggaggtggaggctgcagggagctgtgatcgtgtcactgcactccaggctgggtaacagtgtgaaaatctgtctcaaaaaaaaaaaaaaaaaaaaaaaaaggctgggctcggtggctcatacctgtaatcctggcaatttgggaggctgaggcaggtgaatcacttgaggtcaggattttgagaccagcctggccaacatggtgaaacgctgtctctactaaaaatacaaaaattagctgggcttggtgatgcatgcctgtaatcccagctacttgggaggctgaggcaggagaattgcatgaacccaggaggcggaggttgcagtgagccgagatcgtgtcactgcactccagcttgggcaacagagcgagactccatctcaaaaacaacaacaacaaaaggaaagaaagaaagaatggagtgggggtgaaaagggtgaagacactggagaacagcatgtgcaaaggccctggggtgggcctgagggatggaaggatgatgcctctgtggctgaagagtgatgaggccatggcgaggctgcctgctccctgccctgagtcctggcgggactgagcctcagctttctggcgtgtcctgcagggagtggaggaaggcctcttagtgccgtttctagtggccccaagagtgtcagcttcgtggcctttgttcttctgagaatctcagcctccctccccatctggctggtctctgctcctggtgcagaccccactcccctgggtcatcccaacccggagcctccaggctctcctggctcccgctggggtgaagggggctggggaggtggcggagagaagccagcatgagcctcatcaccccctccctgcatcagcaccttcatgcctgctctctctttccacacaaaccttcagacgtggacgagtgtgcaagggacccgctgctctgccggggaggcacttgcaccaacacggatgggagctacaagtgccagtgtccccctgggcatgagctgacggccaagggcactgcctgtgagggtaagtgtgcatctgggtgtgcaagtgtgagtgttagcccatgtgtgtgaaagtgagtggatgtctggtgaatgtgggctggatgagtgagagggtgggcatgtgtatctgtctttctgaggccatacctatgtgtgagcgtgcaagtgtgtgtgtgtatctgtgtgtgtaagtgggtttatatgcaagatggcgggagtgtgtttgtgtgtctagatgaacacgcacatgtgtgagtgtctgtacaagggcaagcgtttgtgcatttgtgtgactgtgtgtctgtacaagggggagtgtttgtatgtgaggagtgagtgtgtgtgtgcgtctgtgtgaacacacaagagggtttgagtgtgtatttggctatgaatgtctctaccaagggcaagtgtgtttgcatgtgcgtaggtgtgtttcattttgttttgtttgagacagggtcccagtctgttgtccaggctggggtgcagtggcacaatcacagctcactgcagcctccacctcctgggctcaggtgatcctcccatctcagcctcccaagtaggtgggactacaggcatgcgccactatgcctggctaatttctgagtgggtgtgtttgtacgtaagtctgtgtgtgtgtgtgtaagagaatgtgatgtgtagttggatgcaaatgcatgtttatagaggtgtgtttgtgtgtgagtgggtgtgagaatgtgtttgagtgggtctgtgtgggtgtacctctgggtgtgggtgtctgggtgtggacatgtgtttgcacaaggacaggtatgtttgagggtgtgtttatgtgtgtgtctgtgtgagtgtgcacatgggtgtgtgtgtatgtgtgagtgtgcattgggtgtttgtgtgtctgtgtgtgcacatgggtgtgagtgtgcccctgggtgtggatgtgtatttacacatgggtgagtgtatttgtgtgcaagtggatataaggtgtgttgtgaatttaggagtgtgcacttgagtgtgagtgtgtatctgagtgtgcctgtgtgtgtctgtcaagggtgagtgtgttcacacgtgagtgggtgccagggtgtgtttgtgagtctgtgtgagcgggcacgtggggtgtgtatatgggtgtctgtgcttataggagagtgagtgtatttgcatgtgagtgaatgcaagtgtacggataggcacatgcggggctgtgccaatgctggcagtgtgagctccttagcatgcatgtgtgcccccagtgtgtctcatggtcacacagacggcagatggggcacaggcccgtctttcacctgcactcccccacagacatcgatgagtgctccctgagtgatggcctgtgtccccatggccagtgtgtcaatgtcatcggtgccttccagtgctcctgccatgccggcttccagagcacacctgaccgccagggctgcgtgggtgagactgtgcccacctgctggcccctgggcaccaaccacagtcccagacatagtggtagctcctcctgtcctcacctcaactccactctgctcccacccccaaaccagccccctccccatcctggacccctccccccagccccagcccctgtctgccctgcatcctgcagacatcaacgaatgccgggtccagaatggtgggtgtgacgtgcactgtattaacactgagggcagctaccggtgcagctgtgggcagggctactcgctgatgcccgacggaagggcatgtgcaggtaggtgggcacaacttcttcccactgcctggtgtggagggtgaggaggaggtgttggctgggtcctgcactggcccagagcccagcacagcatagtgaagccagccagacccgaggcaccccctgcctggcctgtggtcctggccccaggcaggctgctcaccctgtgggagagcccctgggatttttgcagaggagggtgaataaggtggaaaagaacctcagaactgcttgagcgcccccagactactcgagtgaccatcgctatcctcacctggctacaggtcgtcctggggcctggggagcagatgtgtactgggtggtctatcagggcaaagctaagcacagtccccaaccctgctcccccagacgtggacgagtgtgaagagaacccccgcgtttgtgaccaaggccactgcaccaacatgccagggggtcaccgctgcctgtgctatgatggcttcatggccacgccagacatgaggacatgtgttggtgaggagccgggacggtggggcggggcgggtggaggaggcagtgtcagaattcacacaccaggtcttccacaaggtggcacataggcatgaaaaatgccaggccccacccctgccattcgcaggtaggaagatgaggctttgtaacagcacttgcttctccacataagggtccccagcaccccaagtctgctctccaaagcccatgagatcccatttatataacagaagcagaattccccaaaccttgctcttttaaatggcatttgtttaatatgacatacccaacatctatcagaggattgtgtcctgttcaagggctgtgctttaagatcactgaagacaaaggggtttctggcagaggacagtggacaaggcaggaaagagactcagaactctgttctctaaggtggcgactgctgtcctcacctggctacaggttgtcctagggcctggggagcagatgtgtactgcataccctatcaggacaaagctgaggccagagtgtggaagttccgggaagtaacaatgtaactcccggccaagaaaccgagtgaagcttaaagagcttagagagttgcagtttataggagtctcagagagcaagtgcttcagcgatgggccttgtgaacaaatgcatttagggaatgcagtctgctccatgcccctgttgcagacccactgtgcatattggcataaaggctctgaaaagtcctgcaggaggaaaccctggttagctttgtggatctcagccttctctaaatatatttgaccataaaatacttttggaaacacattcctggtgtgttccttggaatgtacactgtgaaacgctcacagaacattcccaattgcccagtagtggacatagagggagctccccgcccctggagaaaagaaagagagtcctagcagagaggacctgtgcggcgggacagtcaggaatgctggtgatctccctcccaccctcacctacttcctctcctgtcacccctgcacccagtcctcagacctcatgctctcttccccaacagatgtggatgagtgtgacctgaaccctcacatctgcctccatggggactgcgagaacacgaagggttcctttgtctgccactgtcagctgggctacatggtcaggaagggggccacaggctgctctggtgagccggcggtcagcggtgcaggcagaggggactccccggggccattttgggaatcatggggtctgtttccatcccccagggcagagcacagccagaattcattctcatagatttccacggatggcttcttgtgttaaagcaagaacagagtcctatacagtgccccggggggtcccctgaacagctcaggaagggaagccccaagtgtctgcagcagcatttctgaaacgtgaatccctcataatttgatgcaatacagggatgaacacttaaacatttgaatagtgactgtgttagttccctgtggctgccataacaaatgatcacacaattggtggcttagaaattgattctctgggccgggcgcggtggctcatgcctgtaatcccagcactttgggaggccgaggcgggcagatcacctgaggtcaggagttcgagaccagtctggtcaacatggtgaaacccatctctactaaaaatacaaaaattagccaggcatagtaatcccagctactcgggaggctggggcaggagaatcatttgaacccgggaggcagaggtggcagtgagccaagatagcaccactgcattctagcctgggcaacagagtgagaccccgtctcaaaagaaaataagtaaattcaggaggctgaggcaggagaatggcgtgaacccaggaggcgaagcttgcagtgagccgaggtcgagccactgcactccagcctgggtgacagagccagactccgtctcaaaaaaaaaaagaaaataagtaaaatgattctccgcctggtgcagtggctcacacttttgtaatcccagcactttgggaggccaaagcaggaggactgcttgagcccatgggttcgagaccagcctgggtgacatggatacatcacaacacggccatatggcaacattaatagagacagcaaccccatctatattaaaaattttaaaaattagcctgggcagggtagctcacacctgtaatcccagcactttgggggctgaggtgggtggattacctgaggtcaggagtttgagaccagcctggccaacatggtgaaaccccgtcactactaaaaatacaaaattagctgggcgtggtggcgcacgcctgtaatcccagctgcttgggaggctgaggcaggagcatcacttgaatccaggaggcggaggttgcagtgagccaagatcacaccactgcactccagcttgggccacagagcaagactccatctcaaaaaaacaaacttttttttaattaaaaagaaattgattctccttctagaataatagttctggaagccagaagtctgaaatcaaggtgtctacagggttagtaccttcttgggggctcagaggcagaaagtgttccatgcctccttgctgttcctcagcttgtagatgtgtcattccagtctctgtctccatcttcacacggccttcttctctctgtgtatctatttttttttatttttcatgttttacattttatttattatttatttatttttgtgagatagtgtctcactctgtctcccaggctggagtgcagtgacacaatcatagctcactgcagcctccacctctccaggctcaggtgatcttcccacctcagcctcccacacgtgccgccacactcagctaatttttttttttttttttgtagagatagtgttttactatgtcgcccgggttggtcttgaactcctggactcaagtaatcctcttgcctcggcctcccaatttgttgggattacaggcacgagtcactgcacccagtagtatctaatttgtaaagatgaggtctcgctgtgtcgcccaggctatagtgcagtggtgtgatcatagctcatgaactagttcatagccttaaactcctgggttcaagcaatcctcccagcctcagcctcctgagtatctgggactacaggtgcatgccaccaagctgggctaatttttaaaaaagtgtttgttgatcaggcatggtgactcatttctgtaatgccagcactttgggagattgaggtggaaggattcttgagctcaggtgtttgagataaaaattttaaaaaatagccaggcatgctggcgctcacctgtagtcttagctactcaagaggctgaggattgcttaagaccaggagatccaggctgcagtgagctatgattgcaccattgcactgcactccagcctgggtgacagagtgaaaccatgcctcagggggaaaaaaaagtgtttttgtagaaacaggttctcactatgttgcccaacctcgtctcaaactccttgcctcaagcgatcctcccaccttggcctcccaagtagttgggattacaggtgtaagccattgcatctggctacacagccttctcaaaagaacactcatcactggatgggagcctacactaatccgggatgacctcatcttaacttagttacatctacgaagaccctgtttccaaataaggtcacattcaccagtttcagggtttaggacttgagcataccttttaaggggacacaattctatccactccagttacatggttattttaatgtgtattagaaacaagtgttacataacagagcatcaagcctatgacttcttagaggttgttgatgttgatccaaaattgtcttttaaaacacaatttatgtcagggaaaacagaagtgtgggaaagaaatgtttagtaacagcagctcaccaaggtttaacatggcagagatcataagggtgaggcataattgactctggattggaaatgctggtggacagggaaatcctggcttggaaaaggggcgtgttcatacggacagtcacttttttatttttttatttatttatttttttgagacggagtctcactctgtcgcccaggctagagtgcagtggcacaacctctgctcactgcaagctccgcctctcgggttcacgccattctcctgcctcagcgtcctgagtagctgggactacaggcacctgccaccacgcctggctaattttttttttgtatttttagtagagacagggtttcaccgcattagccaggatggtctcgatctcctgacctcgtgatccacccgcctcggcctcccaaagtgctgggattacaggcgtgagccaccgcacccggctggacagtcactcttaatatctaccccaagtctttcatgctgctatttcaggccatttctgagggctgctgagagtcatgtctgttgggtttcggggttttcctcttgggctctgggtaaagatggaagctccccaggtgaatgggaggaggctttctgggccagctctcccctagagaggaagagtccctgccctttccgctgctattgcatcgagtctttccttctgtgactgggtcttggcgtcgtgcctcctctccctttagatgtggatgaatgcgaggttggaggacacaactgtgacagtcacgcctcctgtctcaacatcccggggagtttcagctgtaggtgcctgccaggctgggtgggggatggcttcgaatgtcacggtgagtacctgggggcagggagtgggggcaaagcagtagaggtaggtggggggcaaggcggtggggggcaaggcagtgggagggtgggatccgggagtgtctgcaggggggcagtcagggttggagggttgatgggtctttctcccttctgcgcccacccaatgcacacaccatggggtggggggtctgggctccatctcctgcagacctggatgaatgcgtctcccaggagcaccggtgcagcccaagaggtgactgtctcaatgtccctggctcctaccgctgcacctgccgccagggctttgccggggatggcttcttctgcgaaggtgagattagaggggtgggagggcaggggccctagagggacagccacgggggctgaattcacggtggctgccatggtcactcgacctcctgactccttctgactcaatcgccgctctgtgggtgctggagaggctgtgtcctcggcccaggcggtgctgcggcctgcccacggctcccttgaacacttaagtgcatgagacgcttccttcctggctgccctcctccctggatccagagagactgggtcccctctctggagtccaagagtccagaccacctctcccctccctgtccctgcctcggtcactcgcctcccacccccaagtcagggactgagtccccagggctacttgcctgggactctggctgacagcgaagtgttccagtgactggggcctcctgcccaccctgtgtgggtcctggtccaccggcctccagccctccgaatcttggggcccctcagacagggatgaatgtgccgagaacgtggacctctgtgacaacgggcagtgcctcaatgcgcccggcgggtaccgctgtgaatgtgagatgggctttgaccccaccgaggaccaccgggcctgccagggtaaggttgggcccgccagggcagaggacagagtgggtaggtcccccctgcagactctgggtggggcaggctgacccagggtccccgcagatgtggacgagtgtgcgcaagggaacctctgtgcatttgggagctgtgagaacctgcctggaatgttccgctgcatctgcaatggtggctacgaactggaccgagggggtggcaactgcacaggtgtgaggtcatctgggctggaaggggagaggagagagcaggagttggggcaggggacatggctcactccctcactgccctcagatctcttttcaagcatcctcccctgcagtcttgctggggggtggggggcgccttgcctgatgtccccatcatttcccgttcctgttcgcctgctaaataagttctgtgattgaagtggcccctccacgctagctgctgaaagggtctcctacctctgtgtgttttagaaatgggcaggtggtaaatatttttggctttgcaggccacacagtcagtctctgtcacaatgattcaactctgccattgtagctcaaaagcagccacaagcaatatgtaaatgaatgaatgtggcccctgtaccaataaaactttattgacacaaacaggtggtggaccggatttgacctacaggttggaatttgctaacccatggtttgaaagtattttctatatatgggttttggctgggagtggtggctcatgcccataatctcagcactttgggaggctgaggtgggaggatcactccaggccaggagttggagaccagcctgagcaacatagcgagacctcatctctaaaaagtaaaaataaaaaattagctgggcattgtggtgcacacctgtagtcccagctactccaaaggctgaggcagaaggatcgcttgagcccaggagtttgaggctgcagtgagccgtgattgtgcaactgcactccagcctggtcgacacagcaagaccctgtctctaaacatcaataaattacggaaataaaatagatatgattttcatatgttgactgcatggaacccagggcaggtagagttcaatgaacaaaactctgccaggcagaacagagcaggagagggaatggggttggaggggacaggacagactggaggctcctgtccccttaggtttcttcccagggaaggacatgacattgtcccacaatctggtgcccaggagttgaccttgagcgagggctgtagcttcccaggatgaagctaggagggaggggggccgaggaaggggctccctgctgaggaccgcgcttcctccctacagacatcaacgagtgtgcagacccagtaaactgcatcaacggcgtgtgcattaacacccccggcagctacctctgcagctgcccccaggattttgagctgaaccccagcggagtgggctgcgtgggtgagtccatgctcaactccagatcagggttctggggtcagcagaggtgggtgggattgccccactgggttaactcagatgtcaacgtgttcaaatctacctgctcctgacaaacgggacatctgctggtctcctgcaagagtggttgtccttgtcacctgttgaaatagacacatgcatgcacacgcacacatacagctttccctctgacacctactaaccatccccttctgcctgttcagacactcgggccgggaactgtttcctggagacgcatgaccgaggggacagtggcatttcctgcagtgccgagatcggagttggtgtcacccgagcttcctgctgttgctccctgggccgggcttggggcaatccctgtgagctgtgccctatggccaacaccagtgagtccctgcggggcagttgaacaccgtgacctaagccaccgaggcccgggagcttagggggtcacctctgctaatggcggtggtggggggcttaggcgacaggaaaaccaagaactgggggaggagaggggctcatcctgggtcacacagtgtacgtcttggtagttcattggctgggcctctctccaaggtcgctttctgtaaattctctgtgtttatagtcacttgatcactcagtcagtcaacaaatattgagagttcctctgtgtcatgtgctggggactggggactcagagaaggatgagccacagcctctgcacgctgcttctccctcacccttaaatcaacagtttcaggactgtgagagtagaactgtcctaagggttttctttgaggcatacccatagctcaggagaaagctgtggggaagtgaaagctctggggaaggctttccaggggaggaggcttgagtgaggttttgaaggatgtgtaggagttttcctagcagagtagggggaatgatgtgcaatgcagtgagaacagtatgtgcaaaggcctcaggtgtgaaacagggaggtacctgtccacctattcaggtgtatgcgtgtgtgaatgtccaaggtcttccttgcatggggaaaacttgcagttacactaggatatggttttggatcagaaggaataatcttctctccctcctacccccagccactaccacataactctgctcacatgttgaatgggaacccacatttacacacacacacgcatgcacacgcacatgcacacacacacgcaagcagccccaggactggccaaagtctcttggccccaagaggctaaagagatatggggatgtcgttagtacagtagaaggatgggagcccactcttgagcccttttcaggcttcctgctgttgctcccctgtttcccctaagctttgccccaataccccacctcacaggagcctgtttccctttacagctgagtacagaaccctgtgcccgggtggtgagggcttccagcctaaccgcatcactgtcattctggaaggtgagttcctggcagatcatccatccatctgtctgcctagagactgacttttctctcatccccacctcaccaaagtgtagagttgagtagttttgtcctgggatggggcagatctttccacctggaggctgagcagcaggaccacactatgcttttagtttgtgtttaattttttttatctgttctttcagccatttcttccacttgttggtttattgatcttttcatttgtcccccatccttccattcatcctccatccttctgtccatttatccttccatccacccatccttccatccattcatccatccttctacccatccatccagccattcatccatctatccatccatccatccatccttccattttttccatccatccagtacatccatacatccttccatccagccatcctccatccattcttccttccatacttccatacttccattcaaccatcctccatctacccattcatccatcctccactcatccctctcttatccttttatccatccatctagtcaaccattcattccccatccttcatctatcccccatctttctgtccattcatccctccatccatccatccatccatccatccttccacccgaccatccatccattcatccatccttccactcatccttccatccattcatccatccatccatccatccatccatccttccactcgaccatccatccattcatctatccttccactcatcctttcatccattcatccttccacccatccaaccattctccatctacccattcatccatccccccacttattcccctcctatccttctatccatccattcacccatttatcccccatccttcatctatcctccatcctttcatccatcccccctccttctgtccatttatccttccatccacccatccttccatccatccatccttccacccaaccatcccccatctacccattcatctatccttccttccatccaactatcctttatctacccattcatccatccttccattcatccatccttccatccatccctccatccttccatccaaccatgccccatccacccattcatccattcatcactcatccctctgctatccttgtatccatccattcacccatccatccaccccccatccttcatctagcccgcattcacccatccattaacctatttcccactctcccatccatccatctcccacccacctatctctcattcttctatccatctattcacccatccatctatcccccattcacccatccatcctcaatacatccatccatccactcatccatccacccatttcccatccacccgttccctactccctttctattcccccattcatccacccttccatccatcttctatctcccatctattcatccattcatccatccatccatccatccacttatccacccattcactcatttgcctgtctactcacctatccatccaccttcctatccatccactcactcatcatcttattcattgacccacttgcttatttacccatccactgtttcatatccatgcatccatccactcatccatccattcatccatcctcccatccatcctttctatagggagtgacaaggttggagaagactattctccatctagaggaagaaaactatctatttctctatctagaggaaactatgtggtggatgggagaatggactaacagatgaagggaatggagttgaatttagggtaacattaactcaagagaatctgtgtccagccatcaagatagaccctttaaatgtctatcagtcatggacagcacttggggatcctcgagagggccctggagaacccagagcatggtgtgggtgccccttaagtcctctgcatgggtttagctcccaagcttggcttccttacttcctgacagacatcgacgagtgccaagagctgccagggctgtgtcaggggggtgactgcgtcaacacgtttggcagtttccagtgtgagtgcccacctggctaccacctcagtgagcacacccgcatctgtgagggtgagcatggattctctttggggtgggtcaggctcttccgctctctccctgccttcctgccctgccaagcctcacaagggtagaggagggaaggcctcatggaaaggcttctgccccctgcctcctcttttgtcatgatctgtcagttctctcttgctgcctttaagatgttcatggctgctgtggatctgtggtgtgggggatggtagatagaccctttaaaatgccacgacactcccttatgaagtacagcagcttccttcttcaccatatctttgtctggatgttgtaagcttttgactgattccagagttctgcaaaagtttatttttgtctgttttgccagctcaatagttgcttttgtggaggaatggagccctggagttccctgctctgctatttttggtgacatcactcttaccatgctaatattccactacctatttttgcctgctagctaagaatactttattacacttttctcaacggttgaaaaaaccaaaagaagaataacattttgtgacacatgaaaattatatgaaattcaaggctgggtgcgtggcagctcaagctggtaatcccagtactttgggaggctgaagtgggaggattgcttgaggccaggagtttaagacccacctgggcaacatggcaaaaccttgtctctacaaaaaattaaaaaaatagctgggcatggtgactcacgcctgtaatcccagctacttgggaggctgaggcaggaggatcacttgagcctcggaagtcgaggctgcagtgagccgtgattgtgccactgtactccagcctgggtgacagaacgagaccctgtcttaaaaaaaaaaaaaagaaaaaaaagactgggcacagtggctcatgcttgtaatcccagctctttgggaggccgaggtgggcagatcacgaggtcaggagttcgagaccagcctggccaacatagtgaaaccccatctctactaaaaatacaaaaattagccgggcatagtgacacatgcctatagtcccagctactcgggaggctgaggcaggagaatcacttgaacctgggaggcggaggttgcagtgagccaagatgaggccactgcactctagcctgggcaacagagtgagactctgtctcaaaaaaaataaaagaaagaaagagagagaaagagagagaaagaaagagaagaaagaaagaaagagaagaaggaagaaagaagaaaagaaaagaaagttatataaaattcaaatttcaggggtccataaataaaatttccttggagcacagccagtgccacagtgtgtttgcatattgtttgtgtctgctttcttgctacattggcagattgaataatcatggcacactgtagtttggcccgcaaaaccaaaatgttctggccctttacagaaaaagcttactacccctggactagagtaatgaccagattgagaatcaatttttttcccccaagaatactttatccataaggtccttgattcctatcatatcatattaggaagacatggatgatcctttcttggtgattataaaactgactcatgaactcaggtcattttgttcctaatagaagcagtatcatcatcaactttatttttaggaatttttttttttttttttagagccagtgtctcactctgttgtccaggctggagtgcagtggtgtaatcacagcttgctgtagtcttgacctcctggactcaggtgatcctcccacctctgcctctcaagtagctgggaccacaggcgtgtgccaccatgcccagctaaattttcattttttgtagagatgggacctcactatgttgcccaggctggtctcaaactcttgacctcaaatgatcctcctgccttggcctcccaaagcagggatgataggcatgagccactgcatccagcttgtaaatgttttttttttttttttttcacttaatgtcatattgtttttgttcgtttgtttgttttttagagccaggatctcattctgcacccaggctggagtgcagaggcgtgatcacggctcactgcaaccttaacctcctggactcaagtgatcctcccaagtggctgggactgcaggcatgcaccaccatgcccagctaattttttaaaatttttagtagagatggggtcttgctatgttgcccagactggtctcgaactccgggctcaaatgatcctcccacctcagcatcacaaagtgctcagattacaggcatgagccaccatgcccagcccatattatagctttcttcatcactaagatgtgtgtgcgttttaaactgattttgaaaccaaacttaggtccctggtgaagtggccttgctgggtctctggagtggagttattcagacaattcctggacgctgcccactgttcccctccaccccttctttccctgcagatattgacgaatgctccacacactccggcatctgtggccctggcacctgctacaacaccctggggaactacacctgtgtctgccctgcagagtacctccaagtcaatggtggcaacaactgcatgggtaagaagcgtgatgacctagggaactggcagtcacagaagcagcacctgggcatgggaggaactgctgggagccttcaagcctatggagagggagggtaagcatatatgaagtgctgacatgtggcagtaaacaaagctgcaggactcaggagcccagagctgccatgaacagttgctcaggttgtgcactgctcaaaaaaggctgaaaaaagtgaatggatcccccaagtgtgttgggggagagacatcaagccaatcaagccagccagtaatctttttttttttttttttttgagatagagtctcactctgtcacccaggctggagtgcagtggcacaatctcggctcactgcaacctccacctcccaggttcaagcgattctcctgcctcagcctcccaagtagctgggattacaggcgtgtgccaccacacctagctaatttttgtatttttagtagagacagggtttcaccatgttggccaggctggtctcaaactcctgacctcaagtgatccgcccgcctccgcctcccaaagtgctgggattacaggcatgagccactgtgcctggacaagccagtaatcttcaaatgaatcagttaaggagttcctatctctttggctccctcttccactgatttaggtgacccttacccacattcttctcctttgtgccaactacagatatgaggaagagtgtctgcttccggcactataacggcacatgtcaaaatgagctggccttcaacgtgacccggaaaatgtgttgctgctcctacaacattggccaggcctggaatagaccctgtgaggcctgccccactcccatcagtcgtgagtaaccctccccaaccttcttcccagcctggcccctcctagcataatggttaaggaaacacagtgcccttagggttcttagattaatcctccttgttctgatgagagccagagagttgaagttttgtccctctattagtccattctcatactgctgtgaagaaatactggatactgggtaatttataaagaaaaagaggtttggctgggtgtggtggctcacacctataatcccagcattttgggaggccgaggcgggtggatcacttgaggtcaggcattcgaaaacagcctggccaacacagtgaaaccctgtctctactaaaaataccaaaaaaattagctgggtgtggtggcgcaggcccgtaatcccagctacttgggaggctgaggcaagagaatcgcttgaacccgggaagtggggtttccagtgagccgcgatcatgccactgcgctccagcctgggtgacagagcaagactccatctcaaaaaaaaaataaaaaaataaaaaaaaaggaggactttaatggactcgcagttccacataactgggaaggcctcacaatcatggcagaaggtgaaggaggagcaaaagcacgtcttacatggtggcaggcaagagagcgcgtgcaggggaactgccctttataaaactgtcagatctcacgagatttattcactatcacgagaatagcatgggaaagacccacccccatgactcagttacctcccaccgggtccctcccgtgacatgtggggatatgggagctacagttcaagttgaggtttaggtggggacacagccaaactgtgtcagtccccatgtatggaaggcaatattttaaagtgagcaaggcagcttttcttccattttgcagatttcgagaattcaggatggatcaatggagttttcattggtgggaaaggcccttgaagattcacaggagtagctggggctgggataaagtgggagggggtcggtaaatgtcccaggccagggaggaaagcaccgctggttagagataccatagacctcctgggctgggatagggtgggagggggtcggtaaatgtcccaggccagggaggaaagcacagctggttagagataccatagacctcctgggctggggaaggggcagacctggagaagctcagagccaagattgggaccctgatgggaacatcggtcaggatgagggaaggcgttctaggcaggggcacagcaggagccaaggcctggaggcaggactgaacagagtgtgttgacagcaggaatgagtcctgttggaatgatctagcagccagcccaggcaccaggaggagctgcaggaatgggacagtgatgggaaggggacttctaggggcttatagctgtattcattccccagagctgctgcaaaacattactgcaaactaggtggctttaaaaaccagacgtcgtggctcacgcctgtaatcccagctacttgggaggctaaggtgggagggtcacctgaacctgggaggttaaggctgcagtgagccgtgattgcaccagtgcactccagcctgggtgacagaacgagactttgtctcaaaaaaattaaattaaataagtggaaggagggaaagggtggggagagcaaaaaaagttcaaggtggccaggtgagggctgggctccagggatgaggtgtcccctccagattgggagcgggctggggtcaggcctgcagccccagactcagctttgttcccctttgcgcagctgactaccagatcctgtgtggaaatcaggccccgggattcctcactgacatccacacggggaagccccttggtgagtgagtggtccctgctctatccctgggcacccatccacctgggtctgcttcctcccacccctcccctcctcaacagctcttttccttacatccactcctccatcctcccctcctcctcgctccacacacctccaactccccaggaatcctgccctcaataacacttctttttaaaaaaagaatgacactatttttattaaaccattatccattttttaaaatgatagtaaaatatatgcaacataaaatttaccattcgagccatgcacagtggctcatgcctgtcatcccagcactttgggaggccgaggtgggtggatcacctgaggtcaggagtttgagaccagcctagccaacatggtgaaaccgtgtctctactaaaaatacaaaaattagctgggcatggtggtgcatgcctgtaatcccagctactcgggaggctgaggcatgagaattgcttgaacccaggaggcaaaggttgcagtgagccgatatctcgccattgcactccagcctgagggatagagtaagacttttttttttttgtctccgagaaagtatcatttgaaccatttttagtgtgcagttcagtggcattaagtacactttcactgttttgcaactatcaccatccggaactttctcatctcctcccactgaaactctgtccccatgaaactctcactccccatccccctcagtccctggaacccaccattctactttctgactctgtgaatctgacggttctagggacctcctgtgagtggaaccacgtaggatttgttgttttgtgtcaggcttatttcactgaacatgatgtcctcaaggtgcatccgtgttgcagtttgtgtcaaattgctccatgccctttttttttttttttgagatggagtttctctcttgttgcccaggctggagtgcaatggcactatctcaacttactgcaacctctgcctcctgggttcaagcgattctcctgcctcagcctcccgagtagctgagattataggcacctgccaccatgcctggctaatttttgtattttaatagaggcagggtttcaccatgttggtcaggctggtctcgaactcctgatctcaggtgatccacccacctcagcctcccaaagtgctgggattacaggtgtgagccactgagcctggccagaatactccctttttaacaacgtattgcataatttaacacctgcatcccaaatgtcaactatgcagtgtttaactgatgaattcattttcatttgttttaatcctctgaatatattctccttattttttaaaaaaatcaaaccatggcggccgggcgtggtggctcacacctgtaatcccagcactttgggaggccgaggcaggcggatcacgaggtcaggagatcgagaccatcctggctaacaaggtgaaaccccgtctctactaaaaatacaaaaaattagccgggcgtggtggcgggcgcctgtagtcccagctactcgggaggctgaggcaggagaatggcgtgaacccaggagatggagcttgcagtgagccgagatcgtgccactgtactctagcctgggcgacagagcaagactccgttgcaaaaaaaaaaaaaaaaaaaaaatcaaaccatgacaaataaaacccacttctcctccagtcatcacctcaactctgtctcttttctccctctctggacgttcttatgctttatggctggaatatttctttctagttttttcttccttcattacataataggtcccccactgaaaatatatgacattggtttctggggcattttacgtaaatgatgtaatgcttgacatgttggttacaacttgcttttttcgtccaaattgtgtcttgaagaaccggccaggttactatctgctgtgcagcctctctctttgccctgcctaaaagtgtttcatggtgcagatacatcccaggtcccccagtgatgggaacttaggtaatttccagtcccccactgatggacacttaggttgtttcagatctccttttgatggacacttggattgtttccagtcccctattgatagataggtggattgtttccagtcccctttggatggacacttatattgtttataacagttttattgagagataattcacataccacacacttcacccatttaaagtgccctgtttagtggttttgaatacattcacagagttatgcaaccatcacctcagtataagtttagaactcattttcatcacacaaaaagaacattttcatcacagtcccccattgatggacacttagtatgtttccagtcccccactgatggatatttaggttgtttccagtcccccactgatggacacttagtttgttcccagtcccccactgatggacacttagtttgtttccagtcccccactgatggacacttagtttgtttccagtcccccactgatggacacttagtttgtttccagtcccccactgatgcctgtttaggttgtttcccgtcccctattgatgggcacttaggttatttccagtcccccattgattgacacttaggttgtttcctgtcccccattgattgacacttagtttgtttccagtcccctactgatggacacttatattgttttcagtcccccattgatggacacttaggttctttcaagtccccttttgatggacacttaggttgtttccagtcccctactgatggacatttagattgtttatatataacagctttattgagatataattcacataccacacacttcacccatttaaagtgccctctttagtggttttgagtacattcacagtgttacacaaccatcgcctcaatctaagtttaaaacattttcatcacacaaaagtaaaccctgtgcctattagcagtctctccctttagcccctcccttctgcccctggcaaccacaaatcgactttctgtctctattgatttgctacttctggacatttcctttaaatggagtcatgcaatattgttctttcatgtctggcttctcttagcagaatgattttaggtttcaaccacattgtcacatgttacagggctttactccttaataaggctgaagaatattccatggtacagacatcccatattttgctctgcattcatcagttgatgtttccagtttcttgctaaatagcatctcataccgctgtcctgcttacgcttaaggccatttctttccagcagggttgctgggtcacaggaagtgtgtatttttaattgagaaaaacacacacagtctctctgctcttgtctttcctcccactcctcacctctttctggtgtgagcggatgtattttggtcacagcaagattttcttgagtgtgtgctggtttgtggccacaacagcctcaaccagattgcagggctagtgggtcccttcgctcagcatcgctggaagtcccagggggctgggctgcccctgatggcagatgccttctgcagacattgatgagtgtggggagatccccgccatctgtgccaatggcatctgcataaaccagatcgggagtttccgctgcgagtgccccgcaggcttcaactacaacagcatcctgctggcttgtgaaggtgccacctctccctgttcccagccctggggcctgggtgggatgcatgtccgccactgtgcaatctgggcgagtaactaaaactctgtaagcctccatttccctgtatgtataatgggctaacacctttccaagggcctccatctcatataaccacccttactccagctctggctgcttccagagaaaccacctgctccgaagcagtggactgggtttcacgtttgattctgtcaggatgggcttctctgtcacccccacctcatttgctgtattttcccagatgtcgatgagtgtggcagcagggagagtccctgccagcagaatgctgactgcatcaacatccccggtagctaccgctgcaagtgcacccgagggtacaaactgtcgccaggcggggcttgtgtgggtgagcagggtccctgggaggaggtgagggagctgggctctgtcacccatggggacttagatggggtatggctctgtccaggtctttctccttttctatactattaggggggtgggggatgtattgagagtgtctgttaataggatgtgatagaggtgagagctcaggtccatgcagacagcctgacgcccctggtggaagtttgagtggggaacttcaaggcagattctggcttccccattgcagtagggagagctcaggcaaacactgtggtaggagccctgggaacaccatgctctctgcacccccaggacggaatgagtgtcgggagatcccgaatgtctgtagccatggtgactgcatggacacagaaggcagctacatgtgtctgtgtcaccgtggattccaggcctctgcagaccagaccctgtgcatgggtgagacccttatcttccccctccttttcaagccaggctgcctggggtctaaacctcccctgggatggaagtggtgtttctgtccatcctagttcacaaagagatccaagtttgggtcctgagattaagatcttgggtaaatggttgatctgcctccctgtgcctcagttttcccatctgtaaaatgggggtgatatatcataccaggagtacttcccagccatcaccgccaggggtcactgcccagtcatctaggcagggctaggtgcaggggaggagtgctaggtccagctggcctctcactccccaagttccccaatgccctgggtgagctgggttgggctctcggctttgcttctgcagacattgacgagtgtgaccggcagccttgtggaaatgggacctgcaagaacatcattggctcctacaactgcctctgcttccctggctttgtggtgacacacaatggggattgtgtgggtgagtcggctcaggtggcaggctggccacaaagtgggttctcagaatctaaggaagtgaatctagaaattggccacagaaagatgcccagaaagtccccgattatttagaaattaaataacatactcctaaataatccataggtcaaataaatcataaggaaaattagaaaatattttgaagtaaaagaaaatgaaaatgaaagcataacatatgaaaatacataggatgcagctaagggggcacttagaggcaaattcatagcattacatggttatattagaaaatatcagcaactacctcataagataggtagaaggctaatatacatagtctatacatgagtgctcaagttgaagccaatgctgtcagctcaactcagttgtggacagaagtacaaggaaggtttgatcccttcaagttttgtgggtgaactggcctgcccatctcccctctacagattttgatgagtgtactaccctggtggggcaggtgtgccgatttggccattgcctcaacacagctggttccttccactgcctctgccaggatggctttgagctcacagctgatgggaagaactgtgtgggtgagtctgcctatggtgctcggaggcatctcagccagcccctgctccatgtacaccacagtttggtacttctgggtgagcatagatccatttactacccaagcatttattttaagatttaaaaaaaaaaatacccagcactttgggaggctgaggcagaaggattgcttgaggccaggagtttgagactagcctgggcaacatagtgagtcctcgtctctacaaagaaatttaaattagccaggagtggtggctattgcctgtagtcctagctactcaggaggctggggcaggagaatcacttgagcccaggagtttgaggatgcagtgagctatgatcacaccaccgcatccagcctgggcaacagggaaagatcctatctcaaaataaataaataaataaaataattataaaatcagcacatcaaacctatgtttctatgtatggggtttgttgtgtagggtgaggctgtcttgaaaatgtaactttccagaagcaaagaatagtagaagcgctaaatagataccatggaaggaatctgctggtggtgccagattaggaatcttgctacctctttccactggacaccatctgccccacctataaccccacgagagtcagataatccttccccagctgtccctgtcgtcctgagtctcagcccttgccctggagccagaattgccactgggagggcttgtcctggggccctcagtgatcacacagtgattgcaggtgttggtcccagtcccaagtgagccccctgcatcctggctggcacaaggacctttcttcctccttttcacagacaccaatgagtgcctcagccttgcaggaacctgcctacccggcacttgccagaacctcgagggctccttccgctgcatctgtccccctggcttccaggtgcagagtgaccactgcattggtgagtgtccagccccactcccgtttctggcgccagggagtgcctctctttctccatccataaaatgggaataccagctagggttgtgatgaaggtggagatgtacttaacgcagcgtcaaacacagcttcataaactattattgtcattctgattgtttctggactctgcactcaggactttgtctctagtgcccacaggcttcctcatgaatcctataaattgacatgggtgtggggtctcaccgtttctcagtgcacccaaatgtagagctcctcacttgctaactggagatcaaggaccagtctggcctaagcttcaccggtgtaatcacccatagagatgatttcatgcagtctggactaacaagtctggcctaatctcctttggtccatttatccacttggactagcctcagagagtgtgggctaacctggaccagcctgggctgagcagatgggctgctttgttcactgtggtctaacctggaccagtctggcttgagcagatgggctagcctgggctaacctgaaccagtctggcctgaatacctctgatccaggcttccatctgggctagccttgtataacctgagctaacgtggaccagtctggcctgggctcttctgatctatcctttttttgttgttgttttgttttgtttgtttgtttgttttttgtttgttttgttttgagaggagtctcactctcagctcactgcaaccgccacctcccgggttcaagagattctcctgcctcagcctcctgagtagctgggattacagtcactcatcaccatgcctggctaattgtttattttttttgagacggagtctcactctatcccccaggctggagtgcagtggcacaatctcggctcactgcaagctccgcctcccaggttcacgccattctcctgcctcaacctcccaaatagctgggactacaggcgcccgccaccatgcccggctatttttttgtatttttagtagagacggggtttcaccatgttagccaggatgctctcgatctcctgacctcgtgatctgcccgccttggcctcccaaagtgctgggattacaggcatgagccattgcgccaggcccaatttttgtatttttagtagaaacggggtttcaccatgatggccaggctggtgtcaaactcctgacctcaagcgatcctcccacctcagcctaccaaagtgctgggattgcaggcatgagtcaccatgcccggcctattctgatctattctatttgggctagcttagtacaacatgagttaaccctgtccggtgtagggtaaatatatccagtctcagttagctttgtgcaattttctttttttaaggtttaaattttttttttctattttttcttattttaatttcaatagttatgggggaacaggtggtttttggttacatggataagttcttcagtggtgatttctgagattttggtgcacctgtcacctaagtagtatacactgtacccagtatgtagtcttttatccctcacccccctcccatccttccctgggggtccccaaagtcctttatatcattattatgcctttgcatcctcatagattagctcccacttataagtgagaacatacgatatttggttttccattcctgagttacttcacttagaataacggcctccagccccatccaagttgctgcaaaggacattattttgttccttttttttttttttttttttttttttggtggagtctcactctgtcacccagactggagtggcacagtctcagctcactgcaatatccacctcccgggttcaagcgattctcctgcctcaccctcctggtagctgggattacaggtgcgccccgccacaatgcccagctaatttctgtattttcagtagagacagggtttcaccatgttggccaagctggtctccagctcctgatctcaagtgatccaccagccttggcctcccaaagtgctgggattacaggtgtgagccactgtgcctatttcgttccattttgtggctgagtagtattccatggtgtattatataccacattttctttatctactcgttggctgatgggcatttataaatatgatggctccagatttttgcgattgtgaattgtgttgctataaacatgcatgtgcgtgtgtctttttcatataatgacttactttcctttgggtagatacccagtagtaggattgctggattgaatggtagttctacttttagttttttggttttttttttttgagacagagtctcgctctgtcacccaggctcaagtgcagtggtatgagctcagctcactgcaagctctgcctcccgggttcatgccattctcctacctcagcctccagaatagctgggactacaggcgcccaccaccacacccggctaatttttttgtattgttagtagatggtttcaccatgttagccaggatagtctcaatctcctgacctggtgatccacccgcctccacctcccaaagtgctgggattacaggcatgagccaccgcgcccggccttacttttagttctttaaggaatcgccacactgttttccatagaggttgtactatgtgcagtttcagtctccaatcatgaactattcctgaccatgacctttactctggagatgccttccgggaaggacctacgtgcacacacaatgcccacctcgtgctgaagctcatactgagctctcaggaccccagccccactgcagcccctggctggacctgcactccatctgtcccttctcacagctgagtcctctccccactgatggaggtcctacttgccccccacccagctcatgtccctgcccttccagatatcgacgagtgctcagaggagcccaacctctgcctctttggcacctgtaccaacagccctgggagcttccagtgcctctgcccacctggctttgtcctctctgacaatgggcaccgttgctttggtaagtccacacagggcttagggaagagggtgggaagtggggcggggaagggtcagattgcccagaaaagagggctgtggtttcttgtgtgaccctttgggagctctgaccaggcagaggtgtctgtttgcattagcagagttatcctagtgccagcaacctcttggctatagaggtcatgtctatggagggctaacctggtccattctgagctaggtgtgtgcttatttaggttttccttgtattggtcacatgactgtaggctgtcaatgggctggttttgtccagtttgagctagcctagactactctgggctggctccgtttcagctgggctagccttgtctactgtgggctaacctcacccagcttgagccagcctgttctctcacaggtcaggggcaataagggtgagagcagagcatgcagttcacctcagcgaatatttgctgttctgggaggctgggaccccagcctgctggtgaggacttgataggtgtccagagccaaggattgggggtttggatcctcgggctttctggaatcagtcgttttgcctctccaggaaggggtttttgatccaagagtaaccaccaagtttgatctttcttcctggcatgagaacaccccaaagcaatgaagtggggtgggattccagctgtcccctcaaaaccccagggcaggccaggggcggtggctcatgactgtaataccagcactttgggaggctgaggcaggctgatcacctgaggtcaggagtttgagaccagcctagccaatgtggtgaaaccccgtctctactaaaaatacaaaaattagccgggtgtggtggcacatgcctgtaatcccagctacttgggaggctgaggcaggagaatcactcgaacctgggaggtagaggttgcagtgagctgagatcgtgccactgcactccagcctggtcaacagaggaagactccatctgaaaaaaaaaaaaaaccaccaccaccaccaacaacaacaactaaaaacccagggcagatcctcattggcccagagtaggtcacatgtccatactcaaaccaatcaccatgaccaggggcatggcatgttctgattggccactggcaggatcagcacaacccattcaccaggactggggtgcgggaggtcacaggggcaggtgggcactgccagcggctttcaatcagggtaatggagcccccaccccacagacacacggcagagtttctgcttcacccgttttgaggctgggaagtgctcggtgcccaaagctttcaacaccaccaagacccgctgctgctgcagtaagaggcctggggagggctggggagacccctgcgaactgtgtccccaggagggcagcggtgagtgcccacccctgtccaggctccctggatgatgtgccctcaccttcctctctcattcttctctcatccttccctgcacacacctgggggctgcacctaggccctgactctgactcccctccccctctccgtccagctgcctttcaggagctctgcccctttggccacggggcagtcccaggcccggatgactcccgagaaggtgagcccctcacccacatgctaagagccccttctgggccacccagatccatctccgcactgcctgggtctctgagtttcaggctccccctgagagcctgggtggccctggaccctgccagcctggggcttgggcttttgtccccttggggccttgagtgtggccagggctctggcgattgtgtggtgacagaagccatgtctgcaacgcctgccatccgcagacgtgaatgagtgtgcagagaaccctggcgtctgcactaacggcgtctgtgtcaacaccgatggatccttccgctgtgagtgtccctttggctacagcctggacttcactggcatcaactgtgtgggtgagtggccagcccttccccagctctgtcccaggcccctcccaggacaggaaggagcagagcagggcagggaagacacccccaggcagtgggtgagatcctgtccttaaccactgcctctctcccccattcactttttctccctctgtgcttcattcactcattaattcacttgctcactcattttcttgctcattcattcactcactcacttattcatttactcattcacttattcatttactgactcattcattcacttgctcactcacttactcattttctcattcattcactcattcactcactcatttactcccttattcattcacttaccaattcactcactcattcactccttggctcactcattccttcacttgttcattcattcacttattaattcactaactccctcattcattcacacgtcattcattcacttgctcattcactcacttattcatttactcacttattcatttactcacttattcactcattcactcatttgccccctcactcattcacttgctaattctctcactcattcactcctttgctcactcattccttcgcttgttcattcattcacttgttcattcaatcactccctcattcattcacacctcatttattcactggctcattcattcactcactcattcatttactcattcactcattcactcgtttgctccctcattcattcacttgcttgtttgttcactcattcatttgttccttcatttgtctccttgctcattcacccattcaatcactcatttattcatttactcactcattcctttgctcattcattcatgctttcactcacttattcagtcactcattcgtttcctcatttgccctcttgttcattcattcacttccttgctgatttctccattcactcactcagtaattcacccactcattcacccctttactcactcattcccttattcatttaaccattcattcacttactcatttatatgttttttagagatgaagtcttgctatgttacccaggctcttttggaactcctgggctcaaatgaccctcctgcctcagtttcagttactggtttaatcactccttcattcactggctcattcattcacttcttgctcattcactcactcccttgctcactcatgcattcctttacctgcccacttgctcacacattcactcattcattcactaaacacataccgcttgcctgccccatagccagactagaggtgcattcgatctggccccctccgatctgtggtggtcaacaggcaggcagatgggatgctactgaggatgggggaccctctgcaggtgctgaccacccccttactcccacccagacacagacgagtgctctgtcggccacccctgtgggcaagggacatgcaccaatgtcatcggaggcttcgaatgtgcctgtgctgacggctttgagcctggcctcatgatgacctgcgagggtacaactctgcttgcccaggacctgggccgtgtgacggagatgcctgggggagggagtggaggtcccgccctcagtccctacccagctggcacctccactggcctccccagacatcgacgaatgctccctgaacccgctgctctgtgccttccgctgccacaataccgagggctcctacctgtgcacctgtccagccggctacaccctgcgggaggatggggccatgtgtcgaggtaggcctgactaatatggtaaaaccctgtctctactaaaaatacaaaattagctgggcatggtggcacacgcctgtaatcccagctacttgggaggctgagagacaggagaatcgcttgaacctgggaggcggaggttgcagtgagccgagatcatgccactgcactccagcctgggcgacaagagcaaaactccgcctcaaaaaaaaaaaaaaaaaaaaaaaaatcctgcaatgcacacagaacagccgcccaccgcaaagaactttcctatcccaaatgttcatagtgtcaagcgtgggagaccctggtctgggactcagtgtctctggggctgtttcagggtcagtgttccaggggccatgagcagactcacagaccctgacatgggcaggggatgcaagctttgggggacaattcctgattccctcagcttcttggaggctggggctgggcaggagctgggggctcccttcctaagagggatagacatttgacagggtctgcagggaactcactcaggtcccacagggctgacgcagggtggaatccaggtccccacagccatagggtgcctggccttgactgaccatctgtctctggtcatccgaagatgtggacgagtgtgcagatggtcagcaggactgccacgcccggggcatggagtgcaagaacctcatcggtaccttcgcgtgcgtctgtcccccaggcatgcggcccctgcctggctctggggagggctgcacaggtatggggcactggagcttcatgggtgcaggaaactccttgtggaagggagaggtcaaagcaagagggttggaccgggcacggtgactcatacctgtcatcccagcactttgggaggctgaggcgagaggatcgcttgagcccaggaatttgaggcttcaatgaatgggagggacaggcagtggggggggacaggcagtgggagggacaggtagtggaggtgacaggcagtgggaggacagtgccgctgcactccagcctggacgacagagtgagaccccatctccaaaaacaataaaaatgaaaataaggctgggcacggtgcctcacgcctgtaatcctagcactttgggagaccaaggcggttggatcatctgaggttaggagtttgagaacagggtggacaacacggcgaaaccccgtctctactaaaaatacaaaaaaaaaaaaaaaaatagctgggcgtggcggcgggcacctgtaatcccagctacttgggaagctgaggcagaagaatttcttgaacccgggaggtggacgttgtagtgacccaagatcaggcaattgcactccagcctgggaaacggagcgagactctgtctcaaaaaataataataataataataataaaaataaataaaataaaaataagcaagagggcctgggcagatccaaaggggccctttggggctgtgggagaggctggctgcctgtggcctccccgcccacctgcctcacccctcccatctcagatgacaatgaatgccacgctcagcctgacctctgtgtcaacggccgctgtgtcaacaccgcgggcagcttccggtgcgactgtgatgagggattccagcccagccccacccttaccgagtgccacggtgagtgtggctggacacgcacagtggttgcaaccacctaccatgtggcacccactgcctgtccccccccactgcctgttccccccactgcctgcccccttcactccctgtccctcccactgcctgttccctccactgcctgttccccccactgcctgtccctcccactgcctgtccctcccactgcctgtccccccactgcctgtccctcccactgcctgtccctcccactgtctgggagccctccaaggcagggacggggcctgcggcactgacgggcaacccagggggttgctgagctaatccggacacacatgtccagtgctcccctgctgcccctcttccctctgtcccttctgttaaatactggaagagcgggacgctccctccatgcctcctccaacttactggcgccacaccccggaaccaaccttccccagatctcccacttctggggagctaaccccagccggtgacccactagggccatctgtcctgtgtatccaactccctcctggacacccctgtccccaacacccccaaaatacagcttgccccaaagcaagctcagtctttgcccccaaaccagcctcctggagtgaccgttgtctttcccattgttctctgcagacatccggcaggggccctgctttgccgaggtgctgcagaccatgtgccggtctctgtccagcagcagtgaggctgtcaccagggccgagtgctgctgtgggggtggccggggctgggggccccgctgcgagctctgtcccctgcccggcacctctgcctacaggaagctgtgcccccatggctcaggctacactgctgagggccgaggtgggtgcccatgccctcaggacccccagggaggcaagaaacgggggagtttgctcagggtcatgtgtctgtactgcagcaggtgctggaatgtgtgagccacactgtgtgtgtgtgtgtgtgtgtgtgtgtgtgtgtgtgtctttgtgctagcagatatgagaaccagtacgtgtgcaccatatgcatggaagaactcggggggttgagggagcagttgtgtgagccaatgtgtgtgtatgtgttctgagacagagtctcactttgacacccaggctggagtgcagtggtgcaatctcagctcactgcaacctctgcctcccagtagcatacctgtcatcccagcactttgggaggctgaagaaggaggattgcttaagcccaggaatttgaggctgcaatgagctaagatagtgccactgcactccagcctgggtgatagagcaagacctcgtctccaaaagcaataaaaataggccgggcacagtggctcacacttgtaatcccagcactttgggaggctgaggcggccggatcacctgaggtcaggagtttgagaccaccctggtcaacatggtgaaacctcatctctactaaaaatacaaaaaattagctggatttggtggcgtgtgtctgtaatcccagttactcgggaggctgaggcaggagaatcccttgaatccgggaggcagagcttgcagtgagacgagatcacgccattgcactccagcctgggcaacagagagaaactctgtcccaaaaaaataaataaataaaaataaaaagcaagagggccttaacagacccaaaggatctctttggggccgtgggagaggctggctctcccatggccagtaaagatgaggttttgccatgctggccaggctggtctcgaactcctggcctcaagtgatccgcccacctcagcctcccaaaatgctgggattacaggcatgagccaccgcgcccggcccagtgtgtgttctttgtgagtgagagctcgttccggactgcgtgggagctggtgtgtgtctgtgtgtgtcagctgggtgagaagtatacaccatgttcatctgtgaagtagaaggcagtgagagggagccagcggcctgtgtgttgtggacttgggtgagtgtacaagggcaggtatgtgagtgtctgcgtgtgagcgagcataaggacatcagtgcgtctcactgagtgtgtcactgatagtgagatgggttatccatgtgaccagcagtggcatcaacaggactggggagggccgcggtggctcacgcctgtaatcccagcactttgggaggctgaggcgggcagatcacgaggtcaggagattgagaccatcctggctgacacggtgaaaccctgtctctattaaaaatacaaaaaattagccgggcgtggtggcaggtgcctgtagtcccagctacttgggaggctgaggcaggagaatggcgtgaacccgggaggcggagcttgcagtgagcagagatcgtgtcactgcactccagcctgggcgacagagcgagactctgtctcaaaaaaaaaaaaaaagaaaaaatagtaggactggggaggaaatggctttttgggggtgtggctggggggagactcgggagtccctgagtgttggcgtgtgttcccgtgtttctgcaggagcatctaggtgtgtggctagtgtatcatgttgcatgcactgtgtgtctctgttctgcatgttggtgcactgaggaggtgtcgctgttgaggctggggaggggtgggtgtgagtccccttccctggaagcttcatgggcgtgtcctgcgggctcaggtgtcatccgcagcctgaggatggggtccacgtgggctggggtgcagtggccggtgtggaagggaggctggactttcctccgaggagacggctgctgggcagagagaaggagacattcctcggtggaggcgcgaagcagccagccagccccatttgcaccctactttttcccagatgtagatgaatgccgtatgcttgctcacctgtgtgctcatggggagtgcatcaacagccttggctccttccgctgccactgtcaggccgggtacacaccggatgctactgctactacctgcctgggtgagcccagccctctgcacctgcacccttggcccagcctggccaccttctgtgcagcccctgaactcaacttccctgagactttccactttgcaatgttaggctttcatttacaaagtggtgcccaaaccatacagacaactgagggccaggtgtgatggctcgctactgtaatcccagtattttgggaggtcgaggtgggaggatcacttgagaccaggagttccatagcaacatagcaagaccccatcgctaaaaaaaattagccaggatggtggcctgtagtcccacatgcgcctgtagccccagctacttgggaggctgcttgagctcaggagtctgaggctgcagtgagctgattgtgccactgcagtccagcctgggtgacagagtgagaccctgtctcttaaaaaatgaaaaacaaaagaaaagaaagaaagaaaaaaaaaaacaggccaggcatagtagctcatgcttgtaatcccagcactttgggaggccaaggtgggcacatcatttgaagccaggatttcaagaccagcctggccaagatggtgaaaccccatctctgctaaaaatacgaaaattagctgcacgtgctggtgcatgcctataatcccagctacgcgggaggctgaggcaggagaatcgtttgaacccaggaagtggaggttgtagtgagctgagatcatgccactgcagtttagtctggacaacagagtgagactctgtcaagaaagaaagagagaaagaaagggaaggaaggaaggaaggaaggaaggaaggaagggaagggaaggaaggaagagagagagagagaaagaaacaaagagaaaggggagaaagagaaaaaagagaagaaagaagagaaagaaagaaaaaagaaagagagagagacaaaaagaaagagaaagaaacagaaagaaagaaagagaaagggagaaagagagaaagggagaggaaggaagggaaggaaggccaagtgaggtggctcacgcctgtaatcccagcacactttgggaggctgaggcagaaggatcacttgaggccaggagtttgagaccagcctggccaacatcatgaaaccgtctctactaaaaaaaagaaaaaaagaaaaaaaattagccaggtgttatgtgcctgtaatcccagctgcttgggaggctgaggcaggagaattgtttgaacctgggaggcggagggtgcagtgagctgagattgcgccatcgcattccagcctgggtgatgaaacgagactccgtctcaagaaagaaagagagaaacaaggaagggagggagggagggagggaggatcctttcgttctcccacccccaccctgtttgggccactttcctgctgttatttcttccttttattttgcacatcctgatatttttcagttgtgttttgtagcaagcgtacatctaagtcagcgggaagaaaactctagcccgagggtcaagtctggccctccatttgttcttgtcaataaagttttattagcacacagccatgcacatttgtctgcttaccctcaatggctgctttgctagtacaaaggccacatggagtagttgtatctgagatggtgtggcctgcaaaaccaaatgtatttcccacctggctttttgcagaaagaagtgttcattcctgtgtaagtccacagatttcagatggtcggggtctggtggagacctcagtccctgaacacccccagggaatgtctgtctaaccccgccccactacccacgctgtccttccccagatatggatgagtgcagccaggtccccaagccatgtaccttcctctgcaaaaacacgaagggcagtttcctgtgcagctgtccccgaggctacctgctggaggaggatggcaggacctgcaaaggtgatgtcctttcaactctcccccactcccaccactgcatgcagtctagggccccaaagggatgcccaagacatgtcccctgcaatctcaccccctcccatctgcatggagtcaagcaccatctccgaggtctttctcttgtcacccctctgcctggaggtggcaagggcagcccctgggaagcccctaatcccccactgggccctgccctgagcctgctggaccatccgtgctgcagacctggacgaatgcacctcccggcagcacaactgtcagttcctctgtgtcaacactgtgggcgccttcacctgccgctgtccgcccggcttcacccagcaccaccaggcctgcttcggtgagtgacccttgcccctcaccgggaggtgacccatgaccccagcattagttattttgctcaccaaaaaaatatcaagttggccaggcgcaatggctcacgcctgtaatcccagcactttggaaagctgaagcgggtggatcatctgaggtcaggagttcaagaccagcctggccaacatggtgaaaacccgtctctactaaaaatacaaaaaaattagcctggcatggtggcaggtgcctgtaatcccagcaactccgagaagctgaggcaggagaatcgcttgaactcgggaggcagaggttgcagtgagctgagatcatgccactgcactccagcctgggcaacaagagcgaaactctgtctcaaaaaaaatagtatcaagcacccggtgtgtattggacattggggacatgggggtgatcagaacaaagtcgttacttccttagtgctcgcttcctggaggcatctagaacctccttcctctcctttgggaggagagaggccctctcgccttggcttatggcatcttgccttccccctgacaagtccctgctggatctccctcccagagcctccccagagcgctcctgaaatcccaggtctcacatagtcccaggaggaaatcagttcaacagctaaagccacaagggcatctgctaccatcattgtttcttagtgtctcgtggcccccagggaacacaatcttccccaaaggcagagcctagtcaagggtggcccctttcacgcgcccactaatctgcccagacagcacctactgtgtaccaggcagtgctctagaccaaagggtggcaaactccaggctgccagccaagcccggccccctgcttgcttttgttaataaagtttgattgacacacagccaagcccgcttgcttacaatcacctgtggctgcttttgcactatattggcagagaagagtcttgggacagagcctgttacagaaacagaaatggtttgtcgggccctgttatagaccctgggggtacagcaacaaacataaaaggcagggatcttccatcatggaactttccttctagcacagaatcaagactagaggcagacataacaagaaattaacagaatggtgtggttgggtgtggtagctcatgcctgtaatcccatcactttgggaggctgaggctggcagatcacttgaggccaggaattcgagaccagcctggccaacatgacaaaaccccgtttctactaaaaatacaaaaattagccgggtgtggtggtggcgcctgtaatcccaactacttgggaggctgaggcaagagaatcacttgaacctgggaggtggagattgcagtgagccgagatcgtgccagtgcactcagacacagcaagactctgtctcgaaaacaaacaaacaaacaaacaaacaattaacagaatagtgtgttcaaaggtgatgtgtgtcatgaaagaaagaaaaagtaaaagcaggagttcaggaaagaaggagagggccacagggttgttttggagggtagggagaggtttggtggtggttgtttttggttatgttgtctgtctgtttgtttgtttgtttgttttagagatggagtcttgctccatcacccaggctggaatacagcaatgtgatcgcagctcactgaaacttcaaattcctgggctcaagcaattctcccacttcagcttccctagtacttgggactacaggctcaccacatctgggttttttgttttgttttttgtttcttagagatggagtctcttaatgactctgttgcccgggctggagtacagtggctattcacaaatgtgatcacagcacactgaagcctcaaactcctggtgtcaagtgatcctcccacctcagcctcctgagagggcttcagttttaagagagggatcaggtcaagtatcaccaaaagagaacatttggctgggcactgtggctcatgcctgtaatcccagcactttgggaggatggcttagggccaggagttcgagaccagcccaggcaacatggcaagactccatctctacaaaaaatacaaaattagctagaggtggtgacacctgcctgtagtcttagctacttaggaggctgaggtgggaggatctcttgaacccaggaggttgaggctgcagtgagcagtgttcataccactgcagtccagcctaggggacagagcaagactcaaaaaaaaaaaaaagagagagagagagaacatttgaacaaagactcttgaaacaagaggcatttctgtttctctgcaacattaaagtctgtggccaggcataatggctcacacctgtaatcccagcattttgggaggctgaggcaggaggattgcttcagctcaggagtttgagaccagcctgggcaacacagtgagaccccatctctattaaaaaaaaaaaaagtaaggttttcactggatgtgtgagcagctgcatggaccagggccgtgcatcacatgggtaacatccgtggagcaaggtcacacgtgactgcttctctcactagaaatgagtttaaattctcagccaggcagatggtggtgtgaggctcaacttgatcaaaagtcacaaactttttctgcaaagggctcaagaggagtaaatattttcagctttgtagttgagatggtctctgtcgccacgattggactctaccatgctagcatcaaagcagctggagagatacgtaaatgaaagaccgtgtctgtgtcccaataaactttattgatacaacagacagtggcttggattttgtctcagggtgttcctgtctgctaatgactaaactgttaatagaagagcaaactcacatggccacagtaggccagcctgacacttggtttgctttgctagatgtaagggaaagaaattgtgggtggtggcagacatttctgtttttaatttttgagatggagtcttgctctgtcgcccaggctggagattgcagtggtgcaatctcagctcactgcaatctcacctcccaggttcaagcgatcctcctgcctcagcttcccaagtagctaggactacaggtgtgtgccaccacgcccggctaatttttgtattttttgtagagacggggttttgccatgttgcccgggctggtcttaaactcctgggctcaagcaatctgcccatctcggccttccaaagtgctgggattgcaggccacggtgcctggctgtgccagacatttcttctggccagagtctagagctattctctgtggcccctcaagtgacagctcaggcagccgcaggggccactcctacttagaagcttcatgttcccatgtctgttgttcccaagagatattcactttttgtttgctcgtttttgttttttgagacagagtctcactctgtcgcccaggctggagcgcaggggcgtgatcgtggctcactgcatcctctgcctcctgggttcaaacgattctcccacctcagcctcccaagtagctgggattacaggcatgcagcaccacatccagctaatttttgtatttttagtagagatggggtttcactatgctggtcaggctggtctcaaactcccatgctcaggtgatctgcccgcctcggcctcccaaagtgctgggattacaggcataagccactgtgcccgaccccaagagagactctacatctccatagatatgtgcttagtgtcaagaatctctgtactcaaggaagctaaaagcaggattttccaccaggaatttgttgttcattcctcaaaatcccagttcaaatgcagtataccagccatgggctcccaccattgtagcaatgctctctggccattgtaccaatgccctcctaccatcgtagcaacctggccattttagccagctcaggctgccataacaaaataccatagactgcaagtgtgggatttagcaaattcaaatccaaaaactgggccgggcgcagtggtttgcacctgtaatcccagcactttgggaggctgagttgggaggatctcttgtgcccaggagtttgcgaccagcctgggcaacatagtggacaacgtagtccccactaaaaatacaaaaattagccaggcatggtcttgtgcacctgtagtcccagctacccaggaggctgaggtaggaggctcacctgagcccaggaggcggaggttgcagtgagctgagactgtgccacttcactccagcccaggggacagaatgagatcctatctaaaaaaaccaaaattaacagttggttaaatgaagcagagcaaatccacaccaagtgaagatgtggtggccatttaaaattatgcaaataagaatagtaagaaaaatatatatatatgtgtatgtatacatatatttttaagatggaatctcactctgtcagtcacccagactggagtgcagtggaacaatcttggctcatcgcaacctccgcctcccgggttcaagcgattcttctgcctcagcctcccgagtagctgggactacaggcgtgtaccaccacacctggctaaattgttttgtatttttagtagagatggggcttcaccatgttggtcaggctgatctcgaactcctgacttcaggtgatccggaggctccctaggcctcccaaagcactgggattacaggcatgagccactgtacccagcccccaagaatagtaagaatatttaaagacatagaaagatgatcacagactattcagtttaaaacaatagcttacacacacacacacacacacacacacacacacgcacacggacaacccatacactggttggcttaaactacagagatttatttttttttccattctggaagctgggcagttcaagatcaaggtggcagcacggctggttctgtgagggctctcttcttggtttgcagacagccacctttttgctgtgtcctcacttggcagagacagagcaagctttctggtgtctcttataagggcactattctcatcataaaagccctaccctcatgaccttatctaaccctgatcacctcccaaagacctaatatccaaataccagcccactgggggttagggcttcaacataggattttggagagacacgaacattcaatccatggcaccggctgacctcacactattgtcaggtttccatgggaacaaaactcaacaggcaaccctatgtcatttttccatgggagaaggaaaagaggctttgtttatcttttactcttttaccgggcactgccctaagccttttacatgattaggttaatttaattctcgcatgcacacaaaaatgcaatgaggtagacattatcatctccatatacagctgaggacatcgaggcacagagagggtaggtaagttgcccaaggacacacagcttcgaggcggtggagatgagattctttatgtgcaggatctcaaacattggtgcctattctgagtcaggaactgttacagatctcatttcacagagtgggaaacaggcacagagagggtgagcaacttgcctgaagccacacagtggtgggactggcattgtgtcacctgacacgagttccttaaccagcaggcaaccctgcctgatctctctcctctgcagacaatgatgagtgctcagcccagcctggcccatgtggtgcccacgggcactgccacaacaccccgggcagcttccgctgtgaatgccaccaaggcttcaccctggtcagctcaggccatggctgtgaaggtacagcccagctttggctggggtctagtgtttgggggtgttggtcctgagagccgtctggtaaaccctctctccctctctctatgtctcagatgtgaatgaatgtgatgggccccaccgctgccagcatggctgtcagaaccagctagggggctaccgctgcagctgcccccagggtttcacccagcactcccagtgggcccagtgtgtgggtgagtgaaaagggctgggaagaagctgggccctccaccagaatctgctcagagcaggcgactaacagacgccaccctgcaagatgatgtgacaagcacaattatctaaagattgaacaggccagcccagaaggtagtgagttccccactgctggggagtcaaggtgcagcagaataagcatcaaaaagtgtctgagttcattccttagggcatggtggcctggaggactcagttgagaaagattctgagacctgaagtctgcaattttgtgatcacagggaaagagtgctgtgattgattagtgatgtctgccacgagtgtgattagtgatgtctgctatggatgctgcaaggggcaatggaggtgtgcatgctatgtcattgccatagctgttgcagaggccctccatttggggggctagccttctgccccccaaccttcccccatcttctggctgctctaggacctcctagcagcctctttcactgctcttttcattcctccactgcagtgcagctttcaccctctaccattttcaggcccacttgctctctcctgagacctctcctcggcctccatcctctacctccactgctctgggcaccacagtctgccccttcaggctcctggacactctctcctgtggcctttgtgatgtggctatccctgctctcccactgcctcacaggcactgccttctctgccccctccttttgtctgtcatggtgggtctttagctaagttcttcttgggcttcccacaccacacgaccccaccccccaggcaagctgcttgtcccctggggatcttggggatcccacagaccattggcctttgctggcaactcttcctcaacttgtttcctccccccgtactgactcattcattctttccccaactgtttgccaaggacctgcctttcactaggccctgagctcagatgcagaagtgagctgaaaaaccatttctgccttgagtttttcagtccagcaaaggaaacagagattaattagacccctaactaggttctcaacagaggaccattttacccccatagtacattttgaagtgtctgcgagacatttttgatcatcacaattgggatccgccatggtagttcactcttgtgggatattgaggtagggggatcatttgaggccaggagttcaagaccagcctaggcaacatagcaagaccccccatctctacaaaaagttaaaagattagccaggcatgttggtgcacacctgtagtcccagctactcaggaggctgaggcaggaggatcccttgagcccaggacgtcaaggctgcagtgcactatggttgcaccactgcactccagcctgggcaacagagtgagactcccaactccaaacagacaattggaggcggataggttttcctggtgtcaagcgggtggaagccagggatgctgttcaatgtcccacagtgcaaggaggcctcctccctagagaatgatctggccccaagtgtcaatagcactgagggtgagaaagcttgttctagatcatcccacattttggggtttaggggaagtgttgagagatgttgtgaaggagaaccacagggtttggggcagcggggctatggggccgatctagtctcagggctcactgccagcttgctgaagagtttggcattggacttgggctctgaacatacagcattccaggtggagggctctgggggtgtgaaggctgcactgccccacctctgcgtcctccctctcctcctcctttcctcccacagatgagaatgagtgtgccctgtcgccccccacctgcgggagcgcctcctgtcgcaacactcttggtggcttccgctgcgtctgcccctctggctttgactttgatcaggccctcgggggctgccaggaggtggatgagtgcgccggacggcgtggcccctgtagctacagctgtgccaacacgcctggtggcttcctgtgcggctgtcctcaaggctacttccgggctgggcaagggtgagaggctggagtggggcaagcagactccatgccccgcaagcgtccatgcacgcacgcacacacacacacacacacacacacacacacacacacggggctttgtgcatgccaagaatttaccagaagagctccttcagcctgtgcatgcaggcatttgcccacatatgcacagagtcctggacacgcagaggtacagtggcacctgtatctattcacacacatcctcacagcactcacatgtagttgtccacatggcacacacccgtaccagcatgcgtgggcacccttgtgcatttacagatcccagcatgcacacgtgtgtgtgtgtgtgtgtgtgtgcacgcgcgcatgtcccagtgtgcactcaggctcatgcatgcccacatccctgggggcacagtgccattgctacatcctggtttgcacaggtgaggaagcacgcgtcagccatctgtgagtgctcacactatacacacatccccaggcacactcagggagattcacacattcctacgagcacacatgtgcctgcatgagttattccccatgtgaacacacaggttggcacacgcacatgcccctgggtatgctcatgtccattcatccatcccagcctgtgcacgtcctctcactcctgtgttcacacctatgcccaaatgaaccaagggacacacatgcacacccttatgtggtgcacacacactcgtgcacacggagccacaccagcacatgctcagaggcatttgtgtgcgtgggcatttgcagcatgactcagaacggagtatggggtggagcggcgtggctggggaggtcccatcagcccgcctctgaaacccctccaccctgcccatcctggcccaggcactgtgtctccggcctgggcttcagccccggaccccaggacaccccggacaaagaggagctgctctcgtctgaagcctgctacgaatgcaagatcaatggcctctcccctcgggaccggccacgacgcagtgcccacagggaccaccaggtgacatgggtgctgcactaggcaggggtggccagggaatgggtgagtgtgggaaagaggctgtggacccgacttagtcatgtcagcccccccaagaaggagcaccaggctccagatcccaacaggttccccatgtcatggtgccggcttagggccttcttgtgctttctcagccctgggatttttcttggggggggtctctgggggacacatctcccggacactctgcctcactcctggtgacaagtcaggcgtcttccatacagaccctggccgggctgtgatgctttctatgggtcccttttataaaggcacttggatgcagggaaatacctgggcccctccaaccctgcctgcaccctggaatctgtcaccccctcacctcctggttggtgaaggcctcccttgggaccttttgggatttagttccaatggggccctaagtggcctttgtaccacagctctgcccatctcaactcttctgtgcatccctctgggctgttctcacaaacccttaggccaagttaagcccaagccccttccctgtctgagccttggggaggtgagtcttttctctggggaccccagcagaggctccccttaggagccccagggccccaacctgacatacccactcagcatctgccctgtacccctcttgtgcctgaggtgctcctggagttcctgaacctgccttgtctctaggaatctcagggatcttcaacacaccactcagtagccgtagggcaggcctatggctccatccctccttccctctcgggccaccccatcaaggtgtgcagagagggcatttttgccacagatgccagctgcttgcccctcaactgaagagtccctgactatgggtcagtcctgcagccatcacccaagggatctgaaagccaaaaatgtattaaacacctgctgtatgcaggtatcactccaagtgctctctgttcacagcctctcaatgtttatgacaaccctgggaggtgtagatgccactattttttttttttttttttgagacagagtctcactcttgttgcccaggctggaatgcaatggcgtgatctcggctgaccgcaatctctgcctcttgggttcaggcgattctcctgcctcagccgcccgagtagctgggattacaggcgtgcaccaccacgcccagctaattctgtatttttagtagagacggggtttcttcatgttggtcaggctggtcttgaactcctgacctcaggtgatccacccggctcggcctcccaaagtgctgggattacaggcatgaagcactgcacccagcctagatgccactattatccctattttacagatggaggaactgaggctctgagaggttagggcacatgcccaagttacagaacttgaacgtggtggttcagagattccatggatatggcacgtggacttctctttacaagcagccttggcatccatggccagccatcctgggcccctctgtcttccgaagccatcactttacattgtttcccaaacaattatcactgagcatggaaaccattaccccaaactcacccccactgcagacatttaggtcgaagcttcttcactccacagattttactgaataccactgctgggcactgtaatggagcaacagtgaacaacaacaacaacaaaaacacctgccctcgtgaggctgatattctaaaagggagacacacaagaaatcaacatgtaaaacatatcatcttttataacacatgacaaatatgatacatgataagtgctatggggaaaaacaaagtgagacatgggatagggttattgggcttgagaggctttctatattagataaaatgtgagtgtattactttgtattactgaaaggccctttttcccctctagttattttttcccccttgctaggaaaaactgtggatgtatatattatcccatagttactgatattttctgtaaacttcataagggtagagctgtgtctgtaggatttactactgtattggtaccccttggtactcaataagagtgagtgagtggttgtcagggtcccagggcagaagtagatcaagacagagaagggctaatttttgtatttttagtagagatggggtttcgccatgttggccaggctggtctcaaactcctggcctcaagtgatcagcccacctcagactcccagagtgctgggattacaggtgtgtgccactgtgcccagtcaaggccaggattttgagaccagcccgggtaacatagtgagaccccctccacctacaaaaagtaaaaatattagccagctgtggtgccatgtgcctgtagtcccagctacttgggaggctgaggcgggaggattgcttgaacccaggagttcaaagcggcagagagctgtgatcacacctctgcactccagcctgggtgacagacagaccctgtctcaaaaatagggctgtattgtgcctttgcctgcaatacccactgactgccagcaggggtcagtaagagcataagtcttaacaacattccgtgggaagaaggcctgagatctccagaactgaggggctggggaacaggaataactttcacttgaatgcaacagcaaaacactccgtcggcatgtaaatgaggccaaaccaacacagtgctccctaaaacaaaggcaaagaaaacacagatgactttctgtggggttggatacgtcacccagccctggggtagcctgccattgaggctcgctgtcttattcagggccctgtccagctgccaagaccaggaaggcacttcagaggagcttaaataaagaagggtttgtcattggcacacaaggggctctcaaagagggccagatgcaggaagcacagcggaagctatcaggcggctcttctgtctggtcctttacgctctcctctccagccctgcttggcatcccgtttctctcactgtcagctctggcattcttttaggggctggcttctgctgaaaggcccttgttcctaacaccagccatcccaagacatttctgagtgaccttagggctctgggtcgcaatgtcatctgaataatcccctggctgctgggtctctgagagcaaatctttgatacctttggcccaggctggcaggggtctgagcaaggtccctcagctgggactaggggtctgtagtgtgtaacagtggccgtttccctgcctctctcagaagcagcctcagccttatgccactgagtctacagatccagctgaccttgcggatgaacaaccagacttgagatgccaagggaagcagtattttcctccactttatttttttattgatttattatttatttatttatttatttatttgagacaaggtctcactctgtcacccaggctggaatgcagtggcgcaatcatagctcactgcagccttgaactcctgggctcaagcaatcctcccgcctcaatcccccaagtagctgagaccacaggtacatgtaccaccacacctgcccagctaatttttgtattttttgtagagacggggttcaccatgttgcccaggctggtctcaaactcctgggctcaagtgatccacccacttcagcttcccaaagtgctgggagtacaggcatgagccaccgtgcccaccctatttattgattttttttttttttgagacggagtcttgctctgtcgcccaggctggagtgcagcagcgtgatctccactcactgcaagctccgcctcctgggttcatgccattctcctggctcagcctctggagtagctgggactacaggcacctgacactacgcctagctaatttttttttttgtatttttagtagagatggggtttcaccttgttagccaggatggtctcaatctcctgacctcgtgatccacctgcctgagcctcccaaagtgctgggattacaggtgtgagccactgcgcccagcctatttattgatttttaaaatcaatttattttcttttttttggggagcagggtctcactctgtcacccaggctagaatgcagcagtgcaatcatagctcactgcagcttgaactcccaggctcaagggatcctcccacctcagcctccctagtagctgggactacaggtgtgcaacaccacacctggttaatttcttgtatttttagtagagacagagtttcaccaggttactcaggctggtctcgaactcctgggctcaagcaatctgtccaccttggccctcagccaacttcatgtcttttcgtagcacatcttgtcacttttacattttccatttatttgtctactatctgctttgctttactagaaggtaaactccctgaggggaaggatttttatctgctcattgctaaatccccagtgcctcaaagattgccaggaattcagtaggtgcctaataaacatatatatatttttgagacagggtctcagtctgttacccaggctggagtgcagaggtgtgatcacagctcactgctgcttcgaactcctgggacctcccacatcagcctcctaagtagctgggactacaggtgcacaccagtactaatattttcacttcttgtgggtggatgaggtctcactatgttgcccatgctgacctcaaaatcctggccttggccaggcacaatggctcacgcctgtaatcccagcactttgggaggctgaggtgagcggatcacttgaggccaggagtttgagaccagcctggccaacatagtgaaaccctgtctctactgaaaatacaaaaattagccaggcatgatggcaggcacctgtaattccagctacttgggaggctgaggcaggataatcacttgaacccaggaggcagaggttgcagtgagccgagatcgtgtcactgcactccagcctgggcgacagcaagactccatctcaaaaaaaaaaaaaaaagaaaaagaagaagaaacaaagaaatcctgtcctcaagcaatcctcctgccacagcctccaaaagtgctgggattataggcatgagcccctgtgcccatcctatttttttagattgagagggtacaggtttgttattaataaatggatatattgcatgatgaggcagtttgggcttctgctgatcccatcatccaaacagtgaacatagttcccaataggtagttttccttttatttatttatttatttgttttgagacagtcttcctctgttgcccaggctggagtgcagtagcgtgatctcagctcactgcaacctccacctcccgggttcaagcgattctcctgcctcagcctcccaagtagctgggactacaggcgcccgccaccacgcccagctaatttttgtatttttagtagcgactgggtttcaccatattggtcaggatggtctcgaactcctgaccttgtgatccacccgcctcggcctcccaaagtgctgggattacaggcgtgagccactgcgcccggcctcccaactcttgtctccctccctctctccctgctctagtagtcctagtgtctgtgcttcccatctttatgtccatgggtatgcaatttttagctcccacttataactgagaacatgccgtatttggtcttctgtttctgcattaattagcttaggataatgacctccagctgcatccacgttgctgcaaatggcatgatttcattcctttttatggctctttccttcactttagagattggccagaatctcctctttggccacaatccgaggaccccctacccacaccacatcccgattctcctgggctctgaccacacacctggcctttcttcccaggtgaacctggccacccttgactccgaggccctgctgaccttgggcctgaacctctcacacctgggccgggccgagcgcatcctggagctccggccggccctggagggtctagagggccggatccgctacgtcatcgtccgcggaaacgagcaaggtttctttcgcatgcatcacctccgtggcgtcagctccctgcagctggggcggaggcggccggggcctggaacctaccggctggaggtggtgagccacatggcaggaccctggggtgtccagccagaggggcagccagggccatggggccaggccttgaggctgaaggtgcagctgcagttgctttagttgggaggagcctcagtgggccccagctgtccagagaagggggattctggaactgggaaggactgatccccagaagcgatggctgaccagattgaaccccgaaactcaggaagagtgaaatgctacacgacaacctcaggcaagcccggcctctgcctgggcctctgtgccagccccgggggccccccagttactcagtctttcctggagacagcaagaagctgcaatgtgcaatccccctgcccccacagccaaggtcaggaagaggccctgtggtcaccgtgtctggccaatctcaggctttcacttctgtactgcactgtggcttgccctggcggggggcagggggttggcaggacatggcaatgggcaactggggtgggcacagggcttattcctcggagtagaagggtgtacagggggcccagactccacagtgacttgccacatttgccccccatttggagaatgcttttatatcaaaagtggagacgataataaagttattttgggttaagtctgcctgccctttggcaagttcttgaagtaagtagatgctgcccttggactgggcgaggcagatcttgtgcctggggaagcagaaggccttatgggctccccagaatggtaataatggctcacgcttcctgaccacgtactacataccagacaccattcgattttttttttattttttctgaggcagggtcttgctctgttgcctaggttggagtgcagtggcgcgatcgtggctccctgtggtcgccactttccgggctcgagcaatcctcccacctcagcctctcccaagtagctgggaccaaaggtgcacgccaccacacccagctaatttttttaaatttctttttctttctctttctttttgagacagagtctcaccctgtcacccaggctggactgcagtggcgctgtcttggatcactgcaacctctgcctcccgagttcaagtgattctcgtgcctcagcctctcgagtagctgggactacagatgtgtgccaccatacctggctaatttgtgtatttttagtagagacggggtttcaccatgttgtccaggctggtctcaaactcctgacctcaggtgatcggcccgcttcggcctcccaaagtgccgggattacaggcatgagctaccacacctggcctaacatttatttttcttagagatggggatgtccctatactgcccaggctgatcttgagctcctgggctcaagtggtcttactgccttggcctcccaaagtgctggaattacaggtgttagtatccaagtattttaccattattgaccactttgattgtcactacaacctcacggaatagatgctattaccatccccattttacagggaaaactgaggctcagagaagttaaacactttggccaaggtcaggccaggttgaaagttgggtggcctggcggggtgtggtggctcacacctgtaatcccagcactttgggaggctgaggtgagcagatcacctgaggtcaggagtttgagaccagcccggccaacatggcgaaaccccatctgtactgaaaatacaaaaaaaaaaaaaaaaaaaaagccaggcgtggtcgtgggcgcctgtaatcccagctactcaggagagtgaagcaggagaatcgcttgaacctaggaggtagaggttgcagtgagctgagatcatgccactgcactccagcctgggcaacagagcaagactccaccaaaaaaaaaaaaaaaaaaagaggaggggaggggaggggaggaagttgggcagccaggtgcagtggctcacgcctataacctcagtgctttgagaggccaaggaggctggatcacttgaagtcaggagttcaagaccagcctggccaacttggtgaaaccccatctctactaaaaataccaaaattagccaggggtggtggtacgtgcctgtaatcccagttactcaggaggctgaggcaggagaatcacttgaacccgggaagcggaggttgcagtgagcggagatcgtgccattgcactccagcctgggcgacacagcaagactctctcaaaaaaaaaaaaaaaaaaaggtgggcatgttcccaggccatcagcccccacaccaccatgcatggttccaggcggactccaattcgatggccagggtactcattgtgttaataaacacacagttagcatgtactgtgtgctgtgcgtgtcacacatcacagtgtctttggtctccaacaaagcgctatgaggcaggcagtattatcacccccattttccaggggggcaaaattgaggcttagagagcttgtggaacctgtccgggtcacccacatagtgcgcggtagagcccgaacactgaacgtgactccgtttcttctgcaacttcatcccggtccctgatcccaaaccaccagggtgtcccctaagagatgatgtgcttggttttctttctttctttctttcttttttttgagacaaactctcactctgtcacccaggctggagtgcagtggcgtgatctcggctcactgcaacctctgcttcccgggttcaaacaattctcctgcctcagcctcccgagtagctgggatgacaggtgcctgccaccacgcccgactaatttttgcatttttagtagagatggggtttcaccatattgaccaggctggccttgaactcctgacttcaggtgatccacccgccttggtctcccaaagtgctgggatgacagagtgagccacggtgcccggcccaatgtgcattggttttcatccagatcattctctgttgtgatggaaactgaggttgccaaggactgaagacagcatcatcgggtggtgactcaggcctccacctgcagaattgtcactagcgcctggtaccagagctctgtccctggtctggtcctggcttaccagtggcctccaggcagcctataagagcttgcagagggcttctgtgtccatcggctggactcaccacagccctggaatctaagtagagcaagcacagtgactcttattctacagacaagctgagaggtacccagagagtcagcaattggtttaaggtcaccagctgggaagtgcattctgcaaccagtgaccaatgcttggcccctggagagccgtctgttaggagagcttggggtggcaaagatcgcattggcttcaccccagggcagggcagcagcaacttgcacctcatcatgaaatgtaacaggcaagaaaaaaaaagaaaaaagaaatgtaacaggcaggaatgactccatcaccccccaaggtttatttaaaagttatagaaaagcatagcctgggaggggcatccttgaactgaccagagttttggagggacccagagggacacactggcatggcccggggtggacggcaagaaacagaaagtgagagaggtatcctaagtcttctctacaagagccactggctgcccaggattgctgctggtccccggagcggcaaaaggcttaaaatcaggccaactccctctttccagttgccagacgggcaggaggtggtgggggtgcagagggaggaccaactcaggtgcagggattaagacttgacccaaaagacagaggcgtggggacagctgggtctgtagggcgacggttttatcggagaaagatccggcccctcctgtgccgatggagcccagaaatgagccggctcacagtcctgcagaagcaatgagagaggccgaagtaaaattgacggctgtaaaataatagtaactatatgcatttgtctctacctccagtccctacagctcctaaaacccttgtgaatttctgagtaataggagtgctagaatcttttatgctaacttttttttttttttttttttttgagacagtctcgctctgtcgccagactggagtgcagtggcgcaatctcggctcaatgcaacctccgcctccaggactcaagcgattctcctgcctcagcctccctagtagctgcaactacaggcgagtaccaccatgcccggctaatttttgtattttttgtatttttgtatttttagtatttttgtattttgtatttttagtagctaattttgtattttagagacagggtttcaccgtgttagccaggatggtcttgatctcttgaccttgtgatctgcccacctcggcctcccaaagtgctgggattacaggtgtgagccaccgcacctggccttttgtgctaatatttggtctttgaattctgtttctgacacagagctctggatcccttggagtgtcctgggtaatggggacatattttattctaatgaggtgactcttggttggcttctgggtgggggctggtcaccagcaagaccaagccattgattagaaacttggagcttttggtcccattctccaggaaggggaagaaggttggcaatggagttaatcatccttcactcctatgtgatgaagcttctaaaaaattccctggttggctgggcatggtggctcacgcctgtcatcccagaactttgggaggccaaggcaggtggatcacaaggtcaggagtttgagaccagcctggccaacatagtgaaacgccgtctctactaaaaataaaaacaaataaacaaaaaaattgctggtgaaggccaggcgtggtggctcacgcctgtaatcccagcactttggacagttgaggtgggcagatcacttgaggtcaggagttcaagaccagcctgcccaacatggcaaaaccccatctctactaaaaatacaaaaattagtcggcagtggtggtgcatgcctatgatcccagctactcaggaggctgagataggagaatcacctgaacccaccctggaggcagaggttgcagtgagctatgattgcaccatgcactccaacctgggtgacagagtgagactctgtctcaaaaaaaaaaaaaaaaaaaaattaggccgggcatggtggctcacacctgtaatcccagcactttgggaggctgaggctggtggatcatgaagtcaggagatcgagaccatcctggctaacacagtgaaaccccgtctctactaaaaatacaaaaaattagccaggcgtggtggcgggcgcctgtagtcccagctactccagaggctgagccaggagaatggcgtgaacccgggaggcagagcttgcagtgagccgagatcatgccactgcactccagcctgggtgacagagcaagactccatctcaaaaaaaaaaaaatccctggtaagctgagggtactggcctgcagtcccagctactcgggaggctgaggcggtgagctatgtagtcctagctgctcaattaggcagtgagctacaattgcgccactgcactccagcctggcggagagagtgagacctcatctctgaaaaaaagaaagcctgaactatggggttcagggtcttgtgaccatatccgtgtgtgggaggggtggtgtactgcaactccacgggaacagaagcttctacacttgagtcccttccagtctttgcctacctaagcatctcttccatctggcttattcatccctatcctttgtaatatctttttattcttttttcgagacagggtctcattttgtcccccaggctgaagttccaatggtatgatcatagctcactgcaacctctacctcctgggctcaagtaatcctctcacctcagcctcccaagcagctgaaactacaggtgcatgccaccacaactagctaatttaaatttgtttttttttttcttgagacagggtcccgctatgtttcccaggctggtctcaaactcctgggctcaatttttttattatttatttatttatttagagacagagtctcgctcttttgcccaggctggagtgcagtggcttgatctcggcttacttcaaggcccgcctcccaggttcatgccattctcctgcctcagcctccagagtaactgggactacagatgcctgccaccacgcccggctaattttttgtatttttagtagagttggggtttcaccatgttagcctggatggtctcgatctcctgacctcgtgatccacccacctccgcctcccaaagtgctgggattacaggcatgagccaccgcgcccggccatcctgggctcaattgatccttctgcctcagcctctcaaagtgctaggattacaggcgtgagccaccatgcccagcccctttgtaatcttttacaataaaatggtaaacacaagtagagcgcttccatgagtcctgtgagctgttctatcgaatgatccaaccagaggtggaagccctgacttacagacaatcagtcagaaataaagtgacaacttgctacttgcaaccagcatctgaaatgggggcagtcttgtgggactgagtccttaacctgtggattgtgtcactacctccagatagacaatgtcagctggacacagtggctcatgcctgcaatcccagcactttggggggccgaggtgggagaattgcttgaggccagaagttagagaccagcctaagcaacatgacgaaaccccatctctaataaatatatgaaaattagccagacgtggtgatgcatgcctgtaatcccagctacttgggtggctgaggcacaagaatcgcctgaaccctggaggcggaggttgcagtgagccgagatggcaccactgcactccagcctcagcaacagagtgagaccctgccataaaaaaatattaattatatataatatatatatttatatattatatatattatatattatatatattatatattatataatatatatttatatatatttatatattatatataaatatatacattatatatattatatatattatatattatatatatttatatattacatatatgtttatatattacatatatttatattatatatttatatatttatattatatatttatatatttatattatatatttatatatttaggctgggcgcggtggctcacgcctgtaatcttagcactttgggaggccaaggcgggtgggtcacgaagtcaggagatcgagaccatcctggctaacatggtgaaaccccgtctctactaaaaatacaaaaaattagcccagcgtggtggcgggcgcctgtagtcccagctactcgggaggctgaggcaggagaatggcgtgaacccggaaggtggagcttgcagtgagccaagatcgcgccactgcactccagcctgggcaacagagtgagactccatctcaaaaaaaaataataataaatatatatatttatatattatatattatttatacattatatatactttatattatatattatttatatattatatatttatatattatatattatttttatatattatatgtatttatatattatatattatttatatattatatataatatatttacttatatatattatatatttatatattatatatttacttatatatattatatatatttatatattatatatttacttatatattatatatatttatatattatatatttacttatatattatatatatttatatattatatatttacttatatatattatatatatttatatattatatatttacttatatattatatatgtttatatattatatatttacttatatatattttatatgtatatatagagagagacacacacacacaatgtcagaattcagtagaattacaggacaaccacccggtccctgctggagaattgctggctttggggggccctggagctcttgggccactcccctggggctttactttctcacttgctgtggtgtctttgcgctgagtcacagcagtggacagccaccgaggaccctcccctgtgaatctgcggcactgaccgcacaaccacctctcctgggtcctggaggtgaatctcctgtcccagtgtgagccaatcacgagccctcaaccctcagcaaaggtgatggatgggagacagtcacatgaccaagagtccttacctgaattagctgatatcaggagggagacattcctcttactgctgctgatgggattgctaaacttggacgatgataacttggagtttccagaactcaacttctttacagcatgagggcctgctggagaaatggagagagaaataagcaagagctctgccatcatcctttgagctcctggatccagctgagcctgaagctgttgactggttatttaagccaatgagtctcccatgtgcttgagctttccatctgtaccagtggaaagtgtcctgattaaaagagctggactggctgggtgcagtggctcatgcctgtagtcccagcactttgggaggccaaggcaggtggattgcttgagtccaggggttcaagtccagcctgggcaacatggcacaacctgtctctgcaaaatgaaaataaaaaattacccaggcatggtggtgtgtgcctgtaatcccagctacttgggaggctgacgtgggaggattgcttgagcccaggaacacaaggctgcagtgagatgtgattgtgccactgcactccagcctgggtgacaagagtaaaaccctgtctcaaaataataataataataatgagctggagccaggcatggtggttcatgcctataatcccagtgctttgggaggccaaggcgggcagatcatctgaggtcaggagttcgagaccagcctggccaacatggtgaaaccccgtctctactaaaaatacaaaaattagccaggcgtggtggcgtgggcctgtgctcctgctacttagggggctgaggcgggagaatcgcttgaattcaggaggcagaggttgcagtgagccgagatcgtgccactgcactccagcctggatgacacagcaagactccatctcaaaaaataaaaataaaaaataaaataacaatgagctggattagtggagcatgcctgtagtcccagctactcaggaggctgaggtaggaggattgcttgagcctgggaggtcaaggcttcagtgagctgtgatggcgccattgcactccagcgtgggtgacacagtaagactctgtctcaaaataataataaaagagctggactggtggcacacacttgtaatcccagctacttggggaatctgaagtgggaggattgcttgaacccacaagtttgaggccgcagtgagctatgatcatgctactgcactccagcctgggcaacagagcaagaccccatctccagaaacaaaaactggacaatgactcaatcagttggtcattcacttggtgccccactcaccagcaactggctttgtttggggttcaggcaggtgtcagtattctggtctccaattccctccctcggggtctgaaccacacatgggcttgcaggcagggagggcaggccccctagatgcccagcagaggtcttgcccaccttggaaggtctgcgtgttgtggtggagctttgcaaaaaccttatttcgagcatccaggagcttcatggctctctgcacctccctgcttttggggttcccacacaccttcctgtgtctcttggggaggtagaatctgtggtgagcagaggggggtgcccaggttagggtgtaggctggcagcaaggctgtgtgtgcaccccacccccccagcccccacggccccactcacatcgcagcaggcagattgcagctcccgctcacctcctggatccggtaagtccaggcgcgccggagcacagcccacccaatggggtagtggtaggccaggcagcagtcctcaaagacacctgcaaccacacagccgcccagatactcgcacccttgcatgttaacttggcagggccagccacaggcaagggcacctgtctgcatacctgtctgctcataccacaacccttccaggcccggcagaggctgaggaacagccttaggaaagaaaaagcctcctggctcaccccttatccctggatattgggacagccagaggttggagaggacccttgggtcccggctgggaagggtgtggaaccagcaaatgaacggaccaaggccacctctactcctgctctggggaaaagggtgactcggagtgcaggtgcactgtgaggaggggccaacaccacccctccccagccaagttcttccctcctaaaaatgagctgattggcagctcagcacagtggctcatgcctgtaaacccagcactttgggaggctgaggtgggtggatcacctgaggtcaggagtttgagactagcctggccaatatggtgaaaccccgtctctactaaaaaatataaaaattaggccgggcgcggtggctcatgcctttaatcccagcactttgggaggccaaggtgggcggatcacgaggtcaggagattgagaccatcctggctaacacggtgaaaccccgtctctactaaaaatataaaaattagccgggtgtggtggtgggcgcctggagtcccagctactcgggaggctgaggcaggagaatggcgtgaacccgggaggcagagcttgcagtgagccgagatcgcgccactgcactccagcctgggcgacagagtgagacaccgtctcaaaacaaaacaaaacaaaaaacaaaaattagccaggcatggtggtgggcgccttttttttttttttttccagagtctcactctgtcacccaggctggagtgcagtggctcaatttcagctcactgcaacctctgcctcccgggttcaagcgattctcctgcctcagcctcccgagtagctgggattacaggcgcccgccaccacgaccagctaatttttgtatttttagtagagacggggtttcaccatgttggccaggatggtcttgatctcttgaccttgtgatccacccgccttggcctctcaaagtgctgggattacaggcgtgagccactgtgcctggctgatagtgggcgcttttaatcccagctactctggaggctgaggcaggagaatcacttgaacccaggaggtggaggttgcagtgagccgagatcacgccattgcactccagcctgggcgacaatagcaaaactctgtctcaatgaaacaaaacaaaacaccaaccaaacaaacaaaaaattgttttaatacaaagtaaagagctctcagtaaatgtcaatgtctagacaagcagagatgaaacacacagatgaattagacctagtgttgtcttcagggagctcccgggaaactgatctctgcagaaagggggaagcacaggcactgtggggggtgcccagaggaggaggaggtgatgccagaaagttctggggggatgagcaggtggaatgaatgagccgaggatgagctgatgagatagtggaggaagctggggtgcaattctctgcctaaatggcctttggagttctctgcaatctcacctctgccagaactaacctccagaggccgagtctgagtccctgcagagcccagcccagcaggagcagggaaagggaggactcgagccctccaggtgtctcccaaccgcggcctctgagggcaaggggcagcgcattctgttggaacctcggactgcagtgccaggcaggtagttcccaaggctggaggccaggatcgaagggctgggctgggcctggctctgatagcaaaacaatcagaccacagcccaacccccttcccaggcaaaggccaaggacttggacccatcagacccagccgaggggcaggtgggtcaggtgggggcagacagggaaggagggtgggaccctgggtctgccgcccagccagggaccctgctttggccagctgctgaaactcagaggatgtaggacccagtgtcagggctcccgtggggacaccccaggcccaggaattgtcctttggcgactgaaatcctcaagtgcttgctctgcggtagggagtggggaagaaggaaagagttccctattaataacaggaacagttactattgccgccgccagacatgaggcctagtcttttgcaggcatgagctcactggaccctcaagtcagagccatgcagtgggaattttagattcccactttgcagctgaggaaacggaggctcctaaaggtttaggaagccgggcacagtggctcaaacctgtaatcctagcactttgggaggctgaggcaggcggatcgcctgagatcaggagatcgagactactctggccaacatagtgaaaccccatctctactaaaaaatacaaaaattagccgggcatggtacacacgcctgtagtcccagctacttgggaggctgaggcagaaggatcgcttgagcccaggaggcggaggttgcagtgagccaagatcgcgccactgcactccagccagggtgacagagtgagactctgtctcaaaaaaaaaaaaaaaaaaatggtttaggagcaactaactctcagctggactgcatggagggaccaggatgggaatccactcttgtcagtctccagggccctgatctccaaccccacccctggctcggcaggattaggattctacaatacatccctggcagtaactggctttgcccacagctggaagccaccctctgctccctcacatctttaggagtcttgcaaaagactccatggggctctcgaagaaggaactggggactctccatctccccgaccccatcccaagagctaaccaaacaccaggagttcctgcatgtcaggagcgggagaattcagtggagatgggattggggagacttccggaggagataagagacaaaaggggtggggtgggggcatggggagaggggcacttggtggtaggcattgccgaacacagtaccttgggtgtggacagcgggggcccaggctcccaggaagccggccaccaggcaggccaggagccacaggttcatgctgcaggcgggtcctcctccctgggcacctggacgaataacggggccacctggggtcgtggagggaagtggtaaggactgaggaagaggaggggagtgggtactgggaacatcccccctcttaagccccaggcatatggcaagggaaggaggttgtataaagtaggaacaagttgtgctggagggaaaagctgttcatctcagtcatgttcaaggaaaagactcaccgatatccactgggtcaagggagctgatgcccgccgggctgtaggccaagctgtcccatctgcaggaccaacacgctgagcttcactctttatagacagagccccacccagccaccccctgcccgccctcctcccttcctcctcctctccacctgcactctcagcctctggaattctccctcttctacagcaagctccaacctcgacccacaggcccccttgcctccccactccccatcccaggcctcccagccagcacccctactgtctccagaaagggccttttcccctgtttccctcacctgcacacacctggtggacactggctgcctgcgaacaaggctcagactgccttgagcccccaaacaagcccttaccttcatgctccccccgccctcaagccacctgttccctggtgggtccccaacttcactccatttccctctccttccacaccatggttaggtaacttagcatgtcacagaaatcctctggttgtgatcacaggcaaatccatagaaacagaaagtaaattagcggtggccacaggatggggggaggggagaatgaaggactgactgtgagagggtatgggtttccttttgttctgaaattagatgagagtgatggttacataactctatgaatatagtcagcacggcacaatggtgcacctcccaccggtgaacaaccccaacaagaaagaaactctctaggccaggcatggtggctcatgtctgtaagcccaacactttgggaggccgaggccagaggattgcttgagcccaggagctcaagaccaccccgggcaatatagagagacctgcgtcactacaaaaattttttaaaaaattagcctgacgtagtagtgcatacctgtagtcccagccactcaggaggctgaggtgtgaggattgcttgagccttggaggttgaggctgcagtgagctgtgatcatgccactgcactccagcctgggcaacagagcaagaccctgtctcaaaaaatggaaaaaaaaacggtggccggacacagtggctcacacctgtaataccagcactttgggaggccgaggcaggcggatcctctgaggtcaggagttcgagaccagcctggccaacatggcaaaaccccatctctactaaaattacaaaaattagccgagtgtggtgggggggcacctgtaattccagctactcaggaggctgaggcaggagaatcgcttgaacccgggaggcggaggttgcagtgagccgagattgggccactgcattccagcctgggcgacaagagtgaaactctgtctcaaaaaaaaaaaaaaaaaaaaaaacaaaagaaaaagaaaaaatggaagaaatgttttgtttttggaagaaaagccaggagccccgggtagccatgccctcaggaagcaaagcaacattcaccgagaaggcatgtcttttttttttttcttctgagacggagtcttgctcttttgcccaggctggagtgcggtggcgctgtctcggctcactgcaagctccgtctcccgggttcacgccattctcctgcctcagcctcccgagtagctgggactacaggctcccgccaccacgcctggctaattttttgtatttttagtagagacggggtttcaccatgttagccaggatgggagaaggcatgtcttctttccctggggcagcaggacccagccaggacacagggactgggggagacacgaggtgaagattagggagggcgaaaggagcgctgcagaggccgcacagctgattgctttaaactttttatcgcctgcatccatagctacatctgacctctgtgggtatttatcacatcctaaactcctttctcatttctccccttccactgggagcccagaggcggcggcccctagcctacttccctgtcccaaaccacatggccgggtgagtggggcttagaggtggggccgggcctggtgggtgtggcttctagccggggacgtgactagataaatgacacttagagcccaggggcagggctgggtgggcgtggcttatggctatgggcggggcttgctatatggctccgagtcaggggcagggcagagtgagtgggatttaagacagtgggcggagcctgacagatggcgcttatggtaaggggccgggctttgtaggaggggcttagactggggcggggcttgcacggtcagccccgccccaccagagcagttaagacgcgtcgggggcaggtgctctcacccgtcccgttgctgcggccagtggcagcccacgggccggggcgctgttccagttcctccgcctcttgctctgggtgggtgaggctggaccaggacgcggctccgcgtggctgcgagcgtggggaagcggcgtggcgggctggggccagcctctccgctacggctcactgccccctaccttcccaacccgcgggccgcggccaagacggtgttacccagacttgggggaggtccccaacgtgagtctccctccctgcctcacccctcactgtttgtcccgccggcagccttcacggggaggaagggttcccagtaagggggccctccagggaccagcaagcacggagcactggggtgggcgcgctggggacctgggacccaggggttggagcaagaaacgggatgatcccggagttctgaggaccacagttgctttgagtaaaggccagaccttcacagtcggggctggactggcctcttccactcctgcagcagctgggggcattaagagtaatccgctatcggccgggagcagtggttcacacttgtaatcccagcactttgggaggccgaggcgggcggatcacctgaggtcaggagttcgagatcagcctggccaacatggtgaaaccccatctctactaaaaatacaaaaaaaaaaaaaaaatagccgggcatggtggtgcgcacctgtaatcccagctacttgggaggctgaggcaggagaattgcttgaacccaggaagtggaagttgcagtgagccaagatcttgccattgcactccagcctgggcaacaagagcaaaactccatctcataaaaaaataaaagagcagtccgctatcagcaagggtcctcttctccgccagtgtgaaatcagcacagctggggggaacaagtgccccccacaccgacttctgttctgcacctctgatgatgggagcagttgagggtggtctccatcctgtagctcagccaaattcagagaccaataccccagagcctgcagggttgggtgggtaggcaggtgtctttctagacaagcccagttggttgcagtggccaggtggtgggcaggggcgatgagatgttctgggaagcctgcaccagccaccaccacatctgccctacccagtggcaggcacctctagtgggatgaaggatgctcctgggtgctcaccattggcccaactgtgcaaaggaggagattgagggtcagagaagccaagttacttactttttttgttggccaggaaaatctaatttttatttcttaaatactgtgaagaaaaggacagtcccccaatggggaagcgccatagagcagatgactgggaggtcatcggcaaaggctcaggggcactgggagaacactatgggcagaagtgggggtcctcctgtagtcacttttgcatatcagaccccagctgcctgcagctctcctgaactctggtgcctccaggtccctgatgagactcttggcttctgatgggcccccactgccctgcatggtcacgagtcttgtagggagcaatccacaccccaggagccccgtctgccaggcctggactcctgttgtacccacagctgcctcttttttttttttttttcgagacagagtcttgctctgttgcccaggctggagtgcagtggcaggatcttggcttactgcaacctccacctcccgggttgaagcgattctcctgcctcagcctcccgagtagctgggactacaggcgcctaccaccatgtctggctaatttttgtatttttaggagagactacatttcactatgttgcccaggctggtctcgaactcctgacctcaagtgacctgctggccttggcctcccaaagtgctgggattacaggcttgagccaccatgcccagcctccagttacctctttttaaagagaatttggttatttgaaagatctttcttcttttttatgtaggcatttatttattgctataaacttccctcttagaaccacttttgctgcattcattggtttaggtatattgtatgtccatttcagtttgtctcaagttttttgttgttgttgtttctgtttgttttattttgtttttagaaacatctccctctatcacccaggctgagtgcagtggcacaatcgtagctcactgcagcctccaactcaagtgttcctcccaccttagcctcccaaataactgggactacaggtgagcatcaccatgcctggctaattatttttattttttgtagagatggggggagcgtctcactatgttgcccaggctggtcttgaactcctggcttcaggtgatcctcctgcctcagccaccaaagtgttgggattacaggcgtgagccactgcacctggcctcaagatattttttaatttcgttttaatttcttctttgacacattggttgtttaggagagtgttgttgaattctcacgtgtgaattttccagaattcctcctgttattgatctctagtttcgtatcactgtggtcagaaaagatacttgatacaatcgcaatcttacatttgtttttttgttgttgttgttgagacggagtctcactctgttgcccaggctggagtgcagtggcaccatctcggctcactgcaagctccacctcccgggttcacgccattctcctgcctcagcctcccaagtagctgggactacaggcgcccgccaccaccacacctggctaattttttgtatttttagtagagacggggtttcaccatgttggtcaggctggtctcgatctcctgacctcgtcatccacccgccttgacctcccaaagtgctgggattacaagtgtgagccaccgcacctggcaatcttacatttgttcaggcttgctttgtggtctaacatgatctatcctggagtatgtcccctgtgcacttgaggagaatgtgcgttccgctgctgtcaaatggaatgttctacatatgtcattagttccatttgatctacagtgcatttcaaatccaatgtttccttactgattatctgcctggatctgttcgttgccttttttttttttttttttttttttagacagagtctcagtttgtccaccaggctggagtacagtgatgttgttatggctcactgcagccttgaactcctgggctccagcaatcctcctgcctcagcctcccaagtagctgggactacagatatgcaccaccacaacccacaaatgtatatttttaattttgtggcctgttgcccaggctggtgttcattgttgaaagtgcagtactattcctgtattgcagttcagatctgttcatatttcctttatatatatttcctttatatatttaggtgctctgatgttaggtgcatatatatataattgttttatcctcttgatgaactgacccctttttcattctataatgaccttcttcctctcatgttagagttttgacttaaaaaatattttatctgatacaagtacagctacccctgatctctttcggttttcattttcaaagaatatctttttgcctcccttcactttcagtctatgtgtgtctttaaaccagctgcctcttgctttggtccagatgcatagtggttgcccagcaaccggaggaggagaaggaggaggaggaggaggaagaggaggaggaagaggaggaggaggaggaggaggagaaggaggaggagaaggaggaggagaaggaggatggggaggagaaggaggagggggaagaggaggagggggagaaggaggagggggaggagaaggaggagggggaggagaaggggggggaggagaaggaggagtgggaagagaaggaggaggagggggaggaggaggatggggaggaggaggagaaggaggaggaaggaagaagggtttttccaggatgtcttgcaagcccttggcctgatgttcgagaatttggttaactctaacctgaaccctaagtccctgatgtagctggctctgctggctcctggaaagtcagttctgaggggatccccaccccaggctaacctgaggcctctgtcttccaggggacagctgtagcagtggcctgggcaggggccgtggttctccagagggattcagactactggtattaccgagctcatgaccttggctttcatccttgtacttgtcctgcccctgcaggatgtgcgggggccagacagctgggaagagtgactgcctgatcctggccctgctgccttgggctagaggaggggttgcatggagagagagggtggcaggccttggggagagggtcccatagggtcctgagtccctctttgaacgtgctgagctctactcaccctttccacatctgttttctgagtatcccttatgttccagccacatgcggggccccagggtgccccagggtgacagcagtgagcaagccgacacattgcaactatcaaagatgatgatcgctggctgggcgtggtggctcacacctataatcccaacactttgagaggccaaggcaagaggatcacttgagcccaggagttcgaaaccagcctgggcaacatagtaagacccccatttctacaaaaaaaaaaaaaaattttttttttttaaatagccaggcaaagtgaccggcatctatagtcccagttactcaggagactggggcaggaggattgcttgatcccaggagttcaaggctgcagtgagctatgattgcaccactgccttccagcctgggcaacagagtaagaactcatctcaaaaaaaaaaaaaaatgatgatgttgatgtcacagatgcctcatggaacatctatgtgggaccatttgttattcattcaataaacacttattgagcaccctctatgtgcccagcactgagctgggtgctggggacaagcagtgaaggagtcagtcccacgtgctcagtgcctagtagcattgcagacaagagaagcagcaagtaatgaagcaagacattcagatgtgactttctgctgacaaggaaaaacaaattttaatttaaaaaaaatttaaaaacaattttcagatgaggatcactgtcaccaatgctggtgtgattggaagagactagggatgggctggatgccgttttttttttttttttttttttttttttttgagacagggtctcactgtgtcaccctggctggagtgcagtggtgcgatctcggctcactgcaacctccacctcctgggctcaagtgattctcccacttcagcctcctaagtattacaggcatgtaccaccacgcccagctagtggatgcctttaaagagagtggcttgaggtaacaagaaccttattaggttaaaattcattcctactttatagggaaagaacaatcaaccgaggctgagagaggttacattgcttgaccaagtaacttgactaagtcgcttgtctctaaacaaattaattaagtaagtaaaaacaggtgcccagtgatgtgcagagagctggagacagaaggcagataataccactctccaagtggccctcacagctaataggaggatttttttttcaagataatgtctctgatttgtttttggttttgggtttttttttgttttttggtttgtttgtttgtttgttttttgaaacagagtctcactctgttgccaaggctggagtgcagtggtgcgatcttggctcactgcaaccttcgcctcccaggctcaagcaattctcctgcctcagcctccccagtagctgggattacaggcacgcaccaccacacccggctaatttttgtatttttagtagagatggggtctcaccatgttggccaggctggttcgaactcctgacctcaagcgatccgcctaccttggcctcccaaagtgctgggattacaggcatgaaccactgtgcctggccgagataatgttcctgttgcccaggctggagtgcggtggtatgatcacagctctctgtagtcttgacctctggattcaagcgatccccctgcctcagccccacaagtagctgggactacaggcacatgccatcatgcccgactaattttgtaactttttgtagaaacagggtctccttatgtggcccaggctggtcttgaactcctgggctcaagggatcatcccgccttggcctcccaaagtgctgggattacaggcctgagccaccttgctctgccttaggctgccatgtctcctgatcagacattcctggaggaacatctgcatcaggctgtggggatgtgaagggcatcccacctgtctccagggggacctgcagctgaatggtgacctgaaggacaacctcgtgttagtcagagaccagcagggcaggacgctagagggaactgccaagtgcagagtatctggggcaggaggtgcgggggtggatagcggaagatgaggtaggcagggagaagctatttggagcctcacgtgccaagcccagaagggtgaccttcatccagaggccaagaagaagctgccgaaaagatttatttatttttatttttatttttgagacagagtcctgcggcccaggctggagtgcagtggcgtgatctcggctcgctgcaacctctgcctcttgggttcaagcaattctcctgcctcagcctcccgagtagctgggattacagacccgtgccatcacgcagagctaatttttgtaattttagtagagacggggtttcaccatgttggccaggctggtctcgaactcctgacctcaggtgatccgcccgccttggcctcccaaagtgctgggattacaggcatgagccaccgcacccaccctgaatagatgtatttagtcaggggagggttgtggtcaggtctgcatctgagctctgccaaggtcatctggaagatgccgcagagggtgaggtgagggcagggagattcaacagcccaggcatggtagggcatggtagtgtggacctgttgtcacagctattcgggaggctgaggcaagaggactgctcgagcttaggagttcaaggttgcagtgggctatgattgcaccacagcactccagcctgggcgacagttagactctgcctctgaaaaaaataaaaacaggatggggcgcagtggctcacacctgtaatcccagcactttgggaggccgaggcgggtggatcatttgaggtcaagagttcgagaccagcctgaccaacatggtgaaacccctgtccctaccaaaaatacaaaaattaaccaggcatggtgacgggtgcctgtaatcctagctactcgggaggctgaggcaggagaatcacttgaacccgggaggtggaggttgcagtgagccaagattgcgctgcgtgctgcactgcaggctgggtgacagagcgagactcagtctcaaaaaataattaattaaaaataaaaaaagaaagtggcatgctggacccactgggtgaaggtgggcagatcctagaattaggtctctctttctggaatgacgggggcgatctgagccgcctccttagctccctggagaatcagacaaacctccctcccactgctacctacttctcaaatgtgggaaccctggcagtccagtaggccggccatgcatacaaagggaacccaggaggctgtcagtgcctataggattagggaatctgtctgcgctttcacctctgctcctccaacccgtcttcctgtggttctttttctgtttttttttttttttttttttgagatggagtctcactctgttgcccaggctggagtgcagtggcacaatctccgctcactgcaagctctgcctcccgggttcacgccattctcctgcctcagtctcccaagtagctgggactacaggcgcccgccaccacgcacggctaatttctttttgtatttttagtagagacggggtttcaccgtgttagccaggatggtctcgatctcctgacctcgtgatctgcccacctcggcctctcaaagtgctgggattacaggcgtgagccaccgtgcctggccctttttaagacagattcttgctctgttgcccaggctggagtgcagtggcaggatcttggctcactgcaacctctgcctcccgggttcaagtgattctcctgcctcagcctcctgagtagctgggattacaggtgcgcaccaccacacctggctaatttttgcatttttggtagagatggggtttcaccatgttggccaggctggtctgaaactcctgacctcaagtgatccacctgcctcagcctcctaaagtgctgggattacaggcatgagccgccgtgcctggccaatattttctttttctttttctttttttttctttttttttgagacagagtcttgctctgtcacccaggctggagtgcagtggtgtgatctcggctcactgcaagctccgcctcccaggttcatgatattctcctgcctcagcctcccaagtagctgggactacaggcacccgccaccatgcccagctaattttttgtatttttagtagagacggggtttcaccgtgttagccaggatggtctcgatctcctgaccttgtgatccgcccgcctcggcctcccaaagtgctgggattacaggcgtgagccaccgtggcctggccaattttttgtttttagagacagggtctcactctatcgcccaggctggagtgctggtgttatcacagcttgctggagcctccaactcctgggctcagaccatctgcccactttagcctcccacagtgctgggattactagcatgagccaccttctctggcctctcctggttgttctaagcacgtggattcagatctgccagttgcccactcagtcctgggggcgaggtgctggagaggaggctggggaggaagattgggtcaccacggttcctctttcctgcctcttctctcacggcacctgctgttcccccagggctcccacctccgcttgtctcctgctgagcctttgccctagtagcgcactctgcctggcaagccctccctctgcccatctccaggcagccagcatggctgggattatgtattcagcttcgagctctgacaccctgtcaccctgggccacatgttgggaccgccctattctttcttttttttttttttttgagacggagtctcactcttttgaccaggctggagtgcagtggcatgatctcaactcactgcaacctccacctcccgggttcaagcagttttctgcctcagcctcccgagcagctgggattacaggtgcctgccaccacgcctggctaatttttgtatttttagtagagatggggtttcaccatcttggccatgctggtctcaagtcctgaccatgtgatccacccgcctcggcctcccagagtgctgggattataggcgtgagtcacctgcctggccgggactgccctattcatctctgtctgcccctgaaatcttattgtgtacgtgcctccacttcaaggccatcaaacctcatggaagggatgtacttcagtcatccctttgcctgtgatgttccccttccccaccaatagaggctgagcaagcacctcagacttgagagtggaccaagcctccttgctgcaggcccccaagtgcccaagggagctctcagcttgtccagcccttcacaggcctataaactcttctcagtcctggctgggtgcagtggcttatgcctgtaatcccagaactttgggagaccgaggcgggtggatcacttgaggtcaggagttcgagaccaccctggccaatatagcgaaaccccatctctactaaaaatacaaaaaaaaaaaaaaaagcgaaacccaggccaggcacagtggctcatacctgtaatcccagcactttgggaggccgaggtgggtagatcatgaggtcaggagtttgagaccagcctgatcaacatggtgaaaccccgtctctacaaaaaatacaaaaattagatggtcgtggtggtacgtgcctgtaatctcagctattcaggaggctgaggcaggagaatcgcttgaacctgggaggcagaggttgcagtgagccgagatcgtgctactgcactccagcctgggcgacagagcaacaggactacagagcaagactctgtctcaaaaaaaaaaaaaaaaaaaaaaaaagcgaaaccccatctctactaaaaatacaaaaatattagcatgcatggtggtttgtgcctgtaatcccagctactcaggaggctgaggcagaagaatcacttgaacccaggaggcggaggttgcagtgagccaagattgtgccattgcactccaatctgggtgacaagagaaaaattctgtctcaaaaaaataaaataaaaataaaaataaaaataaaattaaaaaaaactcttgtcaggcccccctttcccccagctttcccacttccccctacaccccacacttacttgtgtgcctcccttgttctgggctaatttcatgtgcattgttgcaatagatgcttacagtgacacattaaggtaaacaatatacttattcccattctacacatgaggaatttgtgatttgatcagggtagccaagccaagtattgttgttacttttttgagacagagtctcactctgtcacccaggctggagtgcagtggtgtaatctcagctcactgcaacctccacttccctggttcaagtgattcccctgcctcagcctcctgagtagctgggattacaggcgcccaccaccacacctggctaatttttgtatttttaggagagacatttttcctgacctcaagtgatccatccgccttggcctcccaaaatgctgggagtatagacgtgagccaccatacctggccccaagtgttttttttgttttgtttggctttgttttaaaaaaataaaataagcctggccatggtggattacagcactttgggaggccgaggtgggcagatcacctgaggtcaggagtttgagaccagcctggccaacatggtgaaaccccatctctaccaaaaatacaaaaattagctgggccgtggtggtgcatacctgtagtcccagctactcaggaggctaaggcaggataatcgcttgaacccggaggcagagtttgcagtgagctgagatcatgctactgtactccagcctgggcaacagagcagagtctgtctcaaaaaataaataaataaataagtaaataaataaataaataaataaataaataaataaaaagcaatgattttccctttgtgggtctgggggtcacctgtagccccactggaacttgctccaggctgtgagttggatttgcatctgttccatgtgacttttcattcagaggcttcagggcccatatttgtttttttgtttttgagatggagtttcattctttcccagccccccaagtagctgggattacaggcatccgccaccgtgcccagctaatttttttgtatttttagtagagacagagttttaccatggtaagcaggctggtctcgaactcctgacctcaggtgacccatcagggcccatatttgtttcatggcaaggtgacatgcaagcagagtggcgggaccacgtgatgcttcctcagcctttgtctccgatctgatgagggtcacttccatgcaggttccattggccaaaacaagtcatatggccacaccctaagctggagaatggggagtgcaccccacccacagggagcagtgatcaggggaggaagagaggaagatgtgttgtcttagtctctttgtgctgatataacaaaatgcctgaggccaggtaatctgtcaataatagaagtttattgcttacagttctagaggctgggaagtccaagatggagttactggaggattcagtacctgggtgagggctcattctctcctcccaaggtggagccttcttgctgcaccctcacacagcagaaaggtaaaaaggacctacctgctccccttcaacccccctctcttgctttttttagagacagggtcttgctatgttgcccaggctggagtgcaggggtgtgatcatagttcaatgtaaccttgactcctgggctcatgcaatcatcaagtcctcagcctcccaaggagctaggactacaggagcatgccaccacacccagctaacttttttgttttttgcaaagatggggacttgctgtgtttcccaggctgctctcagacttctggcttcaagcaatccttccctcctcagcctcccaaagtgctgggatttcaggcatgagccacctcacccagccttttctaatgagattaatcccattcatgagggcagagttctcatgacctaatcatgttccaaaggctgtaccttctaatactaacaccttgggtttttagttccaatgtatgaattttggagggacacatacatttaaacaaaggcaattgtgaacaaatgataccatccaccacagtcatgtaaagtccatgatgaatgttcctgattggcaggtagggcttctctgagggctgtttccagaacacaggtcccttccgtcttctggctctgccatctttaacatatagctcccaaggtcaccagcttggagagcttggagagtgaaccaccatgttggccaggctggtcttgaactcctagcctcaggtggtccacccgcctcggcctcccaaagtgctgggattacaggcatgagccactgctcccggcctgttccttattttttatttattgttgatattttgaatagtagaagtcaagatgtagccgactttgaaatgcttcccagccaggcacggtggctgccacctgtaatcccagcactttgggaagccgaggtggaagggtcacttgaacccaggagtttgagaccagcctgggcaacacagtgagactttgtctctacaaaaaatttaaaaattagccaggtgtggtggcacacatctgtgatcccagctacttgggaggttgaagtaggaggatcacctgagcctaggagttcaagaccagcctgagcaacatagcagaaccccatctttaaaaaaaaaatgagcagggcatagttgtacacatctgcagtcccagctactagggaggctgaggcagaaggattgcttgagcctggaaagttgaggctgcagtgagctgtgattgcaccactgcactacagcctgggctacagaacaagactctgtctcaaaaaagaaggaaagaggaagaaagaaagaaaggaaggaaggaaggaaggaaagagagagagagagaaagagaaagaaggaaggaaggaaagagagagaaaggaaggaaggaagggagagagaaagaaagaaaagagaaaagagaaagaagaagctgggcacagtggctcacgcctgtaatcccagcacttttggaggctgaggcaagcagatcacttgaggtcaggagtttgagagcagcctggcctatatggtgaaaccccatctgtgctaaaaaatatacaaaaattagccaggtgtggtggtgtgcgcctgttgtcccagctacttgggaggctgaggcaggagaattgttgaacccgggaggtagaggttgcagtgagctgagatggcaccactgcactccagcttgggcgactgggtgacagagccaaaaaaagaaagaaagaagaaagaaagccaagaagaaggaagaaaggaaggaaggagggaggaagggagggagggaaggaaggaaggaggaaataaaggaaaggaaggaaggaaaaggaaaagaaaagaaaaggaaaaggaaaagaaaagaaaaggaaagggaacagaacagaacagaatagaaaaggcacacttggagggaagtgtttctatctctaggaactggccagccccagaagggaccgtccgtccctctcctggtcttcaaagccctagatctaaagtatcataagcacagaaaattaaaaccacgattcatacatcaccctctctcttccatgaccacctgttgttttcccttccctggttccacagctgctccctctggcaacagatggataaatgccaggattgctctcaagtttcccccatgccaaagaaatccagctcccccatcccatcctgcctcattgtcccctctctcgcctcctggtcctaaacccctgcactggctcccaatttaagctgaacagccttagcccccgctccttacagctctcactctttcagctgcagaaacacggccccatgagtgtctgtatcacagccttctttccatcacctctgacgtgaggctgtttgttcaaggtggtgcccccagccctccttatctctggcatcaggaagaggcatggtggacccccgggctgatagcggaggccaggggacgccaaggcaacacagcctgatcttcctattttagctgctactgaaagggttaagggtgctgcatagggtaggtgtccatttgactgtgaatttcctttcttttgtttgtttttttgagacagagtctccctctgttgcccagggtggagtgcagtggcacgatctcagctcactgcaacctctgcctcctggattcaagcaattcacaagcacccgccaccatgcccagctaattttttttttttttttgagacggagtctccttctgccacacaggctggagtgcagtggtgcgatctcagctcaccgcaacctcttcctcctggatccaagggattgtcctgcctcagcctcccaagtagctgggattacaggcgcatgccaccacacctggctaatttttgtattttaatagagacggggtttcgccacgttggccaggctggtctcgaactcctaaccttgagtgacttatggagtcaataaagcccttggaaactggccttatattttgtgtatacagttcctgtacagggtttctgatctgtggtaagtaaagaaggtcattttctgacaggccaggaaccccaagttatcttaaaacctcaagaggagaggaattcacccaactcataggtatttcatgttacaaatccatggctgggcttggcttaaacaagtcttatctcaaattccttctatataacaaagttccatcaaagctgatttaaaaggcctgtgtagcggctaggtgtggtggctcatgcctgtaatcccagcactttgggaggccaaggcaggcagatcacaaggtcagtagttcaaggccagcctggccaacatggtgaaaccccatctctactaaaaatacaaaaaattagcaggcttggtggctggcacctgtaatccctgatactcaggagggtgaggaaggagaaatgcttgaacccagcaggcggaggttgcagtgagctgagattataccattgcactccagcctgggtgacagagcaagactctgtctcgagaaaaagaaaaaaagagaaaaaaaaggcctatgtagcaaataattattcttgctgcactctatgcaaataattaagccaaatataataaagcaaaccagtcctaccatgatttatcttttaataaaaatgggaaactgaagagtgaaaattatgtttcagaaactatagcacacctgttgttaaattctagtcttgcctaatgtttttcaatttttattattttctacagtttaaattatatgtgttacagaaatcaactcctggatacattacactcaaagcctaaagagtggagaaagcaacccctaacagcctagagaaaggtcctatcaatgtaaaaaaaaataacaaatcttaacctgaaaatcataaaagataagtggctgggcaaggtggctcacacctgtaatcccagcactttgggaggctgaggtgggtggatcacctgaggtcaggagtttgagaccagcctgagaccaacaaggtaaaaccccgttgctactaaaaatagaacacctatatggacacctataatcccaactactcgggaggctgagacaggagaattgcttgaacccgggaagcggaggttgcagtgagctgagatcacgccactgcactctagcctgagcgatagagcaagactccatctcaaaaaaaaaaaaaaaaaaaagataagtaactaagtggaaattactcatttcagtctcacccctacctcaccaaatactttttgtcatttctacatctccttttaagccaaatattaaaacctttttaatggaaattatttactatgccaccctcatgggaattgctttagtctactatttgcagaaggactatatactgtagtaccctcagggtggaatatcggacacagagtctcaattaccgtagcatttggcttagttattatcctcataccaggaataacagttgctaacaaacaaataacacatgggtcttcccaaacatgcgcctctgcctgtcattgggaaaaaaatgttgattctgtctcaaccaattaggcctaataagaaacgctgctgaaggccaggcgcagtggctcacgcctgtaattccaacactttgggaggccgaggcagacggatcacgagatcaggagatcaagaccatcctggctaagacagtgaagccccgtctctgctaaaaatacaaaaaattagccgggcgtggtggcgcgtgcctgtagtcccagctacttgggaggctggggcaggagaatggcatgaacctgggaggtggagcttgcaatgagctgagatcgcgccactgcacaccagcctaggcgacagagcgagactccgtctcaaaagaaaaaaaaaaaaaaaaacgctgctgaaaagcctaggactaatgtttttaccctttatggccatttcgtagacaactaccaaaacatctacacacaatattgctcctgcaggcaatccaagaccaaaaaactctccgtgtctcccctccaccccacaacagcaggaagtagccagaaagaacacgtcgccccttgtccttttacaactatagggtctggaatgacagagcagaagcactgtcatcttggacaaaccccaccactttaagttccagctccctctctagcctcttacatttcaaggatatcacttatcttctaactacaagcagccagaaagagcaggcagtaaaacacagataagacagctcgggcacagagggaaatagggggaaagtctgttgggtaattgccaaacttcaccctcatacaatgggccccagtaaaacagtggggccttacttaataagcacattcctttcccttcaggtgcactgaaacagggaagccaaaggcagactcccggtgggggtttttggggggcgggtatgcctgcagctgcaagaagatgtatggggacagacacgcaactctccctcccagataagcacaacaaagagacacagaagcagtccaagcctctgataaactctcccaccctgaatccttaaaactcttagtctgggctgagctcggtggctcatgcctgtaatcccagtattttgggagactgaggtgggcagatcacgaggttcgagaccagcctggccaacatggtgaaaccccgtctctactaaaaaatacaaaaattagccgggcatggtggcacatgcctgtaatcccagctactcaggaggctgaggcaggagaatagcttgaacctgggaggcagaggtcgcagtgagccgagatcacgtcattgcactccagcctgggcaacaagagcgaaactctgtctcaaaacaaaaacaagaaacaaacaaacaacccaaaaacaaaaaaacctcttagtctgtaagagagtttgcctctgactcaacttgcctggaatactcctctcaggtttgttttctctaaaataaacctgtgttgactggcaagccaacttttgtgtttctttcctctttatttcttacaggcctcccaacatgctgggattacaggcgtgagccactgcacctggcctaactgaaacttaaaacacattttcccggccgggctcagtggctcacgcctgtaatcccagcactttgggaggctgaggcgggcagatcacgagatcaagagtccaagaccagcctggccaacatggtgaaaccccatctctacttaaaatacaaaaattagccaggcatggtggcgcatgcctgtagtcccacctactagggaggctgaggcaggaggatggcttgaacccaggaggtggaggttgcagtgagccaagatcatgccgctgcactccagcctgggcaacagagtgagattctgtctcaaaaaaaacaaaaacaaacaacaacaacaacaaaaaaaaaaaacacacagacacattttccctttagcattgcttctaaaattcaaaaatgagctgtcctagggaaagggaacaaggactgccctaggacatgttgaagaatgtggaaaatgtttcatatttaaaatgttgattcattgattgattgagacagggtctcactctgttacccagggtggagtgcagtggtgtgatcatggctcactgcagtctcaaactcctggggtccagtgatccctctcacttcaacctcccaagtagctgggattacaggtgtgcaccatcatgcccagctaactttgtcatttttttgtagagacagggatctcgctatgttgcccaggctggtcttgaactcctgagctaaagcaattctcctgcctcagcctcccaaaatgctgggattacaggtgtgagtcattgcacctggcagggaagcatttcaaagtcagctacatcttgactttgactattcagaatatttaaaaatgaataagtagtaagaaataaagaacaaaggtaccatgaaacaaagattgggcccttgggtctttataggaataactttttcggggggcagggatgggggtaggctctgtcgtccagactggagtgcagtggcccgatcatagctcactacagcctgggaatcccgggctcctgggctcaagtgatcttcctaccacagcctcccaaagtgctgggattccagatatgagccaccagcctggccttttaaaacaattatttgggctgggcatggtggctcacgcctgtaatcccagcactttgggaggccaaggcaggcggattacttgaggtcaggagttggagaccagcctggccaacatggtgagactctgtctccactaaaaataccaaaaaactagctgggtgtggtagtgcatgtctgtaattccagctacttgggaggccgaggcaggagaatcacttgaactcacgaggcagaggttgcagtgagccaagatcaagccactgtactccagcctggacaacagagagagagtccgtctgaaaataaataaattaaataaataaataaattggagagaacacgagtcactttgtctgcttctccacctccctaacaaagctctctatggtataaagcttgaaggaatgtggtccacccaagccctgactctgaaacctttttccattgagttctcccatctcctaggagatgcttgccacggccagcagctctgccgggttacaaagctcatgccaggaaaggcaaatgccaggccgactgcccggcagctctccagggctgactcggggctgcagagaagaggctggtatgagtctctcgtggctgctgaaacaaatgaccagaaacagagcagcttaaagcaacccagatttatgattttacagcactggaggtcagatgtcctaaaattaaggtgttgatgaggctggttcctcctggaggctccattttcagcctttcccagcttctagaggtacctacagctctcatcttggggccccttcctccaccttcacggccagcagcgcagcctcttccagtctctttctgactgtgaccctcctgcctcctcatttttttttttctgagacagagtctcactctatagccaagggtggagtgcagtggctccatctcatctcactgcaacctctgcccctcgagttcaagcaattctcctgcctcagcctcctgagtagctgggattacaggcatgctccaccacgcccagctaattttgattttttagtagcaacagggtttcttcatgttgggcaggctggtctcgaactcccaacctcaggtgatctgcccgcctcagcctcccaaagtgctgggattacaggcgtgagccaccaagaccagcattttttttttttttttttttttgagacagggtcttgctctgtagccaaggctggagtgcaatggctcaatctcagctcactgcaacctctgcccccactgagttgaagcaattctcctgcctcagcctctcaagtagaactgggactactggcatgtgtcaccacgcccggctaatttttgtatttttagtagagtcagggtttcaccttgtttgccaggctggtctcaaactcctggcatcaagggatccatccgcctcggcctcccaaagtgctgggattataggcatgagccactgcacccggccccagctaatttttttttttttttttttgagacggagtctttctctgtcgccagtctggagtgcagtggtgcgatctcggttcactgcaacttccacctcccgggttcaagcaattctcctcgctcagcctccagagtagctgagattacaggcacgtgccaacacgcccagctaatttttgtatttttagtagagacagggtttcaccatcttggccaggatggtctcgatctcttgaccttgtgatccgctcgccttggcctcccaaagtgctgggattacaggcgtgagccaccgcgcccagccccagctaatttttttatttttttttgtagagactgtgtcttgctatgttgtccaggctggtctctaactcctaggctcaagtgatcctccctcctcggcgtcccaaaatgttgggattacaggtgtaagccaccatatctggccaaaggggctttattttacctaccacagcatccgtgggggccaaaatcataagatggggggcccacaggacacttcctgagggaggtgatgtgtgggtttagttctggaagattgcagggctggtgggggattgtgctatgcgggaagaggattccaggctgagagaacagagtccatagaacagcaggatcctaaatatctaccccagacgccacctggaagctctgtttgggaaagtacagttctcatctggggtcgatttttccccaggggacacctggcccgtgcctggagagagatttggctgtcaccactgggaggctgggggggcggtgggctgccagagagctgctaaataatctagactgcacaggaccgccccctaccaggaagaatcagccagcccgcagagtagcttagagggcgagaatccctctgtcctcatccctccggactcagaggggctttccaccaggggcagctggaagggtttattgggtgacctttggcctttctaaccctgccccccgccccccaccctgtctcccgcctttcttgggaaaagctgattttagttcctggtgacccttggcctcctcagggaacacaagcatttgtgtgggctgatggtttctacctctggaatgtgactgctccgcctggcctgggccctggaggacgagggatctaagaatagtgacgtttttccccccacccctaggcctggcccactctggcctccagatcccaggcccctcactgtgctggaagaggtggtcaggcagacaatgtccgagggaaacgtctggagcctgtgctggtcactgggccggggaatgagctggttcattcatggggcacggggcagaggtgatggatctgcggaggaggggcttggttggggtggtgggtctgcaccttgtcagcaccccacaccccccaaccccaggcctgccctgttttccctacagctccttgtccctgctgcctctgaaggacttacgtcactgatcccctcaatggccaccccttggagtcggcaggttctccttgggctgaagcaggagtcgggtgcctctcttgcctactggaaaagggaccccaagcttgggaggtctgatccagtggggcaggggccctggtgccaatgccggagaggaactggtccctgggggcctcatgtccactgggatgtcataaacccacctggtgtcctcaagacgggccctcgaaggcagggctcactgcttgttcatttggtctgaaagccttggctgcctcatgggtgccaggccccccatgctgggcactggggatgccaagggggacagatccccgcctccttcctgaaggagcctgcattgacccaggagagcagggctcacatttgctgatgtctcagtcaagagccaggccctgcactggatgcaggagctgtggttgagggcaaaacagctgtgtttctgggggacagtgtagggagatgtcagccacaggaaggaaaggcagtggggatctgggtaaataaaaccccaggggctgggtgcagtggctcatgtctgtaatcccagcactttgggaggccgaggcaggtggatcactggaggtcaggagttcaagaccagcctggccaacataatgaatccccgtctccactaaaaaaaaaaaaaaaaaaaaaaaaaaaaaaaatcaaaaattagccggatgcggtggcacatgcctataatcccagctactcaggagactgaggcaggagaattgcttgaatctgggaggcagaggttgcagtgagctgagaatgtgccactgcactccatcctgggtgacacagcaagcctctgtcactaaaaacagacaaacaaacctgggtgcaatggtataaagaggaggacgaggaaggccagtgtgtgtccagggaagcccctgtaccctggagggtggaggctagtttcagggtttggccgtccctcccacgcaggcccacccagtcctggctcctgccttctacctgctgtggctgcaactgctctggccagccaggtgacttccatgtgacccctccccaagcctgagcccccgatgtatgaaacccggtactcccacccaggctccaggccagccccatccgccagagaatggggtgtccaaaccccagaatcctggctccttgacctgtggaagacctggcaaggaatgagtgtgggtaacaagggccacctgaggtcctctgcgcaccctgctgaaaccccgtgggctgtagcacagtcatgcgtcccctggggtgcaccccagtaagagagaagtacatcaggtgctgaatgggaatgaggatggaacaaagatgaaagaccagtgagactgggcgatggctcatgcctgtaatctcagcactttgggaggctgaggcgggcggatcactgttgcccaagagttcaagaccagcccgggcaacatggcaaaaccctgtctctactaaaaatacaaaaagtagctgggcgtgctgacacatgcctgtaatcccagctactcaggaggctgaggcatgagaatcgcttgaacctgggaagcggaggttgcagtgagccgagatcgtgccattacactccagcccagcctaggcgacagagcaagactgtttccaaagaaaagaccaatacatccctttccccagcctcagttccttcctctcccaccagaatctgaagccactgctttaactgcaccattgagaatgtccctatctcccccaaatttaagcttcttaagcctcagacccttgattggatggagtacccacagatgccaccatgaacccacgatctcccacccagctgggctcctccctgcccccagagcagccccttgctgtaaaatggggtgaacagaactgaacaggctgttaccatgaggatttgagggcatcagtacagcgcttggcccagggcccgggagccactaccactctacagagtcacaggcctcctgaccataactcctatgggtgcgtgatttaccgggccagcctgcgtgctgggcgtttaggtagtttccaaccagaaggtaacttattaaagagcctaagacacgtccttctgcaggcagcccttccacaagtggcttggggtaattttcagtggtataatcacaagctcagactacgaaccctcttttttttttttttttttttttttgagatggagtctcgttctgttgtccaggctggagcgcaatggcgcaattggctcactgcaacctccgcctcccaggttcaagtgattctcatgcctcagcctctccagtagccaggattacaggcgtgcaccaccatgcccggctaattactgtatttttacagagctactgagctcgaactcctgacctcaggtgatctgtatttttagagagctactgagcttgaactcccaacctcaggtgatctgcctgtctcagcctcccaaagtgctgggattacaggtgtgagccactgggcccgaccttttttttttttatccatagagacaggatcttgctatgttgccccggctggtcttgaactcccagactgaagcaattctcctcctgcctcagcctcccaaagtgctgggattacaggtgtgagccaccacgcctggcctatgaaccctcttatatgctgggtgtgcattgtccaaagggtctttccaattgaagtggcagccacccctttggaaagcaagtgttttttgtttgtttgtttgttttttgagacggagtctcactctgtgacccaggctggagtgcagtcgcatgatctctgctcactgcaatctccatctcccgggtttacaccattctcctgcctcagcctcccaagtagctggcgcccgccatcacgcccggctaattttttgtacatttagtagagacagggtttcaccatgttagccaggatggtcttgatttcctaacctcgtgacccacccacctcggcctcccaaagtgctgggattacaggcgtgagctaccgcgcctggccagaaagcaagtgttggggtcccggcagcattggaatgatccttgctgtgaccaaccctggccaacaggccctcccttgatgcccaatacatccactcttaggctcctagaccccccgcttatcctcctgggaattgtctgtttctgatctttgcacctttggtgcttatcaatttgcatgagctcttaatagactgataacacctggtgccacagtttcaatgttcgtttcctccaaaactcacgttgaaacttaatccttgatgtggccgtgttgacagaggtggggcctttaaggggtgactgggtcatgagaattctgccctcatgaactgattaatccattcctgggttaacagatccatgggttaatagataatgggttatcataggagggcaactggtggctttgaaagaataggaagaaggggccgggcgcggtggctcgcgcctgtaatcccagcatttgggaggccaaggcaggcggatcacgaggtcaggagattgagaccatcctggttaacacggtgaaaccccatctctactaaaaaaatacaacaaattagacgggcgcagtggcgggtgcctgtattcccagctacttgggaggctgaggcggagaatggcatgaacccgggaggtggagcttgcagtaagccgagatcgcgccactgcactccaacctgggcgacacagcgagactcggtctcaaaaaacaaaacaaaaaaaaaaataggaagaagtccagtcatggtggctcacgcctataatcccagcactttgggaggccaagtcaggcagatcacctgaggtcaggagttcaagaccagcctggccaacatggtgaaaccccatctctactaaaaatacaaaaattaggccaggcgtggtggctcatgcctgtaattccagcactctgggaagctgaggcgggtggatcacctgaggtcaggagtttgagaccagcctggcgaacatggtgaaaccctctctacgaaaaacacaaaaaattagctgggcatggtggtggacgcctataattccagctactcgggaggctgagggaggagaatctcttgaacccaggaggtggaggttgcagtgagctgagatcgaggcactccagcctgggcaacaagagagaaactctatctcaaaaaataaataaataaaaataaaaaccacaaaaattagactggtgtggtggtgcatgcctgtaatcccagctactcaggaggctgaggcaggagaattgctcaaaccctggaggcaattgaaccctggagattgcagtgagccaagatcactccagcctggcgatagagtgagactccatctcaaaaatagagaaaagaaaaaaggccaggcatggtggctcatgcctgtaatctcagcactttaggaagccaaggcgggaggatcacctgaggtcaagagttcaagaccagtctggccaacatggtgaaaccttgtctctactaaaaatacaaaaaaaaattagctgggtgtgatggcgggcacctgtagtcccagctactcagggaggctgaggcaggagaatcgcttgaaccaacgaggcagaggttgcagtgagccaagctcgcaccattacactcgctgcaacctccgcctcctgagttcaagcaattctcaggtgatcagccctccttggcctcccaacatgctaagattacaggggtgagacactgcaccctgccaacccccagctaatttttattttatttttattttttgatatggaattttgctctgtcgcctaggctggagtgcagtggtgcaatcttggctcactgcaacctctgcctcccaggttcaagcaattctcctgcctcagcctcctcagtagctgggattacaggctcccgccatcacgcctggctaatttttgcatttttagtagagatgggctttcaccatgttggccaggctggtctcaagctcctgacctcaggtgatctgcctgcattggccccccaaaatgctgggattacaggcatgaaccacccagcccggacttaatttttcaaagatgttttaaagttagagtcttgctatgttgcctaagggaactcctggcttcaagtaacactcctgactcagcctccggcataggatgaaattacattcaaccctgaaaaggaatgaagtactaactccttctacaatagcacgtgaaccttaaaaacatgctcagtgaaagaagccagacacaaaataatgcactggataagattccatttatatgaagtatccggagtaaaaaaatccgtggagtcaggaagtagaccagtgggttccagggatggggagtgacaggtaatgggtacagggtttctttctggggcgatgaaaatattctggagaccgggcatagtggctcacacctgtaatctcagcactttcggaggccgagacaggtagatcacttgaggtcaggggtttgagaccagcatggccaacacggagatatcccatctctactaaaatacaaaagttagctgggcgtggtgacacgcacatgtagtcccagctactcggaaggctgaggcgggaggatcacttgaacccaggaggcggaggttgcagtgagccgagattgcaccactgcactccagcctgggtgacagaatgagactccatcgaagaaagaaagagagagagagggaaagagggatggaaggaaggaaggaagggagaaagaaagagaaagcaggaaagaaagagagagagagaaaaagaaaagaggccaggcgcggtggctcacgcctgtaatcccagcactttgggaggccgaggcaggtggatcacaaggtcaggagatcgagaccatcctggctaacacagcgaaaccccgtctctactaaaaaatacaaaaaattagctgggcgtggtggtgggtgcctgtagtcccagctacttggggggtgaggcaggagaatggcgtgaacccgggaggcgaagcttgcagtgagccgggatcacgccactgtactctaacctgggcgacagagcgacactctatctccaaaaaaaaaaaaaaaaaaaaaaaaaaaaagagaaaaagagagagagaaagaaagaaagaaagaaagagagagagaaagagagaggaatggaagggttataggtaggatccagaaagtgaactctggaaaacgtcccgagctggctgaggccagtgacccgtgttatcttgtgcgtggtgttagagaggctgcaattctgtgacaagcggtggagaggtctgtgctgccctctgggtcgctgacccccacgttgtttactggacagccaccaagaaggtgcgttaagtgccctgctcggtgcctgctttaaacaggctctcgaggtggtggcaccggtactgcctgccttgtacaaataaacgaactgcggctggggaaagtgaagtaattcctaaagttaagcctggtggccaggcacggtggctcacacctgtaattccagcactttaggaggctgaggcgggccgatcatttgagatcaggagttcgcgaccagactgcccaacatggtgaaaccccgtctctactaaaaatacaaaaaaattagccgggcatggtggcgggtacctgtaatctcaaccactcaggaggctgaagcaagagaatcgcttgaatctgggacgcagaggttgccgtgggcagagatcatgccactgcactccagcctgggtgacagagcaagaccctgtcttaaataaataaataggccaggcgcggtggctcacgcctataatcccagcactttgggaggccgaggcaggcggatcatgaggtcaggagatcaagaccatcctggccaacagggtgaaacccccatctctactaaaaacactaaaattagctgggtgtggtggcacgtgcctgtaatcccagctactcaggaggctgaggcacgagaatcgcttgaacccaggatgcggaggttacagtgagccgagatcactccagcctggcgacagagtgagactccatctcaaaaataaacaaataaataaagtaagtaagtaagtaagcctggtatttctgtgcctgctttggggccagtctctttgagacagaactgtgcacaaggtagaacggccaaagtgtcgtggctgcaaggactctgcacacagcacactgtggccacctgcccctccaactctgacctcatccaggaagcgaactccaaactgctgctaacctgaaaataaactcaactgcctgagaaaaaataaagcctctaatcttctatgaccgatctcactggcgcttgagatggcatcagattgaagttgggcctcagaagaacacagggcttctagaaggttcttccggctttttggagcttgcccggcttctgttttcagagtgggcagtgaactggggtgggctatgatgcttcagctctgtgtgggggctgacaagtgaactgctcgcctgacaggcacacccatttcttatgatgtccccagaataactccatcccatatatggaaccctccagaattctgagagagaatggctttcccccacatctgtctctaattgacctggctgccaccttctccacatttcactggtcacccagggtcctgctgaccccacatcttaaacatctggaatcagcctccttctctccagaaccctccagcactcctccggccaccagtccactttgccgtctctctttcagttgtctagatggcctccctggaggcctcccccttctcatgttgtatcttctacttgccccaggttcccgcggaaagaaggaaaaaaggaaggaaggaaggaaggagagagaaagagaaagaaaggagggaaggagggaaaagaaaagaaaggaaggaaggaagggagacagaaagaaaggaaagaaagagagaaattaagagacagagacggccgggcaccatggctcacgcctgtaatcccagcactttgggaagccgaggtgggtagaccacctgaggttgggagttcgagaccagcctgatcaacatagagaaaccccacctctaataaaaatacaaaattagccccgcatggtggcacatgcctgtaatcccagctactcgggaggctgaggcaggaggaaaattgcttgaacccaagaggcagaggttgcggtgagccaagatcacgccattgcactccagcctaggcaacaagtgcgaaactccgtctcaaaaaaaaaaaaaaagagagagagactcacgtaagtctctcagttttaaactctttcagttaaaagataaattctttgtttgtttgtttgtttgttcaagacagatctcactctgtcgcccaagctggagtgcagtggcacgatctcacctcacagcaacctccgactcctgggtccaagcgattctcctgcctttctcctgcctcagcctcccaagtagctgggattacaggcatgtgccaccatgcccggctaatttttgtacttgtatttgtatttttatatatattgtttgagatggagtttcactcttgttgcccaggttggaatgcagtggcatggtctcagctcactgcaacctccacttcccgggttcaagcgattctcctgcctcagcctcctgagagtagctggaattacaggcgcccgccaccaagcccggctaatttttgtatttttagtagagatggggtttcaccatgttggccaggctggtcttgaactcctgacctcaagtgatctgcccacctcagcctcccaaagtgctgggattacaggcgtgatccaccgcgcccggccaataaattttcaatgcccacccccttttagttccttgcggctactgtaacaaataaccacaaccctggtgacttaaaacaactattttattttatttattttaattttgttgttgttggtggtggtggtggtttttttttgtttttgagatgggagtctcgctctgttgcccaggctgcagtgcagtggcgcaatctcggctcactgcaagctccacctcccgggttcacgccattctcctgcctcagcctgagtagctgggactacaggcgcccaccaccacgccccgctaattttttgtatttttagtagagacggggtttcactgtgttagccaggatggtcttgatctcctgacctcgtgatctgcccgcctcagcctcccaaagtgctaggattacaggcgtcagccaccgtgcccagctatttattttaattttagacagggcctcactctgtcgcccaggctggaatgctgtggtgcgatcatggctcactgcagcctcagccttctgggctcagttgatcttcccaccttagtctcccaagtagctaagactagaggcacatgccaccacgcccagctaattttattttttgtacagatggggtttcaccattgcccaggctagtctcaaactcctgagctcaagcaatctgtccacctcagcctcccaaaaatgctggaattacatatataagccaccgcatccagcccaaagcagcacatttttattatcttacaatcctggggtcagaagtctgaaattagttcttactaggttctaaaatcaaggtgtgcgcagggctggttccttctagaggctccaagggagaatccatttccctgcattttccaacgtctagaggccgcctgaattccttggcttgtggccctttcctccaccttcaagccagcagtgcagcctcttccaatctctgattctgaccatcctgcctccctcttataaggaccctgtgatgccattgggtcacccacatcatccagaatgatctcccatctcttttttttttttttttttttgagatggagtcttactctgttgcccaggctgaagtgcagtggtgcgaccttggctcacggcaacctcagcctcccaagtagctgggactacaggcgtgtgccaccacacctggccaatttttgtatttttagtagagacagggtttcaccatgttggccaggctggtctcaaactcctggcctcagatgatccgcccgcctcagcctcccaaagtgctgggattataggcatgagccaccatgcctggcccatctcaaaatcttcaaccaggttgggcacggtggctcatgcctgtaatcccaacactgggaggctgagttgggagtatcacttgaggccaggagttcaataaaaccagcttgggcaacatagtgagaccccatctctatttttttttttttttaattagctgggcattatgtctgtagccccagctactcaggaggctaagccaggcggatcacttgagactaaaagttttgaggctgtagtgaactgtgatcgtgccactgcactccagcctgggtgacagagcaagaccctatctcttaaagaaaaaaaaaaagacccttaagcctgccgtgtgaggtaccatattcatgggttccagggtatcaggacatggaagtctctgcgggggatccaccagtgttttctgaaaagggcttcacagcaaatactcggggctttctagggcacacggtctctgttgctgtgtaccctacatgacataatgtgcatggtctgatgcaaaataaaaacctggggcccttcaatcataaagaacttcagaacagggacagtggaagggcagggccccgtgtgaggcagtgtgcacatccatgaagcgcgtcctgtgcaccacttccgcctctatgacagctcaagagcgtcccctggccacacacaaaggagaggcgtggctgtgttactgtcaaactttatggacgctgaaacttgcatttcatgtaattttcacatgtcacaaaacgctactgttatttttccaactgtggaaaaatcattcttggctcacgggccgccggaaaacaggcatgggctgaatcgggctgttgtgggctgactacgtgggctatgggatcacatcagatcttctctgcccgactttccagggctcctcaaggccagtgccacctcactgtgatctcccctccgaaccggcacccctgctccctgaatgatcctccctgacaaatttgtgccgttactcctgtcggtccctctgtctggaactccccacctctcttctctgcctagccgacccttcctcatggattaatgtggccccaacactgccctccatgggaggccgatctgtgcccgtcccttgtcacgttgggtggatttatgtgtccacgtgtccatcgttgcctcagggcagtgatgtcctctagaacagggacttgggctcagtcagcttctctgtctcctgacctcctggactcacaatagcttgtgctgaaggaacagacagggactgagagggacagcaagagtaccccgaactaccgtggccgattcctactccccaggatcaagactatgcttctcatttaaaaaaaaaaaaaaagcaaaacagagccagatgtggtggctcatgcctgtaatcccagcactttgggaggccaaggcgggtggatcacttgaggtcaggagttcgagactagcctggccaacatggcaaaaccctgtctctactaaaaatacaaaaaaattagctgagcatggtggtgcgcacctgtaatcccagctacttgggagcctgaggcagaagaattgcttgaacccgggaggcggaggttgcagtaagccgagatcttgccattgcactccagcctgggcgacaaaagcaaaactccatctcataaaaaactaaaaataaaagtgtaatctgctatcagcggaggttgcagtgagccaagattgtgccactgcactctagcctggatgacagagacagactccatctcaaaaaaaaataaataaataaaagggcaaaatcagataagaacttcctatctcacaatcagagcaggcaaataaagatctttgagaccaagcagacctgggttttgtttttttagaaaattttttttagagacagggtcttgctgtcacccaggctggagtgcagtggcacgatcacggctcatggcaacctcaaacttctgagctcaagggatcctcccacctcagccacctgactagctggacaacaggcacatgccagcacgcctggttaagttttttttttttttgagatggagtctcgctctgtcgcccaggctggagtacagtggcacgatctcggctcactgcaagctccgcctcccgggttcacaccattctcctgcctcagcctccccagcagctgggactaccggcgcatgctgccatgcccggctaattttttgtatttttagtagagacggggtttcaccatgttagccaggatggtctcgatctcctgaccttgtgatcctcccgcctcggcctcccgaagtgctgggattacaggcgtgagccaccgcgcccagctgcctggttaagttttaaaaatttttgtagagacagagtcttgctttgttgcccaggctggtctcaaactcttggcctcaagggatcttcctgcctcagcctcccaaagtgctgtaattacaggtgtgagccccagccacctgcccccggttccaaagattgtaaaagtgggttatttaacttagttctcacagtgccctcaggaagtgcggttgacccttgaacacacactcccccaaaacttaaccaccaataatagcccactgtcgactggaaggcttactcataacatacacagtccattaacacatattctgtattttatttgtatcatatatttttatgataaagtaagacagagaaaacaagatgtactttaaaaaatcattaggaagaggccaggcaaggtggctcatgcctgtaatcccagcactttgggaggccaagtcaggcagatcacctgaggtcaggagtttgagaccagcctggccaacatagtgaaaccccatctctactaaaaatacaaaaattagccgggcatggtggtgggcgcctgtaatcccagctactcgggagactgaggcaggagaatcacttgaacctaggaggcagaggttgcagtgagccaagatcataccactgtactccagcctgggggatgcagcgagactctgtctccaaaaaaaaaaaaaaaaaaatcattaggaagagaaaatatattcatctttcattaagtggaagtggatcataacggtcttcatcttcatcatcttcactcggagtaggctaggaagaggaggaggaggggttggtctcgctgtctcacaggtggcagaggtggaagtaaatccagctgtaagtggacctgtgcagttcagacccaggttgttcaaggatcacctgtactgtgatcacccccattttatttattttattttttgagacggagtttcactcttgtctcccaggctggagtgtaatggtgcgacctcggctcaccgcaacctctgcctcctgggttcaagcaattctccagcctcagcctcccgaggagctgggattacaggcacccgccaccacgcccagctaattttgtatttttagtagagacagggtttctccatgttggtcaggctggtctcgaactcccaacctcagatgatctgcctgcctttgcctccaatgtgctgggattacaggcgtgagccaccacaccggccttattttatttttatttattggaaacagagtctcactctgttgcccagactggagtgcagtggcgccatctcggcttactgcaacctctccctctcaggttcaagtgattctcctgcctcagcctccagaatagctgggattacaggtgtgtaccaccatgcctggctaatttttgtatttttagtagagatggggttttaccatattggccaggctggtcttgaactcttagcctcaaatgatctgcccacttcagcctcccaaagtgctgggagtacaggtatgagccaccacatctggcccacccccattttagagatgaggaagctaaaactcagagagattaaatgactcgcccaaggtcacactgctggtgagtgcagaccctttcacaaaaacaaaaaaaaaaaagaaaaagaaaagaaaagagctattgatgctgggtttggtggctcacgcctgtaatcccagcacttcaggagaccaaggtgagtggatcagttgagctcaggagttagagaccaggctgggcaacatggtaaaaccctgtctctacaaaaaatacaaaaatttaggtgggcacagtggcacacacctgcagtcccagctacttgggacgttgaggtgggaggatggcttgagcccaggaggttgaggctgcagtgagccaagatggcaccactgcattccagcctggacaacatagtgagaccctgtcttaaaaaaaaaaaaaaaaaaaaaggccaggcacagtggctcacgcctgtaatcccagcacttcgggaggccgaggcgggtggatcacaaggtcaggagatcgagaccatcctggctaacatggtgaaaccccgtctctactaaaaatacaaaacaattaaccaggcgtggtggcgggcgcctgtagtcccaactactcgggaggctgaggcaggagaatgccgtgaacccgggaggcagagcttgcagtgagccaagatcgcgccactgccctccaggctaggcgagaatgcgagactccgtctcaaaaaaacaaacaaaaaagctattggtgatctaaagatctaaagaaacaacattccagtagcaatgagcacttccagtaccccagatcctggttttcaatatcattctctactaaaaggaaccagggcccccttggagacatggctgcttctaggacgaagggcagaaatacacaagataggcctgcagcattttgtgttgccacaaagtttaaggaactgcttcgaataaaacgaacaaacaaaaaaaccactgaaaaacacattgatggggatatgtcaaagggccacaggagccaaattaaagagtggtagacggccaaagctggaacaatttgaccgacaaaatacagtagtattgggttataacacaaagcataaaataaacatccaggccaggtacagtggctcatgccggtaatcccggtaatcactgccttgggaggccaaggcaggcggatcatctgaggtcgggagttcgagaccagcctgaccaacatggagaaatcccatctctactaaaaataccaaattagccgggcatggtggcacatgcctgtaatcccagctacttgggaggctgaggcaggagaatcgcttgaacccaggaggtggaggttgtggtgagccgagatcatgccattgtactccagcctgggcaacaagggcaaaactccatctccagagtaaaataaataaataaataaatatccagcattccatcctgatataattcaatgacctagtaagtgggggagagcgagataaatctcccacgtggaaggattctagaaaacttatgtttcagctgtggacaagcttaaaaaataataataatttatgtagggccagatgtagcgatgcaaatcataaccctagaactttgggaggccaaggcaggaggagtgcttgaggccaggagttccagactagcctgaacaacatagtgagatcccagctctacaaaaaaatacaaaaagtagccagatgtgatcacgtgcacctgtagtcccagctactagagaggctgaggtggaaggatctcttgagcctaggaagttgaggctgcagtgagccatgatcacaccactgcactccagcctgggcaacacagcaagactctgtctctaaaattaaaaaaaatttatgtagacagtctacccttaaataaatagagtataaccttccacaacttaggtgtgggctacgcatagtgacttccttccacagtattaaaaaaaaaaaaaaaaaaaaaaaaaaaaaaaaggactgggcacggtggctcatgcctctaatcccagcactttgggagaacaagacgggtggatcacctgaggtcaggagttcaacaccagcctggccaacatggtgaaaccccgtcactactgaaaaatacaaaattagctaggcatggtggtgcacacctgtaatccccacgctggagtgtagtggcacaatcttggctcactgcaacctccgcctcccaggttcaagcaattctcatgcgtcagcctccagagcagctgggactacaggtgtgtaccaccacatccagctaatttttatacttttttagtagagatagggtttcaccatgttggccaggctggtctcgaactcctgacctcaagtgatccacctgcctctgtctcccaaagggctaggattagaggcgtaagccacagtgcccggccgggaccctgtctctttaaataaataaataataaatttgataggatgtatccttgatatggtgtgattaaattgatactttattaccttgatcttgctgccaaaaacgtgtatcttatgagaaaaactccagataaattccaaaagagggacactcttaccaaaatacctgaccggcactcctcaaaactgtcaagatcatcaaaaactagggaaatctgagaatctgtcatagccaagaagagcctaatgagataagagaactaaaagtgagatggactggccaggcgcagtggctcatgcctgtaatcccagcacattgggaggccgagcaggtggatcacttgaggtcaggagttcaagaccagcctggccaacatggcgaaaccccgtctctactaaaaatacaaaaattagccacgcatgatggcaggtgcctgaagtccgagctacttaggaggctgaaacgggaggatcacttgaacccaggaggtgaaggctgcagtaagccgagatcgcgccactgcgctccagcctgggtgacagagcgagactctgtctcaaaaaaaaaaaaagtgagatagtctcctgggtgggatcctgggagagaaaaaagatactagggcaacacaaaggaagactaaataaactctgaccttcagttaatagcaaagtatcagtattggtccattaactgcaacaaattatcattattaatttgttaccaatatgttactcatttgtaactaaaatatgttactaatagagaataatggtaactctgtttttttgtttgtttttaacacagggtctggtggctcacgcctgtaatcccagcactctgggaggccaaggcaggtgaatcacctgaggtcaggagttggagaccaacctggccaacacagtgaaaacccatctctattaaaaatacaaaaattagctgggtatggtggtgggcgcatgtaatcccagctactcgggaggctgaggcaggagaatcgcttgaacccagaagacgcagataggagtgagccaagatcacaccactgcactccagcctgggcgatagagtgagagtcggtctcaaaaaaaaaagaaaaaaaaaaaaaaaaaggacagggtctggctatgttgcccaggctggtctgcaactcctgggctcagagatcctcccactttagcctcccaagtagctgggattataagtacctgccactgcaccaggcctggtaactctctactactactttggaagtatttctgtaaatctaaaatttttcttttttctttttttttttttttttttttgagatagggtcacactctgtcacccagaatagagggcagtggtgcaatcacagctcactgtagccttgacctcccaggcttaaccaatcctcccacctcagcctccccagtagctgggagcacaggtgtgtgccaccacacccagcaaattttttaaatttttactagagatgggggtcttgctatattacctgggttggtctcaaactcccggcctcaagagatcctgctgcctcagcctcccaaagtgctgggattacaggtgtgaaccactgtgctgggtctaaatttttctaaaaaataaggtctttttttttttgagacagagtctcactctgttgcccatcaccccaatctcagtttaaaacgtttccttttcccttttttttttttttttgatatggagtttggcttttgttgcccaggttggagtgcagtggcgtgatctcgtttcactgcaacctccacctcccaggttcaagcgattctcctgccttagcctcccgagtagctgggattacaggcgcccactaccatgcctggctaatttttctatttttagtagagatggggtttctctatgttggctaggcttgtcttgaactgctgacctcgtgatctgcccgcctcggcttcccaaagtgctgggattataagcgtgagccaccacacctggcctatttctaggatttcacaggaggatgtccataaagcatttgccatgaaggacccacttaattcagaggacttgtcaacactataccaaccctatgctgtccactataggagcgactagccctatatggttatttaaatttgaattaattaaaaacttacgctcagtttttttttttttttttgacatggggttttgctctgttgcccaggctgaaatgttgtggcatgatcacaactcaatgcagtctcgaactcctgggcttgaggaatcctctcaactcagcctttcaagcagctgagactaaaggcccacaccatatcacctggcttatttttttatttttggtagagatgggggcttgctatgttgcccaggctggtcttgaactcctggcctcaagttatcctcccactttggcttcccaaagtgctggagattacaggcatgagccaccgttgtctggccagaaagtcagttctttaatggtaccaaccatgtgccaagtgcaaaaaaaaaaaaaaaaccctacaaaacacacatggaggccaggtgcaacagctcatgcctgtaagcccagcactttgggaggccgaggttggtggatcacctgaagttgggagttcaatactgacctggtcaacatgatgaaatcctgtttccactaaaaatacaaaaaaattagccaggtgtggtagcaggcggtcccagctacttgggaggctgaggcacaagaatcacttgaacccaggaggcggaggttgcagtgagccgagatcaaaccactgcactccagcctgggcgacagtgcaatatttcatctcaaaataataataataataataataataataataataataataataataataaataaaaatataaatataggtcggacgctgcagctcacgcctgtaatcccagcactttgggaggccaaggcaggcagatcacgaggtcaggagatagagaccatcttggctaacacagtgaaaccccgtctctactaaaaatacatgaaaaaattagccgggtgtggtggtgggcgcctgtattcccagctactcgggaggctgaggcaggagaatggcgtgaaccagggagatggagctcgcagtgagccgagatcacaccactgcactccagcctggacgacagaacaagactccatctcaaaacaaaacaaaacaaagcaaaaaatatatatataaacattagccaggcgtggtggtgcatgcctgtagttccagctactcaggaggctgaggcagaagaatcgcttaaacccaggaggcagaggttgctgtgagctaagatcacaccactgcactccagccttggcaaaagagtgagactctgtcttaaaaaaaaaaacaaacagaaaaaaacaaagagagaaaaccccatggagccaggggctactgaattggacggtgctgatatggaacatgcccattatcgtgggaagctcttctggacagcactgcggcagacaatgaagaatgtaactatttgttcagtgctctcacctcttttgggtccctctgcgaatgacagctcttcagccttcccaaccatcctctttcaaacagcaacccccacattccccatgctctttccccaatttacttttcttcttagcctgttcaccacttgacatggaaatcacttggtttctcttctgactccccatctagcactgcacagtctgatgcagtagccactggtaacgcgtgatggttgagcccttgaaatgtagccagtccgactggagatgtgcggtgctgtgctgtgctgtggagtataagatacatactagatttcaaaagcaggcaggggccaggcgcggtggctcacgcctgtaatcccagcactatgggaggccagggcgggtggatcacttaaggtaaggagttcgaggccagcctgggcaacatggtgaaactctgtctctactaaaaacacaaaaaattacccgggcatggtggcaaatgtctgtaatcgcagctactcgggaggctgaggcaggagaatcgcttgaacccgggatggggaggttgcagttagccgagatcccgccactgcactccagccttggcaacagagtgagactctgtctcaaaaaaataagaaaaaaaaagcatgcaggaaagaaaaaggacacaaagtatcttctattttggaaagataacagatgcaaaacatcctgtattttaaaatattgactacatgtttaaataataacatattcaacctactgagttaaataaaacacattacaactaacatcacccgtttctttttacttatttttaaacatggctaacaatgtaccaatttaaattacatacctcgctgacaaatctgtggcttgcttatactgtttttttgagatgtaatttccctctttcacctaggctggagtgcagtggcgggatctcggctcactgcaacctccactttccagtttcaagcgattctcctgcctcagcctcccgagtagctgggattacaggctcctgccaccacgtccagctaatttttgtatttttagtagagactggggtttcaacatgttggccaggctggtctcgaactactgacctggtgatctgcccgcctcggcctcccaaagtgctgggattacaggcgtgacctactgtgcctggcctgctttgtttatacttctattgcaccgtgatgacccagaatgctggctactataaaatttaacaattaaatgttaaatttaacatttaattgagctaggtgtggtggcacgtgcctataatcccagctacttgggagcctgaggcagaaggactgcttgaggtcaggagttaaacctgtgggatgattgcacctgtgaacagccactgcactccagcctgggcaacacagtgagacccaatctctaaaaagctttcctaggccgggtggtggctcatgcctgtaatcccagcactttgggaggccgaggtgggtggatcacttgaggccaggagtttgagaccagcctggccaacatggcaaaaccccatctctactaaaaccacaagaattagctgggtgtgatgttgcacgcctgtgatcccagctacttgggaggctgaggcacgagaatcacttgaatagggaggcagaggttgcagtgagctgagatcacaccactgcattccagcctgcacagcagagtgagaccctgtctccaaaaaaaaaaaaaaaaaaaaaaaaaacttctaagaaaatatgattaaaaaaagaaacaggctgggcaccgtggctcccgcctgtaatcccaacactttgggaggccaaagcaggaggatcacttaagtctagaagtttgagaccagcctaggcaatacagcaagacctcatcgctacaaaaaaataaaacattagccaggcatagtggcacatcctgtagtctaagctactcaggaatctgaagccggaggattgattgcctgagctggggaagttgaggctgcagttagctgtgatcataccaccgcactccaaattgggtgacagagtgagatcctgtctcaaaaaaaaaaaaaaaaaaagaaaaacaaaattgtaggccaggcgcagtggctcaagcctgtaatcccagcactttgggaggctgaggcgggcagatcacgaggtcaagagatacagatcatcatggccaacacggtgaaaccccgtctctactaaaaatacaaaaattagctggttgtggtggcgcagcgcctgtaggcccaactacttaggaggctgaggcaggagaatcgcttgaacctgggaagcggaggttgcagtgagcggagatcacgccactgcactccagcctggcgacagagcgagtctccgtctcaaataaataaataaataaataaaaataaaaagactattattttcagatcataaaaaaaaaaaagaaaaaattaggcagagtgcaggcatgcctgtaatcccagctctttgggaggcggaggcaggagaatcgcttgagtccaggagttcgagaccagcctgggcaacagaaccagagcccatctttacataaaaaaaaattaaacatgtagcttgcatgtatttctactagggcattctaggccagcgctggtttagaatgttagcccaataagaccaggtattttttttctgctcactgcccatacagtgattgacacacagtaggcgctcaatgacattttaatgaatgaatgagatgctgagccttcgggaactggcttgctcaaagagccagcaccgatgaagcgctgaccacgttccatgccccgcctcctcagcgcaccagagaaggaaactgaggcccggcaaggtgacgtcagctcctgcccaacggcacgtagtgcggaaacgtcggggccgggattcgaacccaggttctgtacccgtaaccccggcgcgctgacctttcctaccttaccgggcggcggcaggacagacaggtgcgggacacacggcgagcgctcaaccagaggcgccgctcctcagccaccgccttccgtcagcctccgagggccggaacccagttcgccccctccgcggccatcgctggctgcccgcgtctccgccggccgcggagcacttcgcaggcggcgccgaccggaagtcccgcctctcccgcgcgccccggagcgccgcgacagctacgccggccaatgagcagcgcgccgtggcggacgtcggccaatgggctcgcgcgcggggggggcgtgtccgggccgcgggccggagcgggtcgtgcgcgctgaggaggagccgctgccgccgtcgccgtcgccgccaccgccgccaccgctaccgaggccgagcggagccgttagcgccgcgccgccgccgcctcccgcccgccccggagcagccccgggcccgcccgcccgcatccaggtgaggcggtggggggccttcggcggcgcccgacggggtaggccgcggcaggcctgagctcgcctggcctggccgcggggcgcccgcgggcctgcaccggccgaggcccaggccgcgccggaccgggggaggggacgcgcgctggggccgcggcgggcgggtcggggcgggccggtgtgggcgccggctacaggccccggggccggattcctctggcgcctcgagggacgggcgagggggatacggcgtgggcatgcgccggggggccgggctgcacggccgggggccccggtcgccttggaagcccgggctccgggggcgggagagtggggccagctacgggggagcgccgggaacgctttgagcgcgcagaggtcacggcccacgggcttgctcccccgggaaatcccacagattcttttgtggtcgttgtcagagcaccgcggccggtgcgaggtcctttgagaagtgtgcaaacccttcagtagatacacgggagtcctgggggaaaaaaaaaatctaaactgcatctttttttgagcgccatctctaacaaagctgtttgtggggcgtgggacgttaggatttgtaaaatatgtgtgtgtgcctgttggaaacacaagctgcacacagttgaacaatgggggatggatgcccttccttccttttccggtgctctgggctgcggggcttgttaaaatgggttttggtccctactgtgtgcagggcaggtggagaagaacttctgcacaacttctgcatgggcttcccgtggtgggactgagcccccttgctagaaagtgttcatctaagatccggatggccagaaatgggaagatgaggagaatgatctgtctagagcagggtttctcgacgttggccctactgatgtttggggtcagatagtttttggttgtggtggtagtgggggcttccctgtgcaatgtaggaagttgagccgtattcctggcctctacccactagatgccagcagtatccccatgctccaagtcgtgaggatcaaaagtatctccaaacattgccagatggctcgggttgcgggggaggggtctcttccactctcacacgcacaggtgagaaccattactgaactaaatgctcttcctccaaaagttctaatgccctgggagatgctcccaagacctcgaacaagcttgactctgttgagccttagttttcttatctataaaatgggaaggacaaaagtgtggtgcaaattgaagagggtggaaatcccgttgcgttgtgcgtggtctgtgcctggtaggcactgaataaatgatgttgtacatagccaccagtatttattgaggatttactatgtgcttgacactttgtggacgtttgtctgcagtccttgaggcaggtgatgttataatttccattaatttccattttagagatgaagaaactgaggcttagatgggtcacttgatgtgaccagtctcatgcactaaagtggctgcgccagggtttgaactcgggccctctgattcaaaacccttactcttaaccactcgattgtactgctcctataatcacaaggctccagggcactccagttgtcatcgaatattttctgtgtgcaaagttctgtgctgggatctattatcaaattctgcaacttcgaggcccacaaagaggttgagatacacgaacgtctcaaatgtggaaggaaataatactgtttatgttgatgcattggttttgagcagacagagtttcagtctggatgtgttgagtctgagatcatggtgctatttcttttttttttttttttttgagacggagtctcactctgccgcccaggctggagtgcagtggtgcgatctcggctcactgcaagctccgcctcccgggttcacgccattcttctgcctcagcctcccgagtagctgggactacaggcgccggctaccacgcccgactaattttttgtacttttagtagagacggggtttcaccgtgttagccaggatggtctcgatctcctgaccttgtgatccgcccgcctcggcctcccaaagtgctgggattacaggcgtgagccaccgcgcccggaccatggtgctatttctttttttttttttttctttttctttttttttttttttttttgagacagtttcacccttgttgcccaggctggagtgcagttgtgccatctcagctcactgcaacctcagcctcccaagtagctgggattacaggcagccgccaccacgtccagctaattttttgcatttttagtagaggtgggatttcgccttgttgagcaggctggtctcgaactcctgacctcaggtgatccacccgccttggcctcctaaagtcctgggattacaggtgtgagccaccgcgcccagcccatggtgctatttcaagtaaaagaaatgagagaattatgaaaaaactttatgaaaatttcttgcctctctcactctccgcttcccatctcttccctctttccacactccagcaggagttctgttctgtaaatgcacatctaattgtatcccttctgatttaaaatctttgtgcagaaaaaagacacgttttcttgacctctctggtggcttaaaagataaagctagaagcccttagtttggagtgccagttccttcacaccctaaccctccccgcccctgcacgtagaccccaaactctaaccctccctgcctgttgcagcctccacctggagacagatctcttccacctggagatcctttgcttatgctccatggctcagcccagagctcactggccgtttgaagcctcgtctgactgccactcttcctccacccgcaccggaatcaactgttccctccttagtgttcccatcccattcagtttattgaatcgaattcaaggctgaatggcgagagaagcgcagcgcccggctggcgcccctaggtggcagtagcgaggcggtgcggccgacccgagctgtgggtcaggggaagaccaacggaagccagcctgtgggagggaagtgaggctcgctccctcctctgaacgactctccctgctccgctgctgtgtcctgggcccccgctaggctctggagagtgtgcatgatgtgtgtaggtcatctcagcccactctgatgagtgctgtgagaattatgccctggctgatgtggaagcccagaaaagggacctgggtgggcacaggagagcccagaatgcttcctggaggagaggaggcagtagcggtggggaggagctaaccaggcaaagacaatagggtggggctttttaggatacagccaagcccggaggtgggaacatcgcagtgttcagagaacatcgtgtgttcaaagaaccacgtgggttctttagggacaagaaggctgagatgggtagtggtggcaggagtgctcaggtgtccactgggcagagggcttggctgttaccctgcaggtaggccaggggtggctactgagcagttttagttcactgctcaccctggtggagaggctggggggagacaaggagaaaccagtcacaggctgttgcagtactgaggtggccccgtaatggctgaaccgcttgagggtcaggactgggactgcttctatattttgtatgcctgatgctttgctctgtgcctggcacgtggttgatattttgtctgtgccagggaaaggaaagattggcagactactcagaagcgactggatccaggtacctgtcaaacagacatctgtggctgggtgtagtggctcacacctgtaaccccaacagcttgggaggccaaggtggaagattgctcaaggccaggagttcaagaccagcctgggcaacatagcgagatcccatctctaaaaaaaaaaaaaattttttttaagagtgagacgtttatgtcaggggaaggaatcacaggagagggaacaatcctgaacagctcgatggccagactcatgtcaccatgaacagaaacaggcagactcaaggaaggggagtgactaggaggaagaagatgaagctgggtttagagacactgagtttgcaatcccacttaggagtcggtctagcaggaggtgacaggaatctgaatagggatggtggcagagaggtggcaggacggtgagagatctcacatgtcaaactggcaggacatggtgcttgattaggtccaagggctagagagaggtggcttgggggacaggtggggctatgccaccaaatgaagtaattcagggggcggaggcggtttgaagagagggcaaggacaggaggagaggagatgaaggtgtttgtagctgcagacagggaggttggggagacatacattcgccttgattttgttcatgaagtgggactagagacaggtactcactgtaccaggcactgtggagcaaggggtgacatccccagtggaggaagctgaagctctgggaaggggagcgacttctgcacagtagttcagctgatgagcaggagacttagtgcccagctcgggcctgccaggctccagagctcagggttttttcctgccatgccctgttgctttgcacttctgtgtgagatccctgcagtggcctttggccttgaccagccagaaagaagccagagcccttagcagggctgtggggtgcctggactgggccacaggccagccacacctgacctgctcctgccccgggcttctcagcctggctgaaagggaattgtcacttagctggagctgctccagccaggcatcctgcccttctgtgggccatgggcaggggcttggaagaagctggtgccatgtccacctgagaccttgccttgcatggcatttataactgggtcaggtggtgctttgggttttttctggcagcagagcatttcctgaatgacctaagccttttttacctggaagactcagaatgttgcatctggaaaggaccttaaacattattgggtccaagccctgtcagatgatgtgtgaagtgtcaagattgagcctgaagatagatttgactgttctagttttgctctggctcaagtggtttagaatacctgctccgtcatggtgcaatgaaagtgattctcatgcttgcctggtggaaagcagcctcactgcttcactctttttctgtcacacataaagacacacacatctctctcccctggatatgcgctagatgatcgacggatgtgaacaacatcactgatgtcacatagacaaccaggattgtttaaaatagtgcattggagtcaaaaaccttcagagatcatccaaacaagacttctcccagaggccaggcaccgacggtgactctcacctctaagcccagtgcttgggaggctgaggtaggaggatcacttgacgtcaggagttaaagaccagcctgaacaacatggcgagacacccccccgcccccgcctctacaaaacataaaaaagcggccaagcgtggtggctcatgcttgtaatcccagcactttgggaggccaaggcgggtggatcacctgaggtcaggagtgccagagcagcctggccaacgtagtgaaaccctgtctctactaaaaatacaaaaattagccgggcgtggtggcaggtgcctgtaatctcagctactcgggaggctgaagccggagaatcacttgaacctaggaggcggaggttgcagtgagccaagatcgcaccactgcactccagcctgggtgacaaagcaagacccccctctctgcaaaacataaaaaagcttagacagaactacatagaggacttagtaggactacgtagtgacacgcacctgcagtcctaggtacttgggaggcttaggtgggaggatcacctgagcctaggaggccggggctgcagtgagccgtgatcatgcctctgcactccagcctggtctgagagccagcagcctcctgtactgctgtgtgacacaccctggctttgcctggggactcttagatggcaatggtataacctgggccctcaaggttctcaccactgacattggtcattgagtgtaaggcaaataatgataggagtggttgggacagtaacaaaggtttacagcaatggcatggaggcactgagaactagagtaagtaacctgttgtcctgggggaaggtggccttttattttttatttttttgagacagtctcactctgttgcccaggctggagtgcagtggcgtgattttgactcactgcaacctctgcctcccgcgttcaagtgagtctgctgtctcagcctcctgagtagctggtactacaggcatgcaccatcacgcccagctaatttttgtattttcagtatagacagggtttcactatgttggccatgctggtctcaaactcctgacctcaggtgatccgcctacctcggcctcccacattgctgggattacaggcataagccaccacgccaggccaggaaggtagctttttaaagatgagccagcctggtgtagtggctctcacctataatcccagcactttgggaggcccaggtgggaggatgacttgaagccagcatgggcaacaaaatgagacccctgtctctaaaaaaatttaaaaatcagccaggtatggtggcacacaccagtagtcccagctacttgggaaactgaggcagtttgaggctgcagtgagccgtgattatgccactgcactctagtttggcagcagagcaagaccctttctcaaaagaaaaataagtaaaaatagaagtgagctgggaggccaggcatggtggctcacacctgcaattccagcactttgggaggccaaagtaggaggatcacttgagcttgggagttcaagaccagcctgggcaacaaagagagacccccatctctttaaaaaaaaatactaattttaaaaaatgagctgggaagtgaaggagaggacactagtgccctgcagagggaacagccaaagcagaggcctgtagcatattggcaagaagctggagtgagcgggaagggagggtggcgactgaggctggagaaccacctgggtccgattgtgaagggccttgccagtttgacagttgcattgtcatgacaacttgaggcctggccctgccacttattaatggcatgcctgaccgtgagcatcatcgtgtgaccgccgagcctcaatgggtggtgaccactgacagggaataccagaggggtgagcatcttgattgcaggacagtgcaggccttgcacctcgagagacagaagtggctacgacttgggagtcagtgataattgagtggtgacaaggcccagttgtggttggagcttgtgggatagaagctgatttggcccaggattgatgatgcagatttggagaaggtcaagggaagggcctccagagagtggggtgggggcccagaaacgtcatgaaactgctttgcagggcaggttgttggtttctcccgtgttactagttgaccaagaacttgacctgcaggggctgctcagccttgactcagagtgtcaggaggaacagggccgcaaagcagaagttctctttttaaaccttttaaaatttatttttattgtggttttgttgttgtttttgaggcaggatctcactctgtcgcccacgctggactgcagtggcacaatcatagctaactgcagtattgacctcccaggctctagtgatcctcccagctgagccccccgattagctgggattgcatacaggtgtgcatcaccattcctgggtaatttttaattttttttttttttgtaatgatggcatctctctgtgctgcccaggctggtcttgaactccaggcttaagcagtcctcccaccttggcctctgaaagcgctgggattaaaggcatgagtcgccacactcagacaatttatttttaaatttgcatgtaggaaaattcattttttcgagtagagttctctgagttttgacaaacggataaagttgtttgattaccaccataataaagattggaaagttcgctctcccacaaacagaaatactccctcctcctgtccctgtgtaatcgacttttcccctcactccctaaccccagcgaccacagatccatccctatggttttgccttttccaggaaggcacagaaatgatgtggcaagatgtgtttgagattcacacaagtagcatgaattggtgataccttttattgccaggtggtattctgttgtatggtgtatcccagtttatccatgaatggcttgaagaatatttgggttgttgtagttttggatgattatgaataatgccgctctgcacatttatatacagatttttgtgtgaatatagattttcctttctattgccttaatactaggagtaggattgctggatcccatgctaagtgtatatttcaccataagaaactgccaatctgttttccaaagtggctgtcacatttcacatttttgcattcccaccagcagtgcatgaatattctggcttctccacatccctgccagcacttgacattgtctgttttgttgctgttggttgttttttgttttattttgctttagccattctaataagtgggtagcggtgtctcgatgtggttttaatttgactaatgatgttgagcatcttttcatgtgcctgtctgccatccatatatattctttggtatagtatctgttcaaatcttttgccatttttgaaaccaggttgtttgctcattatgttgtttttggtttttggagatggagtctggccctatcgcccagtttggagtacagtggcgccatctcggctcattgcaacctctgcctcccaggttcaagcgattctcctgcctcagcctccccagtaactgagattacagatgcccaccaccacgccttgctaattttttttttgttgtatttttgtagagatggggtttcaccatgttggccggactggtctcaaactcctgacctcaggtgatccacccacctcggcctcccaaagtgctggaattccaggcatgagccagcacactagcctgcttctgttttgagagcttaaaaaaaagtgttctgggccaggcgtggtggctcacgcctgtaatcccagcactttgggaggccgaggtgggcagatgggcagatcacgaggtcaggagatggagaccatcctggctaacacggtgaaaccccgtctctactaaaaatacaaaaaattagctgggcatggtggcgggcgcctgtagtcccagctacttgggaggctgaggcaggagaatggcatgaacccgggaggtggagcttgcagtgagcggagatcatgccactgcactccagcctgggtgacagagcaagactccatttcaaaaaaaaaaaaaaaagggttctgggttgggtgaggtggcttacgcctataattctaatactttgagaggccaagatgggaggatcacttgacaccaggaattcaagaccagcgtgggcaacatagtgagaccctatctcgacaaaaaataaaaaattagccagaaggctgaggcaggaggattgcttgaacccaagagtttgtggctgcagtgagctatgattatggcattgcacttcagcctgggcagtggagtgagactttgactcaaaaaaaaaaaaaagtgttctgactacaagtcccttttgcaaatgtttactccagttggtggattttaattctcctagcagtatctttcacagagcaaaagtttcaaattttgatgatatccagtttatccatttttttttttttttaacgaagtgggcttttggtgttgtgtctgagaaatctttccccagcccaatgccacaaagatttttctccaagaaattttatgtttttacattttaaaacagaggtcggcagattttttttgtgtgaagagccagatggtaaatattctcagcttttttggccatacggttgctactacttaactgtgttattgtagtacaaaactatctatagacagacaatacataaacaaatgagacaagctgtattccaataaaactttatttataacaacaggcaatgggccagatttgtaccacaggccatgatgtgtgtttcaggaggtccacttttcccagacctagaggataccacactgtggacagtaagcctgggacagccattgtccatctcaccgtccatgaaagcagaatgagggaaaaagcaaagtagatgcctaactcttagagaaagggcgaggagaaggaaaggtaaaggaaaaaagagaaagaaagaagggaaatgcttgaattacattttgagcaagcttcaatgtgcattttaattcttcagtgttaacccttgtggtctgtttggatcagcttccagcaaatgtttttgtctgtttgtttgtttttgagccagtgatctattctaaaatctcgtggccacagatggtgtaacagacacgtggagtttctcatgattaaagtctataggtcccgagctgctactgaaagttgaaatttagccatttcccattaacgaatatttagaattctatccagttttatactcttatgaaccatgaggtagtgccttccttgcactttttgttttgttttgttttgagacagagtcttactctgttgcccaggctggagtgcagtggcgccatcatggctcatgcagccttgatctcctgggctcaagcgatcctccctgcctttgtctcccgagtagctgaaactataggcatgggtcaccatgcccactaaattattttattttttgttgagagtcagggtctcacgttgttgtccagactggtcttgaactcctgcacttgcgtgattatttctgtagaaagatcctgcagttgtgagtcagaaggttctaccatctcatactcagatcagtagcaggtgatcttgcgctggattttattccatgtgactggcagaaaatagcatctggttttcttttgcattttcctcattgttcacgaagatgaagttcagtgtctttttctggacttacgagccatttgaatttaaggcctttataaattgctgctcacatcctttgcctacttccctcttggttacgtctcttcttttatcccttaccaatttgtagatgttccgaatcaagttttcccaacctcggcagtactgacatttggggttagataattcttggttgtggggccgtcctgtgccctgaaggatgctttacagctctctgacttctacccaccaggtgtcagtagcaccccctcccccgacccctggccctgaccaagtcacagtaaccaaaaatgtctccagacattgccctgtgtccccttgggggcagaatggcccagtgtgaaaaccacaggtctaaataatagaatatgcagtgaatcttttctctaggctactcctcttcgtctaggtctgtgatgccttttgctgtacagaggtttttaatttcatggagtctcacttttcagtctttttttctatggcttttgatgctaacctactttttaaagagcagggagcataggacatcctcaaataaaagaaatgttaggaaattgtactgattttccacattgtctgagactagtaggagggtagggaagacctggatgtttctaccaggaagaaagaaaccagacctaattcttccctcggcgttgattcagggagtaggtaggaaatctccacatgagaggtgtgttcagatttttatgtaactgctggcaaggctatttttaaagaaggccaaaggcgcatgaccgtgggcactgggtgttcaaacataacagaattgagcaacagggatctggggaaagggatgggctctcaccgagacctccaggcgggtggccatccacagggatgactacctgtgtgtttagaggcagggatgaggggcctctgagaagtgagcccagtgtgcggcgcactttcagcagggcgggctcggcatacttggccgcattgatctggactcttctccaaagtcatcactggctctgatgtttatcactgaaaggaaagacttcagcaactgagaaagacatttcaaagcctgcaaactgtgaagaccaagttcctctgactggtagagaaaccctcacctctttccagctcactcactgtgtctttgggaataaacaggtgcagaggaccattgcctacctgccccctcagcagcagggtgtccaggggtggggttcaggtacaccccacaggctctggacatggggagaaagcaatcggaaatctggaattctctcgagagacaacccaaaggcttttttacaggatcttaaattgtggtgctggaattgtttgtaggtctctccgaagccctcttagtgaacttggagttgttctgttttgtgtccatagactattttttagagcagttttaggtttacagaaaaattgtggagaacactcgttctgtagcattacaatgaagtattgactgaataaaattttttttaaatagaaagaagccggacacagtggctcatgcccgtaatcctagcactttgggagggtgagatggaaggattacttgaggccaggagttcaaaattaacctgggcaagataccatctctacaaaaagttttaaaaatcagccgggcgtggtggcacatgcctgcgttcccagctactcaggaggctgaggtgtgaggatcgcttgaggatctcccaggagccttggctgctgtgagctgtgatggcgccgccacacccattattagcatctcacattcacatggtacctctgttattcttggtgaatcaatattgacacattattagtaactaaagcacgtaattcagattagagttcactctgtatattgttcattctgtgggttttgacaaacatgtattgtcacatccaccactatatatcatgcaaaatagtttcactgccctaaaaccctgacaatcccgtgttccactatttgttgtcccccccacgccgacctgcatcgctggcaaccattgatctttttctctgtagtgtgcctcttccagaaggtcatagagttggaatcatacagtgtatcacttaacagtatacatttaaagttcctttaaatgtctttcctagcttaatagctcatttctttttatcatcaaaaaatatgcccctgtgcagctgaaccacatgaatggagtctgttcattcattcacccattggaggagatcctggttgcttccaggttttggcaattatgagtgaagccgctgtaaacatccatgtgcagatttttgtgtggctgtaagttaacatgcagcatagaaaagaatctctaagtgcagggccaggtgctgtggctcatgcctctaatcccagcactttgggaggccgaggcaggtggatcacctgagttcaggagtttgagaccagcctggccaacacgacgaaaccccgtctctactaaaaatacaaaaattagctgggcatggtggcagacgcctgtaatcccagctactcaggaggctgaggtaggagaatcacttgaacctgggacgcagaggttgcagtaagccgagattgtgccactgcactccagcctgggtgacagagtgagactctgtctcaaaaacaaaacaaaaaaaaaaaaaaagaaagaaagaaaatctctaagtgcaaatgcagttactagttttgccttcatatactgcaatatgaacattttgaatttacttgctctttttctcttggcagatttttgaaaaatacaatgtctaatggttatgaagaccacatggccgaagactgcaggggtgacatcgggagaacgaatttgatcgtcaactacctccctcagaacatgacccaggatgagttacgaagcctgttcagcagcattggtgaagttgaatctgcaaaacttattcgggataaagtagcaggtaaagaaatggaggcgttttagtaaaccgggtattggtggccatcctttgggcactgtctcctttgcctgtgactctgtggcattcctcagtgcaggataactacagccttgaaacgatggctgtgaagtttcatttttatttcaaactctgtccattgctcttgtataagatcggacataagttcccaaaagaggaaaaattcattgtaagacagagagcatgtacaaaataagacagtgggaggagaggaaggaaccagagacagggcattctgagagctggaaggggctggagaaccacagcctgacctggcttggcctgggcagattgattgggtcccacgtgtggaagggaccctggcgagtgtactgtccagggcaggtgcaggtaggcctgcccctgtctgtccaggcccccactcttggtcaggcccaggtcagcagaacaccgaggaccttgtggacagcccttcgttatgtttgggctgctctgtctactgtcaacaccatcaacttgaacttctgcaccatgctgagcttgaactctcagaggggcaggagcctggcagctaaaagccctgctgttccactccctcacagtgggacttctaagcctttgtgtccccatccggaatgtggagattgtggcttctacatcctggtggtccctacctcgtaggtgtttgcagaggtcctggcacttgtgaaggccttccttacagagtggcctccattctgagagcatggcttcaaggactcgggagagaattacggacagaccatgtgcggagctctcctcctcctcctctcccaatggcccctcttcctcctcttccctctacccacccctacccccctgccttcctttctgtctccgccctgctttaggaagccaaggagcggccagtcctctcggggctctgtctgccaccctggatttggggactgtgattccctatactgaaaactcacttcaggctgggcacagtggctcacacctataatcccagcactttgggaggtcgaggtgggaggatcacttgctcagaagttcaagaccagcctgggcaacatggtgaaaccccatctttacgaaaaatacaaaaacttagctgggcgtggtggcccgcatctgtggtcctggctatttgggggcgctgaggcaggagaattgcttgagtctcgggggttgaggttgcagtgagctgagattgcaccttaccaagtaccacttggtactaaagtgtcttctacactttagcctgggcaacatagtgagaccttgtctcaaaaaaaaaaaaaactaatttaaaagttgaatgctgggcacggtggctcatgcctataatcccagcactttgggaggtcaaggcaggcagatcacctgaggtcaggagttcgagaccagcctggccaacatggtgaaaccctgtctatactaaaattcaaaaattagccaggcgtggtggcgcacgcctataatcccagctactcaagaggccgaggcaggagaatcacttgaacctgggaggcggaggttgcaatgagctgagattgtgccactgcactccagtgtgggcaacagagtgagactctgtctcaaaaataaaaagttaacaaaagtttctattatgaaacatttcaggcatacatgaacatagagtgatgtgttgaacctgatgtacccatcattgcactttatcttcaacatttccccagtaaccttaagacacctgacccccacatgactcccaaagagcctgtctggccgctctacagggaattagctcttcagatgcaggcactgaataagaaagccttctctccttccaactccaagagtctgatttaataaacgccttctcaatggggattttacacagtatacaaacttgagcagtgttagaatgttctagaagccagcatctctctcctgctccaggagaccatcctaaataagagaagggttttaaaattctcctgtgccactaacaattctcacctttttcctctttctggtggaagggaattttccttgatattcctgagcaccagagatattgcaagcattcccatggaatttgcagttattctcctgcaacctgacttctttgtctgttcccttgtggttttcacaggaatgtgagctatgctaaaggaacacctagatttggctcagtctggagagaactggttttgagaatcagtgaaggctgcaaaagtgtaatttggaaattatttcagttcggaggtgagccctgtcttatctttggacagtagttagtaactggcgcaccaggagttgtggagtggctgggcctgggctttcatcttggcccagcctcttgttagcagcccttcaagtgactggagctttacggagaacatgctgcaacctggctttgctcagcctgccgccagtgtgggcaaacctcttcgctggcagggcccggggcacggcgctaggtctcaccacccctctccccagccaacggctttctcccagcctcccaagacagcctctcacccggccaggcaggcaccccggcgaatctgatccctggcctagctcagctcacaacacgggtgtctccgagccccacagcagccatttccccgtgtttaccctcctcggtcctctgaccacccccttcaccctcagctgatgaccacctcccgcttcgcagtggaactaatagcgtctccagctctccagccccgatcctcccttcccttcccttcccggcttcccaagagcctcaggctctccaagtgcccacttttcctgggcttcgagtgtcttgaaaggaattccttccagacttccagcttcctctagctcggagttcctccacatctgtggctcctgatgtcagggctggacgccgcactggacactgcagggtgttgagcagcatccctggcctccacccacgtggtcccagtagtgacatcccagtggtgaaacccaaaaatgtcctgacattgccgcatgtcccctgggaggcagagtctcccctagcgagagccactgctgtgtgtgttggcctcccacccacatactgtcctgttccctgtctccacctccttccagaagcatcctctcccattggctttcaggagcacctcctcctcccacctgtctaactgcccctgaggccatgccccatctgtctttagcgcctttccccagcctttgactcagccggttatgccagagggttatgctcagagggttatgtcattctcctcttcttccaaagctgacactcacggtgggcagagtcacctcatggctcccagctgccctctgtctgccacctcctttttgaccagaaggctgtcctgagctccagaagccctcggccccttaaattcagtatattcctaactgacctgactctccctaaagccagccactcgtttccagttgtccccaccttagccgatggcaccaccatccacttggtagctctgctcagaaatctaggcgtgtccttggctctcatcctcctgggtgttgcttcagtccatccctttcccctctctcctcagccaccattctagcccaggacaccactgctggtggcctgcactgtcgttttggcctcttaactggcctcctatgctccctgaagaccactgtcctcactgcagcagaggggcctgtttgacagcccgcatgtgaccctgtcactcccctcctcaaaccgttcaggtcctggtcgtgtttgcttaaggaggcctcccttggcccaagtgtcagatgctccgctgtgggttcctatggcacctgggccgacctgcactgtggggtttccacctggcactgagctggagctttctggtccagcacatgagtatctctcctggagggaggagctttgttaatctccgtagccctagacatagccagtcggtgtttgcagagtgaaggaaggaatgaatgaatgagtggtgctggggatgggggagagtgcagatcatcattcagcaaatactggttgagtgccagccatgggctgggcactggtggcgggaggaaggaggggcgtgatgatggctgggaggaagggactgccccatgtgctgctctcaagactcggaatgtttctggctggcctggccctggtccctatgttggggatatggcgttggttggttgttggctgttccacccacaaacaccagctaaggaggccactgcagcgcccggtggtcctgcccgctgccttcctgggcagccctgccccagtgtctggtctctccacagtggccccatatgtccctcgggggatcagaaggagtcagccctctaccctcatggatgacctgtcatgccggagccaccaggctgcagccccattcacggcttctgtcttgctgtatatctctggtcgggttaaagcccacaccgctgcccaaggctttaaccacatcccggaggagggggtgtcccaagagggtagggacacccctgggcgcctgccccctctccccacttgctgcaccctcccccccccccggcaccccccggtcaggctctactcttgggcgcttgtgattctctgaacactgttccctctgcaggaatgtccttccggactttcccagcctgatggcttttttcttaatatgagtcatgtttgctcctcacagaaaaaaaaacttaagcatgagccaagcagaaacaaacaaacaaaaaatcacccacaatcataccgctgttagcttttgggcacatgtccctccaaatgattttctttacgtattcatggccataagcagccacgtacttctacagaatgggctcttctctcaggctgtggataaacttcccttcctgtatctggacatttttccacttcgctgaacatctcgcgatcccatcatcatcggtcgcatagtattctgcttcccatttgttgatatttgaaagccctgctgacataaatgtcctggcacaaatctttgctcactggttatttccatagaaagtcttcctgccggtgaagcggcagatgggagagcgcaccttttaaaggctcttggtccctgtcgctaactcgctctctaggggacgcttagttcacccttccttctgtccagccctgctatccgctagccttggcaggatttctcacctttgccaccctgtgagggacgagcgacatccgatcagggtgattcctatttcgagtgaagttcatcactgtttctatttagtggttgtttgtactacttttgtaaaatacccttcttgtccttcgcctgtttcttttcttttgcagacctttgctgtttcttatttattgctgaattaattcagtctccacctccagtctctgtctctcagtgaggtcttcccttgagcctttaaagagagaactcacgggacctgccctcacggtgcagaggagggcttcacccacagggcactcgccccctcagccctgcaccccgtgtcaggtcagggcgcttccagctgcaagaagcatggagggatggaagcattgtgtctggcagcataagacaaggaagcagctctccagtcttaaccctcatccaaagagagggagaaatgtgtttggaagttcgagagcactggccagtgtttgcccagtgtgggcggtgtatgggtgcccagtaaggcaaccatggtgctccccgcagaggcagctttgtcttctccaggcagcagctttcagggtacagtccctgggccagcagcagcatcaggatacttggggaaatgtgactctcagaccctgccttgtggccagaaagggtgaggaggctcttcctccagttgagggaagtgagagccgggcatgcactggcctctgggacagccctgcatttcactcccgggttctgcatcctgcattcctccctgccagtctccttcctgcttccccgtatctcccacccacaccctctccatcccatctcccatcccaggggccccgtttgccccccgagcactgacaccaggcaggcccaccacggcctgtgcaggagccaggcccctctgagcttggctccctgtcctcctgctccctcgcaaaccctcaggcctcctgtctcagggctgatctcccatctccaggcaggggctttggcaagctctgccactggtgggcaggaggagcatctgtaaggagtttggggatgtggattcccacacctgcctgacatcctgggtcccgggatggggtaggggtatctagggagccaagttgttgccttgaactccagatgcccctggtgcaggtggcttgtggaccctgcctggagaaacagtaacttgggggcccgtttgcacttctcctctggaggcctcctctcctctgcataaccatgggaagccccatgcccctcatgcactggaatcactagggagctttaaaaaccactgaggaggctgggcgcggtggcgcacgcctataatcccagcactttgggaggccaaggtgggaggatcgcttgagctcaggagtttgagaccaacctgggcaacatggcgaaaccccatctctacaaaaaattaaaaaattagctgggcatggtggcgtgcccctctagtcccagctacttggggggctgaggtgggagcatcgcctgagcctaggaggcagaggttgcagtgagccgagtcttggcaacagactgagaccctgacttaaaaccactgaggccaactggcaacccccccacctcctccttttctgacttcattggttgggggtgtcgcctgggcagtcagtggtggcttagaaagctgtccagatttgtttctattggaggcaaaggtggaggtgggtggtcaggtgctggacaaagcccttccagtgatggcctcacccagcgggtggaaaccagggcaccttcatccctcacctgcctgccttcctgctgcctccaggcacctaccacagagaggagagcagattctggggatgaagccaggccttgactcacaaggctcagcctgtagggagatcaggggcctgcccccactacctgtcctctgggtggggcattcctctactgccctggcctgtgcacatagcctgcatctcccatctggattagatcaccagcccgctggctccacactggctctgccctgctgccagtggccacttcctaggcccttgccacacgggccacctctactttctgggaatacactggcattgtctctgcctcggagacttggcacctgctcttctgtctggaatgctcacgtcagccacgcagaggtttaaaatatctcctctgcgacgggccctcctgacccctgtcttaatgcttgtcagtttctcaccaccatgttgtctgacttgcccccagggatgtgatggctttcatgatggcagcgaccgtcctctgtcatgcatcactaactcccagccaagcacagggcctgacacatagtaggtgctcagttaatgcgtcagctccttgaggacagagaagagcttgaccatggaaggtgacgggcagcccaggggtgtgcgactccctcggtgatgttggcaggtgtgggcatgtgtggtgaggaagagcatgtggcagagacaagggccaaaggtgggtcctcagggcccatgggtctccatggaatggacagggagtgaggagcctgaggagggacagccagggagacggaaacctggtgtggtttccacatcctggaggaggggtgtcccaagagggtaggccctaccctgagctgccgaaagctcaggggacacatcctgaaacggtccccagggcagtgaccatcctaggggaccagtcaggatcacccagcacctgggagatgaggaagcagggacttggtccaagcagggaccatgtttctgtgttgagaggaaccggctgtggctgaggacacaggaacgggcattggtgctcgagtccctatcagtgtgtgactttctcaagcagcacttaggctgcctgaggcgccgcagccaaggaggcaggtggtccaggcttgtttatggagcagaaagatggggcccggatgcagaaggcgctgagcacttcgagagcaggtgttcaggagtgaaaaaaacccagccaggctggcgtcgtggtcaagaatccatatcacaggaatccctgaccccagaggctgtcccctctggtcctgcccttgccatcccgagtccctcccgtggtgtccagtgagtgggtattcgcttgtacgtgtgctgagtgtgtcacaaagggggtgcagggacacctgccagtttcacactgccatctggagcacttgcagaggccctggcagtcctgacctggctgcactgctccgttgcttgttctccaagctgcgatcccaattcgctccacacgggcctggtcctacggtcttggtgctctgggttctcactttgtccagggccccagagctgagtctcttagccctgaggagttttattagaaatacgagtctagaggatctgattttggttttgttctttaggaaagagagcgccccatgcagaactaactgcacgtcatttctatagctgctacgtcagggccatgccttaagtgtgggctgggcgtcctgacttccttccgcggagggcagtgtggaaaggggtgggagtcactttacagccaagaaacctggcaaactgactgcctcggcccagtgatcacggtcagcaccagcagccataagtcacgttgacggcctgtgcccttgacatcgtgtgacgagaagggcgctccagctgtgacagactccagcaaacccaatcgagagtctacgggatgtccgaccagtcctcaaaaccgtcacagtcacgagaaacaagaaactgtcatagtcgagaggagcctgaggggatgtgactgctaaatgtcacgtgggatcctggatgaggtcctggggcaggaaagaacatgagggaaagactaaggaagcggctggggcgtggactagaggtaatgggaacattcatcgtcaccagcatttcatactcacttgcggtggtacccataggggaaactgggagggggccatatgggaacttggtattatccttgtaatttttctgtaaacctaaaactgttctgaaaaataaaattcattttaaaaagaaagtggcaaacctgggttaggctctctgctggatttgtaatcttgctgtcggtgagatggatctggatgtccctggcccagctgccaggaggatctctgcctcagtggggctccaggccacctcctgttcggtgacctgctcgttgtcgcgctctgccggctgggggaatggagcagtgctgggtgaggctcaggcccacagcagatgttcagcagccttgcaagtgcatggataagctgcgggagacggggattgcgctcttccctgtgcctcctcacttcccctttagtgagagcatttggccaaatgtcctgtgaagctccttctgaaccctgaccccagaggctgtcccctctggtcctgcccttgccctcccgagtccctcccatggtatccagtgagtgggtgttcacttgtacctgtgctgagtgtttcacaaagggggtacagggacatctgcctgtgaacctggttctcccccactgtctggcagggctggggattctcagcccctggcctctccctggactcttctgccccacagcggggtcgggctggtctcaggcttggaaaggtaaatggaactggtggtgggtggtgccagcaggccctcctgctctggacaaggaagtggcagagaaacagcagtgacacaaactggggtcccaccagcctgtccactgccgtggccttcctcatcctcaccacccaggccccacagagcggccggcacccacgggactggtctttcagaaagatgctgtccgtagcacagtatttttaaaaaatactcctttgtaaataacttttggggttattttaattacaaaagtaaaacctcttggccaggctcagtggctcacatctgtaatcccaacactttgggaggtcgaggtggggccgaggtgggaggattgcttgagcccagaagttttagaccagcctgggtgacatagtgagaccccatctctaaaaataattttaacaattagcttgggcctgctggagcgggcctgtagtcccagatactctggaggctgaggtgggaggctgtcttgagcccaagaatttgaggtggcggtgagctgtgatcacagcgctggactccaccctgggtgacagagcaagatcctatctctttaaaaaaaaaaaaaaaaaggaacctgtgttcattgcagaaaatgtacgtgtttgccaaagaaaataaagtttgctagcacctgtaatcccatttcccaaaggccaggcagatatagtgcttcccgacctccctgtccctcactcgcagacggttggcttaccaatgtcttcatgttctcttgcacaggacacagcttgggctatggctttgtgaactacgtgaccgcgaaggatgcagagagagcgatcaacacgctgaacggcttgaggctccagtcaaaaaccattaaggtaaagggatctgatcaccaccgcatccattcctgccctgggcacaggtctgtgctgagccccgcccagcctcacagtcactctccaagggactatgagcacagccgctcctcgggggctcccatcagataccctggtcaggtgtatctgacccaggccttacatgagtgtctcaggacccactccccgcccagggtgcccccaggttgcgtcagctcccaggcctcccctgtcgtctctcctgcctggctctctgtgttcccatccctggacagctccatccacccccagcctgcccagtgctccctctgcgctccttggggccagttgtaacccttccctcacccagcacctcactcagcacctactgtgtgccccacagtgaccaaaacagacaaattcagtgcccccgtgggtcgggggtgcagacagtaaacaagacagaggatagccatgtgtgaccggcagttgccgtgtgtggaggcttcacagcggcaggtgacttgaggaagccaactgtgcagcagcccaggggcagcacctccagcagggccatagtggcttcctgggatgagttgcaggtcctccaggtcacacagatggatttcctctgtcctcatcatctgacccgcgctctcgtgcactggggctgtcaaccccgagccccacttacccccgtccccacgtgtctgccttctggctcctgggttcgtgggcagctcctgccacctgtatcaagcctcgtgtctttccgacctttgctccctggtctcctgtcagtcctgggtactgctgagccttccctgagcctcccgtgccccaggcaggcccctgcaactgggcttcctgcagcagccactgcacccacccgccctcagtgcccgccttcacaagatacccacagacgtaagggcttcccggccagaatcccctctcttgctccaaggccatttggaatgaggtggtcctgtgtgagcctgtagatctgctagattcccctgccccagagaaaggtgctccctgagtcacatcaggcaccctgaagggtccctcttggacctgccaattattagggcctcctggggagctgtaacatatagattccatggtcacaggggggcctcctgagtcactgcagggtgggcctgggagcctggatttttgcctgcccaccaagaggggttctgtgacctgacagtgacagcaccttcagccaacagctggcctctgtccctgccttcagactgccccatgatcttggttactcagtggccaaaccctggctcagcagcagctctcccagacctgccccatgccgcatggacgtggtgtgcagtgggctccctgagggcaggcgcgccactcctgcctcctcgtgtccagtgcaggtcctcagaggcaccttccccggtgggggctggtgagggcagccaagcgccatgggattccacctgagcaggggcagcccttcctcgcctccagccccaggtggcttatccttggccctggactccccatctaggaattctctcccctatttagaaaatgtgtgaaggttcttgtttctgaggcagccaggctgaggtgtggagcagaacgcttgattattcctgcacagctgttccgtttactcagatgcaggagccgggtgcccagtgtgtaaacaggactgtcttgcctctctaggattgatgttggtgggaaaggctggagtggctgcctgagtttggagccagagcctcacgggaccccaggggcccaggcctgggcaggtgtccctccctgtcatcccggccatgcatgcagaagcctgcctcaccttcggcggccctgccctctgccggcagagtctgcttctcagtggcttcacaccactgtcctagttctgcagaaacaggccagcctcatggggacgtgacagccctaagtaatttctccccaggtctccccgaggctccctgggcctggctcctctagcagttcccccggcgcagccctggggtcctctgtgctccaagtgtgttcattccgcaaacctttactgagcccctggccagtgtggtgctgggccagatacgttgatactgagggacttcggatcccctgccatccccagtttaaaggtgactgatctgtgcagtgtgataagggcctggatggagttgtgcgttcaactgatcctggattttattgcatcttggtctgatgccacctggtgtcctgcagttctattctgacaccagtcacccagagttagcacagccccagcacatttaaggccacggtccccaacaagaccgccctcacctcagatgccagtcaccctttgggggaccccaggcccctgcacttttgaccagctggctacaaattcagggttcccgccaccccttcagggtgcatgactcactagaatgactcctggaactcacacttctgatgacagtttgtttataaaggttgcaactcagggcctgccaaatgaagagccacacagggagggtcccaagcacagagctcacatgtctgcacctggtgggatcaggtgcctagtcctccctgcatgtgacctgtgcacctgccaggaggctccgtggagctttggtgtctgccgtgtttactgggctcattacgaatgcatgaccgattgactctttggccatgtgatcgaactccatccccagcacccctttcccctcccccaccctggaggtcaggccggtatcgcccagctcacagccccagccgtctagtcacatgcttggtctttctggtgtcggagcccatcctgagccatcacttagcacaaactcaagtgggatccaaggccttatggtaacaaagacagaaattccaggagttttacaagcttcctcctaggaatctgggacagagaccagacaaatcctttatgacaatacgggctagggccaagccctctgccaggtgctgggggtcactggcccatggtccatcctcggggagcccagttgtgcccaccattctctgtaaggtggtcccagggtgggcttaggagcctataatagtggccagtgccagaggaggctccctcaagaaagccagagttgagatctggaggaggagagggagttagccagaccagggtggagatgagggtattctgagcagcaggacctgcaggggcacaaggcaagggccgcatcctagaggagacccagtggccaggcacatcatgggaactgcaggctggccccaagcctctgccccgctcctcccttgcaggcagggcctcctggagccttgtgctcatcctgggctctgaggccccagccctgcacagagagcgcagacgtgccttgccttcaccccgtccgctctgtcctctttggtcctgatgtcattcccttggtggcagagtggagaaggaggagtcctgtctcctcatccctatctatctttttcccatagtagcagcccaggcagccacagtgggagtggtcctgcatggaggcgacaggctgagcatgtcccagatgcagctcagtgtccctgctgggatgctgcacagtctctgtgtgcagctcttcatcactgctgggtccctgtgtgccacacacagccagtgcttatcaaaggctgacggggccagaccttccatcctgtatctcacgtgccctctccacagccccataaaaaatggtccccagattcgggttgaagaagctgatgtttcgagtagtgaaacagctctgccaaggtcacggagggatggaggggcaaagccagggtgtgaaaccgggtgctgtatgtggctacaggcacttaacattgtcacctggaggcttccccagcacattgtgagatccaagcctcaggaaccagaacagcagaactcctgtcacccacagaagccggcgccggggactgcagtgcagataggcaggcgttcttcacagcagtggctactgcgcactccactcacgcagcagcggtccccagatgcctgccgttcacctgaggctgctctgagtgctttggatatggcaggagacacacaagtctggccctcacagagtctgtttgcaaagttaaaagttaaataagtaaaatagatgccaggcagggtggtgcatgcctgtaatccagggcatttgggaggctggggcaggaggatcacttgagcccaggagttcaagtctaacctgagcaacatagcaagaccctgtctctacaaaaaaaactaaaaaaaaaaaaaaaaaatgtagcgtgtcaggtcatgatcaacgcagtcaagaactaaatagggacaggaggaactgggcgttgatgccagtggagggatctgtggcaagctgagtggtcaggagtttgctcagctgccatgacaaagccccacaggccaggttgcttcaacagaagaagggtatcaactcacagttctggaggctggaagcccgagaccaaggtgtcagcagggttggtttctcttgaaggcactgggaagggatctgtcacaggcctctctcacagcttctggtggaggctggtggtctctggcactgcttgctttagagaagcatcaccccagtgtctgcctccatcttcacacagacttctccctgtgagagtgcctgtatccacatttcccgcctttctaaattgaatttatgttttcaaaaaaaatactttttttttttttgagatggagtcttgctctgtcactcaggctggagtgcagtggcgcgatctcggctcactgcaagctccgcctcctgggttcacgccattctcctgcctcagcctcccgagtagctgggactacaggcgcctgccaccatgcctggctaattttttgtatttttagtagagatggggtttcaccatgttagccaggatggtctcgatctcctgacctcgtgatccacccgcctcggcctcccaaagtgctgggattataggcatgagccactgcgcccagccaaaaaaaaatactttttttttttttttaaagacaggacctcactcagtcacccaggctggactgcagtgatgtgatcacggctcactgcagcctcaaactcctgagctcaggtgatcctcctacctcagcctcccgagtagctgggaatagaggtatgccccaccacgaccagctaattttttttgtagagatggggtcttgccatgttgcccaggctgaactcttgggttcaagcgatcctcccactcagcctccaaaacagtgggattactggcctgcgccaccacacctggcctaaatttccctcttttataaggacatcagtcacatttgattagagatcaccctataccagtgtgacctcgtcttaactgattacatccgcaatgactgtatccaaatcaggtcacgttttgaggtcccaaggggttaggacttcggcatatgaatttggattgtggggtggggggaacacgattgaacccctcactggatgaattcttgagaatgggcagccagaaaaagacctgattgaggccaaagagcaagcgatgttgggagcttaggaaagagggttctggccgaggggccggggagccccaggtcagtgcacgcctgctgtgcgccagctgttctgattctagcctgactgaacatgacagtgtccagagagaagaggaaagcagagttcccatggtccttggagacacctgtccttgggaggcatcagagctttccccagcatttggctctagggcacttctcctctggggcttcatccagggacggcagtaggtccagtcagtgccagcctcagctccgctccactggcgccagggtcatggtttggcaggcccccaaatactgccccagtccagacaggtctgcagggagccagggcaagcccggacactaggggaggctgggggccaaggcagcctctttttctctggggacagcactggcagcccctgacccacatcatggggtgagcaagtgtccccagagctcctgtccacaggctgatggaggtgccccgggcctgggagcagcacggcttccccagagacctcatgggctccgtagtgacatgctccctcgattcccaccgctaccaggcagagctggcctccagccccacactcctctcctcgtggggctgtcctgttcccctgctgggccgcccactgccctatgagcaggggcaatgtctgttgttccttctctggaacatgataggagcttctcagaggatgctgtgtgtgtgttctcagcacgcagattctgcccagtgactcctgagtggcggcttctccctgcgttctggtctcagttaccttggctcatcagttctgtgcccctcactcaaagggaatgaacttcctttcgcacaggttcaagtccccacccttctcgggaacacatctcctgctccctcctccatatcccagcctcctgacgaggctgtgagtcctgccaggctgccccttcacaggcagaggggttccactgtggtccttttcttccttctgggcccatggggtctgcacggccgtcagcgccaacctgagaaagcaccgaagaccttgtcttgcattggcctccgggctcccctcaccaccctctccacacgaatgatgaatgtaccattttgtcaaagcacccagaaggttctcttcagttttctttgattttgcaaaatataaatccaaaaggcattgagtcgtttaatattgaacacttgagtggatttgagtacaaactcggggtcctcccagaactcacagcccctgtcagggcttctgtggcgagcttgctctttggcaggggagtctcctgtgttcccagtagctcccagcttgcttgcccgctgcagcacgggctgctttcaggcaccaggacctctctggcaccggctcactgtccagcacatcagagaggtagccacacacaagctgcgggccctcagttgctgggctttgtgacataggagtcacgcctgcctccttgaggatggtgagcacccagtgaggaagcactgccaggcatcctggctcacggcccatccctcagtgagcttgccaccatgcggctgcaggcggtgagcgtcagtgatgataatcgttccctgcatgatttctaacacacagtgttggcttttcctaacccagcattcaacaccctcctcaatgctttggccacgtgcctgtactaatctcggaaagtggttgtgttcccaaggtgtcgtatgctcgcccgagctcagaggtgatcaaagacgccaacttgtacatcagcgggctcccgcggaccatgacccagaaggacgtagaagacatgttctctcggtttgggcggatcatcaactcgcgggtcctcgtggatcagactacaggtaccagaggggccccagacgcgtggggagggtgttctctaggtgggggctgggttttctagggaaggcagatcaccgtttgattttaaatgtcattagttattccgcaaacgaggacagcaccaaaatgagaagacgttggctttggtttgaggaggctgaggaggtaagatggcattaaaagaagctggggatatctgggcgtggtggctcacgcctgtaatcccagcactttgggaggccaaggtgggtggatcacgaggtcaggagatggagaccagcctgaccaacatggtgaaaccctgtctctactaaaaatacaaaaaattagctgggcatggtggcgggcgcctgtagtcccagctactcgggaggctgagacaggagaatggcatgaacccgggaagcggaggttgcagtgagccgaggtcttgccactgcactccagcgtgggtgacagagcgagactccgtcttaaaaaaaaaaaaaaaaaaagctggggattaggccagcatttcatgtacagtgaaaacgccaagagattctagcaccttccctcaggcacccaaatgtgctggccttgcccatgaatggggtgaaaaggacactgcaggccgggtgtggtggctcacgcctgtaatcccagcactttgggaggccgaggtggacggatcacctgaggtcaggagtttgagaccagcctggccaacatggtgaagccccatctctactaaaaatacaaaaattagccaggtgtggtggcaggcgcctgtaatcccagctactcgggaggctgaggcaggagaatcgcctggaccccaggaggcggagattgcagcaagccgagattgcgccactgaactccagcctgggcagcagagcgggatttcatctcaaaaaaaaaaaaaaaaaaaaaaaaaaaaaggatactgcagccaggtgcggtggcgcgggcatgtcatcacagctgctcaggagactgaggtgggaggattgcttgagcccaggagttcacagctgtggtgagccgtgatcgcgccactacacttcagcctgggcaacagagcaagaccctgtttcttaaaaaaaaagaaaaagaaaaaaaaaggctgctgcacatttgtccactgtggctttcgttgcaggcatttggggtgcagtagtctgatggcccaaatccccagaattcggatgcccctctctggggagcacatctaaagtgcacagagcacatggcagcgaattcctctaatgggcaggcaatcctggccactttgctggccctcccagtccgtcttggcactggatgtgggctctgggctttgtgtgatgccgtcaggcagagatgagcaggggacatgtgcacgcccacggctgtgctccggccctactgcctggcccgcctgccgcactaggctaggaactagtgccccaccacatcctttgccaagccctgcacgtggccccgcctgggggacagggagctcgggccaccctgaggggatttaggatcgctcagctctgtttggggcaggagcaggagtctgctaactaaccagcagggaagaatccactccctgagcctagtgaggcccatgcgttgtatgggtggttttcatattcttcccacacagactgtgtgtgccgcaccttggctgtgatgttgaaataacaccgagtagttgggccacagaaagtcatgctctgaggtgacctctttttgagagaacagcagcactcccccagcagcccagagcctcgcctttcatgtgcacacaggtggggccttcctggcctgcaggctagaggggcatgcacattgtcctgcgtcccctgagctgcgtgctttggggtgggcggccttatcagtctctcttcctcctcctttccggctgtaggaaccccacctggcatgcactggccctgccgctgccggccttcgttcccgctggggcccgaggaggggaagggcccctttgcacttcatgggggccctgggagcttcctgtagcctagcacagactcgcgccctggcaccgggcagtgccgaaggacagggctcactcgcacggccgccgccattctgcctttgctctggggagagggtcgggggatgccagttactcggtgtaaactcccctggtctgcaccagaagagtctcctgtggtccctgaagtcctctcacttaagtgccagctgagcgaatgatcctgtcagtgggccagtgtgtgggtttattgccccccattctgcactggggcatctgagctggctgtgcagggcccagggccgggggaaccaacctcactggcccacagtccactcccctcctcctctagaccccacatgcactgctctgcctcggcctgtctgtgtccagtatggccctgatgagggaagcctgtgctccacttggagcccccaatgcctgagaacatgcctccagccacccaactctcttggggccttccctagtctctcaggcacacacgggccacaggcagggggaactcacctctgcacacagctgctgggggcattgcttcctttccctctgcaagatagtgtctcccagggtgttgggggcaccttagtattgcgcccccagggtcggctgtgaacctcaaggtggcctaaggaacctttgtcatctttgcagagcagtgagggaggcagagagaagggagccaggagggtctcccggctctgcttcccaccccaggatgcagaattggtgggaaggtgaggctcccatcccagggctgtagctccctctgctggagacagagtgtgtgtggcaggccagcctgtgtggagtttgccttcctgtgacgggctttttagtgttaaatagatgaggatggccgggcgcggtggctcacgcctgtaatcctaatactttgggaggccaaggtgggaggattgcttgagcccaggagttcagaacagcctggccaacatagcgagacccccaactctttttttaaaaaaagagaaaaaaaatcccaccctgagctgacagagcttaattttttgtattccttcgcttctatatccaccttaattgtgaactttatagtgtattcatctggagattatgccgtttcttggactctgctgttaaattctaaaaaacacaagggggccgggggccgtggctcacgcctgtaatcccagcattttgggaggccaaggtgggtggatcacctgaggtcagcagttcgagacctgcctggccaacatggcaaaccccatctgtactaaaaataggccgggcacggtggcttatgcctgtaatcccagcactttgggaggccaaggtgggcggatcacgaggtcgagaggtcgagaccatcctggccaacatggtgaaaccccgtctccactaaaaatacaaaaacttagccaggcatggtggcaggcacctgtaatcccagctactggggaggctgaggcaggagtatcgtttgaacctgggaggcggaggttgcagtgagccgagattgcaccattgcactccagcctgggcaaaaagagcgaaactccatctctaaataaataaataaagtaaaataaaataaaaattagccaggcatggtggcaggcgcctggagtcccacctactcgggaggctgaagcaggagaatcacttgaaccggggaggtggaggttgcagtgagctgagatcgtgccattgtactccagcctgggcgacagagcgagactccatcttaaaaaaaaaattaaaaataaaaaacactaggggaagaaaaaaacaaaaaatgcagagccatcttcagaaagtatacatccattaaataattgagtgaattgatatccccctctgctaaacagcatccctcctgccccccttactagagctttcttcctttcactcaggcagtttgcatttgaaagccactctacaaccccagacgaggaagccacacttgcacacgtgccttctctccgctgggccgcagggtctttagaaacagaatgaagccatctgcttggagccagcttccctacgagccggccagcgtcagctctcagtcgtatttgcctaaagttcgattttcatttaggtttccaagactgactaagctgtcattcgtgtcgtgagagactcaaagaaaacagcatctgtcagggttgtgttttcaggtgttccttctgagcagcagctcagaaatgagcttgagccccagaatattcctggcacgtgtgcgtagcgctaggtctgaccttactaaagctgctgtctctgtgctcacggggggcctgcagtgtcgcgattgtgggggcagctggcgggaccctctgggaagtggtggagtaaggtgccgtgtgaggcgtggagacaggacatggggacagttgggtgcccgctggacaggtcacccaaggccccgggctgcctggctttggtcgttgtttgttaccatgcaccagaggcctttgcctggagaagaaacctgacttaagacaccctttgactggaagtctttctttttccttaagaggtgagatcttactgtgttgtccaggctggtcttgaactcctggcctcaggcgattctcttgcctcagcctctggagtagttgagaccacaggcatgagccttggcctggcttgactaaaagtcttgagaaccagggtgtttgggttgggctgtctgtgacggcctctcccactgggacacacccgtgactcccgcctagtgatgtcactctcagactggcctctcagctgtcacctctcccacccctgggccttcccctgactccatcatgtccttgcccccagagaaggagctagtgcgctgctcagtgtgccctcatccccatccccctcatccagtttccagcccgcttcccaggttcctcaagggacgggctactcatgtttccctcccgggcctagtgtatggacaggcaggggtgcaggacagccatgctctccttccacccgccttgctcagcatctcacacccatgcccagctgaccaatgtcccccatagcaggacggtcctcaggtctcacactgctccgtccagggattgggtttagccgggaacccgggactggcccttgggtggctcagttgaggtggcaagagaagatgccctctgggcttggctgctggggccctggcccttcccatacagggaccccaggcctgcctggcgagcctgtggataggttcagctctgctgtatgagcctgggcagtgttctggcctcatttgattctgatggcaatttggggcccacgggaggggtgtaggaccttagagtggagtatcccaagacaggagtgaggtgacagcagcagcatggagctggcagggggtggccacaggaccctactccctcctggcatgaaggagaaggcatgcaggctgagctgggcacctttgcagcaggctcggccacgaggcctgctgtcacagcgggcccagagacagcagccaggagagtggcccctgagcccagggaggatctctcagacgcagtccccactccaaccctgttacccaccaaccacacaccacacccacgcacccactctgtggcggacacctggcagctaaatagtgacggtggatgtgctgtttcctaatgttgctttcttccaaataagaggcctgggtgtctattggggatgtctgtcaccaaaatatctttgggcgccaacactgtggagtcatggcttcagccgggaagaaagtctgaagctttaatcttctgttagtcattggttttctttactccatccatttgttttcacttttaggtttaatttttgtttatttccttaaccagacttctagcctggcccacagtagactgacctgacttttgcttttcagttttgaaagtcctagcgtttttccccctaactccgtttttgttgatttgttgaaaaggtttgtccagaggggttgcgtttatccggtttgacaaacggtcggaggcagaagaggcaattaccagtttcaatggtcataaacccccaggttcctctgagcccatcacagtgaagtttgcagccaaccccaaccagaacaaaaacgtggcactcctctcgcagctgtaccactcgccagcgcgacggttcggaggccccgttcaccaccaggcgcagagattcaggtgggtcgggagggtgcgcgctcctgaaagccatacttagccccgctggcaggcgacggcacagccacagaatagaaaccacggggatgatagactgatcccgtcagagagcgcgtttcagaatcattctgcagctccacaccacaacctccatcagaaaggtgtctgtaggaaagccgtttacttccgattgggcgttgtctttcatgggaatcaaaacagtgactccaggctggacacagtgacttatccctgtaatcctagcaccttgggtggctgagagaggaagatcgattgagcccaggagttcaagaccaacctgggcaatattgcgagaccccatctctacaaaaaatacaaagctggccaggcatggcggtgcgctcctgtagttgcagcaactcaggaagctgaggtgggaggattgcttgagcccaggaggttgaggctgcagtgagttgtgatcataccactgcactccagcctgggccacagggccagaacctgtctttttttgtttttattaaaaaaaaaaaaaagacagcaccagtccccaccagttgctgtgagcgtgagcacttagagcttcagcacgcagttcctagtaacagcagaacggagccgcgagctttaaagatggtttcatgcccagtgtgggggagcacacacctgtaatctcagctctcaggaggccgagttaggaggattacttgaagccccgagtttgagcagcctgggcaacaaagtgagacccctgttcctacaaaaagtaatgaaaaaaactgggcatggtgatgctggcctttagtcccagctactcaggaggccatggtgggaggatcgcttgaacccaggaggtggaggctgcagtgaactatgattgcaccactgcactgcagcctgggtgatagagtgagaccctttctctaaaaaataaatgaataatgaacgtctcatatctgtgggagaaaagatgctgccttaggtatactcgggtgagagtagatcttccagcattcttagacatttgatcagcagccctaaggcaaacctttttcaaacacctgcctcgtggagtcatttgtattggtgaatgttgtatgtatgcattctgtttataagccctgtcctagaggggaggagttttcccggattccttagtctttccatcctgaaaatggttctggctgccaggatgaagtgggatagaggcgatgagagtcagggccttggactccaggatgtggtgtgctgtcgcctcagaaacagcagaggtctcagtgtcagggctgttttgtttttgtcaaaacctcaaggagtggcatcgagggcttatctcaggtatgacaaggatagatttcccttttttttttaatttttaatgtttttattttttgttgagatggggtctcactgtgttgcccaggctggtcttaaactcctagcctcaagtgatcctcctacctcagcctcccaacgtactgggattataggcgtgagcccggccccatcgttgttttaacagtgaagctgggtgggcgctgcccagtgccacacatgctgctgtgagaggtgttattctcatggctgagttacccagcattctcagcctggctcaaattccaaagctggcctgccttccttgaggtttctggcttgaagacaaggctggggaagcttctctggacggaatggagctgaattttaaaatccagctctagaaatcccatcatacagtcggtcctgctcttgatggggcgggctatatgggcggtggggttgggtgaactgctccttagcctggaaggaaaacagggaaggttggaggagacatgggactctggtcccagtaatgaggacaagaaaagaaaggggaaaccggagaagtggacatttctggtcgagcaggaaaagtgagtggcagggcaaccactaagacaaagtgatggaaggaagtggggagggcgggagagtctggagggaaagattcgctcaggaggctgagagaagaggaggaagaaagacccagactgcagtgagtttgcagtcagtccctatcacgtccagaaaagcccagagataagggatggaaaagaattgggttggaggaagagaggagaagatttatgactgtcaagaccagagaaatcagcaggagaaaaactaccaacaagagtaattcctaagaaggccgggcgcattgactcacgcctgtaatcccaacgctttgggaggccaaagcaggaggatcacttgagcccaggaatttgagaccagcctggacaacatagaccctttcttcttagtctttccatcctgaaaatggttttacaaaaaatgtaaaaattagccagcatggtggcacacacctgtggtccagctgctcaggaggcaggaggatcacttgagcctaagagtttgagaccatactggacaacatagtgagaccctctctcaaaaataaagaaaatcaccgttgggctagtgagctgccccatggcagctggtgtcctctcgtgtctgtcgagagggtgaatctgtttaacagcgcttgaaggcactcgtttaccccggctggggcctgcagggctgcgcttggctgatagggccatagcctgaagcccagttttattttggagcaggtaatgcttctctgcatgcatcacgcagcttcacagatgccggcttcacaaatgtatgctactcagatattcccaaactgaccctcagacctttacttttttaatgtgagaaagttccagagggaaacatagctttaggaactgttttgtcatataccttaatccttattacagcatctgtacattttcagaaggctttattttattttagtttagtttagtttttgttttctgaggtttttgtttttttcctagagatggggtctctctgtgttgcccaggctggtctcaaactcctggcctcaagtgatcctcccaccttggcctctcaaagtcctgggattccgtgcttgagccaccatgcctggcccagaaaggcttattttttatgtaaataaaagtatcactgtggaaagagccccacgtgtgtggtcaagtttggtgagcctgccgttgctggtgtcccagggcccttccctgtcccttgagttctcagtcctcagtggtttggcccctgaccctcaggggatgttgagctctagccacagagggttggttgcctggtgcttgggaaggaattcttgtgccctacaagtggccctggcaaaggcgtgctctaaccagagaccactgggctgtcaacgcttgggggcgggtcatgataaggggaaggtgcaaaatttggaaaaaggagttcagcccctgcacgtaccccacagtacgaggagagtttcctccagggagaactgaggctgtcagaggcctgcagagcatttctaccttcaacggaggaccaggagaagcgcccatcatctaaaatgtggggaaccgcaggaacccctaaacagaaaccccgacatacacagtgggaggagtggagggcaccaaccagcccctcagagtcagctccctacagaacagggtcccgcccctccactactgtatttaattcctcccagggttttgacccatgcaggtgtctcaaccgtgagcacctcgtggctgcgcagagcgggatggggcccagcggccatggtcagcatgcgtccaggccttgccccatccccaggccgcctgcgctgaccgtggcctgacgcttgctctctgtctgccaggttctcccccatgggcgtcgatcacatgagcgggctctctggcgtcaacgtgccaggaaacgcctcctccggctggtgcattttcatctacaacctggggcaggatgccgacgaggggatcctctggcagatgtttgggccgtttggtgccgtcaccaatgtgaaagtgatccgcgacttcaacaccaacaagtgcaaagggtttggctttgtgaccatgacaaactatgaagaagccgcgatggccatagccagcctgaacggctaccgcctgggggacaaaatcttacaggtttccttcaaaaccaacaagtcccacaaataactcgctcatgcttttttttgtacggaatagataattaagagtgaaggagttgaaacttttcttgttagtgtacaactcattttgcgccaattttcacaagtgtttgtctttgtctgaatgagaagtgagaaggtttttatactctgggatgcaaccgacatgttcaaatgtttgaaatcccacaatgttagaccaatcttaagtttcgtaagttatttcctttaagatatatattaaacagaaatctaagtagaactgcattgactaaccagtccctctggatggtggtgaacctgaagcatgctttaacctctaagactgtctaacacgcgtttcattcaatgtctccacagactgggtagcaaaaaaatcaccttttagttttagtttttaatctaaagatgttagacagatgctgagtgtgcgttttctcaaccgcttcaacattgtaagcgatgtatgctttggttgacaggaagttccttttccaggcaggtcccgttgccacctcctgctcactcagtcccgggctctgccgagtggtcctgggaatggcggcgggcccgtccagcgtgggccaccactggggccgggggccacgggctgcatgctgggcgggccctccagagaaggacacaaacgtgtttcgtaagcccaggcaccaatgggaatggaccaaagagtttcagggaaactccagtatattccagagtcagatctaagctccaggcacgcctgaagatgtgttgctactctgacatcccgagtttctgtccacacattgcatgcacagcgccccacacattggatactgttgttcacgataatttctcccgttttccagagcatttaacatagcttggaggcgtaaaatggctctgtattttaataacacagaaacatttgagcattgtatttctcgcatcccttctcgtgagcgcttagacctttttctattttagtcggattttgttttggaattttgcttttgtatgaacactcagcagaaaagtacttacttcttgccagttatctattaaccaaaacctttgatttgtagttttaaagattaaccctcaaagttctcttcataactgccttgacattttgggttgttctgttctgttaattttcttttgcttttttgtgttttttgtttgtttttacttttgcatttaagaccattaaatttgattttgttttgctcgaattttgttttgttttttattttaccttttctttctttttggctagggaaggtgcaggtggcccagcattcagggaggagtcgtaagatcttaagaaaccaatccttgcctcaagcaaaagcatttctgaatctgtgacgcaagaatgtgcagttacaggctggtggcttttaaaccaggagcccggaggaagggtgaaagagaaagcctgtgaaataggcagggccagatcacccaaaactcctcaggactgggatctggcgtttataaataactagtttacagagagaatcacaaacaggataacttagtaccagcagtttttaaccttgacgtgagactaaaacgtgaccgtaggctgttttttagttattgctctcatgagatgatggctgtatttatctgtttatttatacctatttatgtatttatttattgaagtgtgaaattgagcaataggcaggcaccaccgtccccagagcaggtcagcgtctcgagaggcccctggacaattgaggatgcccatcccctcccctttccctgatcttttactgaggggctgtgtgcgcgatccttgcaaattgatgatgttgccatccgtacccaggctgtgtctcataaaagtcggcctggtgccagagaggacctcctttctcccacagaatcccagatcctcaggaaaagccaaaaccgaggcccattgcccggattcgacacaaaagagggtccctgctctgttgcccgagagcagtctgcatcctgggaccagaatgctttcctggaaaaagaagcctttcaggtttccctgggccagcatcttctgatggaaggtgggagccaacacccttctgatggaaggtgggagccaacacccttctgatggaaggtgggagccaacacccttctgatggaaggtgggagccaacacccttctgatggaaggtgggagccaacacccttctgatggaaggcgggattcccgcttctgaaactccccctggagtctcactcccacacatgcccatagctagcattcaacagagaactctgtcttaagcttcaactgtgaaaatgatgacgggcttgtagcacctcagcttctttcctcgcccccttttatctgaatcctatcaattattctgatgctgggacaggtgagaagaaactgtgaagtatatgagcctttgaaagttccctgaagtttctcagttcaggaacattctcattgtatgtggtctccgctgtttgaacagccttctagctaaaaaattccaaagcctttatttgggagtcttagcttgcaagcttgtggaaggatttagcttaacaactgtcactcctgaaaagcaatctctgttccatcaaggttctagttgctggccctgtgtcctcaaagttcattacatcttatcaaggcctgtttgcaaaggggagatcccttttcttaaaaaaggctcaacccaaaagaaaccatttcttaaaaaattttacatagatcagttgtatttctatttagcaaaaatgagtgctctgcttttatttgggaatttcgatgaaaaagcgttcagagtagataatgttcatttatcaaaaatctggtttgggaaataccaaagaggctttgattgaattcccttttgacccgtgtgtaacttcctctggtagttagaccccaggcagctccgaatttgtgaacctgcttcctgatgaattctcccttgttcccccttggctctgccattatttcgttttcagtgtaatttgccaagccgcagttttctgtgctggctgtgcctctagtcgcagctctgtgactgattccctcccgggtgctgagtcccctccccggccaccatcctgcgtgaatatcctgaaattcatgggcttcctcgggggcccgcccgcaggtggtgctgggtgggttccgccaccttctcctggaaggtgagccttttcctggccaagggcagctgccttaacctctgagagtctgcgcttggccttagtcctggagacccagcctccagggactgaaccgtgctgctgttgggagccaagaccggccctttggagccggcagcccaggggtccctgctggatcagagaaatagaagcacccgaagacggttagtggcaattccttgacccggtttgcttccaaatgaaggccatttgtccaccaggcattgaaaagacatgacttacccagtccggcatcggacttgaaaaatcgaaattgacatcactcagctgttacatttcacatccgattcagcccccttttatttccatgtgcttttcgcagccttcctgtgttggatgaaagagaataagaattcagctgacaggaggcctctatcctgtccctccaccccaccctccacctcaatcccctcccatcttccccagacctacctcacctactaggacctgaggcagctccttagcagagacccctggggtttagctgactctgggggtcaggggttcctgtccccaaacttcgcaagacagccctgaagtcacaagtgctttcttttaagtggcattggcaattggcgtgtaatgatggcagtagaatctgaatctcggatcccaggcagggttcacatttccaaacctttttgatttcccctgacctctaatggctggatcctatttttctacaacctttcagtgacatcgttcaggtttctttcttggccatttaaaaaaacaaattttttttttctcacttgtaagtcaccgccagtacctaagttaggctaacggagactttgacaggactggatttttcttccaccagaagagaagccttttccgttggtttggggccacctctttgaccatgaccatgtgatgttccgtttacagtgacttgctttgggggaggggaggctctcttaaccgattcccatgttgtacagtagatggttagaccttttgtatattagtgtgttttaagttattgatttgttttatataaaataatttatttttcaggtgccatttttcattttaactttgtttttacatgggtttgttttcaataaagtctgacactggtgtccaaaagtcaacaataaaatgaatcccattgtgttcttttgaagatgcctatgtaacttttaagctttttaaattattttcagaaaaaaaaaaagaaaagcccttatcagttttccatcagcccattgcctttttattttttttttttaatccttgtgaataaatgttctttagtgttttaggaggaaaaagcaaacctagattttgataacccagaagacttcagattaataaagaagctttgaaagaagaccatttttcaaaattttagtgaagtgtgaatattttttgtcaatggctttctcaaagagaatgaaacttttgcaccattttcagagtttttatagagatgccaaattgatatatttacatgtaatggaaacatgaaaaagttttattaaacaattgttcatagctgtgtagacattttaattcagtttccaaagctctcaaaaaatcgtatttttgaagtacggagtgatgcggtttggggcgtggcttacagttccaacgactcaattgtcccgatactcagttctttctacaggtatcaggttcgtgttaaacgctgtatgttaactatgactggaattctgtgatattttggtaataaatgaagtgggatcattgcg

SEQ ID NO: 35963 - DNA, 100435 bp, Homo sapiens
gccgcttctcttccccttccgtgggtcagggccggtccggtccggaacctgcagcccctttcccagtgttctagttcgcccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgaggtgagttgcattgtatgagcgaagagttgtcagctctcctgttcacagattttgggtcaactgtgaggccacagcgctcatcttggtttctcttacaatgtacctacataatgttgaaaggtacatcgtgaattgggatgctaacccatcctgattaggtatataccctcagacattctttaaaatttcacacatctgcttcaggaaccgtcgaaggacctctgaataaaatggaagtgggttccaggagaagattaactttaaacttagaggagtgggttttactttcgctaaattttccccaatttaaaaataatattcagtttttctatctttagatatatatgtatgtaaaatattttttgtgtatatatatttgtggtttgatcttaaacttgaccagaaactgccttagaatctcagaaattgactttgcatgtggtatgctttgtttgtatggcattttaaaactgcggagcatatagaagataattacatatgcattgtgcatattagaaactgagatttctgtttcctttagaaagaaattcctgttcatggaattgaatcaacagcgaccataccttttacacagatatataattcaaaagttcagttctacaaacgtaaacttttggagctatgcagttcagttactgcagcatcattgtggcttgtataattgttgaatctttccagaaatgcttttactttcatctttaaagagttaatttagaagatttttttttatgaggtcggtatggaaataactgcgtccctttgtgagtcactacaaaataatatttgttcagttcaggagtacatatgggagttaaagtgcttgtgtataaattgttgactttcatcttaaaaggtgctgctgctattcagtgtcttgttctataatatggctttaaaaaccatgtgtgtgacctacagatattttctcaacttgaatatgcgtatatggcctctggttaatacagacagccactgttggcagaattcatcacagattgcatacccttcccaccccttactcccctcagcacctcgaaaactttgctgctttacttgaatgatgagtcacattattttaagaagtcaatatgaatgtatagtacctacatttttacttggaaattgtacttcagtatgtgttatcagtcatacatagctcattaagaatgtaaatatttaaactacttttggatagatgtggttcaggggaacagatttgttgatgttgtgggtttgtgttagtaaattggctattttccaggtcatgttagtggtaggctttccatttcctgttgtgacatgttggtcataattttcagacggctcaggaagccagatttgatctctgtggtgggtcttatatcaaagcagtatcctgtggggtttggccactatcgctgttttgtagaacttccaacttagtttggtagtcaaacttgtcagcagtgatctaaaatgtataatattttataataagtgttaatatttgttgaatgcattctgtgttttcaggctcttttccaagtaatttttgtgaattatctcaattttcacactaaccccacgaagtaggtactttcactaatcccgttttacattcgtagaaactgaggcacagaaaatttaactaacttgccctacagtaactgtcagaactgagactgaagcctgggagtatgatttcagagttcctgctctctgctgcaccatagtgtagtttagaatagtcaaaatgctagagaaaaacaaggagggacgtggcttgtaggttcaattataaaagcaatgtaaaattacagagagtctgggaaacagtgtttttaaaaggaatactcataatcttactactctaataaacattttaattttttaaatatgcacattcacatctgtacataaacattgtagctgtgattcattttggttcttaaagataaatcttcagtgaagtttaatatggagattgaaccccactgcctcactttcattgttgaaatccagagagatttgatctgcaactttgactggaaccaagttaaataaatatatttcttgctatttcttgtgagaaataatcgaacagtttctgtcttttaaaatcatgaagactatttagttttcaaagtttctgtcttccacagcaactttttattggtttattgttttatctttcttccttgttataatctgagtgttatatttgtatgtgtgtttattccgttgtcctcttgaaagcctctagcatttatacccgctgcccctgaggaatttgggtttttttgtctgtttttatttatttttaattgacagataatcattgtgtatatttatggggttcaatgtgatgttttgataaatgtatattttgtagaaaggttaaatcaagcaaattaacacgtccatcatatcacctacttgccatttgtttgtggtgagaacgtttaaaattaacttttagcaattttgaggtatatagtacattattattaattatagtcaccgtggcatgcaatagatctctaaaacttactcctctaactgaaacttggtattctttgactaacctctctcctttcctttttcccccttctccctagcctttgtagaccaccattctgctctctgcctccctgagtttgacttttttttttagattttacacatatgtgagatcatgcagtatttgtttttttgtgtcttatttatttcacttagcattatgtcctccgggttaatctacgtttttgaaaatgacataattttcttccttttaaaggctgtatggtattccattctgtatatatattacattttctttatccattcatcatagatccttttagatatctctaatatcgaccttaaatgcagaagatgaatcactgtattggaagaaagaaaagtaatcctataaaatcagtttaaaattaggtcagtatagcaaggattagatatgttgattttactttgggtactctgagaacttgatttaaactgaaccttgcccagtgctaatgtaatcagtagaccacactaattcctatggtatagtagtgactttttttttgagatagactcttgttctgttaccccagctggagtgtagtggtgcaatctctgctcactgcaacctctgcctcctgggttcaagcgattctcatgcctcagcctctggagtagctgggattacaggcacgcgccaccactcctggctaatttttgtctttttagcagagacaaggttttaccatgttggccaggctggtcttgaactcctgacctgaggtgatcgacccgcctcggccacccaaagtgctgggattacaggcatgagccaccgtgccgagccaatttttgtatttttagtagggacagggtttcaccctgttggccagactggtctcaaactcctgacctcatgtgatctgcccacctcggcatcccaaagtgttgggattacaggcatgagccactgcactgggctggaatacatactaatttttagaaagctattacagcatccctcttgaggaaaatgtataatgtaatttatgctgaagtctactgaaagctgtagggcctatacaaatataatggcattaatacaataaaaactgtgttcatatttattataatttctggtacattgttagctattctataaatgttagtaaatgaataagttatgttgaaattccttttcacatttttttttcttttgtttgaggctcagtcttgctcttgttgcccaggctggagtgcagtggcgcgatctcagctatcctcagtctctgcctcctgggttcaagctattcttctgcctcagcctcctgagtagctgggattacaggtgcccgccaccatgcccggctaatttttgtgcttttattagagacggggtttccccatgttggccaggctggtcttgaactcctgacccaggtgatctgcccacttcggcctcccaaagtgctggaattacaggtgtgagccactgcacctggcctcttttcacgtttcaatctgtgactagtacttagcacagtttttacaatatttatatgaaaatgctccttacatacaaatggctagctcagattttcacctctctgccatcgttgctcttgagacttttgttccatctctctagttgctgacattgacaatctttttcttctttcacccagtttatatccacttttctttttagcttaacagagagttgactgacacacctttgggaattagatgtggtcctcagctgtacccagtcagtctcctttatgggagagacaaaactttgttgggaaccatgaaaaattagtgtgcatatctcaggctgtggatcctttcgccacccatttccatggttttcctatttttgctcccctccccaaattctggtggcatattgcttagtgtttgcagttttggggctcaggtcagtgtaatggaggtaaccttctttatagtctgacctggaatagaaactaaagcctcgacatataatcctaaagttggaaagaacacgctggtcttgagttctgtgagttgcaggagactgaaatttgtttctgccaactgttttcagttaatcaagttggaaccttagtggatatcttagattcttctttaccattccctatatcttattaattaccaggtcctcttaaatatttcttcaaactctctctgcttctcaatattgatgtgtcttagtgagcagggtaaaatcacagccaaagtattttttaattctctcactcaacacaacaataattaacacagaagacttctgtgaccagatgcttgggggtttctccccccacagcaaccaaccagttagttctgcagcagataccaactgggtgccccccggttccaatacggtgtacctggaggtagtgtcagacaccactggttgagggcagttcccaaaagacttcccccacttccagtgctaatcgcaagccccaggttattttgattttgcctgtgcttctgataacactggctataaatcagggatcccatgacccccccactccttacgtccttgggttcaattaatgtgctagagcagctcacagaactcagagaaacacttaccggtttattataaaggatgttcaaaggatacagatgaacagatgcatagggggagataggggaaagagcatggagcttccatgccttcccatggtgcgccaccttccaggagcctccaatgttcagctatccagaagctctctgaatccactccttttgggtttttatggaggcttcattacataggcacagtcaacaactgtgtagaaatgtgattggacaaaaagagtatgacctaacagcactaatagacccagtggggaaacccagcaaggcctgcctgtccaacttcttctgcctgtctgcagcattccttcttccagggtctggggcaagctcccttctaaagggaaggtcttatgacccacagtcagacaggctgtggaagattagagttctgccttgggttggtggaaaggagggcaggaaaaggtcagcaagagaagagattctgttttctgaggtttaatgtgccccaacattatacaaaagactgtagtaaggccaggcacagtggcttacctctgtaatcccatcactttggaaggccgatgtgggcggatcacttgaggccaggagttcgagaccagcctggccaacatagtgaaatcctgtctctacttatataaaattaaatttaatattaaaaaagaatgtaataagagctgtgggacttataaaccaggaaccatggatgaaaaccaatatatatcatatcactcttaattcagttatgccctatcttacgtttagaattgttcagacgtctagtctcatctccagcttctctatctgtagtccttcagtctcttacccttcttatctggctttcacactgctgctagtgttggcttactaaaattcatgtctgatcatgtgatttctctaaagttcttcatggtttcccctgtgtatagatgagtatgtaagtttcttagtgtgacacatgaacccctccccttcatgatctggcctatgtctgcctctgtagctactctctggtcctttacctcttacataagctacccaagcaggttttactatgatgcttttatgctgttgcgcatactttttttgtgtgtgtgcctgtattgactttttacctcacagcccaattaatttatcctaattcttcaatattttgctaaaatattccctctattaagtgcttacggactgtgtgccagccagcttgcttacttttctcaggtttatcaaatacattgtatgtacctctcctgtgatgtgtatcataccatattgttgttacttgttgatgtctgtcaccttcactgccttaggaacagaaaccatatcttattcattaccctagcatctggctttgtgcctggtacatgctaagtgtgcagtcaatgattatcaaataaattaataaatgactccaaaaactagctttgaatactagataaatggtgatcctgtaaactgagataggaaaagtaggaggacaaggacttttggggcaaatatttatttagtttaggtcttgttgagttttagctcttttacaacatcaaggaagacatgtaccatttatttcttatacatttgttatttattcatacaatataattaacccaacaagattttttttagatatggacaagattattctaaaatttacatgaaaaggcaatgaaaaagaagaataaggtgtgaaagatcaatctactcaatttcaagacttattatgtagttacagtaatcaagactgtgtggtatgggcatagataaagacacagatccgtggaacagaacagagaactctgaaatagatccacataaatatacctagtttttgtcaaaagcatgaaaacagttcaacggaggtagataactttttcaacagttggtactggagcaattagacatccatacactgtcccattcccaaccccccaataaaggaacctcaacctatgtctcataccctgtgcatgcacaaattaaaatggatcacagactgaaatataaaaatattaaactataaaattttaggaaaaatagaagaaaattttggggaggtagggttaggcatatgtttctttgacttgccaccaaaagaatactccttaaaggcaaaattgataaattaaacttcatcaaaattaagtatttttgctctgttatagaccctgttaaaaagatgaaaagataaactagagaggggagaaaatatttgcagacaacacaactgacaaataactagtatctgtaatatataaagaactcttaaaagtcaacagtatgaaagcagtccagctagaaaacggacaaaagacatagtcatttcactgaagaggattacacatatagcaaatgagcacataaaaaatgttcagcatcattacccattagggagatgcagattaaagcaacaagatactaccgtacatctatcagaatagctaaaataagaaatagtgacaacaccaaatgctggcaacgaggtcaagaaactggatcactcatacattgttggtagaaatgtacaatggtacagccactctggaaaacaatttggcagtttctttaaaaaacaaatatgtgactactgtatgacccaactattgtactctgacatttagcccaaagaaataaaggctattcattttcaaaaacctgtacatgcatgtttgtagcagctttattcatagtcaccaaaacatagaaacaagccagatgttcttcagtgggtgaatggttaaacaaactgtggcatatctgttatcatagactactctgataaaaaggaaggaactattgacacatgtaacaccctggatgaatctccagagaattgtgctgagaacaaagagttaatccccatatcatatcatttatataacattcttgaactggcaaaattattgaagtagaaaacagactatgggttgctaggggttaaggagggatggccataaaacggcaacatgagagatacctgtggtgatggaatattctgtatcttgactgtatcaatgtccttatcttgattgtgatattgtactatagttttgcgagatgttcccattaatggaaactgggtaaaagatatacaggatttttttctgtattatttattgtaactacatgtggaaccacaattatctcaaaataaaaatttaattaaaaaaattgaacatctactgtgacacattttttttttttgaggcagatcttgctcagttgcccaggctggagtgcagtgagtggtgtgatctcagctcactgcaacctctgcctcctgggctcaagtgattcttctgcctcggcctcctgagtagctgggattacaggcactcaccactatgcccggctaatttttgtatttttagtagagacggggtttcaccatgttggccatgctggtcttgaactcctgacctcaggtgatctgccctcctgggcctcttaaagtgccgagattacagctgtgagccactgcgcctggtctaatgtgacatattttgctaaccattgagtatacagtgttgagcaaaaattgagtgtcagacctcatgacacgttctacaatggcagacagatattaaataatcacagaaataaatttaatattcaactgtggtaagtgctgtaaaagagagctataagaactaataatgagaaaatttgatccagatagtaagtgggtcagcgaagctttgcttactaactgcatgactttgggcgagttatttacatgctttgtgcctcagttcctcatttttagtggggacaataatagcacctattctttaaggttgtcatatatttaatatgaatattaaatgaatgaatttgtaaagggcttaagatattgcctagcatatagtaagctctggttaagagtttgttaaataaagggatacttgatgtaagaccttgtaagaaaaatgagtaggagagttaattcttttttatttttacaatttcaacttttattttagatgtgcaggtttattccatgggtatacagcatgatgctgcggtttggggtacagttgtacccattacccaggaagtgggtatagtgctcaacagtttttcagcccttgcttccttccctacattgcccgcgctggtagtcctcagtgactattgttgccatctgtacatctgtgagtacctgatgttaaagctcccacttaaaatgagaacatgctgtatttggttttctgttactgtgttaattcacttaggataatggtctccagcagcatccccattgctgcaaaggacttgattttattctttttatggctgtgtagtgttccatggtgtatatgtaccatattttcttttctttcctttttttatttttatttttttttgagacagagtcttgttctgtcgcccaggctggagtgcagtggcacgatcttggctcactgcaaactctgccttctaggttcaagcaattctcctgcctcagcctcccgagtagctggaattacagacacctgccatcactcccggctaatttttgtatttttttagtacagggtttcaccatgttggccaggttggtcttgaacttctgacctcaggtgatccgccagccttggcctcccaaagtgctgggattacaggcgtgagccaccgcacccagcctgtaccatattttctttatccagtccactattgatgagcacctaggttgattctgtgtttttgctattgtgggtagtgctgtgatgaacatataagcacatgtgtcttttatgtagaacaatttattttcttttgggtatatacccagtaatggcattgctgggtcaaatggtatttctgttttaagttctttgataaatctccaaactgctttccacaggggctgagccaatttacattcccactgacagtgtataagcattccatagccttgccagcatctgttgttttttggctttttaataatagccatcctgactggtgtgagatggtgtttcattgtggttttgatttccatttctctaatgattagtgacgttgggcattttttcatctgcttgttggacagttgtatatcttaatttgagaagtatctgttcatgtccttgcctactttttttgtttgtttgttggagacggagtcttgctctgttgtcgcccaggctggagtgcagtggcgcaatctcggctcactgcaagctccgcctcctggtttcacgccattctcctgccccagcctccggagtagctgggactacaggcgcccaccaccacgcccggctaattttttttgtatttttagtagagacggggtttcaccatgttagccaggatggtcttgatctcctgacctcgtgatccgcccacctaggcctcccaaagtgctggggttacaggcgtgagccaccgcgcccggccgtctttgcccactttttaataatgttgttttttgcttgttgaattgtttgcttcttgtagattgtagatattagacctttgtcagacgttagctagattaacagagaaagagacaagatccaaatcaccacacaatcagaaacaacaaaggtgacattacaaccaatcccatggaaatacaaaagatccccagagactattatgaacacatctgtaaacacgaactagaaaatctagaggaaatgggtaaattctggaaacagcctcccaagattaaatcaggatgaaattgaaatcctgaacagaccaatatcgagttccaaaatggaatcggtaataaaaaatctaccaaccagaaaagccctggaccagatgtattcatagctgaattctatcagatgtacaaagaaagctggtaccaattctactgaaacgactccaaaaaatgaggaggggctcctccttaactcattccagcttcaccccgataccaaaacctggcaaagacacaatgaaaaaggaaaagtacaggtcaatatccctgatgaacatagatgtaaaaaccttcaacaaaatattaagagagtgagttgttaaagagaagagggtatgatccaggcagagggagcaacaaaggccttggggcaggagtcaggaaagagcttgataggactgagagattgaaagatcagtgagtctagagtacttcaggaagtacatacttctcaaagtaagatatacaactggccaacaagcatgtgaaaaaatgctcaacatcactaatgattagcgaaatggaaatcaaaaccacagtgagacaccatctcacgccagtcagaatggctattaaaagaagctggggccaggcgcggtggctcaggcctgtaataccagcaatttgggaggccgaggcgggcggatcacgaggtcaggagattgagaccatggtgaaaccccgtctctactaaaaacacaaaaaattagccgggcgcagtggcgggcgcctgtagtcccaggtactcgggaggctgaggcagaagaatggcctgaacccaggaggcggagtttgcagtgagcagcgatcgcgccactgcactccagcctgggtgacagagcgagactccatctcaaaaaaaaaaaaaaaaaaaaaaaaaagtgctggggaactagcaggggttgggctgcatagaactttttctgctatattaaagagtttgtttcttaagggtagcaggaaatgattaagagatgttaacatggaatggagagagattatgagcaaacttactttttggaaaaaaaaactgtgctggctgcagtgtcatcagattcgaaggaagcaaaataattgcacgtagataatataggaatttattaggtaaacgaggccttattactggaagttttcatagtttatctctgattattattattactttgtttgagacagagtctcactctgtttcccaggctggagtgcagtggcataatctcagctcactgcaactgccgcctctctggctcaagcgattttcatgcctcaggctccttagtagctggggttacaggcggctgccaccacgcccggctaattttttatttttaatagagatggggttcaccaccatggccaggtgggtcttgagctcttgacctcaagcgatccagctgcctcggcctcccaaagtgctggaactacaggcatgcgccaccacacccagcttatctctaatttttataattttgtaagaatatatttacaagctactgtgtatctattacaatgttttgaaatgattataagtatatttttggtgattaaaatggaaaaggtgactttgcattattttttttaaatatgtaaaatttcatctgctgtgttagagtctaaatagccttttgtgcccaagcctgggaattgggtttagaacctgaaaatatttaacactagtgttcagatttccttctgttatatgtcctttatgctactatagaaatttgaatattttatagcagtgctgttcaataaaagtgttagtgctgcaaatgcaagccacataggtaatttttaatttttcagtagccacattaaaaaggtaaaaagaaagtggtgagattcatttcaaatatattttatttaacccaatggatctaaaatatttcaacatgtaatcagtataaaatttctagtcaaatatttgacatcctttttaaatattaagtcttagaaatctggtaggtattttacacttagagcacatttcagtttggaccagccatgtttcaatggctcgatagccgtatgtatgctggctgctgcatcagtcagtacagctctataggtttctgggttaatacgtggaatagttttttttttttatcttaagttatcaaatttatagaaatagaaacccatgcaggcctgggtttaattggtttatttggagcagagttgcatgcttgtgttacaaagaatgatctgcaggctaggtgtctcaaaggtattatgaaattaatttttttaacggaaatagttaaatttccagttaccacttacgatttttgagagacttttagggataaaatggaggagatatattggaatttgctgattgaagtattaacacataaaaaggtttaatgattttacagagatttcttagtgctgtgtagcctctagctaatgttcactgaaatgttatcatatgtattaagcccttctattctgtaaagaaataaaaacagagtgtctgtgttcttcacaaaaatcttagcatacatgctttgatacatcaaaattaaatgattcttaagctattaatgtttatgtttttaaaagccttttggtaattttctcaaaagccacataatatttaatttgtttgcctctatggaactgcagatttcttagtatgaacaactactttcatactttcctattgttttaattaatatactctaacaaatctcatctcagtataatatgccatctttggtagcgataactataaaacattcataaagttgcaaagcagcaagtatttacatttttcttttttaatttgctaattttggttattcctccaagaacagtttaatactcttggagagaggatttttttttaaattgaaaactgaatacatttctctttttgacctcattaattgaatagtttgacatttgttgttcttacactgtgccagtcattatgccagatgtggagagcagaggcatgctctcaaggagctctcaaaacttcacctttttcaaagtgatctttaagttaggaaatttatataatctgtttaaaagatatttattgtcagtaatagtctagttttctaaaacttcataaatacctttttgttattaaagctctttgaggttatctttccatttgcagaaggaaaatttactgagtagaagagattgtcttaaaacactccacgtcttcagtgttagaattcactgctagaattcatcactggaattgaactgtgcttactttagtcttcatctgtcattttctgtgtgtacttactaggccatatctgctaagtcttgttttacaaggcttactggtttgactgcttttatgactgcatctttcaagtcccacccatgcagcttaaaagtctattactaatgtccccatacttatgttgaactcttattttggtgttgagtaagtaagtggaggtatttaaaaatcaaactagttaggagtaatacagatttaagaatatggagagtaagaacaatgaaaacatacccttttttgatttgttgcctgttaccattttatcagtggctaatgtttgaccataggctctgaagatttaaattttaaaaggatgaaaggagaatgaaataaatattttaaaattttttaattgtagtatttatttttaaaatcaggttgtacttacacctcttacacctgataaaatattcaaaaggggcagtctgtctttcaaaccttgtacttcagccatcttgttccctaccctttgggcaacttacttggaactctctcctgagacaaatctatacatacacaagcaaaaatgtaaatatacgttacatttttcaacttaacaattggagatctacctggagaaattcttcattcttttttacaactgtataatgagaataaaattattacctcaccccaaaatacttaataaaggtaactattgttacagtgaatacgcttaattttttttagcacatagatcataactttccttttgtgatgttaaactagatgatttttattgtatgtttgaaaaatgttaaaactactttttcccccccacagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggtaagttcagcatgacagcctaatgtttgtattcatgaatatccactaataaatatgtacactattttattgaggttgaatttttcagtaactttaaaaatttgagatcaaatttacataacataaacttaaccattgtaaagtgtggaactgagtggcatttagcaggttcacagtgttgtgcaactaccgtttctatctcgttccaaacattctcaccaccccaaaagaaactactacatttaagggtaagcttttaaatataatgtaatacagagaggtgtgcaatcatcacatcttagtgtggaaattgatgaattcctacaaagtgaacatttattatataactactcctcaatcaagaagtaaaacattaccagtagtttcagaatccttccttgttccaccttcagtttcaatattattttgatttctatctagattaattttgcaagtatttaaactttatgtatgtggaattcatactgtgtactcttttatgtctgtggcttttacttacgtttcaaaatcatctatattgtcgtgtatagcaatagttaacgtattttcattgttggtgtagtgtcccattgtgtaaacatgcttcaatttatttagttattctacactgatatttcattatttggttttttttttttttttcatattttggctattgctaacagtgccactatgaattgtcatgtgcatatgttttagtgcacattatgtacacagttctgtatgatttatatcacagaatggaatgcttagatcatagaatatgtatatctcagcattatcagatactatcagagatacttccatttcttttttttttgtcaattaccctattcaaagatactaccaaagtggatatagcatgtacatttctactagcaatgtgtgagaatactagttactccacatcttcacctatacatgataacagtttttaaaaaattggctattccagtgtggttgcagtagtctctcattttggtttcaatttatgtttacttgatgatttatgagtttaaatgcctttttgtgtgtttattggctttttagattgcctcttttaaagcacctattcagtccttttccctgttttataggagttcattatgcattctgattatgaatcctttttcagatacatgtacggtattgcagttatcttctctcattctgtggtattttttttactctcttaaaggaatcttttggtgaagatatcatcaattctaatgaaatccagctaatcttttcctttattctaagccagtctcagtcacttatgcctgcaatcccagcactttggaaggccgaggcaggaggattgctcgaggccaggagtttgagaccaacctgggcaacaaagtgagactctgtctctacaataaaaatggaaaagaaaaaaaattagttttgattgcaccactgcactcctgctaggcaccagagcaaaaccccgtctcaaaaaccaaacaaacaccaccaccaccaacaacaacaacaaaaactttttcttttcctttattcttagtgtttttttttgttctgtttaacaagtcttcccatacctcaaggtcacaaagatattctcctgttttgttctagaagttttatttttgtgtattcacatttagatctgcctacctgcagttaattttttaaatatgatgtgggttaagagttcagattcatttttttcccatatgaataactagttgaccccacaccatttgttggaaaaaactttgctttttctaatgtactacagtgacatctttgtcatgtatcaagtggctatatttttgtagatctgtttctggactttctactgtgttacattgaaataattgtcttatccatatgccaatgcccaggatatatatgagttttgttttttaaatttgtttttgtcttttattgatttatagtctgtttgcatttaacataatcaccaatatgtttggtttcagaccatcctctatttgttttctgtttgtcacatctgttctttcctctccccttatttctgttaccttcaaaaccttgttatatgttctcttactttttgttcagtaggctaccctagagattattacatgtatccttgatttattagttctaggcattggtacttttaccacttcatggaaaatgcagggacttcagaatactttacctctttttacccctttctgcttccttaccattttctcaccaggaaataggtcaagaatgaaaatggttgagactattgggttttacctttctttgtttcacttcttttcagaatattgacacttcaagttctggctcccttggatatttactggtttaaaatacaatattttgctgttatttgtcatttgctgtctttatcacagattttttttctaattttaatgacaaaattataaacaagaaaaatacatatattcataatttgaaacaggtgaaattaatagcatacccattttttctgtgtttaaatagctctttagccctttatgtgaggcagaaaattaactccaggaagtagaaagatataggaagagctgactccttccaccttcccacgttgccgtcaagtgctggtgatgtctttactcatggtcttcaacaggagagagtgccaagcagtaaggatggggcaagggcataaaaaggatctatttgtgttgctcttttatcagggaggataatttttctagaaccttatcattagacttccttatgtgtcactggccataattgggtcacatgcccaccccaagactgataactggcaaaggggaatgaaattactgattggttaggacaattatgattccttctctgaaattaggcactttaacatgcaaacaagaggaaggcccaattagcaagtataaagttggaatgactatagcgtaggcaaccattggtgttttcttttctttttttggagacagagtctcgctcttttgcctagtctggagtgcggtggtacaatgatggctaactacagcctttacctcctgggctcaagagatacttgtgcctcagccttctgagtagctaggaccacagttgcacaccactagacccagctaattttttaaaattttttgtaacaatggggtctcactgtgttgcccaggctggttttgaacttttaggttcgaacgatcctcttgccttggcctcccaaagtgctgggattacaggcatgagccactgtgcccagtctattggtagtttatataaagagtctgtcctcaaagttagtgtagttgaaggtataagttgtggagtagcagtcaaaaataactgtgtgagttttaaattcggtggtacagattccaaatgttacatgtcaccaaaaaaagatatcattttgatatccctttagaattgggaaggttgtaaagggaagataatgcatgaagatccagcaatagggataattattatatatgtgaaacagtgaatgtccttttttaagacagtgaatattctttctttcaacatagctgatattcttctgttaacagtagcagggaggggaatgtcttggaagaagttggagcctcacattaggtctctcactatgggttaaggcagatttcagaggaaaaaacttatttctgtttctgctcagtatctggggagtatggaagtggttagtaagtcaagcagtaattcttcgtgactccatatctttttagcataccaaaaaataactattaccagaaggtactgatagtgtttttttgaatatgtgttgaatgaaaatccatgatgttcagtggctttcaagttggtgacctgaatttacatcctggttctgtcacttattctctctctaacttttggcaagtcacatagcctgtttatacttcagtttattcccacgtacaacatagtagtaaactcctaaataataaagtctttaaatgattgctctgagaattaaatgcatatagagatcttaacaaataatgcatatagaatccttagcagtgtgactggcttatggtaaggtaaggactcactaaatagtagctgtttctgttttcttctagattactttccctttggatatgttagactctgtacccccaacgtaagcagttttcttttatgttcatgttcaaatgagatgtcagtaacatctctactagtattaatgaaaagctgtagctctagaactcaaatatgacatctggattaggatttagcttgtcagagataaactgctttggaatctactgacttcagtagatatctgttgcatagcccttgctttgaaagtaactatgtgtacttaataatctcaaaaatgtaatcaatctgctcagagtgagtgctaaacaatctagagtacactgattaaaaaatagaagttattctgtataatgatgactagtagtatcagtcagaaatgtcagctagcaaaaagctgaaaaagtaggcctgaaatgtgtttatattaggtatatctaatttgaatgagtcattttggtcaataattcagattccatggaaaatgcaaaatttttttattgcaagtaacaggaagggagagccaagattttgttgccagagttgtattcattaaagagaaccatatggctcttgactcattgaaaatgaagcacatgactgttcatgagtgcagctttagaattattcttataatagatagtactatcttcacttgaagtaagagaagttattgagattgactgatggggtaaaaactgtgatcagccatgtttaagcaaattaactttcagtagttaatttatgttgataacgtgattatgctagtaagtttaaaatttaggcgcctatatccttttttatcacacctgaaatgtttacttgacaacatcaagggtctcccaggtttctgattatgtatagactgagagggaaatgtgagaggagtaagagttgagagggctcactcctaagtgtttgatttcctatctatacataactttaaaaaataaaaataaaaacagccttggaagctgggtgcctgtagtcccagctgcttgggaggctgaggcaagaggattgcttgagcccaggtattcaaggctgtggggtgctatgatcgcacctgtgaatagcccctgcactctggcctaggcaacagtgaaacccagtctctaaataaaaataaaaaacctttggaaatactaaaatgcaaatgtgaggttttctgatttattgggaatcttggggcatgtgataactgggaatggaatccagagaaattacatagattattatattctacttcccatatatgtaacattctgagcttcagaactcagaaaccacatagtagacgaggctcagaggtggactgtcctggtcaaggtgttgtgatcctaccacctgtgctaaaacttaagctaccttctgagctattacaagagattccagtattttcattcaaatatctattgttagattgagctttattcaaaatatttgtaagtttattcatctggtattcttctgggtggcatattcataactactgcctacacaagacgtttcaaaagaagaagcttggcaaagtagatgcagagtgataatgccagaagctgagtggccatctcttagtgtgaagacacctcctagagtgagggtacacaacacaaatacagggtccagcctttcctcctgtaaacgcagaaacatggcatcaacatgaaactagctgtctctaagaggcggattcatattaactagggttttagatctcattaggtaaaaccataatacaaatgtatttatagtgagaaatatactaataatctacttcattccaaaaaaggatataaagcaacttaaagggataaacagaattcaatcatttgcataagtatctgacacagatgaagcaaagggaaaacaacttgaggtgacgtaaaatgtagatatgagaccaataaaagttaccaatatacattttaaaatttatttttttttttaactttaaaaaatgttttgtagagatgggatctcactatgttgaccaggctagtctcaaactcctggccgcaagctctcctcctgcctcagcctcccaaagtggtgggattataagtgtgatccaccatgcccgatttaccagtatacttcttgagaggagactacaaatttgcctctaaacttcatagcagcaagtaaataaaagaacctgtttagttaaatgattcaaagtgtttataaaacaaaaacctaaccaattgttcagcagacaccctattactaatattaagataaatctccggtgacattatgaagtgtttactagctagtgtatgaaacagtgatttttaggaatatgcttggagtaagcagtaaaatttcacagggctttgttttttgttttttgtttttgagatgggatctggctctgttgcccaggctctcttgccagacaggggtctgactctgtcacacccagtggcacgatctcagctcattctaacctctgcctcccaggctcaagccatcctcccacctcagcctcctgagtagctgggactacaggtgtgcaccaccacacctggctaattgttttgtattttgtttgtagagacggggtttctccatgttgctcaggctggtctgcaactcctgggctcaagcaatctacctgccttggcctttcaaagtgctgggactacaggcgtaagccaccgtgcccgtcctcacagggcttttattattaacattcttcaatatctcctacttgaatcacaagattccacaatgacaccattattatatagtataaacattgattatttgtgatgttctggtaggattcataggtgtattttagactatcttcgaatagatggactgtatagagagtttcaggaggtcatcaatgtatattttttctgaggtttgatatatattaggtaacagtgattttagaattataacagagctatattataaaagagtatattatttacatttagctagtttttctttagcaacagaacacaacccagctgaatgtaagactgaatagaagccaccagaagtcatcttaatgaaaagtaaaggctatgccaatgggcaaagtcaggagtcttcattcaaaataaaatatatatatatttttgaggcagagttttgctcttgttgcccaagctggagtgcaatggcgcaatctctgctcactgcaacctctgcctcctaggttcaagcaattcttctgcttcagcctcccaagtagctgggattacaggcacgcaccaccatgcctggctaattttttgtatttagtagagacggggtttcaccatgttagtcaagctggtctcaaactcctgacctcaggttatccacccgcctcggcctcccaaagtgttaggattacaggcgtgcaccactgcgcctggcctcaaaataatttttttaaaaaaattcagggtctcattctgtcatccaggctggggtgcagtggcatgatcacagctcactgcagcctcgacctccatggactcgagtgatcctctcacctcagcctcccaagtagctgggactataggcatatactaccacacccagctaatttttaatttttttgtagagatggggtatctcactatgttgctcaggctgatgtcgaactcctgggctcaagtgatcctcccatctcggccttccaaagtgttgggaagctgtctggctcacagtggtgaatacaagttttccaaaatttagtttttgcttgagagctcaaattttttttattggcaacaatatactgtcagttgttttacttgaaaagacaggttgagaaaatgtctggcaaaatctttagcctaaataactaaagtgagtgtgtcagtttttctttcaaagaaaaatggtgtaccatgaaaaatgttcagcccacaactcaaatattcagataagtgcttttcctcaggacggaacattgtacaacagtatgagcgaaagtgttctgttcgttctttctactttgttacacagaatattaaaaagatgtgtactcaagagttgtgatttaataaaatgaatacttactgttttatcaagaacatttggaagtgaaacaggcttttgttttctgcaaattcatgttgatgaaaaatataacaactgcttttttttttcttttttttttttttgagatggagtctccctctgttgcccaggccggagcacgatcttggctcactgcaacctccgcctcccgggttcaagcaattctcgtgctttggccttctgagtagctgggattacagatgtacaccaccacgcctggctaatttttgtctttttagtagagatggccaggctagtcttgaactcctgatttcaagtgatccgcccgcctcagcctcccaaagtgttgggattacaggcgtgagccaccgtgcctggccaatacaacaagttctagtaaattttggtgccactgttttgatttatgctagatatcaagctgtcttcctcactattgcttttgtactataaatgaaaggccaatacaatgaacaagacaaagaatgttatggtctgcttaataatggccatccccacacccgaattcccaaaacctgtaaatatgttacctttcatgttaaaatggactttgtgattaaatatctagagatggagtgattatcctggattatctgggtatctctgatgtaatcacaagggtccttaaaagagggaggcaggaggatcagagttagtggtagcagacatgataatggaaacaagaagtcatgtgagaaaaaggccataatccgaggaatgaaagtggcctttggaagctagaaaaggcgaggaaacagattctcccctgaagcctccaaaaggaacactgccctgctgacacaccttgatcttagacttctggtctccagaactataagaaaataaatttgtgttgttttaagctactaagtttatggcagtgtgttacgataacagtaggaaacggacacggatatcttagtattatcgaaagtgttgtttttaaccttgtggacccctgagaaagatttttggggtctctcgacaattcttgaccacactttgagaattctaagataagctagctgccaaatgcacactgggtacatgaataaggtgacttgttatattgtattaaaaactttaagagtgaagggtttatataaaaagggtaaaatctacatatatgatttcccaattctcttcaaatattatatacacacacagaaaaaacattggaggaaaatacaccaaaataatgtgctttttcttcatgatggaatttggggatttataatttttctttatactttcagtattttccaaattgtcagcaatttggctgcagaattagaaaactgaatttaaacttccaggtcattccgaggtatatttgtatataggatagaacatattaatagtttaaacttgatgtataactaaatattttgtccatatggtaattgggccttctgttgtactattgccctggcccttgtaaatgttaggtttgagcttgtgcctggctgtcatttttccaggtctttatacatggtcctttgtctagaatactagtagtattccaataccaagtagtgctaaagtactacttttactttgcttcttaaattagccctcagtccctttagtaagccttaccttactactcagttaaagttaagggcccctcgtatgtagtaaactgggtgttgcttctattgtgcttgcattcttgactttatctgtatttgtcttacttgtttatagcctgccctcctcctaaattgagcaacacattttttttcagtaaaattatcctagtaatttctgttagtttgtaagtaatttattttcctatgtacatagttctgtttagagctgattcattacattttgattacatagtttaactcttgatgagcattcttatttttttctatttccaagttttgtggggaagggatattcatatataatgggcagccatatatactgtttattttatccttccttcttacaaatgtctaatatattggcatgcatagagtaggagctcgttaagagtttacttctttgtaaaatagtcatctattcaacatattcactgctcatattttataccttttaggagtcttttttcctttttaattattatttttgagacagagtctcactctgtcattcaggctagagtgccctggtgatattttggctcactacaacctctgcctcccaggtggagtgttgaagtgattctcgtgcctcagccttccgagtagctgggactacaggcatgtgccaccatgcccagctaagtttttatacttttttttttcagtagagatgggtttcgctatgttggccaggctggtctcgaattcttgacctcaaatgatctgcccccctcggccttccaaaatgctgggattacaggcgtgagccacagcactcagaccttttaaattatcgaactaatacagttatataaagttttggtttagctggacactaaactggtgggttattcagtagagtagcaggatataagccacttatctatattgttaaactgtattgcataagggcccaccaaaatggtagtgtaatccagaaggaaatagggatagaatagaaagccaggagaaaaccacagaggaaaatggctacctgcctgacattagtcagtgtcatcacacccttttagattttctcatctaaaaaatgaagggaaacatatctattctacctacctgattcagattagttttggaaacaaaagaatacggtagaagaaatgatggaagtgttgctatttaatattatatgtgagagtcctttatgataattttagcctgagtgcccaaagtttaaacttacttatactttctgcagctatcaaacagactacctacatcatgacattcagatagattatcctgggttcataaaaatcttatatggttggctgggcgtggtggctcatgcctgtaatgccaacactttgggaggctgaggtgggtggatggatctcttgatcccaggaattcgagaccagcctgggcaatatggcgaaaccctgtctctacaaaaaatagaaaaattagctggacatggtggtgcttgtctgtggtcctcaatatgcaggaggctgagatgggaagatcacttgagcctggggaggtcaaggctgcagttagccgagatcagccactgcactccagcctgggtgacagagcaagaccccatctcaagaaaaaaaaatcttatatagttaactttaggtcttagtaatgacttggattgcctaggagaaatggcagagtctaggactgagagagtagaaatacaagatgtggccagagtgtcttgtagtaccaggagtgaagaagtactcataaaacaaaggatgggggcacatcagaggaacacaggaacttacctgaagaagctcctaagggtcaaagctggaataatttgagcaacaaaaataatgtagcatgaattataactcaaagtataaaataatcccatatatatgatataaaggatataagttgacataaaggattgaataaatatgaggcaaaagagacaaatctcccatcaaataatttatgtacccattccattctatggaggagaagctcaattcctacctcccttgagggtggactggacttagtgacttacttccaaagaatagagtagggaaaaacctggaaaacactatcttagccaaatagtgaacattaatatcaccagagataaatcatagatatcatgtactcttgatatgtgacaagaagagcatgtcacctttgtgatagtgtttccaaagacccataatcctagtctaatcataagaaaagcaactgatgagcttagactgaatgacattttacaggatacctgactagtcaagatcatgaaaactaggaaagactgaaaaactaagaccgaaggagttcagggagacaagatagctaaatgcaatgtggatcctgtattgggacctggaatagaaagaggacactcatggaaaaggtgctgaaatctatgtaaagtctggagtttacttaatatacaaatgtcaagtttcttagttttgacaaatgtatcatggaaatgtaacgtgttaacaattggggaaactatgaatgagaggtatttgggacatctctgtactatcattgcaactttcataaatctaaaattattccaaaatgaagtttatttttaaaaatggactggagttaacttttaaataataaaagcaaaatgtgcttattgtagaaaatataaatgatgaaaaatataaggtagaaaatgaaaactacccataatcctaccacccagagataactgattatttggatatgtctttttctagacttaattctatgtgtatttcactcagcaaataattattagactcctttgtggaccagacatcttggtaggtgctaatgatagagcagtgaagaagaatgatgtgtccttctcttatggagcttatactctagtgatagagggtactattaaacaatctcacaaaaaaagttacaactgtgatacgataagggctgtaaagaagtatgaatgtcagccaggcacagtggcttatgcctataatcccagcactttgggaagccaagatagatggatcacttaaagccaggagttcgagaccagcccaggcaatgtgactaaaccctgtctctactaaaaatacaaaagttagccaggtgtggtggtgcacacctgtaatcccagctactcgggagactgaggcacgagagtcgcttgaatccaggaggcagaggttgcagtaagctgagatggtgccactgtattccagcctgggtgataaagggagaatatctaaaaaaaaaaaaaaaagtatgaatgtgagaacatataagtggggaaatcaaaattgaatatgtattatttaagatgagaactgaaaaacgaatacaagtcaggcatgtgaaagaaggaagcagggcattggaggtgctaggagcttgtacaggtgcagttgcaggcagagggaaggaacttggagcgttagaggtaaaatgtctggagtgcagagaatgataactagaaagcgagggactgaggctgaagacgtagctaagcaaggtctaaataatacatgtaaagtttttggtacttttccccaagagtggtgggaaaccactgaagatttttgaatcaagggaatcatacgaactttgtaatttaagaagatcattcagaggccatgtgggcaaatggactgttaggtggtgagagtatggaggtaaatataatagttcagaaaagaaattatagtgtctaggactataggtagtgatagagagtagagagattcaaaatagatttaggagtaaaatcagccagatatactgattgttttgatgtagaatgagggagtataaggataaatgttctgtatttctagcacatgcagttggtagtgccatttataaggcagagagtttttaatatataaaacactgccttatggtgcaagagcttaatcatttttaatggttgcataataatcagatacacaaatgtattttcagttcccagaaataaaacatctgttaatgtgtagtgaatatgatgttttgaaaattagtggtgaaaggctgggcgcggtggctcatgcctataatcccagcactttgggaggccgaagcgggcagattgcttgagcccaagagcttgagaccagtctgggcaacatggcaaggccttgtctctacaaaaaatataaaaattagctggggcatggtggtgcacgactgtagtcccagctacttgggaggctgggacgtgaccattactggagcctgggaagttaaggctgcagtgagccatgatcatgccactggactccatccagcctgggtgacagagcgagaccctatctaagagaaaaaaaaaatgagtggtggaattgttgctaaagatagtctgagtgctgataaaacagttgagttggttctttctgtgactaagaataatgaagctctttgtttgatattaactgctggtagaaaacattaataaaacaatccaagaaaggtgttttaggaaacacagtattctcgtatgtagatttataagcacagaaaaatttccaacagtataaagttgtggtatagctccaagaaaagtattcttagttagaagaatttggctttgctacagagtttcaaaggttatgtgtgcgcatattgtcttcagtagatgacaagttgattttagttttattgttttatctggcattttccaataacattggtagtattctaatgagtaagacatttgactctaaagtcaaatttgacaacatatattcttaagccagtttagaaagtatagaatggtggttacattgtaaatctttggcagagtttttgtaagaaattcttaaatgaagttaacatatcactgctaccatttaatgtctgtctgttgggaaaaggtcagagctcttttaaatgctctactctgaattatttttagaaataaacaaataattctaaagttcatctgatatttattctaagcagggtcatgttcttaatacatttgacacttcacattctgttgccaactactttgtaaacatttctacacctgtgtctccagactgcttcagccagagcaacttagttaacctattatacttatatgagggagtaggagactgcccaaatttgtgcgtttatataagagtaaggtaatgcatttagggaagacaaactcatactaggtttatgaaatgctgtaattcaggatgttactaatgaactaggaaagaagttggtattaataataaactggtgccttgataaaattagcctaagatgccagtggaaagtcaatcaagtactggatagatatcatcagaaaggtcattggaaagaaatcagcttaattttataatatacagaaactggtggtttatacctcacttaccaccttaattattgtcattgcattgcaaaaaaaatttttcttcttaaaaaaatttcaaagaaagttaactaaaatgattacctcttcactctacctttctcaccctaatatcatgatgcgacaaattaacttttcttctgtgcatgtagaatattacctatgaactgtccttgggagaattgagaaaattttcaagcttcatgttttgtgttgtggttctggttaagaatttcagttgaaaagggctggaggagttatgtgctaaacctgtaaaatcataagctgaagcaaatatagtcatttcttggtatttgtgagagtttggctccaggagcccctcaggtaccaaaatgcatggattttcaagtcccctatataaaatgacatagtatttgcatatcacctacacacatcctcttatatgctttaaattgtctgtagattacttatgatacctgataaaatgtaaatgtgtaaatagttgtgctactgtattgctcagggaatcatgacaagaagaagaagcctgttcatgttcagtacagaacaaccatccatttttttcctaaatattttcaagccatagttggttgaatccacatatgtggaaaccacagatgtagaatccctggatacagaagattgattatacataaaataataagtctatggacctattttacacagttctgaaatacagaggaaattccttggaaaaaccagcaccttagaacacattgaagtcagtttagatgcttatgaaatttgttacctacaactgattgagactgtaaataagattaaactagaagggtttaggtagggaaaaaaagaagaaatccacattagatattaatagaattagagatacttaggatatgtttttaacttaaagacttttgaattgtgacataacacatcagaaaatgcataaaacgtaattgtgtagtttaattagttattacaaagcaagcatctttgtagcccactgaggttaagacaataaagcataaccatattccagaagcctcctgtgtacgttcctaatcacaacccttcctttccctctgaaggtaaatactattttctctttgtctaatcactttcttgctttactttgtggtttgctcatctaggtatgcatccttaagaatataattcattcaagccagaaatggtgtgttgaaaaaagaagtatataatttaggattgcctgtttttgaaagttaagtaaatggaatcatatagtgtatatgtctttgtttcttggtttcacacaatgtggctttcaagaatcaggcatgttgttgcaggtagtagctgtgtggttgctctaaactattatatatcattttttaaaaaatgaatttactacagtttacctattcattttacttttgatggatcttgaagctcctaacaggttttggtggttactaacaatgctactttgaatattatgcatgtacttgtgtggtacttaggtccttaggtgcacaaattttatttgtcctggatgtgaacttgttgggtcataggtcatgttttccccagtagtgtttcagtatacattcagaccaagaatgtatgagagcttccattgcttcatgttcactaaccacttgatattgtcacacttttaattttgtcagtgtgctagctatgtatggattttgattgtggtttaaatttgcattttctttgtagtcaaagagatgtagcatcttttcatgtctatttggaaatccttttcagagtaccagtttgggtcatttactcatttttctattggagtgtctatcttacagatttgtagaagttctttattttctagacacaaactttttgttggataaatgtgttacagctatcttctatggagtgcatttcactcttctaatggacaaattatgaacaaatattcttagttgtaatgtggtcctatgtgttaatcttttgctttatggccaaggctttttgtgtcttaattttaaaaaacgtccctaccctgatgttatgaagacatttttctatattattttgtaagagctttgccgtttacatttagttgtgtagtcatctgatttgtatatgtgtgtgtgtgtgtatgtgttagagtgtattcatttttttctcatatagatagtgtgttagtctgttttgcattgctgtaaaggaatacttgaggccggacaatttataaagaaaagaggttggctgggtgcggtggctcaagcctgtaatccctgcactttgggaggcccatgtgggtggatcacctgaggtcaagaattagaaaccagcctggccaatatgataaaaccctgtctctactaaaaatacaaaaaattagtcaggcgtggtggtgggcgcctgtaatcccacctactcaggaggctgaggcaggagaatcacttgaacccggagggtggaggttgcagtgagcctagatcatgccaccgcattccaggctgggtgacagagtgagactccgtctcaaaaaaaaaaaaaaaaaaaaaggaaagaaaagaggtcgtgcaggctgtataggaagcatagtgctggcatttgcttctgtctggtgagggcctcaggaagcttccaatcatgatagaagctgaagtggaagcaggcgtgtcacatggtgagagaggcagcatgagagagatgccaggctcctttaaacaaccagctttgttgtgaactaacagagcaagaactcactcattatcatggtgagggcaccaagccattcatgaagggtccacctccatgaaacaaacacccactaagcccacttctaacactggaaatcgcatttcaacatgagatttggaggggacaaaacaaccaaaccatatcagatagccagttgtcccaacatcaattactagaaaacaattttttacccactcttgtacagtgccacctctgatacatatatgaagggctcattatatataggagggcctatttctagactccccattttgtactattggtttttcatcctgataatggttgtgtgtctttttcttctctttttcccaattcttctccgtctcctttcctttctcctattccctcctctccttccctcctcctttcccttcttcctctctcttgttctcctttctctccccttgccctcccccatcttaatctgtgtcactgtagatttatcaatagttagtttttccaatgaattggtttgccttttttgttcttttctattatgtatttcttttctgtttcattaatttctgatcttctactttctttgagtttattttgatgagttttttttctaatttcttgaactggatggttagctcctcagttaacttgcctttaagtgcatttaaagctataaattttttttcagatactgttttatttctatgccatatgccttttttattatcactatttaaaaatcatttttaacgtttataatgagtctactttgggctataggttatttagaagttcagtttataatttccaacacatgaggaatttctggctgtttttaattatttataacattattgcatcgcggtccgggaatatgcattatgtaattacagtgtgttgaaattttttgcaacttgcattgtggcccagaaaaaaagtcaacttttgtaaatgttccatgtatgctataagaatacataatgtgaagttttcagttatggtgttctctccatgtccattaggtaaagtttgttaatctatgaaaatactctgtttctttactgattattctccttgtttgtttctattaagtattttaaaaattttcactgtatttgcacatttatctactgcttcttgtcattctgtcaatttttgctttatatactttgatcttatgttattaggttatatcttcctggtgaattgaaccacttttattttttaaataactctatttctaattatagttttttatcttacaatctactttgatattaatataactcccaatattctttggattagagtttgcatattatactgtttttatcctctttactttcagtctttctgcatctgtttgttttgttgaaactcttgaactgtatagttgaactttcaaatccaattaggtagcatttattttctaattggaacatttagtttggttccacttaaggtaaatagtggcatatttggatttaaatatttctaaaatttagaactcttaaaatctttttttgcttagtctttatattagcttatgttcatgcctgaatatttgagaaactccttcaaaaggaattgtttaggcattaaaacaggtttgccggttttggttctgattttgaaaaattgatcatcgtgtgatgttttttgtttttgtttctaagatggggtcttgctctattgcccaggccaaagtgcagtagtgcaatcatgactcattgcagccttgacctccagggcccaagtgatcctcctacttcagcctcctgcgtagctaggaccgcaggcatgtgccactatgtccagctcatttttataaattttttgtagagacgggaatctgggaatctccctatgttacccagtctggtcttgaactcctggcttcaagtgatcctcctgcctcagcctccagagtgcagggattataggcatgagccgccatgcctgggccaattgtgtgatgtctgtgaaagcaaactcttcatatttttattcctgtgatatgttatttgggtaaccggatagctatattggaaactaaaacttcttatgtttatgaggtatgaatattataaaaccattttgttttttccatttattttctggcttgtcagttttaagaatttccacctcttctttctttagggcttcaataactttacaactaattgtgtagtttattgattgtcccccagaaaagctttgctgtatcttttttttttttctctgatgcattttgattcggagaatgactgacaatgcaagttaaggtttagtgccatatagtgtgtccaaatgtaaacttaaagcagcctgtattagtcccttctcatgatgctataaagaaatacgtgagactgggtaatttataaagaaaagagatgtaattggctcacagttctgcacgctgtacgcgaagcatagcgtcttctggggaggcctcaggaaacttacattcatggcggaagatgaaggagaagctagcatgtcttacatggccagagcaaaagcaaggagggcagtgagggaggtgctacacacttttaaagaaccagatctcatgagtactctataatgagatagcaccaagtggatggtgctaaacctttcatgtaggctccacaccatgatccagttacctccctccaggccccgcctccaacattggggattacaatgcaacatgagatttgggtgaggatacagatccaaaccatattacaaccatactgatggattgtaaactacagtttttaacctgcttctattaattagaggggtaaaggttgtaattttttattaatgtttatctcatgtaagtggttttatttataagcattcttttaaaaatctttttggcttggtgcagtggacagtgttgggtgggcctggacaacgttgtaagacctatctctacaaaaaaagaaattaaaaaattagccaggcatggtggcacacacgtgtgtattccctgctattggggaggctgaggtgagaggatcacttgagctagggggtcgaagcttcagtgagctatgatcatgccactgtactacagcctggacgttggagtgagaccctgtctctaaaataataaatacaaataaaaaatcttttcattatggaagaaattttaaaacatggaaacatatggagaagaatattgtgtaccttttcatcctggtcacttactttaattaattatcaattcatagccaattttgtttcatttctactccctcaattatgttgtaatctgaaacattgtgtcatttatataggtaggtagatatacatgtatattgtgtatttctaaaagattaagattcttttaaaggtcattattttaaaatatgaataattccttaaaatcaaatatcttgtgtttcccatttccccaattgtttcttaaaaaattgtattgctgtatcttttaagtctttttaaaaaaaattctgtaggtttccctctctccctttttccttactaaattgtatttgttgaagaaaacaggtcatttgtttcctagtttggttttttcctgattacatttttgagctataatttaacatgtttctctgctcctgtattttctataagttggtagatttaaaggcaaaaaattgtttaaaatttatttttattgttttaaaatttaagtacttctaatattgtagatttctcagatcattactgttacaaggggcggcttaaaggtagaactcttaaaatattattatcatctattctgccttcctggtttgtagatacagagacatcccagagaggttgtgatttatccagatttccacatcaagttgagattacagtggagggtgcgttcgaaagtaaaaataacttctccttttgaattttgatggcttcatgtgtgctacttgtgattttggttctttagaattcatcctgagcatttttccagagctatgcctaggaattcttgaatttgtcttctgctctctctctatctgggctccaccctgactgtaattcagtttgttaatatggtaataaaaagtctctatcaaagtcctcttatgtgtcaaagtcctcttttgccacatcttccagtctaccttgtgcttttctaaattgtgattggacttaacctgtgtactgattcttttactttaagaaagtggcagttgtggaccccataaacacaagagatgtgtttacttctgaagttttaaagatttttaggtttattattacaaaagtaatatatttgtttaaacagtgtggaattatataaacactgaatgtactcctcaacctctctaccttatgtctcagtgataacaattgctaagggcttgatgtgttttattctaaacttaattctatacaaatataattatatagatatatattatatatacacacaattgtttatctttaaaaataattcaaatatggctacaaaacttttacaatatgaagcattgtcagtatttattttaccgggaggatttcccccatcagtgagtgctgactgtcattttcattctttatgatcaagttgtagatcaggaaaaacaagttaagagagtgcctacaaataccgggaaaacttgtggatagattttcattttttatgtaaagacatataagaacatgaatggtataaaaacaaaatcctttataaatgccatacaattatatatttagaaaaattatatggtggtaaaacatataaaagaaccacacactcccaaatttacattgagctaatttagtacagttagcctttgtcaaagctttccttgtttaaaaaaactattggctcagtgtgcaggaaggagcataggagaaaaaattgccaagaatatttgaaaaatacagaaaataaagaaaaaaatcacctactatcctatcaaaaattttaatagctagaatcaggataagatagaatattcctgtggcagtaattctagtctatattcctttcctggaaccctgtctcccaaatttcaggtgagattttataagaagctctgtttatctgagatttaaaatataaaaacttgatttaacctatacagttttttaaaaagaccctaaataagtaaaatttagtactccacaaattgaagagaatttctctcttctctttactgccctctgagttttctctttccttctctcacctccaattttcatgtaaacactttcagttcgagtggaccttagagattgtctcattcaatactttaggaaaacaaattttatagaacccttgagttctgtggaattgcttctaatgaacaacaccttttgttgttgttgttgtttagtgacactgtgtaacaggcatttcaggaggagaatctcccagtctagaggaatcctctcagaggtagctataaaatattgaactctgatcttcaataagcattgtgcggtttttgtttttgtttttaatgacagttttaaacaagaaagttgctttatttctgaacttcataaaaatttctattaaagagacaatttctgaattttataacaatttctagaacagttgagtacctcactttgagacacatttttgctaaaagttaaaaacacaaaacccttatgagataaaataggaagctagtagagataggaaagccctctgcttagtaaacctcttttttgcgtagtttagacacatacaatagtaaagttacttagtacgttgatagttttctttctcctcaaaagctacaatgtcttactagctagttccttcaagaaaggaaacaagaagccgctggaggagattggtgagtgggataaaacactattcaactcttcagttattcggtttttaaatcctcaatgaaaggctgctgtattatagagtattttttttttatttttaatagacttagaaccaagtttcttgagaaacctttggcatattgtagtttttttatggctatgactcacatgacattactgtataaaactagtacattctctcgtaaaaccacacaaacttactagagtgctgctctcatttttctacattagaaatgaaaaagggcattgtctgcattcaaaatttcctttttacatctctgtattactttttcccctttatatttatcttaaaaccaaaagaaataatgtttctattgttttactgtagttaccactgatgctaccgaagctgtattgtgagtgtttcaaaattctcaaaccagttttgtgtgttgtacttggagcttagtcattgtcatacgtagcaggacctgattaagaaggctgtgccgcctctaagccttgctagattgtagccactagcaaccaggctgcaataatttccctttgatgacatcatccactgtggaagaacccagttgcttcagcgagtcgaactacagttttaacctcatcaaatatggcatctcccttgcttgctgcagcagggatggaagaaatgtcactttctttttaagctagcaagctttttctttttctttttcttcttctatttaaaaattctaatcatggatgcttcttccgacccttatttgccttatgacgggggaggagacagtattcccctgagggaattacataaaagaggtaatactatccccttgctgtgaattctctgttggtatgttttgcatgcggctgggcggtcctctagcttaaactggttctcgtttgtcctttaaatactgcagtacgttgtttagttgccctgggttgttagtaaggggaaaatgcaaccttctgaatggttgtgtagccatccctgattgttttctctgtgcagattagtactgcttcagatcacgtcgggctccgactccatcttctgcatgaaaatcttctttctaactctgaaaatgaattaatctgcttttacagccaactaaagtcgtgttggttggcatctaaaaagtaatgtttttcttccttcagaaaacttacatttcctttaatttacacagagaaatcaggtgcctatgtaccattatattttagctgctgccaattaccatgtagattttacaccacaaagtaaatttatagcaaaagctttacctacattttagaacattttaaaatgatagtaaagatgaataatttctatattaatactttttatttaatatgtatttcggctgagtaacatactacattgtcttccacaggtatcttgtgaaatttgatatgataaaacacatttgactaaatgtcagaaaaaataatattggtttgtgaaaagcagaagagcacccagcatgcctgtaaatcttttggcaggcacttcctcagtctccttaaaattaattgcatgttaattactaccctttttttcatttttgtttaattgcttattcgaaaaacagactggtcgacatttgttgtcctagaaaaaaattgaacttcaagaaaaatctcttagcttatgtgacttcatttttgagccacattagtttgaattactgcatgatattataaactcaccttatgatttaacccaaacttttatttgtaagtatataaggaagtaataatgtttttctaatataattagcctgctttatttaaaatatactttgtgttctgataacactttttttttagtattaagttccactataatttaaacattataatgtattcaacaaatgtctgttggttgcattgtgtctgctacacactattttagggtctgaacagttgtagcattatttatcttgcagtattctgtagttagtaaaaacttgctttttacattttgagaaaagctgtgtaaggatcatgttacatacattgtgctttctcttacagagttaccttcttaataaaattttgatatatgtgtatatgtatatgttagaacatttggaagaaatatctaaaagcataaagaagaaaataatttcttgtaatcacaccacccagagctttttaaattttttttcttaatgttacgatcataaattcttctatttcctatgttctgattatcagttttctggtaaggagttctttaaacaggaagcaaggtgaatgaatagtgactgttcaaatgtcacattatttgctaatcagtaattaaactgtaaaacaagacagactgtattttcctcatgctattacaacatttggttgttaatgatgatagatcagaatacctgggcttcagaaatttaaattccttttgtgaagcttaacagtctttgacagaacttacttatggactgtcttagtgtaaaatatgcaaataataagaaataagtcaaaacttatgtgagagtaggcatggttactgatattacctaaacgtaagctttttatttctattatactttcataaataatcctttaagaatcttgcttaggatctaaatcagtcccactcttggcagctcaaataggttctttatcccttgatgagacttattctattaatataagtcattgttatttgaaagtaacattgtgtatgtgtagtagagataagtcagttattaggctttcgtgactgtactgtattacctcaaacatactgtagtatcctagtgtctatgcgtaagatgttattttttgtccataatttatgacctgttgtagccatgggtcaacacaatggaattgatggagacaggcagctaacaaatcgaaaaaactgaatcagcttccctgtgaggaagaacaaaactataatgattaaaattgatcttcagcctgatagtgaagaggcagataaagtataaaattgtgaaggatatcaataaagtaaacatggatctgtttagtaaatccctgagtgctatagccaaggattacctttgttgagtaaattgaatttaatactacttttcaaggcgagatggtaaatggtgaagcttcctatttaagtaaataatgtcaagtctggaagtataagtagattcaaattagaattagtttgatatactattgatagattagaaattaagatgacatttcagaaatagccatctttaggggtagatttcctatatagaaacaatcaagctctctcaaaatgtctcttccttttttatcaggaaaaaagacttggcttatctggactgttagttttacactttttcttcttaatttgttcaagatgtttaagtagttttagaggtcaaatttctttcttctaccaaccctttataatggatttgatcttttgggcctgagcctccatttactccatgaggggcctttaacaattatttaaatatttaattgtttcattcagagtgagcatatatgtgtgtgtgtgtgtgtgtgtgtgtatatatatgtgtgtgtgtgcgtatatgtgtatatatatatatacatatacacacacatatggcactcctaggtgctgtggagaattataaaaatagtaatattaataatagttaatatttattagaatttcctgttagctggatactgtcctaagtgggtttttttgttgttgttgttgttgttgttgttgttgttttcttaagagagaggtatcactttttcacccaggctggagtgcagtggagtgattatagcaaatgcagccttgaactactgggcttagatcctccgtctcaccctccttggtacctgggactgcaggcttgcaacaccttgcctggctaatttaaaaaacaaaattttttttttttttagggagagtctcactatgttgtccaggctggtctccaactcctgggctcaagcaaccctcctgccttggcctcccaagtagctgagattacaggtgcgagccactgtgcctggcttgttctaagtgctttatgtgtatgaaattatttaaatcctcatcacaagtttatgaagtaggtactgttataatccccattttctagttgacaagactgaggtaaggaattgttaaggaaaagtcagaattccatccagatatttggctcatactttaatcatgaggctaaactgcttctctctacacgtatcttcatagtaacttgtgttttaagtctggtagaagcataagaagtttaaacacagacagaatcctgtggaagttagtaaatttctagtgaacgatagaaatgatagaaatctcttcttcccccaaagtcccaagaacagattagtctgcttttgacaagtgttatcaaagtagactgttctcacatacacaggggactcaatagggcattcctggtggatataataaaatgagtaaatgcgataacaggaggaaatgcctagtgtgttgctcttggattagttttgatacaacaaaggcagctttgttgtgagtcagtagagagggtagtgtagaaaggtggaagttggaagagtggcagatcctagaggactaatgatgggcttaaaccacaaaaagtgtcgctttgccattgaaataaaagtttggggtcttattttttcaagtttctccctgaaattatttcttgacattcattagctcagcagtgtatctaaataaagcttttttgggtttctattataatagaggtttgttcctttttcttccctttgaaaagtatcattttttgcacattatttgaaaatccaggtgttatatgatattcttattgccagagggacattctgcaggctctttgtaaaatgattttaggattcagatacttattatatttttattggccctaatattttatccaactagaaaattaaacctcttcttaaaaattaatccatctaagtgtctgtaaattaaaggaacaactaaagattctttatttggtgtcagaaactccttgtttctacaacagtagtataaaacaaagcctgtttttaaatgtacttttcccacagtatctgaatttcaaatcttcaataaaatctggttcatattactacctctagcttgattttctaaaaatagctgacactttagtatggttaattttatgccatctcatggcttgtcagaaatgctttgtatcaagatttccgagtgtgaacagatttcctgccgcattgattaagtttgtaattttggctattttcccagcatcgaggtttctgctttgcgtttatgcaggagactggtagtttaaattgaactttaaggttttgtttcttgtttttaagttaacatatgtttaatttctagtttctttgtagccctttgcaactttaattaggtcataaaatggatttactctagtttctctaacaaattttataaatttatgaaatatgaaatttagcaaattttataaacctttttattcatgtattgtacagctcatcatatttgcagacataataattgaatgtggaacttgtttccaattacacagatgtcttaatatccaccttatcatctctaactaaggatgtggctttttattttgaggtggcaacagaacagaaaagaaaacagtgaattgagtaatgggcttagtattgctgctgcctggttgtgtatctttggtaaacttctttgagatttggcattaacttgcaagtctttgcagtttagacagttaaatatgactgaatggctgaacaaattttaatagcgtatgcttcttttttgctatttatttacccagtagacatttaattgaccacctgctaaatgtgaggcactattcttgccattacctttttaatctttgatttggagtctgctaacattctggaacttccactatcaacttagaacgtttactttcccatcccttaccaggatggccatttcttatcagtagggtcacagagagagaaaaaaaaaaaccatctggggctagacttcctgctcttaacatacagaagcaaataggttgtgaaggaatacatagtattttggatttctgcctcttccttccataatttttttaaaaaggttcatatgttttatgtgtgtcttatgtaacagtaatctgcattatgaacttaaatgacgaggatcaccatttcacatctttggagattgatcacagaggtaataagtaactctttttaaataactatatgcatcatttttcatgtaaaactattatttggataaacccctttgagaaaaggcttaggctcctgccagtgtcactgtgatatttactaataagctcagtttaaggcgcagcaattaaggttgtgttgtttttttttttttaagttcagttcagcaaatatatgtggaaagcttgtgggtaaaattatatttgtatttttgggaaagcagacaattttattaatgcctatatttttctagttcagtgtttgtcaaacttcaagttttaacatgttgatcatgaaaccagttgacttgtgaccagtattttaaaaggaaagattaaaaaaacaaaataaaatatcagtatataccaagtagtaagagtaagcattgtttactaaactttggttttatttaagtacatatctatatactatgtcagtgagaaacatttctccacttcatgtttgaaaaacatttcaaaagctaagaaaaagtttgaaaacctgtttgtaagtacacctggggtaaaggtacaccctgtggcataagatgtcgggaacaactgagggtaagaatggggatgcattactatcgtaaacttctgctaaagcataaggatgtgagtgctgggagcaaagcagtgctcaccacttctgcaattttctattgcagcattttaaataatatgggaaaaagtggactgcaaccaaaggcaaagagggatggtgatggtgaagggtaagattgtatttattgtccaaaggctaagtgcatatacatatgtgtttgggagaaggcatcacgtaatagttcttaacctactctgagagaaggttgtccacatttcttaaagtatacatgtaaaccaacaatgaaattattttagtgacttgagaatcaaagtgctagagtttgaatccctgttctactacttgctagcggtgtgaccttgggcctgtttaactcttgacaccttgttttccaaatttataaagtggagataataatatctgtcacattgtgttgttgtgaggattatatgaactaatatatgtaatgtcctgagaacaatgtctggtacacattaagttaattaaaattagctgttcttactgttattattagacatgagctagataacagtggcctctacatgggaaagattattttaattctgatgtagttcagtttatctattttttttatttttgtcccttttgcattgatgtcatatctaaaaaacctgcctaactcaggatcacaaaaatttactcctgtattttataattttagctctttagatctaggatccatttttagctaatttttatatatggtgtgaggtaggggtacggtttcattcttttgcacgtgaatagccagttgtcccagcatcatttattcaaaagactattctttcctcactagaaaaaatatttctttaaagaataatgaatccttttttttttctttttaaccgctgttactcagttggaaaaagaataatgaataattttaagtaattttcctacaggtaaatttaagtctttatgtttagattacacatattaggaaataatggatttgtattccataggtatgcttgatctttataaagttccctgtctctggaaaaactaaaataaggcaaaacaatcttcttagtagagttatttttacaagaaagttgcaagccagttttagttcatcgattggataatttttcctgcttgctggaggtatttcagtattggtaatacctgaactatgagatgcatgaatgatgcattttaggaatttgtttctgtgtccataccaggcataatgaattaagttatctgttaaaaatacaggatttttgctcaatatacagttgtagaagaactcattgtccaaatttttaagacttttttttctttttttttttgagatggatctcgctctgtcgcccaggttggagtgcagtggcacaacctccactcactgcaacctccacctccagggttcaagtgattctgctgcctcagcttcccgagtagctgggactacaggcatatgccactatgcccgcctgattttttttagtagagatggggtttcaccatattggccaggctgctcttgaactcctgacctcgtgatccacctgcctcagcctcccaaagttctgagattacaggtgtgagccaccgcgcccggccagacatttttttttttttttttttttttgctgtctttgtcatattgttagtcttttggttaagcgatattataacttagtcatatgagtaatataatgcaacatgctgaattgtgtgtgtgagagggggttgttttttgtttgttatttgttttttaaatagagatgagatctcactgtgtttcccaggctcccttgaactcctgggctcagatgatatagcctcctgccacagcgtcctgattagctgggactacaggtgtgcaccactacacgtggctttcctgatgaaattttaaatacccaaatatttgagcagaaataatagcttgtgtttattgtttttctactatctgtcaagtatagtattaaatgttttacataatttgtctccagtccacatacaatactctagtagaagtgggtaacaaaaccaaggtactcaaagaggttaataagtaacttgcgctggatcacagaactaacgggaggcagggctggaatttgactctaggtctttctgacctcaaagtgcagtaaagtcatggaatttctctactaggccacctggaagaaaagtgatcttttttccagtcttttttgttactgtttttcagccaggagatagtagagttaggtagtagaatagtagtcactggcatccggtagtcagccctccaaaaaagtttttgatttttttttttttttgtcttaaacttggaagctactaactttcaggtcatactttcttatcatccaagagctggatatttaggtagcagaaactatggaattatcctaagtcctcttgaagcttcagctgttaaaattaattggttctgattaacactgtgctcaagatttacatttctaggagccacagtttgattggtctaacttggatctatgtgttttctttagctggggaggagaaggtatcttgattgataccttcaccaggactgcatgcagtgagggacagaagtttccttaaaataattgggttctgttataggaagaaggggaaggagataccaagtgggcaaaacaatcaggttctattacataaataataaacctaatgtgacgataataaatggataatatgattattttaagtttggaaatatacctggttattagtattggatatctggtagtggggttggagaaaaagtcgagaataagaaaagacttaaaatcgtaaaaattaactggaaaagaggatggctgagcagatacatatatgttagataatgttcataatggcaaaccaacctgaagatttgtttaaattgtagtatgtagccaggtgtggtggtgcttgcctgcagtcccaactacttgggaggctgaggcaggatgattgcttgagcctaggtttgaggctacagtgagctatgtttccaccactgctttccagcctaggtggcagagcaagaccccatctctaaaaaaataaagtaaaatgaataaattataatatgttatgacaaatatagttatctgaagtcacagaaaatgtgcatgtgcatttaatgatgtgaaataatttttaggaagtatgaataaaaaaatcaacttttaagtgtggctagtatgatcttacctgtatctcacttatagaaaatataaaaggctgaagccagtcaccagtttaatagttctaacctcttgtttacttgattcccttttttctcctccccagcaatcctcatatagttaggtaaagttggttcttcatcaggcttgttgcagaaacccctaagcctttttacttaaagctttttgaaacccagaaacccatcttttgaattcaaaagttttgactgttattagtctttttgtatgtttgttggccgcataaatgtctcctttttatgaacagagaagtgtctgttaatatactttgcccactttttgatggggttgtttgtttttttcttgtacatttgtttaagttccttgtagattctggatattagacctatgtcagatggatagattgcaaaagttttctcccattctgtaggttgcttgttcattctgatgatagtttcttttactgtgcagaagctctttagtttaattagatcctatttgtctgttttggcttttgtcgccattgcttttggtgtttcagtcatgaagtctttgccagtgcctatgtcctgaatggtattgcctaggttttcatggttttgggttttacatttaagcctcaaatcgatcttgagttaatttttgtataaggtgtaaggaaggggtccagttccagttttctgcatatggatagccagttttcccagcaccatttattaatattaaatagggaatcctttccccattacttgtttttgtcaagtttgctgaagatcagatgattgtagatgtgtggtgttatttctgaggtctttgttctgttccgttggtctgtatatgtgttttggtaccagtactatgctgttttggttactgagccttgtagtatagtttgaagtcaggtagtatgatgcctccagctttgttatttttgcttaggattgtcttggccatacgggctcttttttggttccatatgaaatttaaagtaggtttttctaattttgtgaggaaagtcaatggtagcttgatgggaatagcgttgaatctataaattacttcgggcagtatggccattttcatgatattgattcttcctatccatgagcatggaatgtttttccatttgtttgtgtcgtttcttatttccttgggcagtggtttgtagttctccttgaacaggtccttcacgtctcttttaagttgtactcatcatcactgatcattagagaaatgaaaatcaaaaccacaatgagatgtcatctcatgccagtcaaatggtgattattataaaaagtcaaaaaagaatagatgtgggtaaggctgtggagaaataggaatgcttttacactgttggtgggagtgtaaattagttcaaccattgtggaagacagtatggcgattcctcaaggatctagaaccagaaataccatttgacccagcagtcccattactgggtgtatacccaaaggattataaatcattctgctataaagacacatgcacacgtatgtttattatagcactatttacaatagcaaagacttgaaaccaacccaaaaagccatcaatggtagactggataaagaaaatgtggcacatatataccatggaatactatgcagccataaaaaagaatgagatcgtgtcctttgcagggacatggatgaagctggaagccatcattctcagcaaactaacacagaaatagaaagccaaacactgcatgttctcacttataagtgggagttgaacaatgagagcacatggacacagggaggggaacatcacacaccgaggcctgttggagggtgggggacaaggggagggagagcattaggacaaatacataatgcatttggggtttaaaacctaaacgatgggttggtaagtgcagcaaaccaccatggcacatgtgcacctatgtaacaaacctgcacattctgaacatgtatcccagaacttaaatttaaaaaaaaagaatttttctcctctgtgggtttcagaagcctacatttgaaactgggatactgtaatatcgaatcgtgttctccatgctctgctgtgtatttcttttcctatggcaatggatgtctctgactgaattggtgtggggaaggtgtgtggaggggtcaagaaaatagcatggactaaggaacttgcttagtctttcctggaggtgttccactacagctctactactgtcttcacaggtaagtgagaactgcatatgctttgagaaatggctgatccaaggcaaatcctgtcattttaggttaataaaatctaactgtgagcacagtggctcacgcctgtaatcccgacactttgggaggccgaggcgggcagatcacgaggtcaggagattgagaccatcctggctaacaccgtgaaaccccgtctctactaaaaataaaaaaaaattagccgggcgtggtggtgggcgcctgtagtcccagctactcgggaggctgaggcaggagaatggcctgaacccgggaggcagagcttgcagtgagccgagatcgcgccactgcactccagcctgggtgacagagcgagtctccatctcaaaataaatgatagatagatagatagatagatagatagatagatagataaaatgaggatctgggactacagacgtgcaccaccacacccagataatttttgtatttttaatgaagtcggggattcaccatgttagccagtttagtctcaaacccctggtctcaagtgagctgcctgcctcagcctcccgaagtgctgggattacaggtgtgagtcaccacgcccagcctttgatatattattataggaaaaaagaggagatgtactttatgtagaagagaactttaatttatgctgtgacggtacctaaaagatacatcctttattcatgcgtaagatgaaatcgagaggtgaaattggatatactgttgcttttaaaaaattttaacatatatgtaattttttgtacttatctcattttagcctatataagttatatatattttgtttgtttgtttgtttgttttgtttgagatggagtcttgctctgtcacccaggctagagtgcagtggtgcaatctcggctcactgcaaccttcgcctcctgcattcaagcgattctcctgcctcagcctcctgaatagctgggattacaggcacctgccaccgcgcccagctaattttttttatttttagtagagacagggtttcaccatcttggccaggctggtcttgaactcctgaccttgtgatccatgtgccttagcctcccaaagtgctgggattacaagcgggagccaccgcgcccggctgtaagttatatcttacacaaatctaggtttcattcagagaattatatgcaaagaaacagtgcaataggattattttaaagctattgttattgttagaaaacataatacctttaaaattccttttcacattagaaatatagtggcttctccccagtttaggatagaaattttccttttcttctccttctttatactattcagatttgcatgtttgacagaacaaattataagagaaaatatttgaaatgtcacatactaaagtaaatgtttgaatgtttgaaaattttctggttttcagagattttgaattgctgaatcgttgtgtaaattaagatgttgagtagtttccacagagtaattatttgaaagtcactgaaagcaagacacatgcctaatgtaaatgtttattgcactactgtacctttttctacctcataaaaatgagaatagcagtctgtacttttccacttcgtcattcgtaagtctttgcagaaattcatattttgtttgcttattatcttcacgctgtaaatagcttgaaaattctttaagtggggctagcgatgtattatggatacatgttaagtggtatagaaatttcacttttttttttttgcataaagagtaacaagaccagtagtccatatttcttcagctctacccagagaagggcaatgtaggagggaaaatgaagtttgcaaaatatttcatagtaggctttttcttaaagtaacttcagacttacagaagtttaaaaatagtacaaagaatcccatatacctgtcaccccaattcctgaaatattaatattttaccacatttgttcattatgtctgtattctccaagtacgatatatgccattatatgtaatatgtagcattttatatagacatagggcatgtatgcactatatatttttttctgagccacataaagagtaaaacgcagacatgacgtgcttttactcctaaatacttcagtgtgtgtattccctcaagaaagggcattttcttctgtatagctaccgtacacttctacacttttcaaaatcagaacatttacattgataccatactatgacatgatctgcagaccattttccaatatgccagttgtcccactgtgtcctttagtacaaaagaaaaaagttttttttcctggtctaggagctaatcctggagcacatgttacatcctgttgttttaatctagaaccgttcctcagttctttatctttcataaccttgacatttttggagagtacaatccatatattttgcagaatttcccttagtttgggtgtgtctggtttttccttataagattcattttatgcatttctggccagagtaccacagaagtactgtatatcttaccagaaagcctaagtggcatttgcattttctaaatgatcaattttaatattatatggaaagcagagtcagagattctcacatatgtcaagatattataagtattcctgttatatttattctccaattgctttttctcaagaaaatttgtggcctttcagctagcttttcaaagtggaagttactacataacattaggatgggagggtggggaagagctttattaaagctttaagattgagcttttgagtatgtgttgtatgtaaatgaaagtgggcattgatgcagggattgggcctttaaacctttggccaagaatggtatcaattattattattattattttttggagtacttctgctaaaacactgaaatcagtgtgccactctccttttagaagttttacacctttccaaggtacacttttttttttggagacgagttttgctctgtcgcccaggctggagtgcattggcgcaatcacagcccacttcagcctctgtttcccagactccagcagtccttccacttcagcctcccgagtagctgggattacaggtgcacaccaccatgcccagctagtttttgtagagatggggttttgccatgttgcccaggctggtctccaactcctgcgctcaatctatccgtcctcctcagcctgccaaagtactgggattacaggcgtgggccaccactcccggcttccaaggcaggcatttaaatgtaataaatagggagataagcaagaaccctgttggacctggtagaagcaaacatttattagtactattacgttgtttaaaatattagcgccttctatattcatgtcctcccagaattatcaaaaaacctactctatagtttatttggcttatatctcaggagtaataaaattagttaatagtattggcatcgtggttctttgtgtattcctcccttatcccaccccaagttgatttcacatgatctcttgatctagtctaagaatgtttatagtgattacgagaagttcagattctggctttaacatatataattgttttttaatctgtaaaccaaagagaatgagtttgtttaaactagaaagatggcaagagtagtctgggaattttgttccattccttaaaagtcctataataaaataaacatatcttgtgttttatttttacaatttttttaaacattagtacagagtgccacttcttatattctatatcaaataatgagctacattttcaataataacctctgagtaatttttggcattaaaatctgcattacaaaataatttgaggatataatttataatcacttatgctaaaatcacctatttgaaattatgtatgaggttttcaaagtttatagtgctttggaaaaaatttaaatgtttctttgtttatgtatctttattataagctgtagcatatatcatgtagttgtcaaggatgctgatagatacttaatatttaaaggagacttgtctaaagttagctgtccaggactagaatctgggccttttggtaacagttcattgctctatttacttaaatgatgattggattcgttagaatttctctattttcatagctgtctctatggttctatgaaaatactgtgtgtgtgcttatacatatatgtatacctgtaagtacaaagtagaaaatgaaagttcattttctgcttttgacaattgtaatccccagagataaccgttattaatatgttgtctcatgtttggtcatactgttttctctgtattctgtgtattactgtataaattttacacagtaatttgcatattaaaaatgctggtctacacctggcccttttttaaaaactgcaatttattatggccaattttttataccagtatatattgatcaaccttattctttttaactgctgcatttcattcattaccaatagatgagacatttccataggtttgaatttttcagtattacagataatggttcaattaaatatttaagcttttgtgcacttgtagaattaattcctagacatagaacccttatattttgataggtatttccaaatttcttcccaaaatgtttgtatctctttacttccactctcaggtctaataattttcacttggattatcatatttcttacccagcctgttttttacactctaaactctttttcttttctttttttttttgagacagcatcttgctcttggcccggttgaaatgcagtggcacgacgaccaacctgggctcaagcaattctctcaacttagcctactgagtagctgggactacagacacatatcaccatgcccagcatttttttttttttttttttgtatttttagtagagatgaggttttgccatgttgcccaagctggtctcaaattcctgagctcaagcaatccacccatctcagcctcccaaaatgctgggattacaagcgtgagccactgcacctggcccaaaagctctttttctaatagcaatataaattgtcttttacagactatactcatatatgtttcttctttcagaaataggtgttaagtgtatctaacatggaatgtatagctataattctcattgtgaaaccatagcctaatttatttcatattacaatttaaaattcatattttttaggaagttttcttagattaatccgcctagttccaggtgctacagtcccaagatttctttctttttaacaaattaaatataggtaacatgactagaattgtagtcaaagaatattggaaccttggaacttcagtatttgaactttattttgaaatataatttgttatattataaaaatattataatatattgcacctggaagttaggggcagttttttttaattctctttgtatctgctacactgtaaagtgctatttatgtaaaaaattcttaatagaagtcttcagttgtaaagtctgctgtacagactttagatcagggattggcaaactatgagccatgtgccaaatcctgcccttcacctgttttgtaaataaagttttatcagaacacattcagactcattcatgaacatattgtctatgatttattttctgctactatggcagaattgagttgttgcaactgtgtggcatccaaagcctaaaatatttactctctggctctttgccaacccgttttagattatgagcactttggcattattatgtttttgttttctttctatagcacacagtaagatgttctgcccacattgtgcataatttatgggtttattcaaggatttatgcaagtgtagctgcaagaaaaaaacctagaagtgaacttgctaggttgaagagcatctgtgtatgttaaattttgttagctttcgccttcccaaagggattattccatttcatacttaaactactaattttgtgataggacttctttctccatagctttgctaaattaatgcattcacacacttcatctttactaatctgatagagggaaatgatattgtggatttgatttccatttctttttatgtgttagcttgagcttattttcatatttaaaagccaattgtatttctttttcttgagctatcttttaatgtccttcctgatacatttctgaagtctgtgatactcatataagatatatggtgaacatgtgtcaaagatttatttgactctaatgagggaacccgcctgatgacaaggctgattgagaagaggatgtgtgagatgaagtgtatatcatcagtgaaagaaagcaaattcttacagggcaaaaacaaaaccacaactctaagggttattgtttctactggacagaattcatttgcattttaccagataaaaattactattttcaatttatcttttacaaatcattttctaattttacagagtctattccctaatcagtagtaaatagtcttcaaaattctccgcagcgtcaggtgactattatgcaggctaattgttgacactcgggcttgactttaagagaacatgccataatcttttggccttacttccaagttttggataatttttcttaacacatttttctctaattgcaatgatttcaagtgatattatttcttttttttaaatttttttactatttattgatcactcttgggtgtttctcggagagggggatttggcagggtcataggacaatagtggagggaaggtcagcagataaacatgtgaacaaaggtctctggttttcctaggcagaggaccctgcggccttccacagtgtttgtgtccctgggtacttgagattagggagtggtgatgactcttaatgagcatgctgccttcaagcatctgtttaacaaagcacatcttgcaccgcccttaatccctttaaccctgagttgacatagcacatgtttcagagagcagggggttgggggtaaggttatggattaacagcatcccaaggcagaagaatttttcttagtacagaacaaaatggagtctcctgtgtctacttctttctacacagacacagtaacaatctgatctctcttttccccatatttccccttttctatttgacaaaactgccatcctcaccatggcccgttctcaatgagctgttgggtacacctcccagacagggtggcggccaggcagaggggctcctcacttcccacactgggcggccgggcggaggcgccccccacctcccagacggggcggctgccgggcgggggcgccccccacctcccagactgggtggccgggcggagacgctcctcacttcccagatggggcggctgccgggcggaggggctcctcacttctcagatggggtcgcggctgggcagaggtgctcctcacctcccagacagggtggcggctgggcagagacgctcctcacctcccagacggggcagccgggcagaggcgctcctcacatcccagagggggcggccgggcagaggcgctccccacgtcccagacgatgggcggccgggcagagacgctcctcacttcctagacgggatggcggcggggaagaggcgctcctcacttcctagatgggatggcggccgggaagaggtgctcctcacttcctagactgggcggccgggcagaggggcttctcacatcccagacgatgggcagtcaggcagagacgctcctcacttcctagacggggtggcggccgggcagaggctgcaatctcagcactttgggaggccaaggcaggcggctggcaggtggaggttgtagcgagccgagatcacgccactgcactccagcctgggcaacattgagcactgagtgagcgagactccgtctgcaatcccggcaccttgggaggccgaggcgggcagatcactcgaggtcaggagctggagaccagcccggccaacacggcaaaaccccatctccaccaaaaaatacaaaaatcagtcaggcgtggcggcgcgtgcctgcaatcccaggcactcggcaggctgaggcaggagaatcaggcagggaggttgcagtgagctgagatcgcggcagtacagtccagccttggcaacagagggagaccgtggaaggcgggagtcggagacgagggagagggggagaccgtggaaagcgggaggtggagacgagggagagggagagggattatttctgtatgacttaataatgaatttctaagaaggtcacttagctcactgttgtctcttctaaaacatactcatctttccttttctcttctgtaggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacgggtaagtgtttttagtaaaaatttttaaaaacatagtgcataattagatcttttaataatatatttctgccaatgatctcaggctgccaaatgtttacatttaatataagtaaatgtctacatttcatatgtggtacatgtttttttctttttctatgtttaatttttttagtttacttataccctgtaactttccagaaaggatttcaggtagctaaaaaacaaagaaatacaataagaagacaaaataagaaggaaagggaaaaatacagcacaggagttggggggaagaacaagccaagttccagatatggaggtcagcatgattttgggctttgagcagcccaccagctaaggcaaaaaaggaaactcattgcatagctcttacctatggaaaaagaagaaatctactgggggcagatggtcttgtgggattttgctgttttcttttatctcctttcccagcatttgattctgagatatttctcaatttggctcccaaataaagcttattgagtgttgtaatggtttactgttttttttaaaaatggctttaacatataaaagtacaacttatggatcctttttgtttgtggtcgtgacttactgataatataatccaaaatacattttttattttgtatttatttatttatttttgagacggagtctcagtcttctgcccatgctggagtatagtggtgtgatattggctcactgcaccctccgcctcctggattcaagcgatgctcctgcctcagcctcctgagtagctgagactacaaacgtacgccaccatgcctggctagtttttatacaaaatacgttttttaaaaaacaattttttttttggaggtcgggggaccgtcgcccattctgttgcccaaactggagtgcagtggtgcaatcttggctcactgcaacctctgcctcccaggttcaagcgattcttgtactcagcctcctgagtagctggaattataggtgtgtgccatcatgccaagctaatttttgtatttttagtagagatgaagtttcgccatgttggcgaggctagtctcagactcctggcctcaagtgattggctgacctcagcctcccaaagtagaaaatcttcttgaaaaataaaattccaaatctcaaaaggccctatataattttggtgttggaaatttacttgtcaatgaaaatgactatttacacaaattataagcttccatattaatatatatgtgtgtgaacctgaaattcaaattttattatattgtttatgaaaggtacagcctctgagattcatcagatggtatttacctttagggcatatctaaaaataaaatacagtacatgaaatccagtgctttaatccagtgattcttaaactttttgctctcagatcccctttaaactcttaaaagatattgaagagctccaaggaggctttgtttacgtggtttttatcaatggatatttaccatattagacactgaaactgaggattttaaaaaaaaataattcatttaaaaataacagtaacaaaacccattacatgttgacataaataacatttttacgaaactatattttcaaaaattagtgagagaatgacattgtgctacatttgttataaatctcattattgtctggcttaataaaacactgctggattctcatatctgcttttgcagtcaatatgttgtatgttgtttttatggaagtatgtgaagaaattcaacctcatacacagataatatagttggaaaagctatgagtattttaatagtcttttaagattattgcaaatattcttctttgatactacactaaagtgacagttgttagtttcttaaagattagttgtaatgtgtactttgaaactgcatcaatgaactttgtcttctgttacattaaaatccattgattttgaatatatgattttgtaacattatgcagtgatcatttagaaaatattgattcactgatttatgtggatcttttaaatgttgacacttatataatataatacaatattttaaaaatcacatttgttaattttacctttgatctattcagaaaagactctaagtattgggaacctatcatcctcacagtgatagatacaagtttcctaaaattctgatttttactggagagctcaaattctatcattggaaacaaatacacatttatttaacttaaaaatgacaggattacttggtttcattattgagaaaatacctgtcaaattcccaagtctggaaaaccatagtttgatgtcactctttcaagtaaaaatggcattccatgtaagaagtgtctagtttattatgcaactcaaataaattacgcaagtgcttttctttaggacataacttcatacatacttccacaagcagcagatgtgtgtagttatgcatagttccttatgcatggttcttatttcatcacacaaaatattaaaaagactcagtgattgagacgtagcagtttttactgcttcatcaaagatgctcttatttgaaactggcataatatgatttatttatttgattttactgggaagcatggcagtcaagaatgtaatgactgccagtacatttgagtgccactgcttgatttttgctatggagtcagcaattttgccactggttttgcattttcagtaaaaatgtcaacacagtgaaaaaggcacataatgtcttgtattattttgtaaacagttttatcttgcagaccccttgaaaaggtctcggggatcctccaaggtgccagtagaccgtactttgaaaatcactattttaatccaaagtgcctagatcagacacactataaatcctgtgtcttgtatgatcattaggtaaatacatttgtacttagaagtatacattcagagacattaacagtattcaggttgggatttaagtatattttaaagtgtggtacctagagagtatccatgacactatgttcataaaattttagagaaaactgagatcaaaggaaaccaaaacaggctggtcatagtggctcatgcctgtaatcccagtgctttggaaggttgaggcagaggatcgctggatcccaggagtttgagaccagcctgggcaaatatggagactatctctacacaacaaaacaaaaattagctgggtatagtgtcttgcgcctatagtcctagctactcggaaagctgaggtgggaggatcccttgagcctggaagttctaagttacagtgaattatgattgcaccactgccctccaacctgggtgaaacagcaagaccctgtcaccctccaaaacaaacaaaaaacacttttttctctgagtatgtaaatggttagtgtacagtccttgaaaacattgcaaatagtatagcaatatatgaagtagccagtatgtgtcctagctaattttatcaatcatctcttcctagaccaatcaaatatttttcaatattttgatccatgcttatatgaacaagattttttaaagctggaaaattccacacatttatatacttactattgttcttaaaattaattttttttttttttttttaagcagagtcttgctcttttgcccaggctgaagttcagtggtgcgatctcgactccctgcaacctctgccttccaggctcaagcagctctcgtgcttcagcaccccaagtaactgggattacaggcatacgccaccacactggctaatttttgtagtttaagtagagatgtggtttcgccatgttggccaggctggtctcaaactcccggcctcaagtgatccacctgtctcagcctcccaaaatgttgggattacaggtgggagccactgcgcccggcctacattaaattttaaagcctttctatgtcagtgcatatacccaacctaattctttttttccgtgaacttttttgttatgcttgtagccttcctaccccagattatttcgaagcaaattgtcattctgtaatttcaaatattactatttcagtattttacaaaatggttgcagtttaattgttgttccttttttatttattagcttgcatatttctatagagagtttaccccacatcaaccatttggattacctgaagtaagggtggtacaggaaagggagaaatcttgaaatactaggttccttagcatcctcaaagttgaccaatgagattttttgcttgtttggttgtttttttctgtgtcttcatggactcatggatttaagtatatttgtggtttaatcatcactgttattattcttattgatgttcatgttattttagattagtgggagcttttttagtttgctatctgtgtccttcgtcatgtccttagataatcctaatcctaatcctgattcatcgtagacatttcccgcagcaaacctggaatcagccatttctcaaggagctctctgattccattgaaggaaaatataatataggtacaatctaggcactaggtgatacttgttacttctgggttggctattgtttctagcctcctaagtttatatgactgtactaatttgaattcataactatgggactaaacttctaattcttaaatctgcatttcctttaagtcatgccaaaaatctgaacatcacaaacatagtcatttcgtttaccccacaatacacacatacaacattgtcagtataacagtaccaacaccatctccaacaatatgcctactgaaaaattttaggtaatctgtctccagcctcccaggtagctgggactgcaggtgcacaccaccatgcctggctaatttttttttttttttttttttttaagagactgggtcttgctatgttactcaggctggtctgaaatttctggcctctaacagtcctcctgcctttgccttccaaagtgcagagattacagacctgagccaccacgtctggcctatcctttatttattccaccaaagttatttatacaaattactttgttgtaaagtcccttggaatagtttcttctgtggcattatgttaccagttagatgcacctttgattcatttaactttacttcaatttttaaggtttgctttttagatttagttttgttttattatacatatatgaagtatttccacggttccaaagttaaatgaacaaaacaggcatgttcaaagaagtctagtttctatctctgtcccatccaacccattgtcttcttccccttataagtaataatttacatttttaacttgtggtttatcttctgatttttaaaaatataagcataaatatttatattcctgtcttttagcatgcttttagccatcttgcttttttcctgtataatgctaaatatatctcattctttttaattgctgcagaatttctcattacataggtatactgcaatttatttatctgatgctatgttgatgaacatttaaatgatttccagattttaggaacggtgatgattgaactctctgtacatatatcttttttacttggtacactccatcaagcaactacttaagtgactgactatgatgctgtgcaagcagttatataaagaaaacagcagtgactcagcctgaaaacggcttaatattatcatgttttcttacacattatttttattgaggaaaagcaacatggagtttagtgattatttttgaaagaaataacctatttctaattctaaagaatggttaatatctgtgtttggttgcttatagggtagaaggggtaaaattgcctcattcaacttagaacttaccgtgtcattttagtggggcgttgtgacttcaaatagacccgattcttgaaatagactgggtccatgtcctttgttgggacatggatgaagctggaaaccatcattctcagcaaactgtcgcaaggacaaaaaaccaaacatcgcatgttctcactcataggtgggaattgaacaatgagaacacatggacacaggaaggggaacatcacacactggggactgttgtggggtcggggagtggggagggatagcattaggagatatacctaatgctaaatgacgagttaatggatgcagcacaccatcatggcacatgtatacatatgtaacaaacctgcacattgtgcacatgtaccctaaaacttaaagtataataataaaaaaaaaaaaagaaatagactgggtcattgaattccagctgtagccctccttcagaacagttgagcactgaagtcctgggctgaaaattgactttttttttttttttgagatggagtctagctctgtcacccaggctggagtgcagtggcacgatctctgctcactgccacctccgcctcccggtttcaagtgattctcctgcctcagcttcccaagtagctgggattacaggcgttcgccaccacacccagctaatttctgtatttttagtagagaaggggtttcactgtgttggccagactggtcttgaacttctgacctcgtgatccacctgcttcggactcccaaagtgctgggattacaagcgtgagccaccacacctggccaaaaatatgggtttctaaagcaacagtcctagtacaacagaagagaggtgttgactagttagggatttaggtttagaagtacattcttagtaagagaggtgagacttaccttcttgtgttttagtatagtgagatctggatcaaatctattactcttattaatctcctaacttcctacactatatccagtagaggacacttttgccttacacagtaaagaaagagcctctggactctaccaatgggatcggagctctccaaacctgcatattaaaaggcctataagttttggggggtccctttgtccacatgattattctgtaatacattgtatttatggacatggtattattatacacagatcctgtcttttaaagaacattataatccacttaactgctaggaccagagaatgaccgataattcaaaccatattgtcttacagaagacatatataaaagatggttatgtgtaccaattgaggttcaaatttgattcaatttaaaacaatctaggccagattttatatagtttgtggaccctttgcactcaaatctcaaggttcttattaaaatgcagatcttggctgggcacggtggctcacacctgtaatcccagcactttgggagcccaaggcaggtagatcatttgagctcagaagttcaagaccagtctggccaacatagcgaggcccagtctcattgaaagaaaaaaaattttttaataaaaaataaaagcagatcttgggtaaagacatgtagtctggtttacaggtattaacaactgtctgtaatgtagtgattttgctccagacttaccttttccattatttagttctgaaattactgttctatgtatggtaaatgagaaaaattgctagattctagaactgtggcttctattcatagttggaaaaatgaagcataaacatttctaatttcagatcaacagcaaaaagaaagaatcagcatgggaaatgacaaaaagtttgtatgatgcgtggtcaggatggctagtagtaacactaacaggattggcatcaggtaaagaaaatttttcaagcaatccttttttagttaacagaagtataaactgttcttccctccttccctcaattttttttcaggtaccattggattttaaaaagcatttgtttctcttcttcaaaaaatctccttaaatataagactaggaggcagaggcttccaagtctagtcttggctctatcactttacgtgtttatccagcttggttgatctttctggactcagtttctatatctgtaaaataagtggtttggatcagatgatcaataaagtatcttttgatattaacatcgtaataaatagctaatatttcttgagtgcttcctatgtgttgtacactgttctaaaaacttgacatgtatttaaacctcaccggaatcctgtggtaccagtgctgtcattatcaccattttgcagatgaggagactgaagcagaagaaaagtaacttagtttgactgaggtcatacagtttagtaaatggctaaaccaggatttgaattaaagccttctagctcaagacctatccccttcatcaccctgctatacagcgtggccacaaagtcccaatgtgtgagattttaagaaagagctgttgaggacctgaaaacaaatattaagcactgttataatcactttcagcttccatgatggaagattatgttcagaagaccataaaaattaaaatttttgtggagaataaagtactgataattctaattggcatgcatagtaattttatggcctctgtgtatgtaacccactgatctctttatgtaagaaggacccagatttgaccataaatttgtgtattttttatattctcacaataaaataatcttgatatatggttttctgtaatttaagaaaatattattcctatgagtttcaataattatttctaatggacattaaattttaatgaaattgacatcatttataagtctgttaattaagttatcgattgaaaattagatttgtgaacctcctgccaagtagctgtcttttgaagatattttagtatcttttaaacattgtttttcagatcacaattaatttgaatgatgtaactttttaaaattccaaacaaaaatagcacttttattgtaaaaaataactctttacagtttataactaaaatttgaaaatcttaaatttatatgtagttcataaatgaccctttatttaggagtctcctgctttctacttgccttttaactagattgttctcgactcccaaaaaattgacttaatttttttaccatctccaacatgtttttataggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagaggtaagtcttgctttgtctcaagatgaattaataattgatatagcaaaatgtttccaattcatttaattatagaactaatcacatattagatgattacatacacatcaaatggatccaccctcaacacattgcagcaagaaagaattaagtgcaatattgtttcaagtagcttttttattagttaactgcatagtcatataacaaatcctctggattgtggtgcaaatatatttgagctgtagtagaaaagaagtgatagttattgcagtaagatctgtgtaaagttactaagaagtcaagttattaaaactaatatattactaagattgggaagtttgaattatgaaagtattatcaaataatttagtaaaatcaacctacgtagagatacattgaagataatcagacatttttatttgtggcattacggcatttaaatgattgatttactatgatctacaaagaacattttagaacttaggatgttacatgtatattttttacatgatgacatggatatattttttaaattttgttttagctgaactttagagctaaaaggtatacatttgcggtaagatgagtagtatgctgtttctcacctggcttaattgaattgagtttaatgatctggaaagttgcagcagaatgaaatctgagtggtgatgcaatttgtttccactgtttccaaaaagtggtttgtaggcagagattgaagtatagctgagatgtgttggtaacaagactttagggattaggaaaaagattaaatgtgctcagggttccttggtatatgtaggcattaatttttggactctacttaaatattttgttcatataaagtttttattattgtggaaataaaccaggagacttttacacattttactgaagtttcttttctttctttttttttttttttttttggccggtgggatggagtctcactctgttgcccaggctggagcgcagtggcacgatctcggctccctgcaacctccgcttctggggtttaagcgattcttctacctcagcctcccgagtagctggtattacaggcgtgcgccaccatgcccagctaatttttgtatttttaatagcaacggggtttcaccacattggccaagctagtctcgaactcctgacctcaggtgatccacccgcctcaacctccccagtgctgggattacaggcgtgagccaccatgcctggccgtttactgaagtttcttatgacaagcatttgcattagaggtgcaatgtaaattaaattcatactctcgaactattttctttttagggtcctggttcttatatcatgaactacataatgtacatcttctgggccttgagttttgcctttcttgcagtttccctggtaaaggtatttgctccatatgcctgtggctctggaattccagaggtaagccaagtaatatttagtgtcattaaacattattatgatgcttatctttttgaccttagtgataataaaagttggcttttctggagggaggggatagtttgttcataatatgaaaaaaaaatttttttaagtataagctgatggtagacatcattgaaaaatattgttccccatagtcatttggtcatttactgtgaaggctgattttttttttctctcaccactaatttaacacatgactaggcaaattttcagactatttagttaaacatcaagagcctggaagaagtatcttgtgacctaatgttctttgacgggttagttgttactttgctgttatgaccctgaattttttttttttgagactgagtcttgtgctgtcgcccagactggagtgcagtggcgcaatctcagctcactgcaacctctgcgtcccaggctcaagcaattcttgtgtctcagcctcctgaggagttgcgattgcaggcacctgtcaccatgccctgctaatttttgcatttttttgtttgttttttttttttagtagagatggggtttcaccatgttggccaggctggtctcaaactcctaacctcaagtgatcacccgcctcagcctcccaaagtgctgggattacaggtgtgagccaccacacgtggctatgaccctgattttgattcattcactttttataattaccttttgattagataagttaattattcttgaatttggccattttatgctttgagaaagtagttaatcacagtgggtcaacagtacaaacttttgggttttatttttcatcacaataaagtagagttatacataggattgattgaacttgatttgaacttatctcttctcttttatttttctgtagttaaataagttaccaactttttcctaatacatttctttttaaaatggaattgtattgatctttaagtttgtattaagaatatctttcataaaaagcaatatcatgcagtatataacagttgttactcattcttgatacataaaaaactattgcacataattacagtactcagagaaaacataatattcttatttctaacataatgtccaaaatatatttaaaatattatgcttatttttacaacagaaatattcaaatttgccctttttttggttatgtaattataatccttataattaaggtctgtattcattttaacatggcctgatattttgattttgttcctgagatagtgttgccctctctcctttcttgggtagagaattagattataatatcaatttattatatgtagcataataggcaaagttttcgaaaaattaactgtaaatttttctgtagactgctaaaatttgcaaggttgtttttgtgcataaaacaagaaaataacttggattcgttacattctcatgtttcttaaaggacattaagctgccttaatctttgccttgtagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtaagtgtcttttgtagttaatttgactgaaaaatatatattatatagtatttatttaagtaaagaatttcttagtgtaaaaataataaattctgtattcagataaaaaattttgagatttgtgcttctgtttttcctgaataatctataacatctttctagaatccattcccagtgctgctcagttcgtcttacattttagagaagctttagatagacagctggtgtccattgggtttcagctgcatttcacgaagatcttcctgttatcactttaccttacatctttcctcttctgaagtgttttctaagcttagctttgtttttcactcttactttcaacattaagaggttgggaaatcttaatagctatgttttcctcctggaggcagtgtctggtgccagtgtaagtggtgtgtgatatgaaaaatgctatccagtgctatggggaagttctgagggcctttagaagctcttgaagtttaaatcagaaattcacattaaagagattacaggaaatccttttcatttgattgtttaaggcaatttcctttaccatttctttaggccagcctgagatcttctacaagaccttgaaaccttatatatattatggatttcctctgatgtttccatattgctctgggcattttcctgaatcctttatattagctctagactttgggagcccagtcccttcctattttccaaatctaaatctacagccctagatggtacagagatctttgagtttttaagatatgattttttgaaaaacatctcattaaatactggcagaaccttttcatcttgttgagttttttaatgtactgtaaccaaaaaagtagaatattttatcaaactgtttaatcttcaattgaaataattctagtacattttaatgttcgcattaaaatattgtccttgcattggacgtagatatcccaaaagtggaatacttcagattgtcgtagtttcatctctgaataattgtgattccagtactttataacaaaaatagctagcattattgattactttctgtgtatctggtactgtggcagatactttacttggattttaatacttaatttcacagtaatttagtaatatggccctgttatcctcatttagtgattagtaaactagggctgaaaacagctaactaacttgcccgagactacatacctagtaagtggtggaacgtaggttaaaattcatttttctttgacttcaaagtctgtggtcttacctacttacattactgcccttacgactatgtgggtatatatttgtgtgtgttcaaaacaaactcaaaaccatcctgtagcgtagcaagttagtggctaagatgaagctagagcatttgcctcctcaattcaattccattactttctgttgtacctttatattttttggtaagacttttacttattctaagttcaaaaaatgtaatttattagatgtttgagaaattaagtttacctaaattttaatgttcatactgtagtgattagttaatgtttaatacgttgttattctgtcaccttagtgtatatataaatggcaagaattcacggttagttgaaagcattaaggtcccatagttttgtgtagacaagaggggagagcgttgatatttttaaattaaatgcttcttagatacgtatgaaatggattaaaacatgtatatgagttatagatacctaggtgttagtttggttgtaaattcaggatcaggacattcaaataaatatgtttgctttcctcttagtggaggaaaaaaaaaagaagctaaatttgctccctttcctccccaaataagcagagtctacattttaatgccaacaatttgattaaaacaaatatttatttacttttaattcaccaaacttttataaagtatttactggtgccaggcactgttctaaagcactctgtatatatttactcagtccttaagagctaagtaatattatcacgtttccattttagagaaaactgaggcacatataggttaggttatctacccatagccatacagctagtaagtagcagagccatgatttcaacacagcagcctgactatggagttcatgatcttaaccatttacagcttaatttttattatttataatttctcttctggaaatgtaacaattgaccatttgaagaaatactttaggtagctttggatatttgctgtattaaagtagtgaaagtaatacagacacttggctgggcgcggtggctcacgcctataatcccagcattttggtaggttgaggcaggcagatcacctaaggtcaggaattcgagaccagtgttgccaacatggtgaaaccccgtctctactaaaaatacaaaaattagccgggcgtggtggcaggcgcctgtaatcccagctactcgggaggctgaggcaggagaatcacttgaacccaggaggtggaggttgcagtgagctgagacgacgccattgcactccagcctgagaaacaagagagaaactctgtctcaaaaaaaataaaggaatacagactcttagaaaaataattacaaataaaaccctagtgaaattataggtatagttaggtatagttggcttacaggtgggaagtagaccattaccaactgatagactggggagctggagagaggacacggaagagtgtccttggatttttcttttcctttaatttttttgtagaggtgttggttggtgagactgtaacttgaggagctgttgtgtgtgctttcagaatgaggctctctagattgatagtattttagcagtatttcagaatgcatagggtagtgaaaatatagggaatcttacaaggtcttcggttccctgcatatcttgctacgatttggaatagagtatttatggtggagcagttagctctaaaatttgaagaaatgatatcctatttaaaaatagctccccatcccagttactgccctcccctcttacctacacaaacatacgtcttgaaaattgtctatattcattgcctcctcctctttacaccctattcacattagtatatctggcaaaaattttttttaactgaatggtaaatgcatgactgacctttcaattaaagccaggagaaagaaacaaatcttaatagaagaaatgaatagttaccctttgcttagggagcaaggaaacatgcaagttaaattcagaaaatccatttggaaaattcaagtaacatgaagaatttttatttggtatgtttgaatttctatgaaattatgaaataagccatatcctctttctaggtgctatcagctgcctcagctgcaggggtttctgtagcttttggtgcaccaattggaggagttctttttagcctggaagaggtaggtgaaaagaatacaacaattaaaattatatataattaccattacaaatatatttcacacatttcagttttgtaggtgatgtaataggtagagactttgttttcaaatttatttttctaaagttgttttccactcattcttaataaaaagtaaatgttattcatgctccatacctggaggaaactttttaaaaatttattaatgtatgaatgttagtaattatttaaaatctaactttgttgacatatttaaaagtaagaagatgtgaatttgacttaatagaggacatgtgaaacaatctatttccattggctaaattctgtatttttagtagagatggaatttcaccatgttggccaggctgtttttttgtggggtttttttgttttgttttgttttgtttttgtttttgagacggagtttcactcttgttgcccaggctggagtgcaatggcgcgatcttggctcactgcaacctccgcctccagggttcaagtgattctcctgcctcagcctcccaagtagtttttgtttaaaaaattttaatcaattcctatgttgtgttttaaagtttttcccatgtgattatttctgatacagttagtgatgttaaagaaaataattttagtgacttcagtggattattttgtttttgttttcttaataggtgtttaagacttttctttttacataaaaatgtaaccaggaatttttttttaattttttttgacaaataataattgtttttgtttatggggtataatgtgatgtgtctatacatgtatacattgcggaataatcaaatcagagtgattagcaaatccctcaaatatttattatgtccttgtggtggtgagaacatttaaaatcctcttttagctattttgaaatatataatacatattattaactgtggtcatcttactgtgcaatagaacaccagaacttattcctcctctgtaagttcatacccgttgactaatgtctcccctttccctgttcacctccccaacccctagcctctggtaacccctattctactctctacttctatgaatttaactcttttagttcaagatgtttttaaatgtacttttttcttttagttgtttgtattctttttttttttttaatgtagaagaggcaaattaaatgcattataagttaacaggagttggtgatggtacatttatttttaactaccatgattgaattgaatgtgaaactcattttgaatataaaacagcactaggtattctattagtatttattagacatttatgatcaattgatactgtcaatttgtaatgatgatcaccatctccaaaaataataataacatcaatttttcttattacagtaaaatccattacatgtaaattctaactacagcaaaatttagagctaggatatttaccattcaagttataatatatcagaaacatcttataaaattatagcattaatttttcttttccttttcttttttttaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggtaagtgctaatgtgaggtgatatttgggtaattttggcatgttcaaaacttatatgtggaatgagagaggttgttgtttcataaatgactgaaaaaagtacttatcttttgagtttaattttaagtaatgaaaaagataattccttagcatatattgttgaccatgttatctgttgctatttaacaaattaccccccaaaacttagcagcttaaggtaactacttattttgttcttgatattgagtcaacgacttgggaagggctcaactgggcaatttttgcttgtggtctttcatatagttgttattagacatggcgagggctaatcatctcaaagcttctttttttcgtttcctttttaaaaaactgtttttgtggatacacagtagctatatatagttttggggtatatgaagtattttgatagaggcatggagtgcataataatctcagggtaaatggagtatccatcacctcaagcatttatcccttgtgttacaaacaatccaattacactcttaattatttttaagtgtacaattaaattattgaatatagttcaaagacttcttcattcatgactagcacctaggctaaaaaaattcagacacctgggctcctgggatcaatcacgcatactgtgtctcttgtgctcactcccgctgtctctctctctttctctcgcttcctttttcctctctctctgtggttttctagggtggtggcctcagggaattggatttcttatattatagctcaggattcccaagagggctgtttttaatgtagccaaagaagtcttgcagcgtgacttgttttattctattcattgaggcagtcacagaggcccgaccacattcagaggagggacatacacttgctgggacaagtgtaagagaattcatgatcatgttttaaaaccacttttattagtttcctattgctgctgtaataaattaccacaacttaatggcttaaaagccacacaaatttaatatcttacagttctgcaaatcaaaagtctgaaacggatctcactgtgctaaaattaaggtgttcgtagggcattctggaggctgtaggagagagtcttgttttttgccttttctggctattaaaagctgccagcattccttggctcctggctgtctatttgcatcttcaaagccagcagtagctggtcaagtctttctcttgtctcatcaccctgacccaaactctgctaaatctcccttccacatttgaaaaacctttgtgattactttaggcccacgcagataaatcagaaaataatctcctttttcaaggtcagttgcttcgaaactttctttctgccaccttgattcctccttgccatgcaacgtaatgtaatcacaggttctgggaattaagttatggacatctttgatgagccattattctgcctcataccagtatagggtattagcttgaaaggacactgcagactcagttaaattactagatctataaatacatgcctttttccatcaagaaattaaggcagctgggtcttatgccctgggacattgcttcttttggatttataaaataacaaaatttgttgattaatggtctatcagtaaatataatttcttatgtgactatcagtgatatatatggggaagcacatatcagcttattcttgttctttaaattactacccctgtacttcatgtaatagtatttgctagtgatgatgtgcttttacagatgtaaattaatgtggaataacagctttgtttctacaaaattagagtggttttagtttttgaaataaggtctcttttctcttgtcctaagtctgtagtccactgagtatctagagttaaataatagaaaagcctggccaggcgcagtggctcacacctgtaatcccagctctttgggaggccgaggcgggcagatcacaatgtcaggagatcgagaccatcctggctaatgcggtgaaaccccgtctttactaaaaatacaaaaattagccaggcgtggtggcaggtgtctgtaatcccggctactcgagaggctgaggcaagagaatcacttaaacccaggaggtggaggttgcaatgagccaagatcacaccactgcactccagcccaggcaacagggcaagacactgtctcaaaaaataataataagaagaaaataataatagtaatagaaaagcctaaacattttacctttttttcttagggaatcaagttaaaagagctgttaaagctctttttcctacaataagtaagtgttgggtaaatcccaactttctcacagtcagttgaactacaagaagctggaggcaattggcaggcctttgttaagtcccacctttgactcagctctggctgaaggatcatacctggcaagagagtgtaaaacacactttgattttttctattgtttatccttttaatgatcctaagagactcaagagtacatgccatcattttgtgtttggctcatttcatattcagaggagtttattactctttcagtagtttgttcgtttgtttgttttttgagacaggatctcgcctttttgcccagactagagggcagtgttgcagtcttggctcactgtaacctccacctcccaggttcaagcgattctcctgcctcagcctcccaagtagctgggattacaggtgtgggccatcacacccggctaatttttgtgtttttagtagagatgtgattttgccatgttggccaggctggtctggaactcctgacctcaggtgatcctttgggaggccttggcctcccagagtgctaggattataggtgtgagccactgaacctggcctctttcagtagtctttaaatgatcttgcttatggtgcttcttatccctgtttattatccttattaaatttaatcaataaatatttttctctttttaattgattcatataaatagacttacctgagagatataggttcagttcagagcaccacaataaagtgaatatcataataaagcaagtcacataaaagtcttagtttcttagtgcatataaaagttctgtttacactatgctgtagtcttatgtgtacaatagcattatgtcttttaaaaaagtaatactttaatttaaaaatacttgattgctaaaaaatgctaatagtaatctgagtcttcagtgaattgtaatctgttttgcttctgtagggtcttgccttgatattggtggttgctagaggtaggactggctgtagcaattcttaaaataagataacagtgaaatttgccgcattgattgacactgcctttcatgaaagatttctctgtagcatgtgatgctgtttgataccattttacctacagtagaccttcttttcaaaattagagtcatcctctcaaaccctgctactgctttatcaactaagtttaaggaaaattcaaaatcttttgtccttttaacaatgttcacaacatctttaccaggactggattctacctcaagaaaccactttctttgctcatccataagaagtaactccttatacattcaagttttttaaatgagattctagcaattcagtcacatctttaggctacgcttatcattctagttctcttgctatttccaccactctgtagttacttcttcaactgaagtcttgaacccctcagagtcattcatgagagttggaatcaacttcttccaaactcctgttaatattgatattttgacctcctcccatgaaacgtgaatgttctggatggcatctagaatggtgactactttttgaacattttcaatttattttgcccggatcaatcagagaagttgttatcagtggtgggtttccaagttgtcaggggcgaaccatacagatcttcagcaacctcaactcttgccttctcagaggaaagaattctacggagggacataaggcagaaaaagagactgaggcaagttttagagcaggagtgaaagtttattattaaaaagctttagagtgggaatgaaaagaaattaaaatacacttgaaagagggccaagtgggcatcttggaagacaagtgccccatttgaccttggacttagggttttatatgttggcatacttctggcatcttgcatccctattccattgattcttcttttggggtgagttgcccacatgctcagtggcctgctagcacttgggaggggagtgtgcacagtgtatttactggagttgtatgcatgcttacctgaggtgtttgttgcttaccagccaaatgtccctaggaggtcatattcataaactccatgattttgcctctaaatgtgcatgcttgagcccactcacccaactcctgggatcttatcggaaagctgccgatcgctagtttcaggtgtttctatctattggaagatggcctttccctgatgctggctgcaaccaattattactttagagagagagcatgagagctgtctcaccatcatcacctgatggttgcctgacattcctggtggggttgggaggatgcctgtcctgccctgctcatgcctgactagctacctgctgtaacaaaagtactatctatggtagctgtagccataggaaatgcatttcttcagtaaaacttaaaagtcaaaattagtctttaaaacaacatgaatctccttgtacatctccatcagagctcttggaagaccaggtgcattattagtgatgagtaatgttttaaaaggaatctttttgtctgagcagtaggtctcaacagtgggcttaaaatagttagtaaaccatgctgtaaacagatatgctgttatccaggctttgttattccatttatagagcacagagagagtagattggcataatttaaggattacttaaaaaaaaagtctttgattactctcaaaaaaaagtcacgtctctcactttatatcaacagctaaaaatggccaggtattgtggctcacgcctgtaatctccatgctttgggaggccaaggcagaaggatcacttgaggtcaggagttagagactaacctgggcaacatagtaagacccatctctacaaaaaaaaaaaaaaaaaaaagaaagccaggtgtggtggtgcacgcctgtagtcccagctactcacgaggctgagtcggcaggatcacgcccagccaagagacgtgacttctgctttcagttgtacacttagagaccattgtagggttcttagttggactaatttcaatatcattgggtctcagggaatagggaagcctgagaagagggagagacaggggaacagccagttagtggagcagtcagaccacatacaacacttattaagttcactttcttctatgggcatggttcatggtgcagtaaaacaactgtaacaggaacatcaaagatcattaatcacagagcactgtaacatataataatagtgaaaattttcaaagtattgagagaattagcaaaatatgatacagagacacaaagtgaccacatgctgttggaaaagtagtgctgatggactagcttgatgcaaggatgtcataaacctcaatttgtgaaaactgcaacatgtgtgaagcacagtaacacaaagcatagtaaaacaagatatgtctgtatatcagtcaaaatattgggcaactctgataagtttgtccacttaacattgtaccacttaagatgaatagcatctaccatttccgtcatttgtaaatatataggaggacataatcacataatcttgaagtaaaagacagtgcttaaaactgaatcagttaagttttatgaaaaatacttcatattgtacttttaaaaatatatattttttaatttcaatagcttttgggttacaagtggttttggttacgtggatgaattctataatggtgaagtctaagattttactgcaactgtcacccaagtagtatatattgtatccagcatattgtccttttttttttcttttttttttttcatttcaccatggactaatgaaaattttgttagggactgacattagggcacccttgagctaccttgagctaaaggaaataacccttgaatttttttctgtttggcctagagaatgtggtttgttttgtaactgaattcatgggattgttaaggtacaagattttgctttagttttatttgtactaggattttgctatattaatacaatgtgaaaagaatcaaaagtgttagaaataaatgcatagaatgtaagtttcaggcatgtgagtagaggatctctgctccataaagagttctgttgttgttataggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtaatatggctgtgtctgcctgtgtgtggatgtttgcaagtctgagagagccaagagaaagtgggacacattcttgcttaattggtgggcggattggttgagtaaaggagggtgccaggaggagatgttttaacagataagaaacagtagtactattagggtattatacagtaccggttttctgtcttacaacatttgttaatacaagaatttaatggcattagcatattgtaatataacttaatacactatggcagaagccatctaagtacaacataagcttaatttgaatcctgaccaaagatgtctttgattctttcatcgttaaggatcttggcttacctataacaactatagcataatacctaagattagcattgcaacagagtttcagagtaggtttactttggttctgaaatgatttattgttagccttagtaaaagatgtatttacccatgctccatcatctaaggtatatttgtaacaaaatgagaaaaggtaacttcattttaatgagaagaaaagcaaaatacctacattaagtacttgagtctatttaatgtctgttagggcaggaaaaaatggttattgcttttcatatttaaaatatcagctacactctggtgataatattaatggttgccattttgaccagttttgtttagtgaataaaaattatgtgattattgatctttaaaaatgtaatatcaattaaaaggaaaggacagactcattttcaccaaagtagcaagtatttattaaatgtccactttctttttagcattgtgctagatacagtgcataatacaaaaagaacatggacccaatctcgactctaatcaagttgaggagacaagatgaacactgagaatacaatagtgaggaatactaacaaatatatacaaggttaaaagagtctaagtatggtaggaatataggggaagaaagagctgaagtacttcaggaagagtagaacatgagctttatttaaaagattagcagaatttaaggaaaaggtgactttgttgaagattataatgtgaagacaaaggaacgaggatgggaataaattttgtattcatgaggctttgaagaaattgactctagagagtatattttgggtacttttgggaaatgaagttggattagtgagaaggaacagattatgaaaagacaagaaacctgattaatgtcaggatgattttatatttgaagttggtcagatttatggcagtcctggctttgccatttttagtttgatgactttgagaaagttccttcttgaagttttaattttctgtatataaaaagtaataacacctggtgatctgctaggtttgttttgaggattatatgagataaaatgcatgcaaaactgttataatagtgcctggtaaaataagtgcctagttttaaaaacaagtctttgtaaactgcttaggacatgcctggtatagggtaggtatgtaatacatagtaggtaggatctgtctccttgctatttttaggtaaaaaaacaaaaggaagagcttcagcttaatacagtatgaactgacgagccctggtaggtttttgagcaaaagagcaacacagtaaaagtagtacttaggaaagattaacaagggaacatggcttatacagtggtaatggggcctggagtcaaggaggtaagataaaatggtattataattaaggaatagccaggcacgatggcacatgcatgtaatgccagctactggagaggctgaggtgggaggatcatgggagtccaggagtttgagaccagcctgggcaactgagtgagaccccaaatcctaaaaaatacaaagtaaaaaaggaataaagtcatgagggcttggactggattgataacagtgagaataccgagaaagggaccataggcagtgtgaacgcagctcactgcagcctcaaaccccagcccaaacgagcctcccacctcagcctcccaagtagctgggaccacagacatacaccaccatgcatgactactttttttagtttttacttttgtagagacagggtctcactgtattgcccaggctggtctcaaactccttgacttaagtgatcttcctgccttggcctcccaaagtgattacaggcatgagccacagtgcctggcccaaatagttttctgtgagtgaatattacttgcatcgttaatgtaaatcaaaggcatcaaagtattttactctttttgaaaaaaatttagaggagaaatttattatattaatattctacccatatatgagtttaatttgtaaattgtagcaaagcatgatgtgctttactaaattcctttataattagaataagcttttataagggtgaaattatgtctttgctacagcactaaaccaaaatggcaaaattgttttagtcggtaagctttgcttttttaaaatatgaaataaacaggtttttaaaatgttattttaatagtcttctctgttataaacaaagaaaattggtgtttctctagagcttattaaaagtagtgattattgtcctaaaagaggagtagcagttttagatgctaatgcttttccctgactgagttctatttgccatttagttttaactgcctagtgcaaaaattctaataaaatgtaatgatgaggatcctgtccttcctgaccagtgggtgcttacttttttcaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaataggtaccctttcaaaaatatatatatgtatatatgagatggatttctggaagaaaggaaagcaataagcagtaacatttaatgggttggatttgtgggggcaagggacattattttatgtcccttaaaatcttctgttctttaggaaaggaaggtatgcttcagtggatgattttctgctatttagcagaaaatctgtatttcagttttgtcttttgatctggcattgtaccagaaattggagtcagattattttcccactcagataagcctagataagttgatcttggttattcaaaacagcatgtaatataagaccttagctaaatgcattcagtcaaatacattcttgtatttaataaagttggcttattggaatacaagttattgaaaatctcatcttcatcagtctctttcatattagaataacactgttttgctttatcagtctttggggttagaattataatattaatttataatatctgatttaaagtgacaatcactgagatttttatttctgatcaaatgccaggttgaaaaagtataacgtatcagtcctgttgtgttttatgcagactttcctgaaaatactgtttaaaggtattagccatagtgtatttcttggagataaattaaactttctatagttctgtttctctaaaatttgtttttctctttaccttatagtcccgcagtattgatgaggagaccattaagacttaatatttttttgacacaatcttatatctcttcctccaacccctaaaaagtgactgaggataggtacatcaagccattgctttgttactccccaggttttagtgccagaccctgaatggaagtgtcaagcctttggcctgtctgaaaggtcattcctgtgagcatatcatctcccttccagcttacctctgtggccattgcaaaaggatttaaaaataatttttgtgccatttgaatggcacaagaccagacagtgtatgtgggggagtgtttctcaaatcaaactggaaactctttaatttgtaagaaccattaagcagagagagaaaaaagaaaggaaaagaaaaaagatcctacagagaacaccctgttcagtttgggaacaggctacagctttggatttttcaaggcctagcattcccatcattctaaattttacttagctaatacaatagtagttgccagagctgatgacatagtattttgtcatgcttggctccgttcaagcattttagttttttagccattaccatggctagacccagtcaaaagaatttcattgtttaagattcccattctctagtttttactagtagccagccaaagaaaagaaaaaggaggtcagaatttcggtatttacatagaaatttaaggggaaaaggccaggcatgtttttaaagtgtggaaattaagaactattcattatcccactgattgtgtggatgtgttttttaaagttttgttactgtcttgagagagagaatattgagataggacataatgttggtttaagggaatgagggtactttctgtaggtgaggtgccaagccatgtcatcagaaatgttagtcacatgactttctaagcacaccttaaatgttttaccgtgtatgtttttgtaaagttttaaatttttaactgggaaaaacagacctgtatattaagttttatatatatatataaatttaaaattacatatatatgtttatatatgtaacttttatatgggagagatatatatttctatatcctctataaaaaaacatatctatatatgaaaattatgtacgtaaatgttaatttataattaattatataaatattaacataattacattatatatatagaaaacctagtgtacagatctgtatataaattaaaaatgtatgtgttatatatagttacatcatataatacatataattgatatatataatgataaatactttattgaaggatgaaaaaatttccatgctgtctcataaaataagatggttgacatatgctaaactagatagattctcctgtttcatactaaagcagaatgttgtaaaatattaaattcaaatgagatgtctcagattaaggccatttcaacaggaatgctgagactttaaaaaaaaaaaaagtctgaggctgggcgtggtggctcatgcctgtaatcccagcactttgggaagctgaagcaggtggatcacttgaggccaggagtttgagaccagcctggccaatgtggtgaaatcccgcctctactaaaatacaaaaaaaatacatgggtgtggtgacgcatgcctataattccagctacttgggaggctgaggcaggagaatcacttgaacctgggaggtggagattgcagtaagccccaccactgcactccagcctgggcgaagagcaaaaccctgtctcaaaaaaaaaaaaagcctgaattatatcagcaaatgaaaactgtaatgttgttctctgtttcagaggcccttgaatgaatagcactaaaaatattttttaaaaaatgaagaaaatgaaaattgtaatgttccttatttaaaaggcccttgaatgagtagcatcaaaaatatttttaaatgggaggccagggtgggaggtttgtttggcaccaggagatcaagaccagcttgggtaacatagcaagacctttgtctctaccaaaaaaaaaaaattgtctgggtgtggtggtgccacctgtattcctagctactgggaacgctgatgcaggaggatccctgggactctagagtccagagtgagaccctgtctctaaaacaaacaaacaaacaaaaactgtatttatgtaaaagtaatacttgttttttaaattttatttatttttaattgataaaaattgtatgtatgtttatgtgatgtatatattgtggaatggttaaatcaggctaattaactcagattttttgtgtgtgtggggagaatatctaaaatccctctccttagcagtttccaaatgaaatgaaagaataaaagtgatttatttttttgagacagcatctcaccctgtttctcaggctggaatgcagtggcacgatcttggcttacttgatcctcgacttccctggcatccggtgatcctcccacttcactctcctaattagctaggactacaggcatgcgccaccatgactggctaatttttgtatttcttgtataggcaaggttttgccatgttgcccaggctggtttcaagctcctgggctcaaacgatccacctgcctcagcctcctgaagtgctgggattacaagtgtgagccaccacacctggcgaaaagtgttatttttttaaatgacaaatttaagtcaaagagattgaatgttcacttctggtactttgtatataagagaaacattccattaaataattttttaaacatttctaaaattacatattttgtcattaaatgtttaaacaatcagtataatttcattgatacagtgtttgttattttgtcggtgtttaagattgataattggggttagttttaattcagaatgttattctatttaatgtcacacttcatgtctttttattttgtatatctattaatgaattattttagctatagttattactgttttagagatgaggtcttctatgttgcccagggtagacttgaactcctgggcttcagcaatcccctcctcaacctccggagcacatgagattagagacgtgtgccactgtatctggcctgctgtagttatttttaattcttttgtctttcaacttttatactagagttagaaatgatttacaaaccctattgcagttttagagcgttatgaatttgactatatatttcttataacaacttaacttcagttgcttacaaaaactacagagttttactcccccgtccacattttatactattgatgtcacactttacatctttttattttgtgaatccattaatgatacttctggtagtttttacactccactattcagttgtcagacaccattcagttgttagattgttatgagctaaaagcaacttaatgggtatttttcaaaaatcatttatgtcaattgctaatggacttcttttctatgccatgatcatgctttttttatttttgagacggagtttcactcttgttgcctgggctggagtgcaatggcgcggcctcagctcactgcaacctccgcctcctgggttcaagcgattctcctgcctcagctgggattacaggcatgtgccaccgtgccagctaattttgtatttttagtagagacagggtttcaccatgttggccaggctggtctcgaactcctgacctcagttgatctgcccaccttggcctcccaaagtgctgggattacagacgtgagccactgcgcctggcctgatcatgcttttaaggtggttgagtaagtactagttgctggggctttacttagtgccctcctactcaaatgtgttagaacatagttaagaaggctgtagtgttcaaaaggagtaaaaagcagtgcagtgtttgcagtaatatctgcttctcaatttaggactgatgcttattatggcttaaatgtttttgtagtaaaatttgtattcaaaaaatatatttttttttctttttgcgacagagtcttgctttgtcacccaggctggagtgtggtggtatgatcatggctgactgcagccctgaccttccgggctcaagtgatctttccacctcagcctcccaattacttgggaccaccagcatgcttggccgattttttttttttttttttttttgtagaagcaaggtttccctatgttgccaaggctggtcttgaactttagggctcatgtgatactcctgcctcggcctcccaaagtgttaggattacaagcctgagccaccatggccggccaaaatattttcactataacaaatatcatatctgtatatactcagttttaatactaactcaaagtagaaacataaagctgaatgactattttattttcagattctctccattgagtttccttctccgtcttgtgtgatctctgaacttttctccatctttgccacttcttgtctagcattttttttttatcagcagtttcattcagattttttttttagttctttcaacggtggagtggaagtaggcagcaggacagaagaacttgaagcagagcacactggagaggagaaattaacaaagcctttatgaataaaacaaccccccaatatcagtctgtgtgcattatgagcataattgtactttcatctcatctgtaatgttcatgacttttctagaaaattatactttaacatgagaaaagaaaaagaaccagctaattcatagggatggaggacacagcatagtcaaagcaagaatgaaactctctttagtgccacctccagtgcagaataagtaacattcagcagaggcaggtttcatttgataatggattcctataataaactgcgctcagaatttgtgcaggttttaaaatcccgtattccaaacccacttccttagcccccaagttagaaaacagcttcagtaaagaaaattgtacgatgatataactttaccaaaaaataatttctttccatgaagatgatatattattgttgacttctaattcaatcaaatataaacaattgctaaatggcttttcagttgactcctttcttggttaaggagaagataggaaaaaatgaagggatcagaagtcataggatacattaattttttttatctctgaataaacaggttgcctacttaaaaatctatcagtttaaaagtgttggtctcttctctctcttttcagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggtaagtctggtaccacaggaatcagttcacttgctagaatataggatcctttttagtggaatctatatagttattaggggagcatgtgagtcagctcccaggtgggaaagtctgtcctatggtatagtcacaaatataggatcagtcaatcaaatttcacatttactaaggaataagaaagatgtcatctgcctgctctttgccaaacagtgacatttgtaaataatacctcaaagttggaaaagaggtgctgaaagatctccagcatgaaagcatgttgagcttagagtgcttcttttcctagggaagagtggacctaacctgcatggagcactgcaaaaacctgttttatttttgtaaatgtttcatttttagtatataaatttctagtacaataataagtttctagatattttgctatttactctttcagccaatatttgatttatcatgtaatgaaggaaagaatatatacttaaatgaaatttgtaaatgagctaaaaatctcctttaacaaatgctttgtttccttttgtctacctttctctatacacaaatcttttatatttatataactgctaaggacaaataaatactcatgtatttaaaatgtatacattgataatttatttttccaccttttacacatgaactgccagtgtttctccattgacaggaatataggaaagaaacagatgtcacgggggttgtggagaccttaatgcacagaattgatttagcaaatacactacttcgtcaccactgctctcttttcctggacctgggatctgtttctccacacttctttctttaggacccttcatttccactatatattctttcttgttgaacttaagaatgttgttttatccgaaggcaaataccaaaaaacagagggtattcttggattatgcataaactggatggctaatcctgaacagcgtaaagctggttgaaattctaaacagagaatcatagcagttttttgttgttttttttttttaacatgttgtagaaaacacattggtgacagaatacatgactcctgtccagagaaaggagagaaaaagaacagaaaggaaggaaatttgtttattgaacaccttcatattttctcatttaactttgcaggacctctgcaaagtaggtagttatagccctactttacagatgtagtaattaaagctcaagaagctttaataatttgcccaaagtcatgtggtgaacaagtcatggttcaaggaatcagactgtctttcctactttaaaacccagcctcttgctactattttgcactgtaagtgactgatagaaatcctctttctttgtgatttcttaaactactaaaacattttcttggccaatatattagattgagttaagaatagaaatatgaaactagagaattagatctatgtttagtgtttttcactgcgctaattaaaataactctttaggaatatgaagtaaatcattaaagagataaagcccttaaaggcagggagtttagaattattaaattctaataatttagatactgattggagaagagatgtattcataagttattattgttactatttgtctttgtgtaatattgtttgattaaatgatggcaccgacttcattaagtttaaaaactcagtactagttaaatggggcaacttttcataaagctttgctagtccttgagcccttttatttgttaaatggctcaactggaacctaagctgagttgttacaaactattatttgcttcaagttgttttctgttcctggcatggctttttcttttgtgtactgacaaatataaatgttattctgttgagttatggttaactatgaacacagaactgttagggattaattttcatatttcagtttgttgattaattcccaggtatttggcagcatagatattagaaaggaaaatatttaaaagaaagtgtaaaaataacgaagtgtatagagcgaggggtggatagctaattaaaattttgtctggtcctgcctgttcatatgaaaaaaggggttggactttcttctaagggaatatattaaattgctttcatcatattttccttatttctgtctgtcaaggaaaataaattgatacatatatggggagaaaagagatcatttagggaagtggctcatgggactttttgttttgtttgaagtgtattaggaagtcgggtgttttttttctcacttaaattatttaaaacccagaaaagaaatgatatcttctggtttttaaaggagaccatgaagttctgcatagctatcattgatgtgtagttcatactgcatttttagaagtggaaaatagttatttggaggaagataacaaatctggaaccttaggtgcaaggagaaaaagaatagatgaaagggaaagatgtttgtaaattataaaaatttcaattagctattggttttctgcactttatattttaactgcagaatttttcaaaatcagttaatcttggtggaattagcaggatgttaataggagtgactcagaaaaaacattttgtgactgtctaagtttggaaagtattggattaaatacaattgaggtttctttactatggaactcctcagaacttataatatgttgatattctttgattcccagatgaggggatgggtaataggatacatggttttccagacttgtttgaaaatgcaactatttttgggttgcagggaaggatatagtagaactcatgggaactggtgtttcttggaacatgctttggaaatgctgggttatgccctgttaactcttacatcattagtttttagcccaaaaggaaacagcaaataatgttttatatgagccacattttgcgttgattttccttccactctgtaaaattactaaagcagcactctgactttattatgctcaaatcgctcttctccattaatgtgtgtttctccatcttttagggtttttactttataaatacagagattactgtgtaaaattctaaatttgccactgggtcgttatacatttgtaaccttcctcacagtatattttgtgatttggcagagtttaccaatatagatgatactaactgaaattaatcattctgtataattggatagaaaagcatgagtaagaattcaattggtattatatttaattaattgccaagattttcacatttcctgactacaacaataaaatcaaatgaattgatggcttaaaaaaaagaaatctcaaatgtttagtcaatgaagaacatctattgaatgagtgaatgttcattatatatagtgcattttctgagcttttttggagggggaagttgctcccatgctctgagaacttttaaggatcgatacattatttttaacataataatgagaaaacatgagcagagaacccatttctgtcattcccattctctatcctcctgctcccccacctcccaccccagccatcaagctaagtaactattttacacctggacgtagctataggaacaggctactttgaagtctcctagtgacatccttcaagtctgaatgttcaaaggcagtttaacagggaggttgacttaatgagatcatcaaggaaatgtccagtcatcctgaagggtattttggatgggcttccagaatttaaagattaaagtttttttaaggtttttttattttcactgtttatattgccacattaatttccattataaaaccagtaaccatagttttgttttaattagcaatctaattattttcatgtatcctcattatgagaatttatgtccatcactttgcttgatgtgataacagtgacatgctaaatgagaaacaattgttatttagaaaaaaatgcacaaagtgaaagtccttttaatccctaatcataaatacattttattagcttactttaagaagtggcagtcacagctcctgaacattagggagtgtttcttttggtcagcattatttatttagtgcacattgcctttaattttaatttgaaattatagtaaaatccacgggagtttttaagtctcctcacagccttttgctaccttttcaccaaggtagatccagatgataactgctgtgttgtgacatcatagaaattagaaaaatattttcctctgaggaaagaacattgtaaatgaaactctacatatcagaggtctatagctatgtatcaatattaagtttcttttgtactttgctttgtagtcatcttcattccaaactttcataattattatttttactttaaaaagaaaaataacccaccaatattgaagattagtattgtgtcacttttgaaagtcagtagaatttatgcaaaaggaacctggaactttaaatcattttgtttttattttctaaagttcatgagactcattcttatggttcatgtttttattttttctctcattctttatcattatgattggaaactcttttaatttaatttctcacacagttattagcataataatctgtttcaggattgtcttggggatcatcacaaagaagaacatattagagcatctcgagcaactaaagcagcacgtcgaacccttggtgattagatatatcagatctcctcattagacaccttagaagtcaggaagcatgaaacttgtgaactgttgagttctgtctttcccagatatctgctgaacaaaaatatcctactatgctgccaattacatttgtatctgataaaatgtgtctgtaagataaatttagatatgtgtaaaatcccatttatagaaagtaagcaaaagttaacatctctcatcaaatcattcattacaatttcagaactgtaaacagtttggtagtggaataagtgaatattattggacattcttaaagtgaatatggcaaatctgtctacctcagtggatacaccggtctcagaagacacctgactggttaaaaatgtctgacccatccccgcaagcccttttttttttttttaaatgtttcccgatcttgtggtagtcttatggtaaatctaagctcctaaaggattttaaaggagcttagcaattagaactgcttacagttaaatggattttttaatgggcacactaactagagtgtaatgtgtatattatttgtgatcatagcattagttctttttctgctataccctgcatatcttcaaagtcacagtgtgtgtcctgccatctcattagtgaattgtacctagattatgtgtgtgccccttttgtatgatgtttctggaacgctataagcagcttttagagtcaaatgcattcattttaactggctttatgtcctagtggtttcatgactacaaatttgaattatcttactgcataacataaaaaatgtctggctttagcaattaatgcccgaaattattttgccctgcaattgtcatacctgtatgaaacctgtcccagtttgcttaagtgcacaactgattatgtattcctgtgtgtatgctaatatttcacaagtgtttcatgcatccttttttaaaaaactactaaccagaatattatcgtagctactcattcattctgctttctgcttcacctataataatcttttaggactgccttctgatttttcacctatcttttaatgtaagcattaacaactaagactttcataaaagcactgtatcttaactttcctggcctaaatcaaaaaaaggaaaacattgataagtgtcctagaaacttggattcttttatagatttgttcttggggctctgatgtttgggattgacgttctgtgctgaccattttatatgcattttatcttaatagtatgtgctttcatgaagattctgatacaagtgggcaatccttaaattatctttgaaaaattggttaattttggttaaaaaagggaaagtggctgggtgcagtggctcacgcctgtaatccccagcactttgggaggccgggacgggtggatcacaaggtcaggagttgaagcccattctggccaacatggtgaaaccctgtctctactgaaaataattggggcatggtggcacatgcctgtaatcccagctacttgggaagctgaggcaggagaattgcttgaaccggggacccaggaggcggaggttgcagtgagctgagatcgcgccactgcactccagcctgggctacagagcgagactctgtctcaaaaaataaataaataaataaatgaaaaagagaaaatattgagaggatttggtcatcattttactgctctcttcatgtgatggaaatcaattttccttctcaaatgggatcagtatcatttcctagtcatacatccatccagtttttgttacttttttgttggcatacattaatcaaaatagctctgcttcattgaggcatgcagtcctcagactctcggtggaaaggctgtcatactattagtgaccatagtaactttttataccaaaggatggttgctggataattttaatatctttaccaataaagtactttttggaaatacaaaatcaggctgcttgctttgctctattcctgtcaacaaaaaggatttagctatagatttagcttctccttttattttcccttttatttcataggagtcttctgtttattcctttcaggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctg

SEQ ID NO: 35964 - DNA, 81668 bp, Homo sapiens
tcccgtgtcgctcgctttctgtcagcctctctccctctccctctcccctctccttcctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaaggtaagtcggcgacgcgcggcgcccgagcccttgcgtcggcgcccgggttcgtaccccggccaggtccgcggcgctcgaggtgggctgctggatcgcggcggggcggacgcctgggccgtttgtccacccgctgggcctctgggccggggagcggaaggtgaccctctgcgcgccccccgccgtttcccgcccgcgccgccgaggggggcggggaccctgccgggcaggggccggggccggggtcggggcctcggggctactgcaggccggcgtggcctcccttgtccccgccgtcgcgcgctggcccagaaaagggggcctctgtcgctgccgtccgggggcgttttccgcacccttcccccactgggttttgtctttctttacgtccttctgcctattgctcgccaggccctaccccctcgcgacagaacttctttgttgactttgaaacttcgcgaaaaataccccgccagatgacggccgagtggagtgagctgacccctgttgaaaagcctggtcctcggcttgcctgccgctcgagaatctgtttactaaacggggaggctcttttgttgcgatccatttggttttaaatccttgacacctataagcagggttctgtttgttttgttttgcgattgcttgtgttttggatacggttacattgaacaaactgacccttgtaaaatgaatacttaagatataaacgtccacaccttatgtctcttcaaacgcattttcttacccactgaaggtagtagattatttttaaccagctgtgtttttaaatgagtggtgagtttatagaggaaattactaaattttgctttttttgatgttccggttatcgtgcaaatgcttttctactttaggtatatttatgggggtatgagcgtctttcaaccttatgggttgcgattttggcgattttaaacgaaaatgaattatcaaacgccgtcatggagtgcaataatgagtgaaaaaagtttgatattatctatgtaatgagttgataacgacttatttttttttaaagaagtcttgcctttaataaatacctcaactataacatgtggcacttgatgtacattcgcgttccatcttcgtaaaaagcctgtggaataggtaggtattatcttttatagatgtggaaatgtaggcttcgttattttaatagcttgtcgaagctttacacaggtagtaagaggcagatttgaacctaggcattctgattgcaagtaatttccctttcattatgccacagtgtgtttattatatacactgagtgtagctaatcgccactggagacgcctttggaaaaaatagtaaagcgaaactgctgaaggttgcgaactatttctttttgacaggtggtccttgcgtgtaaatttccatctacataggtttcacatccttttagattcaggttttaatgagtaaatctagtaaggcatgtatttatcacaggataggtacggacgtattacattcaattctcattcttttggcctgggcattgctacttgcatacttttatggtgtgacagtaatctgtggtaattcaggaattgcgctcgaagcacgtatggaatcatgaaatattttcactgtacttctagtgcttaaatatattttttctcttgtaaaattataatcaggataaggtatacataacatttatttattgaacactgttgcctgttaaaataacatgtgctgaagactcaacgtgtagtatgtgctttactaaacactttatatacatttcatttaattctctcacatcgttaggtagtcggcattttcattttacagatgaggaaactgatggttagtatgattaagtaacttgtccaggataatacaggtagtaaatggcagaggcaagattcagactcatgtctgtcagagtcgcacttaaattagattatttatttatgagtgtatactacaagtccaatgttgaaatttatttttgtcactccctctataggatgaatcatttatataatttggtggaaactttattttgctttattttgttttatgaaattattagtcatgaaatgcaagtgaattttagtgccgtattctcatgcctgcttttgcaaaattccagtttggaagtcttctgacatttttacaattaaatttaagttgaaataacacttaaaggaaaagggagggttatagaggattaaaaatgatatagcaaagatgccaaaaaactaataaaaaatgttctatttgtgaaatcagttattataggttatttctttaaaaaatgcgacttaggttttttaaatctgcttagaaattttttggtaggagatattcaaagtatggccaaacataaaactaaattaaaaaaaaatcagtatcacctacttttgaaaacacttatactgttgtggttctgttttttatttattttattttattttattttattttattttattttattttattttattttattttattttattttccgagatggagtcttgccctgttgcccaggctgaagtgcagtggcatgatctctgctcactgcaacctccacctcccaggttcaagcgattctcctgtctcagcctcctgagtagctgggattacaggagcgcgccacctccctctgctaatttttgtgtttttagtagagatggggtttcgccatgttggccagactggtctcaaactcctgacctcaggtgatctgtccgcctcaacctcccaaaatgctgggattacgagcgtgagctaccgttcctggccggttctctgtcctttaaaaatatattttaatattctgagcaaagagattaagaatgttacaaacacatcaaccgtgcgtatagtaagtcttcccttccttttaaaaatagcacattgcttgcctctgatggtaccatatatgatagtctgatgctcagaatgttatgcatttgtagtaatacttagttccgacatggctgtttcatactaattgtttgctagattttaaagatctctaaagtttcttcagtattaaattaatttttgtaaaatcaacaggtttataatccattctcataatacagggatggataaatcattcttactgtgtatatgttatttgtatgagtgcagatgtgttatgtcaactgctatccatcctgacatttttaaacttcagagctataggagaccttagacatttgccctcctcattttatgggttaggagtccgatcctgtaatgcactgagatttctcagtttcagagaaaagtctatcctttggtcaaggatatacttttttttttttttttttaaaggaaaagcagtacaatattggaatagatgttgcaagtgttgatgtgcagttctcaaagataatattaaacattttgtcatagaatgcccacatttcggctcagtgatataaagctgaggtttttttttttttcttttccattttgctaaattactgcttgtattagcacaacataatacaaagtcttagtaattttattacagaataccaaagcagctgttctttatgctttacggaacatattcattcgaaaagtgtgaagctaaagagtattatggttgatcatgttctatatcactatggcaaaaatttgaggtaacttaaatttggaagaaatgagttaaaaggatagaaagttgtcagaatcagacagctagttcctctctttctagacccacacagtcttctttgtttccagagatgtctgctgcatgtttcttaccacgcattacctttcactgttttggcatgcttgtgaccaagtgtacatgcatttattcgttaaatgtttactgaggacctgttatgagccaggcactattctatgcatttgggctaggcaaggaacaatatagagaaaatcctttctttcatagagcttacattatagttattagcttaagacaaaataaacatgtaaattatatggcataactagaaggttataaacgctgtggagaacagtgaattgggagggaataagaagtgccaggatatgagggcatgggttgctttttttttttttttttttgagacggagtcttgctctgtcacccaggctggagtgcagtggcgcgatcttggctcactaggggtcgcagttttaaatatagcagtaaaggaaggcctcactgagaaggagcaaaggagaaggagttagccatgcagatactctgggcagagcattccaggcagagggaacatagcctatgtgaagtgtctaagatgggagcatgcctagagtgttcaataaatcaccaggagagcagtgtagctgtaacggagtaaaagagttggagaagagtaagtataatatgaggtcagaaagatatggagccaatggggagagagcatgtaggacttcattgacttttatagtgagatagggagctatgggagggttttgagctgacgtgagacataaattgtcttgatatgcagccagctttctgtatttgtgggtttcgcatctgtggattcatccaatgtcagatggaaaatacttggaaaaaaatagatgattacctctgtactgaacatgtacagcctttttttcttgtcattattcctcaaacaatacagtatgatgactacataacatttatgttataattattctaagtaatctagagataatttaaagtacagttgactcttgaacaacatgggtttttgaactacatgggtccacttacacatggatttttttcttcaataaatatattgaaaaaaattttggagatttgcagcaatttgaaaaaacttgcagatgaactgtgtagtctagaaatagtgagaaagttaaaaagttatgtcattaatgcataaaatatatgtagatactagtcttttactcactatcataaaatatatacaaatctgtcatgaaatgttaaaatttatcaaaacttacacacacaaacatgtaatggagactgtacatggcaccattcacagttgagagatgtaaagaaacttaaagatacagtattaaatcataactgcatgaaattaaccgtagtgcatactgtgctactgtaataattttgtggccaccttccgttgctgttgttgtgagctcaagtgttgctgttgttggagctcatctctccagtaaattgtatatggtaaaaagtatctctctggattctcttgtatttttcattgcatttagtgcagtaccctaaactttgaataacatgatgggatccatatgaggtgccactaagtgatgctggaagtgctccaggaagctgaaaaaaggcatgacattatgaagaaaaagtcgaattgcttcatatgtgccatagattgaggtttgtagctgtggttgctggccatttcagaatgatttatcttgtaaacagacaggtatcaataaatatggtacagtgctgtaaatgtaatttccttctgattttcttaatttttttctctagctttattgtaaaaataaagtatataatatagaatacagtatataatattacaatacatattgtaagaatgcagcatataatacagtacgcaatacatataatacagtttatgcattcatggcataattttattttttttgctccttctaagctacacagttcatctttttttaaattgttgtgaatttccaaaaaattctccaatatatttattgaagaaagaaatccgcgtataagtggacccatgtagttcaaactgtgatgttcacagatctgtactttaaataatctcctgagtactcataatacctagtataatgtaatacaaaggctgggtgcggtggctcacgcctgtaatcccagcactttcggaggcggtggcaggcagatcacctgaggtcaggagttcgagaccagcctggacaacatggcgaaaccctgtctctactaaaaatagaaaaaattagctggatgtggtggcgggtgcctgtaatcccagctccttgggaggctgagacaggagaatggcgtgaacgtgggaggcggagcttgcagtcagccgagatcgcgccactgcactccagcctgggcaacagagcaagactccgtctcaaaaaaaaagtagtacaatatgtgtattaatctactgtttatgttgtattatgttatgggaaggcttctggtcaccagtaggctgttagtagttttccattagtagtttttcgggagtcaaaagttgtatgtgtgtgtgttttttttttttttttttttttgagacagagttttgctctttttgcccaggctagagtacagtggcaccatctcagctcattgcaacctccgcctcccaggttcaagcgattctcctgcctcagcctcccgagtagctgggattacaggcatgcaccaccatgcctggctaattttgtatttttcgtagagatggggtttcatcatattggcttgaactcctgacctcaggtgatccatctgcctcagcctcccaaagtgctgggattataggcgtgagccaccgcgcccggctgtatgtggatttttgattgtgcaggaggtcggtgcccctaactcttgttcaggggactcctgtatatggaaggatgtgcataggttacttggaaatactatgctgttttacataagggacttgagcatctgtggattttggcacctgtggacttcctgaaaccaatcccccagggttactgagtctatctctttcctggttaagacaagtttttgtttgtcttaaattcaaatttctggaagctacaatctcactggctcatcttgggtcagttgcttatccttttgatccaggtagctgggtggtggtgggaaaggtaatggaagaataagaatcatgactggctgtgtccattcttgagctggtaagacagtgcaaaagagatctgctatattgctcaattagaatactttttagactgaagccctgtgagtgattattgctgggctatcctcttccagatgcctacttcccatttcttccaggccaggcttactttagtgggttttacttctgtcctgtaagactatgaagatcacttatttttagtataatacagttagaacagaaagagttcttgaaaagtgaataggaagtaagaaccccccaagggaaaacttaataattcagactatattttagaatgctgttgcagtaggctagatgagatataggagttacattaaggtagagggaatggaaagaatggaaaagaagaaatagaccaaggtagaattaatagaacatagtaattgaagaggtaatataaggaggaggagttaaaaatgattgatttttatattatttcaaatgggaatggaaagagataagtagttcagttttagatattgttttagtttgcaggggctgctgtaacaaagtactacagattgggtgcttaagagaaatttgttttctcaactctggaggctagaagtttgagatgaaggtgttggtaggcctggtttcttctgaggtctctctccttggcttgtagatgattgtcttctgtgtcttcatgtagtcttctctctgtatgtcttcatgtagttgtccctctatgtcctaatctcttctttttttaaagacgctagtcatattggattagggcctactctaaggacctcattttaacttaattacctctttaaagatcctgtctccaaatatagttacattgtgtatacatgcaggttagggcttcaacacgtgaattacggggggaggggcagtgcaattcagcccatgatagacatgaattcttgaaggcttggaagactgaagcattccctgtacacttattttttataacttaacttcattataatatctttttttttttgagacggagtttagctcttgttgcctaggctgcagtgcaatggcgcgatctcggctcatggcaacctccgcctcctggattcaagggattctcctgcctcagcctcccgagtagctgggattacaggcatgcaccaccacacctggctaattttgtatttttagtagagatggggtttctccatgttggtcaggctggtcttgaactcctgacctcaggtgatccgcccacctcggcctcccaaagtgctgggattacaggtgtgagccactgtgcctggctgtaatacactttttactttcctgtctctctccttcccttctgtcacctcttaatgtattctgtaaagatggaatcaggttaataaagtataatttacacacaaatttaccctgtttagggtgcagttctgttataacacttttgaaatagaatattggagattccatgtcttttttgattacttccccatttaccaaatattgggtacatgtctactacgtatctaggacctgtgcaacaatgttttctgcatgtttcatttcttcattccaagtccttgaaaagtgccaagaggcatttctattgaatggaacagtttgaagagcattgatgtagctagagtagtggttttcaaagctttgtcccaagacccctttacattcttaaaattgaggacccaaaggacttttgtttatgtgggttttatatgtaaagatagatatttaccatattagaaatgaagaatgaatacaaattatttagaatatttaaaagtaacaataaactcaatatatgttaataaaaataacgttatctggattattataagacaattggattctcatctctccctttgcagtcactttgttaagtgttttggttagtgtatataaaaactcggcatcacacagatttatagcttgaaaagggatgaatattttcagatgtttgtatgttctttgatactatgtcaaaacttgacaagtggtagtttcttaacgtatctgaaaacatggcagtcaccttaaaaaattaaattaactgttaaattaaaatccatttgtctggtagtgtaggatagagtccagaaatagatccacacatacatggacagttgatttttggacagaagtgcaaaagcaattgcataaaatataaaggatatcgtttttcaacaaatggcactggaatagttgaatagctgtaggaaaaaaaaaagaactttgagctatagcttgtaccatataccaaaattaactcaaagggctgttagacctcaatgaaaaacctaaaactatgaaacttctaggggaaaatataggagaaattcttcggaatcttgggttagaccaagatctcttaggtatgactccaaaagcatgatccataaaagaagtggataaatcagatggcatcaaaattcagaatttctttcaaaattagaaagacacttaacagaatgaagacaggatacagaagatgtatcttataaggggcttggagtatataaaaaattctcagaactcagtaataagaaaacaataactcagtttttaaaatggtccaaagatttgtatagacacttcactaaaaaatacatgtacatggctattaagcatatgcaaatatgctaagcatcattagtcaaaaccataatgagacaccacttcacacctgctaggatggctataatcagaaagaacaggtaagtgttggtgagcattgtagaaaaattggaaccttcatttgttacgctaggaatgtaagatagtgtgactgattttggtaattcctcaaaaagataagctgagtaaccatatgacccagaaatttcatatacccaagagaattcaaaaaatatattcacacaaaaacctgtatatgagttagcagtattatttataatagccaaatagaaacaacccagtgtccatcaactgatgagtagataaatgtgatctatttgtaaaatagaatattacccagcagttcaaaggaattaagtactgatgcatggtacaacttggataaatctcataaacattaggataagtgaaataagccagtcacaaaagaacatattttctatgatcctatttgtgtgaaatgtccagaataggcaaatctatatatagagaaattagtggttgtctggaactggggagagcagatggagtaggaagtatccactaatagttacagggtttccttttgggatgatgataatgttctaaaagattatggtgatggttgcgtaactgtaaatatacttaaaacaattgaagtctttaaattggtgaactttatgacatatatctgaataaaattgttaattaaaactactgtgagatatcattacatacctattagtgtggctaaaatggtaatagaatgactgaccgtaccaagtgtttgtaaggaggtagagcagttggaattttcatatactgctggtgggagtgtaaagtggtacaccacttcttctggggagcagaaagcaaccttccgggtacaggtgagccaaggttgatgggcagttatgcagagggagttgggatatcactgtgtgtacctgtgcaagtcctggagtgtgttgggtcctcatcagcagggctgtatgaaggtgttcattaaaacaaaactactgatagtgtggcaggagctagaaaacacccctttcttcttagatatccctccagcaccctctactggcaaagtttaactgcccctagccaaaagaaaagaaaagaaaagcttagcatccctatcactgaacagggactgaaagggagaatttggagttgagaaggggatacatggataactagctcattactgctgaaattgttggaatcattcattgcctgtgctgctgaagcttgatgttgcccacagctgttgggcagaatctccaccatgacttgcgtatctgttagcaggagtctgcagtacctgccattagctgcaactgctggtttttagaaacaagtagaaaatggtttcgctgtttctctgcttcttctttatttttatttttgagatggagtttcgctcttgtcgcccaggctggagtgcaatggtgcgatcttggctgactgcaacctctgccacccaggttcaagcgattctcctgcctcagcctcctgagtagctgggattacaagcacatgccaccacgcccggctaattttgtatttttagtagagacggggtttcaccatgttggccaagctggtcttgaactcctgacctcagttgatctacccacctcagcctcccaaagtgctgagattacaggtgtgagccactgcacccagcctccctgcttcttctgatctcacagaagtgcttctcattgacagactctaacttaagcctagttggcaaggaggccagaaagtgcagttttcaggcttccaggagcaacagtacaggtgaatttttaatttagtaacgatagtaatctggtgagctaaaataagtaaactttggggtacatagagaattggaattattattattattattatttttgagacagagtttcgctcttgttgcccaggctggagtacaatggcacgatcttggctcaccgcaacctccgcctcccgggttcaagcgattctcctgcctcagcctcccgagtagctgggattacaggcatatgccaccacacctggctaattttgtatttttagtagaggtggggtttctccatgttggtcaggttggtcatgaactgccgacctcaggtgatccgcccacctcagcctcctgggattacaggcgtgagccactgcacctggccgagaattggaatttttaaactgtgtttgcaaggcctaattcccaaacccacatagtttgtgtatgggtatacgctcaccctcaaaaaggaaatattttttgtaaaatttgagcagttaaacatttttttctgcctgtaattgtaaaagtagcaattaaacactatctacttggggacgagaaaggaagaaaaattacccatgttctcgtctgaccaattacagtggctgtcttttttttgcattttcttctttaggctatggtgtttttacctagttggaagtaagggagtgtggtcatttaaaaatgttatatctctttccatattagcaaatagttatatatacatatatatactttttttttgttttttggtctgttgcccaggctggaatgcagtcacgcaatttcggttcactgcaacctccgcctcctgggttgaaatgattcttgtacctcagcctcctgagtagctgggattataggcgtgtgctgccatacctggctagtttttgtatttttagtagagatgggtttcgccatgttggccaggctggtttcgaacttctggactcaagtgatccatcttgccaaagtgctgggattacaggcatgagccactgcgcccagccttgtatttgctatttttaagggactgtatacattccatatagtgaatgtgcaccatttatatagccgcttccctattttgggctatataggttatctgcagacattttgagtaatatttttaatatattttcaaaattgtctactataattgtagctactaattgtaaaaattttattgataattacatattaaacattccttgtttacttcagccagatgaacaaggtcaacattaacagttacatgtggcatagtgccacggttattacttgagactgtcactatgacagttactgctgttactacttgagaccgtcattatgagactgagtgaagggggacaaatgtagaaatgaaaaattaagacaaaagaaacttttaaaggaagaaaaaaggggaagaaaaagagggctccctgcttctagggagcaaaggcagcagcctagcttccacagcccttagaatttattgggtagaaagagcaggggggaggtgataatgactggtcagctgcttaattgatcacacgttcatattattacgaacaggcttcagatgtacctaatcacaagaaactgagcttggggcgtgactgccttcagcattccttctgggtggcataggcagtttgtcagtttgccaacattctgcgtttatgagaacagtttgctgttcactcttatagcctccagtggtatactgagttgatcacgaccctcagtctttcggcctccaacagttacaaatcatgttgatggcatatcccttgatatgatatgatatgatataagatgccacttcatgtgatttttttccttcccaaaacccatagccccagtctattcatgaatcatgcaatttccagtaaacagacattctacagtgtacctgaccagtactccttaaaattgtcaaggtcgtcagaaacaaggaaaatctgagagactgcccgagcccagaggagcccaaggagacatgacaactaaatatatgtagatcctagaacagaaaagggacgttaggtaaagactaaggaaatcagaataaaccatggatttgagttaatgacaatgtatcaatattggttaagtgtaacaaaagtgtaacaaatcctaataagatgttaatagtaggggatattgtgtgctgggtatatgggaactctgtactctcttcatattttctgtaagtctaagacttctaaaatctaaagtctgttagtaataaaaaataattctttgtatattaaattatcactgatttaacaccagaaggtaagtggagagattttgaagtcttacatcaaagaactttcaagatagataatagcttaagagttataacatgtaccccaaaacttagagttttatttttttcctcatactaggcacttaggataaattattgaactgtactgttggctagaaaaactttgatgaaatgggctgacttccacagtggtggtggttttctttctttctttcccatctcctgggcaatctccacaagaatttgaaaaattactaaggacttgaagcttttttttaattaaaaaaaccactattgtttattgagccaagctctttggtggaatctttaaaaggtatccatgtgtaaagacattaggtattcaaatacagcaacaaaaattgctacaggattaaatagaaatttccctttgaaaaccaggaagagctttgccatattgtttctaagtaggtttgcgttcataacaagcaagatgcattgattttactttggcctgagcaagattcataattttactgcatacgaatctgatgggggggagcctcaatctgccacagaacctacttcggtggtttaatttttagtaaaggactttaagctgagccctttgtagacttcactctttttgtagccttggccttgttactctgttgaggttttgggtggtgggattggaactagtatacaaaacaggctattctttttttgactttgtatgtttgtaatagtcgtacttgcttcatgtttttgcaaagctgctaagattctgtataaaataggatcagctaagttatgtcgtagtcacaaactaccctaaacctcaggagcttaaagcatcaaaaggttaatcacttcttggccaggcacattggctcacacctataatactggcagtttgggaggccaacaccagaggattgcttgagcccaggagtttgagaccagactgggcaacgtggtgatagagagaccctgcctctacaaaaaataaagaaaaatttagctgggcctggtggtgtgcacatgtagtcccagctgggaggctgaggcaggaggatcacttaagcccaggagtgttttttgtttgtttgtttctttttgagatagagtcttgctccgttggttgcccaggcttgagtgcagtggcgtcatctcggtttgctgcaacctccacctcccaggttcaagcgattttcctgcctctgcctcgcaagtagctggtactacaggtgtgcgccaccacgttctcggtaatttttagtagagatggtgtttcaccatgttggccaggctggtctcaaactcctgatctcaagcagtctgcccaccatggcctcccaaagtgttgggattacaggcgtgagccaccgtgcccagccaggagtttgaggctgcagtgaactatggttgtgccattgcactccagccttgatggcctggatgacaaagtaaggctctgtttctttaaaaaaaaaaaaaaaatttccaatgtgggtggagggggaagtgcttttgctaactgtagtcactggggagcccagcttgatggaagctccatcccttactgcatgcttccacgcccattgaggcagggaaaatgcagtgtgatgaattgtgttcattggctttcagacacttctaccaagaagggatacttgtcattgtacctcatatttcattgaccaaagtaagttacatgtccatgcctaatttcagaggtggcagggaagtgcagtttcagtgtatgcccagaaagtggaaagtgagaaatatttgatgaccaatgctgatgatttccagtccctaacaacatcagtttctacctggttggatgaaaaacgtgtgctcattgggtgtacacttcaatctacaatttcattagatgacattttagagagggaacaagtatgtttttcatgtcatccttctttcttatttgttctttcttcccacatgtctgtgtagacagtactgtagaaggcctgtcgatttcatttttcaaattaaagtataatttaaatacagtaaaatttaccttatttaatatctattttgacaaatacatgcagtcatatagccagcacagtcaaggtatagaatagttccattacccccccccccccttgcaaatatcctttacccttttatggtcaactttgtcccccatttccagcccctggcaactactgatctgtttctgtccctatcattctgctttttccagaatgtcataaatagaaccatacagtatgtagtcttttgagtctggtttctttaacttaatacaatgtttgagggttatccacatcatcgttgcatgtatcactagttcatttctttttattgcttagtattttattgtagggatgtaccaaagtttatctattacccagttgtggaattcttgagttgattgtttctagttttggggaattaaggatgaaaccgttatacatactcacataggtttttgtgtgaacataagtttttgttttatcaggttaaatatatattagtaggatttctggattgtctggtaagggtgtttttattttcatttttttgccctttcaataggtatgggagtatcttactgtgattttttttttttttttttttttttttgagacaggatcttgcttataaacccaggctggagtgcagtggcgccgtcatagctcgctatagcctcaagctcctgggctcaagcaatctttctgccttagcctcctgagtagctgggactacaagcagacgccatcataccctgctaattttaaaattttattgtagatatgggggtctccctatgttccccaggctggtcttgaactcctgggctcatgtgatcctcttgcctgagcctcccaaagtgctgggattacaagtgtgagctgccatatctggcgttactgtgatttttattaaaaaatttgattgtggtaaagtatatgtaataaaatttacttattttaactatttttaagtatatacttcagtggcattaaatacaccttgttgtgcaaccatcaccatcttcttgtgatttaaatttgcatttcttgaatgacttgaacatttaaaattttttattcctctttcggtgagtgtgttcagatcttttgctgattttttttcaaaccattttctttcttttttttaactaacccagcacaaagctgattttttttttagttttcttactgttgagaccttgattagtaaactggacaaagaacttgaacagatagttcacaaagaaagagaacttggtaaactgtggaaatgttcaggttggcagtaataaaaccactttttaattagctgctgtactacctggttattttttatctttatatttcagtaatgtatgttttactcgatggagcagtctactgtgcaagtgggagaatatgataaagttggaggagcagataaatagaatattgacattatgaaaaaaataaaacattcacgataacctggttgcttgatgaaggtagttgtggggaagaagcatgataaggtcaaaaggagagtactcttggaattgggagctagtttttaatcctcatttggcccttggttgataattacttggttctcagtaactgaaatagaattagctattcttagatttccagccagttttctgaaagtgtgacagttcagtgataccctagatctcttgtatactgccttctccttagtcttgtgtggccttagatgtgttatattaccctacccctttcaacctcagtttcccaaactatgagattggtattgtgaggagtaagtgacagaatacattcggagtgcttagaactgtgtgtagagatggtaggtgtattagtctgttttcatgctgctgataaagacatacctgagactgggcaatttacaaaagaaagagatttataatggacttacagttccatgtggctggggaagcctcacaatcatggtggagggcaaggaggagcaagtcacagggatggcagcaggcaaaaagagagagcaagtgagcttgtgtgggggaactcctgtttttcaaaccatcagatctcatgagacttattcactatcacgagaacagcattgcaaagacttgcccccatgattcaattacctgggtccctcccacaacacgtgggaattcaagatgagatttgggtggggacacagccaaaccatatcagtaggtaatgaaataaagggtagttcttagctgatgtcaaagtaacaattgaatgttgtgcttttttatacttttttttctttgaggcagtggctggtcttttaaaatgccttcattaaagtttctagtacattataccaaatagaaattaaaagacatgcaagttgctgctggctggcatctataatcccagctattcaggagtctgagacaggatgattgcttaaggccaggagtttgagactagcccgggcaacatagtgagactctatctcctaaaaaagttagctgaatgtggtggtgtgctcctgtaatgcccactcctcatagatatttcaaaatagtaatatttattgctgccaatgtgagtaggccaaaaaaaaaaaagagagacatagagacatggaagatcaaatgccaattaattacttaaaattgattttgagaatatgaaaacatcattttggattttgatgttttctgctccataatggagcagaaaattaattttcattttccttatatttgtttttctcctaagacccaattgaggggggagaaaacccatagcatcttaaagatctttatttttttatcatgtctgtgtactattgttagtggatataatgctttatgaaatgtggtcatttcagtagttttataaaatatgttttgatttaaaagcatgtagcaatagtgatcattaatccattcattagaattttttatacttcattatacaattgactctgtgaaaatagatgctagggagattttaaagagttattaatactgcttggaaataataatatgttagaattccctttaggattattttttttccccacttgagacctaacctgtcattgttttcatataaaccaaaccacttaaagtaacaaatggattaatgcacttgttcttcctcttgacgaactccttgaagaacaattttggaagtatttattaatttgctttaaaataacaacactcattatgtgttaatataaatactgtttttcgtgaaaataactattccaaactcccaaaattgatgaggaaagtggatttgttttatatttgccaatctctttaatacctattttaatgagaagcagctgggtcttttcatctctagctgcattcattctattatctcatgtagcctctagaaaataccactgcaaactggcaagacaataagtgaaaaagaagtcttaggggctgggcatggtggctcatgcctgtaatcctagtgctttgggagctgagatgggaggattgcctgaggccaggagttagaggttacagtgagctatggtggtgtcactgcactccagcctgggtgacacagcaagaccctgtctcttaaaaaaaaaaacaaaacaacaacaacagcaacaaaaaacttaagtgttactaggatagtagttgtgtctttgcattctctgagtgagaaacttgggatcccagttctcttctctaggccaagcagagccctggggcttgatttcagagttgttgggtttgcttagtatcttgtttgttggtttgtcattcagaaggacaggggtcttctgaaaaatcagtgccctaattcatgtgtgtgtctacatccttctaagtggagatccatgtctctctccccactccacctgtcctgttccaccattcgctagctggccatccacttggagtcagcagtgcttcctgtggtgagtgtgccctggagtttgccactgctttggtcctgaccacagctttctcaggccacgcagggctaggttgtctaggtggcagtgttttgtatcatggaatgagcccaccaagtgaccaattgctgtacccacgtggatgtcactccacctgttgtccttgcctctcacaggcagcaatgtgccagcaggactgtctttgccataccccaggccatagtcaatggccgacccgtcacgatgttcctggagggcagcgtcccacgggtgggacaccctttgtcatgctgtggctgctataccctacttcctacttgcacagccatctgaatgtgggctagggagcccaaaccctatgcctgagatctgtacatccacacttgcacccaccctccctggtagatcctacagtagtagcacatgccagtttcaaaagttaatccacagtattgttgtgaatggctggatgagggttcagctcctatatagataactggttattgtaggactgatccgcacctgtggcttcagtgactctggtgattctaggtaacctagatcaatcacattttctccccacccccaccatggccctgtcactcttaggtggcagttgtagtgcctactgaggcgaccactgtgaccaagaatcttaataatagggaatctcaatttgattctgcagagagagagcctgataaattaataccctatctaaagaatgcagcaggcgcacaaattacccactcccaaccctggaggataatgattaaaacaatatagaactctttcaaggccctgtagttggaaagagtccagtttaaatcctttaaagaggatctattgcagggcaagcctggtgctggcagccacggtaatcccactttcaatgtggtgtgctgaattcctggcagttaaaatgcttgtttttggatcttaacgtgctgccggggtccattgcaagaaagtccatgcctcttgtctttttggtaccttacgggctcttcttccctgagtttccctggagctgaagtgtgcacttgaagaaaattagtgttcaaagtagcgtgggctgcctggatactgctggtgggaatcatggaatgggagcgtggttctattttgtttgtgttggaactttgaggaagcttattaagcagggcagttggggcattagtattgcaccgctaggactcaaattctgggccagtaataagactgatcagagtgaaagtttttgccaaggatgttttcattaaccaagaatgaaggtgaaagtgggaagtttaaagatgttcaggtcctgtgtagttacgaacataaatgtgatgttgaccactgcattaatgcccatgacccactagcagcttccaggaaaccagagccctttgggtcgtggtagggggaaggtctgtgttcatagctgaaactgaaaggcaacagcaatagagacagcttaatttgactgaacatgagcaaccttacctgcttccagcacagacaggattgtcccattgatagttattctgtgggtgggggtgcatggcttttctacttgatgaagagattttgagaggtgacagcatgctggcagtcctcacagccctcgcttgctctcggcgcctcctctgcctgggctcccactttggcggcacttgaggagcccttcagcccaccactgcactgtgggagcccctttctggcctggccaaggccagaactggctccctcagcttgcagggaggtgtggagggagaggcgcgagcgggaactggggctgcgtgcagcgcttgcgggccagctggagttccgggtgggcatgggcttggtgggcctgcactcggagcagccggccggccctgccggcccaggcagtgagagacttggcacccgggccagcggctgcagagggtgtactgggtcccccagcagtgccggcccaccggcgctgtgctcgatttcttgccgggccttagctgccttcccgctgggcagggctcgggacctgcagcccgccatgcctgagcctcccacccactccatgggctcctgtgcggcccgagcctccccgacgagcaccaccctctgctccacggcgcccagtcccatcgaccacccaagggctgaggagtgccagcgcatggcgcgggactggcaggcagctccacctgcagcccgggtgcgggatccactaggtgaagccagctgggctcctgagtctggtggggacgtggagagtctttatgtctagctcagggactgcaaacacaccaatcagcaccctgtgtgtttagctcaaggtttgtgagtgcaccagttgacactctgtatctagctgctctggtggagccttggagaacctttatgtctagctcagggattgtaaatacaccaatcggcactctgtatctagctcaaggtttgtaaacacaccaatcagcaccctgtgtttagctcaaggtttgtgagtgcaccaatctacactctatctagctgctctggtggggccttggagaacttttgtgtcaatactctgtatctaactaatctgatggggacgtggagaacctttgtatctagctcagggattgtaaatgtaccaatcagcaccctgtcaaaacaggccactcggctctaccaatcagcaggatgtgggtggggccagataagagaataaaagcaggctgccggagccagcagtggcaagctgctcgggtccccttccacactgtggaagctttgttctttcactttttgcaataaatcttgctactgctcactctttgggtccacactgcttttatgagctgtaacactcaccgtgaagatctgcagtttctctcctgaagccagcgagaccacgagcccaccagaaggaacgaacaactccagacgcgctgccttaagagctgtaacactcaccgcgagggtctgcagcttcactcctgagccagcgagaccacgaacccaccagaaggaagaaactccgaacacgtccgaacatcagaaggaacaaactccagacgcgacaccttaagagctgtaacactcaccgcgagggtccgcggcttcattcttgaagtcagtgagaccaagaacccactaattccggacacaatttgactggtagttaatcaataaccagggagattagcgtgctaaccagttaggtgagcattcggcatctcccaatttagacaaatggcattcagccatctgagattgagcagttaggctctggattgcccagctggttagcacacagatagatctctccaccagcctagaaaaggcatgcaccccactcacagaagagtagccacaggcctgtgatgctcttaaatgcctgtaaccacgcaccacactgctctcggcatgtgctcacttgaatccgatggatgtcagagacccgttaagtgcattagtgatggggatcgggattgtagtaagtcgtcgttaaggaagaatttcccgtgagagattaggctgaaagtgtgcattaagtttctgcccattctccctccgataggccactagggattggctcttggccctgacagatagctgagaacggtctaaaataaaagttataaccagggttccctaagtggacccgggtaggagctttagagcgagagtgcgaaggatccgtcgcggttcctctgccgtcgtgctgctttggggccactccaggcagaagacagacaaatatgcccctagagtcttgtagtgctgggcatgaggggtgggctgcggtccaaggaccccttagcgctgtcccttctgcttaaggtggcttccggctcatctctctgtggcctggtgcttttgtggctttggggtatcccctccccccaccagcccttaaagtgtgtgtatgtgtgtgtgtttctgggtctgcctaccttgcactcttgtggggtggggtgacatgaaaagcttgtcttctaactgctgttattgtggtgagtcctcacatgtgttttgtggagtttaggctgttaggactttaaaccgttaaattgttaagactggagtttaaaactgttaggacgctaatggtgacctgattttacatatttttattatttgttgtggagagcgcagttttgaataaaaccatctgtttctcttattttcgactttgatttatttaaaatctgtcatacgaaggaacaacttaacttttaatacattatttaggaattttttagttttagataaacacttgaatagcaacttaatcacaactttcagttctccgtactattaatgttttgtcaagtgatagattcttgctttaatgtccaatattttggtttatgcttgtttcttgcttttttaaaaaagttataaccaaaggaaattcaattttcctttttcattggcagacatatgtagagtgtgtcggtcagaaggaacacctgagaaaccgctttatcatccttgtgtatgtactggcagtattaagtttatccatcaagaatggtaagtcatacttttagaaagttatgtaagtctgagcttcagtttcgtcatgtatacagtaacagggatcatttcaatgtactttctctgtaattatttttaaaagttttattgtattttcctgagcacaggaaactgaaaaagcccttttattgtaaaaattaaaaaatttggaaaagaaattatccattaattcttaataccatggctgttattttggtgtatcctcttccaggtacacgtaattacccattgtttatttctaccatggagagcttattttgtcctctgaaagtgttatgattttctagttttgcttggcataatagtagcttacatttatgaagtactttttgccaagaactgttcttagtggtttgtacatctcaactcatttttaatccttataagaaaattgtgatgaggtggagtattattattatgcagatgaggaaattgaagcatgggaaggctagataacttgtccttggccacatagccagccagttagtggcagaaccaggattcagacctagctaccaggtaccagtattatcagaccaggattaaaactgatgttgatgcttagagattctttcatgttcattttgctttgaggaaattacagttttgattaattgaaccttttttaatggtagaaaaatgtgttgtttttatctctagctgttgtagtttttcattcttagaaggcagttacaaaaagttaagaatattctaaatttgaaaattttgaaactaaaagctctgtgatatatacatttttaataaaaacaatgttttcgacaaaactgtaatgtttctttgctgtaaacactgtacttatgaatctatttataattacagcttagttcaatggctgaaacacagtcgaaaagaatactgtgaattatgcaagcacagatttgcttttacaccaagtaagttctttagacattttcactgcattttttttggttatcactcgtggcataaaggtgtttgatatgatcagttgacagaggaagggggataaaagtgcttaagcactttaaagcaattattttcagcttgattttttttgatagtaataggaagtattgatatttaggaaaatattttgaaaaactgtatgctgtcttttatcacacacatgtttgagatttgtggggtgtttttttttgtctttaaaatttatttacttttaattgtagacaggttcgaacacatgcaaaaatctaacaagtccacatgaacccatcacttagtgtcaactcatagcctgtcttgttttacatacactcttgttccctgcctctttatccttttatttttttctctattatttaaaaaataattctaccatttgtaatttcatctgtacatacttcagtatgtatctctaaaaggtaagggttctttttcaaaaacgtaactataataccattatccacctagaaaaataaacaatgatgccttgatttcatcaaatattcagtactcttcaaatttggactacattttgagttaaagttgtataggttagaataatagtcataaagataaagctttttttttttttgagacagaatctcgctctgttctgttgcccaggctggagggcaatggcgtgatttcagctcactgcaagctccgcctcccgggttcacgccattctcctgcctcagcctcccgagtagctgggactacaggtgcccaccaccacacctggctaatttttttgtatttttagtagagacggggtttcaccatgttagccaggatggtctcgatctcctgacctcatgatctgcctgcctcagcctcccaaagtgctaggattacaggcgtgagccaccgcgcccagcaagctttttttaaaaaaataataaaaaatagagagagggtctcactatattgcccaggttgttcttgaactcctggcctcaagcaattctcctgtcacagcttcccaaagtgttgggattacaggcttgagccacattgcttggccaaacaaagttttaaattaccgtttttttcatgaggctaacttttaaggtcaatatttcataagcctttataaaatatttttgcagcctttaaggttttaactatgattcctgtgcctattaatatttaatatgttttatctcaaataagtagaggactgtgctggcaagttattaaatatttgaagcataatttttcattctgggatcccctatattgccttcccttacaaaggatttttgtgttttagttgtgtgtgtgtgtgtgtgtgtgtgtgtgtgtgtgtgtttaagcatcttgagcttctcgatataaatgctgtaacttagtgttttactttgtttttatttgatgagtataaatgattaaagttattacattttcacttttggagctgtatattcatcataaaaaagtcaattctgttattttgtagtcattaattttctgtagtacgtaaaagctgtacagcttgtcaagattcataggaaactaagactaactagttgagtatcttcatgaaattcagttgataggaaatatgtgggcttttactttgaggccaatagaagcttgttttgtacattttaattttcatttgatagttacattctctatttcttttatcttttgcaaaaaatctctattattcctggttttaatgacttgctcttgtataccagatatcctatcgaagtcaatgatctgtgggcatgtgccattaaaagttgctatttgtggccaggtgctgtggctcacccctgtaattccagcactttgaaaggctgaggcaggcggaccacctgaggtcaggagtttgaggctagcctggccaacatggtggaaaccctgtctctactgaaaatacaaaaatcagccaggtgtggtggcagacgcctgtaatcccagctacttgggagcctgaggcaggagaatcacttgaacctgggaggcggagtttgcagtgagctgagattatgccaccgcactccagcctgggcaacagagtgagactctgactcaaaaaaaaaaaaaaaaggtgctatttgtcagttgtttatttctcaatgtttataggtgtgaacagttttgtgatagtgttcttataaattttagatcattgcttttaaaccctgatatatcataatttcttgttttggccttactggagaaagaattgtttgtttttcctttatgttctttccgagctacctgtggtagaggtttttgataataggcagtggttttttattggaaccattttaaaagggaatcctttttaaatgtggcagaacttttctttttctgaatgtgttgagccacatttctcagagtagtgggaagatctgaatttatcatttgaaattttaagtattatgctaacatcgggaaagtggctaacaaatgtcagtgggatgtttgctcccacatgaaatgatctgctgcggactgttgtgctttttgagtgctatttaatgcttatatttgggggagtgttgatggcttgttgtcagcttcatcttttgctcctgtttgctttattacatcttttatagtttgggaaaccagatgattatattggttgaatgttaaaatgtgtgtaaatgggccttgtatgaggttcatggctattagcaagggatgtgaacatctattgaatttttttttcctgcccagaggcctttgttgatttccacgtttcacatgtgatttgcctcataaatgacttcttgggtaaatgtgatattataactatttggtttattttttttaaataggaaaaaaattaagcacaaggcaaatattggaagtttagttaatgtctattttatatttatgaattaagctattttcgaatcttcatgaaactgtaagtactttttttccgcttatagtttattctccagatatgccttcacggcttccaattcaagacatatttgctggactggttacaagtattggcactgcaatacgatattggtttcattatacacttgtggcctttgcatggttgggagttgttcctcttacagcatgtgagtattcatgcctctgattggagttatttaaacattgcataactacttaatattataaagcaatattgcatcatattattatttgactgatgtttagttatttgatgtcagagtgtcatgtattaggaaagccttacttagaagatgttcatcggaactaagaatgagtttaacaggtcagttttttgagtgaatgtgggaaagaacacagcatacagaatggctaaccatgaaagttcatgaaagcgttgaaaaaatcaaatcaaatcataattagatatgaagtatgctagagctttcaagggctacaaaagacggccgggcgcggtggcttatgcctgtaatcccagcacttcaggaggccgaggcaggcggatcacgaggtcaggagtttgagactagcctggccaacatggagactgaggcaggagaattgcttaaacccaggaggcggaggttgcagtgaactgagatcgcaccactgcactccagcttgggcaacagagcaagactttgtctcgcaaaaaaaaaaaaaaaaggactgcaaaagatgaattcttttgggattctgcaaccctcctttaaaaaaatactcacatggccaggcgtggtgactcacgcctgtaatcccagcactttgggaggccgaggtgggagcatcacttgaggtcaggagtttgagtccagctgaccaacaaggtgaaaccctagctctactgaaaatacaaaaattagccgggtgtggtggtgtgtgcctgtaatctcagctactcaggaggctgagacaggagaatcacttgaacctgggaggcagaggtttcagtgagctgagatcatgccactgcattccagcctgggcaacggagtgagactttgcctcaataaaatacaaataaaatttaaaaatactcatacatgtaatggtcataaataattgggaggcttatctttcagatataggaggctctttgggagggtggtatactaatcaacccccctaatcaatccaaagaatcctcttggattctttgttgttcttatagacatggagagaagtacatagtatatgggaggcagagtatatagataagattcattagagttaaactaaatgtttaattagtataattgatatcttcatgtctccttaaaatatgataaaataatcttgattacctatggaaatgaaattcttggaagataccaactagcagaatataggtactgttgaagagtgagttagctagaaaatgtatcaaggaattctcccaggatgaaactcagagggacaaatagttacaagtatgagaaataaatattgacaaatggaggctagtctagtctgtctagtaagtagttccacaaggtaaaagagataatggagatgaggaaacaattggtgtcttttagattgaacgagaaagctgaccatggtaaaggaaaagtctcatgaacctagacatattctcaagttttctggagctgggtagggtggcgatggtgatagaggtatagagattgtatgcttccagattatcctacaaagtaaagaaaatcagagtggcatcagacttaaaattagcaatgttgaatgctagaagacaatggaaactcaaaatttgatgtttttgaacctaaaattccctttctgcaaattactctcagattgaaggacaaactacagatgtttcaatggatgtgagggattggaaagtttactaccttaaacctttttgaaaaaacaggatatactttactaaatgagcaaggaatcagagagaaagatgtgagatacaaagaagtgtttcatatagctaagtctcaattgttaatctgcaataattaatagtttttgggtaacagcctggaactaaaattccagatgatcttaacgtgggagaaattgtgacgggaagatagaaattaaagcttttaaaattgcttatctcatttgtggggagattatagatgttctagatgtaggtagaaaaatacagcataactgtgcattaaaaatgtggactagacttataactacccagaactggactcaaaactacattgttacattattaatgacaaaagtgccaccacagatcggtggcaaaaagatggtcttttcagtaaatggtatggcagcaatcagatggccgtacagaaaaaaagaatcatatcattacctcaacctaacacagaaattaatttgagatgaatttaaaagcctgaatgtgaaagttaaaaagaaacttctaaaataaaatacaggagaataagcataaaacaaaatattagtaaattgaacataattaaagttaaaaacttctcttcatccttagacacttttaagaataaaaggcaattgaattctggcactcaaaaaaaaaaagaaaattgaaagccatggagtgagagaagatatttgcagtacccatagccaacaaaggacttgtatctagagtatataaatcaataacaaaaaggcaaacacatcccaattaagcagtggacagaattttgaacaggtatttctggaaaaatagctaaatatactaagctctccgtatctgtgggttctgcaatgctgactgtagaatgtgagcatctgtttattttgttattgaggagagtcctggaacccattccccatggataccaagggatgacagtagccaataaacacatgaaaaactgctcagcatcattagagaaatgcacaaggagggtgactaaaaataaaaagagtagacagtgccaaatgttgctcaggacatagagcatctggaacacgtatacagtgatcaagggggagcgcatatgttataaccactttagaaaactggcagtatctactgatgctaaatattacaaataccttatgatctagcagttccattcttgggaatataactaacagaacaagaactttctgttcactaaaggacatatgtataagaatgaccacagcagttttattaatagtacttaaaaactgatatcagtcaaatgcctattaatagtagaatggatacatcgtggtttattcatgcaacggaatactacatagcagtgaaaaaagagctaactattgtgacatggaataacatggattaattttgcttctttgacaaaaacaagccaggcacaaaatcgtatgattgcatgtgtgtgaaattttaaaacaggttacattcatctatagtggtagagatctgaatagtggttaccttttgcaggggctgttgcctgggaagaagcttgagggagccttctggggagctggaagtgttgaacatcttgatttgggtggtagttaccaaagatatacatattttaagaattcacccatctgtacacttaagatttatgtaaaatatactttaataaagacataacaaaactcaagggcaagtgctagaagaatagaaataggatgagtgggaaacagcaaataaaatttggaaatttcaaacaaaggcaggaaagaaaggaagggaatgcagaggaaggaagtagggaaataaaattaaatacatctgtaatcataagggtttagatttctctgttacgagagagcttcatagatgtgtaggtataaaacttgcactactacaagagataaatacaaagcagcacaggttaatgctaaagagatacaaaaatagttttgttagcaaatggctaacaaaaagccagagcaatattaatcagccagttatcattcaaatgcattaaatgggacaaagcattatatttcatattaataaaaggcataatccactaagaaaatagaattaaagaacttttatacaccagaaagctgggccttgaaatatgtaaagcattcacagtcatagtgaaagacttaacatgcctctttgaaatcagtagatgaaataggcaaaagtaaggacttacaagatttaacagttattaatcacaagcttgatttctgttctaatttgtttatatacagatacacacaatttaaattacatcacacgatacatattctgtaacttttctctagcttagcatcgtatcctggtggtctttccatgtacgtgagtgttgtgctgtcttatttttttttttttagcgatacacagcactctgtagtaagaaggcctgttgcacatgaatccatttacctatctaaacatttggtttgtcagttttacattgttacaagcatacttgtctgagtattttataaacatgtaagtaatttttattacagaaaatcttttcctacctttccattttgacttggttttgaaaacagccattgaagtcactgaaaatctgattggaagtctccgatacaaggctatatagggaatgcttaagctaatacacaaatactggtttgaaagaaagcctcaggtttttattcttgtgccccattttcaaatctgtggtctgttatctcattctgtctagaattctgctttcctgactaaaagactttctgccttgatagcagttcgttcacccatactttgtctttctctaaatggccagaatttagaataattatattctgtattttagaggacctgtgaatctgtgcttttaaaatattggttgtcaggttgccatttatggcattgcagtacatactctactgaaaaattctcttaatttcaaagacttatacctccaaaactgaaaccttttattgtcatgagcagacttaatgaattttggaattctagaatttaaaaaattctttatattataattttggagatctttactttagatttttcttttcaaacatctaagctcattcaataaaaaaaagcaactaaacctagagagaatctaagtgctaaacatgattgtgtaacatttactcttcattgtcactatatttgtgcttgactgtgtttttaaaaatttaatattttgagacttaggcttgtaaagactaaatgtttatttcagtggcatttgtggcgttccactttacctctgctttcttgagcagctatgtgaattcatgatgcgagttgtgactgtgtgccatcatgctctttttcggtaggccgcatctacaagtgcttgtttactggctccgtgagctcactactgacgctgccattagatatgctgtcaacgtgagtattgaacctctgtgacgaatgttgcatgatgtagatgatgcttgcttttttccttgcatatttattttattataatttgtaaattcttttgttttgagaacaataatttatgtctattacactaacagttatagctgcagtagaagtagctgataaatgtaaatgacacttcttttaaaacatacctgttttatgggactgttttgtaatgatgggatgacttttctttctttcttttttttttttttgagatggagtcttgttctgttgtccaggctggagtataatggtgcgatctcggctcactgcaacctccgcctcctgagttcaagcgattctcttgcctcagcctccagagtagctgggattacaggcactcgccagcatgcctggctaatttttgtatttttagtagagacagggtttcaccatgttggtcactctggtctcgaactcctgacctcaggtgatccacccgcttcgggctcccaaagtgctgggattacaggcgtgagccaccgcgcccgtccgggatgactttttaaataggctgtcacgcagtttgagatacatactactgtcttatgttcacaaaagtttttttgttttgtttttttaaatggagcctcgctctattacctggggtagggtgcagtggtgtgatctctgctcactgcaacttctgccttctgggtctcctacttcagcctcctgaatagctgggattacaagcatgtggcagcaagccaggctaatattttgtatttttagtagagatggggtttcaccatgttagccaggctcgtctcaaactcctaacctcaagtaatctgcctgcctcggcctctcaaagtgctggggttacaggcatgagtcactgtgcttgcccaagagttcgttttaacatgtgtttttaacatacacatttgaactcaaatttattttttaaatgttttccatgattattagaatataaatgctaagaacttgcctgtagttactttactatatcttgatattaagcattgttgcttgccttatattggcaggcttctttttccctctcacctgataggcttgagggtcacctgaattgctttcattagactactcattgactccagaggaccactggaagcctagtggggctagtcaaaataaattataaacatggcttggttttagctgtcttttacagtttgaaaaattgagccagtttttctgatagcagttgtgaccaaactactttttttctgagtaatgttttacactctctatagaattttttttctgtgaaattttactttaaatttccttaatgtcttaccagtttctatgtattctgtagctcagtaattgaggtcatgtctaggtgcactgtatcagttatctattgctgcaaaacaaactgtcccaaaccttagtggcttaaaacagctaccattttatttgcttataattctggggtcagcagtttgggctgggctcagctgagcttttcatctattgggcttgcctaggtcactcagctgttttactgggacttaatgatctaagatggtttgtctgagatgccttggttcttctctttgtggcctcttatcttctaaaaggctagtagggcttctttacatggtagtctcagggcagcattctaaaagggcaagagaagaagcttgcaggccctcctctgggctctggaacttgggcagcatcgcctctgtccaggattcacaaaaccagcccagattaaaggagtaaggaaaaaggactccagagtttgtcaccaaatgtttaaaatctgtaacaaacagttaggattattgctgatagcaaggaagatgtaaaggggatattttggtcccaacctttcagaatttagtagcctggagagttccttactaaggtggtagttaggattcctcttttgattcaggacatattgcagactatattttcctagaggccataccagtttagtttaagtttggagctgctgggtcaaggtctaccagattgacccttctcaggttttctatggaggaaaaaagtgattccattaaaataatggattttccaatggctaagagtccagaggcttttgagttatctgtgaataattctgaaatcataaacatggactagggaaggaaagataagcctcttaagaaaggaaaaggacaaaatggtcttcagtatcatgatatttgatgcattttcttgtatgattactaaaggaaccatactttgcctttctgaatttgttgagaaactaatacacttttggtatgattgcagttagcatcaaaacttggtttgctttctaaatgaaaaatttctttttttttgagatggagtctcactctgtacccatgctggagtgcggtggctcaatcttggcttactgcaaccccccgcctcctgggttcaagcgattatcctgcctcagcctcccgagtagctggaattataggtgcacaccatcatgcctggctaatttttgtatttttagtacagatggggtttcaccatgttggccaggctggtctcaactcctgacctcaagtgatccacctgccttggcctcccaaagtgctgggattacaggcatgagctactgcacctggccaagtgacaaacttctataaaatttataatagacctctttgtcttacatatggcatactgaatatctctcaaccttcatttctttatgttgtcattagacttatctggaggagcttctcctcttttctgatttgatgattctattaatttgtgtgggttcaggtgtcagctaatcaagtttttaaacatgtgtaaaataaagatacagaaactcttagagttggacagagtttttaacctttggtaaattacataaatttaatgcatggcctttgtcaagtgttagactgcttttgtctttttttgcgtgctgcctttctgtttctaggccattttcaaaagataggctatggataggtaatttccatatagttctgatggtatttgatgcctaaataaaatacataatacaagtatgtaaatatgtataggttctcttgcaagtagaatttcaccataatcacaaatagttcttttggagaaacttgagattttcatccaaaaaattatgatttattcttctggctgttttttttttttctgagactttagtataagaaaattttttacctttgttttcctaattttaagtcttctttggagtaattatatgtacttttttttttaatagggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggtaactcccctaccccaaaattgattttacttaggtaggtcatgagaattattgtttctctctgagactcaaactcttgacttccatgtccctcataaacattcttttgttattacaaaggagggcagcggaaaggtttgggtgaagatgaagagagatgtgaaaaatcaagaaagtggtattacgactttgcctcttaattttctagttagagtgggaacagcgttggggggtatactgaagtccatgtacacagtcttacccactgagcagaaatttgaaaacatttcctcaagtgtttgatgacagagcatgtatgtatatatgtatgtacatttttttaaaaatgtattttcatccctgatgctgtcaataaagacaaaggctgtcttataaaaaggactacagaatgtttttaagagagccagatttgttaaccattttctataatgctttgtgaactgttaatccgctaaattatactgaatgaatatgtacacgtgttatgaagtgaggttgtgttcttatatactaaaattgatcccacatcagatacatttaaaaaagatgtctttgaaaggttttgtttttaaaaagaatttagtagagtttatatttgttttctagttttttgtttgttttggttttttgagattggctcttgctctgtcactcaggctggagggcagtggcatgatcacacctaactgcagcctcacaacctctgggctcaagagatcctccttcctcagcctcctgagtagctgggactataggcgcaaaccaccatgcctggctaactttttaatttaagtacagatagggtcttgctgtgctggccaggctggtcttgaactcttgagctcaagcaatctgcctgcctcagcctcccaaagtgctaggattacaggcatgagccactacacctggcctaggttttttttttttttttttttttttttttagcaggaataatgtgatttggaaacagagcaaaacagacaagtggatctaaatttctgggcttttctgtgattttaggctccagcaggaggaaatggtgcagaaaatgttgctgctgatcagcctgctaacccaccagctgagaacgcagtggtgggggaaaaccctgatgcccaggatgaccaggcagaagaggaggaggaggacaatgaggaggaagatgacgctggtgtggaggatgcggcagatgctaataacggagcccagggtaatggctgcttgtgtgtcctcactcttcagcactgcaaatctgttctcaacttgcattgaggaaaagggctggcgttttcaaatttttaatgttgtgaagttctatttctaacttatttttactttattttggcaaactggcatttatggatgtacatatgcataaatatgtttttttctatgaaacagggcatgttttgtgttttaaaatcctttttacacaggccttttttttttttttgggagactgagtctcgctctgtcgcccaggctggagtgcagtggcgctatctcggctcactgcaagctccgcctcctgggttcacgccattctccggcctcagcctcccgagtagctgggacaacaggcgctcgccaccacgcccggctaatattttgtatttttagtagagacggggtttcaccgtgttaccagtatggtctcgatctcctgaccttgtgagccgcccatctcggcctccaaagtgctgggattacaggcgtgagccactgcgcccggcctacacaggacttttttaataggatagataggaagaaactattttttaagttggattaggtactactttttttaaataaaggactttgatacagattcacctcattcatttgcttctctctttccatgtcccttgagtcagtgcaatttctaagattgaaaaagaatcttgaagtttatactgcagacaagatgccatctaaataaatcaacgtctcgttttctagcagtgtaaactctagaatgtaaaataagatccaagacaggagatgggtagatcacctgaggtcaggagtttgagaccagcttggccaacatggtgaaaccccatctctcctaaaaatacaaaaattagctgggtgtggtggcgcacgcctgtaatcccatctacttgggaggctgagataggagaatcacttgaacccaggaggcagaggttgcagggagctgagatcatgccactgcactccagcctgggtgacacagcaagattccgtctcaagaaaaaaaaaaaaagatccaagacagggtctaccagtcagctgttggtcactcacttcccctcctccctcccaccacagttttcctgtcaagctttgcactatctctagttctacttggcagcctgatatttttgtgtctctttgtgtcacgtactctgttagacactgagcatataactgtgaccaaaacattaggctgctgcattcctggagtttctggtttagtgaaaaagtaggaaatacacgtcatgatgagtgttgtgcgggttgctctgaggatgctgttggggagagacctattaatttacctttttttttgagacaaggttttgcctttgagccaaggtcacctgggagggagtacagtggcaggaacacagctcactgcagccttgaccttttgggctcaagtgatcctcccacctcagctccccaagtagctgggaccacagatgtgtgccatcatgcccagctaatttagtttttgtttttgttttcttggtagagatgggttctccctgttgtcctggctggtcttgaactcctgggctcaagtgatcctcctgcctcagcctcccaaagtgctgagattataggcatgagccattgtgcccagcctagacctattttgaataaggttttccaggtagctcagagtacctggtatttgagctgagacctctgaaggatgagaaaaagcgacttgtgtaatggtaacagggggcctttgcagggggaggtcagaggctctgagaatacagcctgctgctacccttgagtctggccgttatttctctctcttgatctaatacagtagctcctaactattctttctccttccgttcttgctccacatagttcatattactctgctgcctttaaatcttttagtagttttcccattactaaagaataaaatccagactccacattcctcttgtatgatctgatttctgtctttctactacccatatcattagtcagaatgtccttagttccctggcttccttacttttctcaaatctgccagattctttcctggcttagagctattgaattcctctctttcagataaccttatttattccttttctagcatttatctcaatctaggattaccttactttatatgtattatttatttatatgtatgtttttattcttatttgttccctgacaagcaaatactcagtatggaaatgtggcttagcttctcaacaacagcttacaaagtactaaattttactatttttagtgcattctattttttttattatttattatttttacttcaagtaatctttaaattgcaattatattttcagatgacatgaattggaatgctttagaatgggaccgagctgctgaagagcttacatgggaaagagtaagacctttttctgtcaagtatcctggtgttttaatcctaaaatatattttaaactttggtgtatttagatgtatacactaatgttatcgttacagttgatgaaaagttactagaattttcattcctagtgaaagttaagtgatatattgtttatggtcaaaatattgtgatgttggtggctttttttggtcttacaaaatcttgctccatttaggaaatgttttacctgaaattgtggacttttgaaaaacaaaataacaatttaaatttaagtagtattttcatgcttcagttgacaaaataatacagttttattatgaagtaatcttaattagctgtatatcttgagtaacaaatccaagacggaattgttttagactttataaatcatgtaattttgaataaaaggagacccaaaatataaaactctcattcagaaacagaattttttttattttctgaaaatgataggaagtattggaaagtataggaagtgggtgaggactgtgtttaaagatattgaaaggaaaatgaggcttttcataaattagaatagaaagttctgttgcatcttaaattaatgcttatcgtttttgtttattttagatgctaggacttgatggatcactagtttttctggtaagtaaaactaattttttttttttttttttgagacggaatctcactctgtcacccaggctggactgcagtggcgtgatcttggctcactgcaacctccgtctcctgggttcatgccattctcctgcctcagctttccaggtagctgggactacaggtgcccgccaccatgcccggctaattttttgtatttttagtagagatggggtttcaccatgttagccaggatggtctcgatctcctgacctcgtgatctgcccgcctcggcctccccaagtgctgggattacaggcgtgagccaccgcgcccggccaaaactaattctttctagtaacagaattggagttgtcttagtgattcagaaacttcacatttatagtatgtagtaaaggtcaagatgccctttggcttttaattactttatatgttgaagattgtatgtttagtgtgctgaaaatattgaaaaagcataaaggtaatatttttaaaaaattgttaaatatttgatttttagcaaagaaaataaaccccaaagttaatggtagttaaaaagaacttggtcttcttttaaagtttcatcttgcagtgtttattgcctgtactggtggaagcaaagcagttttccctattttcacagtgagacaccccaggctgatgttaggttttcctgtttgctgaaccccacctgtctttacctaggaactttgccatattagtaaagattgcaagtctaaggtgaggagcaattctttaaagaacttgttctttaaagaagaaatggtgctgttttcaggtcctgtaatatgaagttatttgccatttgggatttttaaatagcttaagatgactttggctgcaggtagcagaacccctgctggttggaacattaatttaacaggaagtccagaggaagaatgggcttgaggttgcttgatccataggcccaacaatgtcatcagagaccgagatatctccatctgtctcctttgctgtcctcagtgttggccttctcctcaggctggctccagatgttaaccagaagaggatgttgaatttagcagttgtgtaggtttttaggaacatatctggtataattccacagtttagtgggaatgtgatattaatgagcttctagtcatggtttgatcacagtcagtatagaaagcattatttggccacatactgatttatattccttaccccatcagttcctcataaatgaaggacagaagtcgttgaggtagtggtggtgactcaaactcatttgaattattggaaaaaccttcgacaggatgaattcattattttagtaaaaaatatttaatatgtatagtgtgccagctattgtgctaggcactggggaattcagtgcctatgaattcaatgcctatgaatgagacagggtccctgttctcaaagatgctctatagtgtggtagagagaaatgaacatgtaaacaaggaatgttttggagtctcagtgacaaaaagtgtgcataggacacaagaggggcacaaaagagggtttgattaggtctttcttagtggaatggagtttgtcagcaggagattttccgcgaagataacagaggttgaagtataaaatgtgttggggatagggaaaatttaggagcccttaaggcagagaggttgaaaaaattgagcccacatggtgagaagaaatgtagtagtcattcacaaactaattacccttctttctggttggatttgtggaagattaggggacctgaacagagaaatcctttttttagacaaaagatctttggacggatcatttaacttgatggttgcggggaaggttgtgggcatgaatgaatggacttgggcagtctggtcagtgtcagcatggggcatagctaaggtgtgtgtaacatggctgaaggaataggcagatagctgtcgccttagaggtgacagtatgtaactgtgggaggtgaccagatggtcaggtgagacaggacaaagaaagtcagggcaccatagggagtggagggaccagaggagatcaagctagagttttccaaaggagtggtagccaggcaatagtgaccttgtaggtgtcaagaaggcagattggacgttgaaagaaacactgcagttgacgttaacatgatgtttacaattaatttggctttcaaatttttctccatttgaaatttttagtgtcatttgatttaaatgaaatctggtggttatgaaaatctatgtaatttgtcgtagattatttctaaaaaggaagtgtttataaatgaatttgttttttgtacatgtaacatttttgagttttattaggcttagttgtatgagctatctaatgaaaaatgaaagttacatattatgtctagattgaaatcccaaaacaatagagggaaaatttcaatcttagctgtttttactatttggctctagctaaataagtggaatagtccaattaaacatacattaagtatgaattgaatatgctttattgatgcttttttcctttaggaacatgtcttctgggtggtatctttaaatacactgttcattcttgtttttggtaagttgtgtttgtgctttttttttttatagtattatggtaggaatttagttttgtaggagccttgttataggtttattattattttttaacatagaaataaatactaagcagtatatgaaaatagtttcagatacaaaccctgtatagataggccccagacagacagatactttcctaagcagcagtgactgcagttacctacctatctctccctctgttgggcatttctgggttttttttttgtagaagctggttttagaccgacttgaaaatatacagtttcccatttctggaattagttttatgctgattgtgtgtgctcttccctatggtggaatatcttgttttcatctgtcaaaatcctgaccattgccttctagagatcttgacttgggagctgttaccagagctgagtgtaggcttgtgggaagacagtaagccttccccaaatgtgagcaccccttagaaccagattccagcacatacaaaatcacttccaagcacttctgcgagggcagctgtgaggattctttgacagcacacaatggtcccttccattgggactaattagagaaagaaaggcaaggttgaggagacactgttgacagaggtttttctcctttccagaagaggtaaggaaaactaagttgagtaaaccaaggccttagaattcagtttctgtatctcttaggggtgaggacgtagagtctgatggaatggggttattgttaggtgtcctatgatttgtgtctcagagacttcaggcaacatatccctatatagggataatctatgagaaattccttccttagtacatgggatttacccctcagctctgctgaagaggatgagtagagatttcccaaggcttcttccaccaaattccaagttatttgctctgttgaggactacattgtgacgtgtaaagcagacgtctttaataagaagccatgtggtgtaaggggctttgaatatttggactgaggatgagaccaaaaattgatttctgtgtattatctgtaaaagaggaagataaatttacttgtattttgttaacaaagtatttcggatacttccattgatttcttaatttttagtagatactcacaaaggtgcagatttattaggattttttgttccctttacatgtgggggtgtctgtatgttatcctgcatttatttttcattatgtaaaataattcatatatagactgtgaaactgttatgatcttgactgcattttttttttttgagagaaaaaatgatctatagatttaagtctttactcttgcagaaaagcttaatgctaaattaatgtttggagaaccaggtcacatttaaaacatgaattatacaaataagaactctgatttatagaaatcaaatctaagtaaagctttttctaatccaacctcctgagcttatattgcgaaaagaattttcttagtaaacttatgttttattatatagttagaatcttttggaatcttttgaaatgaaacaagttttcttccattaggaacatactttttcttttaatcattgggattaaacaccctcctgtttttttcttgcatgggttgctctgttggaagttttctacaggcagttttttggctcttgtggtcatatgctttgcagaaatataatttgacaaagctgtggtcttccactagaaggtgacaatcctgagaaattgtccttaatttcaggatgcctttccattagtttgtgtgtaatgggatggaaattgattgttgcaactggtatttaaggttaataattatttaatacatctgctaatagagttaaaacttgcccctcccaggggcctagttgagtcatcttcagactgggatatgagagcaaaataggcaaaattcaacatacagtttttttccttaccttattaaatttcttctgctttatattacacacaatatgttagtaaactaatacgtatatataatttataaataaatttaaatatattggaaatacatgttcaaaaatattcttacccatgaaatagtcagaaagggttagaggccagatccctagtaggttcactctgacttctgtcttcatgattgagtttcccactcccctggtaatctactgcgctgtcgatttatttctaccataaagaaaagataactatattttattattaggaatgaagtaaaatttagccagaaagacttgaggaaaaagaagactataaaaattctcttgctataaaggttttaaaaatactttcatacttagctataatgccattatctcaccttacaaaattactagaatttggtatttcctaataatccatcatattcaaactctctgggttgtcccttacataccattttgcagttggtttctttgaatgaagacccaaataaggtccacatattacttttagttgttaagttataagttattagtcttttaatctagagtactcttctctttgcttcccccaactcaccctatttggccattgatttgttgctgggattaggttaactgttcttgcagcatgtcatgttttacatctgtccatctgcttcctggatgtcctctgcctttatcctttgtctcccatatttctcttaaactggaagtcagatctaagggccttattagattcaggttgaatacatctgggacaaatccatcactggtcacactgtgcctattaatagtatatgtgaggagctgagatacatgatgttggattatccacttttatcactggattcagctgatatcaacctgggcctctaatcttaggttttgtttttccctttaccattataaaataatctgttgggagtgatattttaaacagtcattttttatatttattggctgacttttctgaaagaagaagaaattcttatcaatttgggactattcagtcaacccaaacctgtctgtccggggcaagtaggacagatgctcatatttttcccattaattttggttttcagaataaggaattggtgtattaactattcacatgggtgtgctaactgcttccaaaacatcaaagtgttttctttgatgttgctttttctcttttcgtgattattattttggacttttccttttttgagcatcataaactcatggatttgtgtatgttcagtgtttttccatcagttttggtcattattctttttgatgctcatattatcctctctttggcctgttttcacaatggtttctgtgttgatttggcatggccctattagaccttaatagctttgttgttctctagttacagagaatgtcctaggcagtgtatttttagcctagttctggaatctttcatttctccaagaagccctagttccttttagtggggaattgtagtaggagtgttcattgttttgatgtcggagttttcatggaattttttccccctttttagcattttgcccttaccatattggtcatttctcccttgttggtttgggatttgaagaacacgtgagtataatacttttacaaagttactttcattcattactcccaaatgtgattattaataaaatagtattctaaagagttacatcatttcttcattggcattatgcaagggaatagttaggcaataccgtctcattcttttttaaaaaaaataacagtggctcaagagatagtggtcatgttgccaactaatgaaaatgtgctctgaaatccagtcagctgggtgggcctgaggcataccgtgggaaagtttcccacaggctgattttctgtccatctcaagaacctgtatgttctcttctttccctttccccaggtgccccctgctgaatttagaaaagtaacaatatatcaatcaatttaaaaagggtagaatattttggaatgacgggttgtagtgttttctagagtgctttagttttgacattttatcagtattttccagaggtaaataaattttggaaggattattacttctctgttggggccctagaacaatttagtcttttatggaaaagctgactatctgggatcatatgctcagtttgtatatttgagatctgagagatcacgttctgaagtcttctcatatttagtacacctctgattctcactagttgaatgcaagaacttgaaaggttcaggtaagtgttttgaaaaattttgactttccaaacttttgccacttgctatctgaaactcaggaatcaaaaaataccgacaggcactgttactttcaaaattctttctataagttgagaatgggacagatttgcagagcaagggaaacttgaacagttacttctagtggtaggaaatgaggtggctaggatattacccagctggtgggtgacttgggcagtgtgttcctgctttcagtggttagcctttagcaaatctgctttagagtgagagtagagggcaggctgttgtattacagtgctcttgtttttgtaaaatttaattcactctactgttattttgtctccttgggtaaagtgttatttaatttttcttcattttttagtaatatataacagtcagtgagagaatttggttttcagagatgtcatccaaagcagattttacagttgtttcctggttataaattgtctcaacaattctcttttagtcatttagattgtttaatatgggaaaaccggggtgtagaacatgttgtaaaattaaattttatttacttttttcttatttccaggtccaagcatctcattttgaaggcctaatcacaaccatagttgggtatatacttttagcaataacactgataatttgtcatgtatcctttaatgaaccaacttgggtgtacactaatattattcataccaaagaactcttcattaatggcgaaacttgtctatccttgtcctcttagtaaaagttgtaggtatttgcagtaagggtcagtgtggacaaaatgtgaaataaattaattctgtcaaaaaatactaaatgttggctaagtagttacctgtttcattgtacctttaaatactcagtttttccttgacctgatgctgtagggcttggcaactcttgtgaaatttcatagatctcgtcgcttactgggagtctgctatattgttgttaaggtaattcctgttataacttaaaattggaaatgatttctcctacatttgggtgatactgatgacctttattttcacttaaggtctctttgttagtggtggtagaaattggagtattccctctcatttgtggttggtggctggatatctgttccttggtaagttgagtattcattattgtataatagcataatttaagggcttcaaaagaggaagtcttcagcatgtattctttttaaaggaaagcaaatatttgataatttgcttattcttttggcatgtgtatcagtataggatcttaatgttaatttttcttgagtacctgagtttttgaggctttgtgcaaatttttgatgtcaggatagtttgggtggaatctttctaatagtggaggattttattgcccattttgctgtcgtaaatttgtgtagataatgccaagacattatatacatagagaataatttgataaggaaactgtctttgtagtaataaatttaaccctaatcatttgatttaactaatatgctcagtcttgattatactctttaattgctgttagtgataatcagtttttgattgtttcaaaaatattttatgtgtagaaaagctgcctttggttctgagataacatttaccctcccataccttacttttaaaacttctcaagaatgcagacctataaccaagaaaattttttacattcatcaaaaatagttctttaatagaatcagtattaataaagcttttactaattggtttatcattctttatatttgaagcagtagccaatcttgtatatagttctgtgacaccgtggaatgacattaagtgaactgcagttctaggaattgttccttgcatgcatattgattatttatttcctagaagatgaaaatgttaacttggcaaatgtagggggcacagatttctcttacctgtcctcttttgtctcaggaaatgtttgatgctactctgaaagatcgagaactgagctttcagtcggctccaggtactaccatgtttctgcattggctagtgggaatggtatatgtcttctactttgcctccttcattctactactgagagaggtaagtccacagggaaatgctgatgctgtacatttataaaaaggacttttgctttcaccaccagtcatgtctcaaaggctatgatgatttcctacctaaatcatattctctactattttattctaagagggaataacttataggggactttgacttaattactttaaactgtttcagttgtttgtctccataattggcaagttttaatatttctgtctgagtttgaaagacgattcaactgaggaaaaagataagagtactcattttgtcacacttcgtatatactttagccatcctctaatacagactcttggaattttgtatgatgtgagtgtgtctcagacttcaaggaactgtactgctggaaataaccaaaaggatatggttttgcaggatcagacatgtaaaatcattttgatttaggcgccttaagtatagaattacaatgagggtcctttatgattccagttcactggcctgatggattacctttatttatttatttatttatttatttatttatttatttatttatttacttatttactttttgatactgagtcttgctctgttgcccaggctggaatgtagtgccatgatcttggaacctccacctcccaagttcaagtgattctcctgcttgaacctcccaagtagctgggactgcaggcacccaccaccatgcccggctaatttttgtatttttagtagagacagggtttcaccatgttggccaggctgttcttgaactcctgacctcaaatgatccacccaccttggcctcccaaagtgctgggattacaggtgtgagccactgtgcctggcctgatacctttattagttctatgtttctaatctggttcttagtgatttgaagatgatgaaagcagttgagtatttgattagtgtacatctcaagctcagtcattccccaaatactgaatggtcactgtgtgccggacactatactgcattctggggtttcagtgagaaacaaaggcacaattcctgttctcctcgattttatagcctgaaaatgaatacagcattgaaaatgttggtttacacggagacgggtgatggagatgtgcagggtgtggaggaccaggttgacaattccagtgagaagggaacacaaaagcacaaaggctgaatgctgctcttggtgtactttgttctttgaaagatttgaggaagaggaggaggggtcagggaccaaagcattctcctgaatcatacggtataatttcagtaaattctcttggtaactaaagctttcattctttctttgaaacaactgattgagaactaaagcaagtacagaaatgtgtttcttaaaaatgtaattatatgtgaactccagattacttcattaagtgaataaaatgctttataatgatttctttcattttatcagtgtggtggtttttgttgatataaaattttaatatgtggaacttaggcagaaccttagaaatcacacactgtaaccccttgtttaggagatggagaatagaagtttgggcagattagatgcgttacacagagggtaactcagtgagtttggaccacatagaactagtacccagactcctcctttaccccatcacctgcagcctcttgggtgatgattttcatttacagggggaaggcaaatcagaccgtctatttagtacatttataaattgcaacataacccttttacgatagtaatggttgtatttatttttcgtctcagaggtctagatttcttgacacattggacccaatgaatgttttttttttcccccgcccctagtgaatgatgatgtcaaaggacatcatcagacacagggtagttttcataaagattctggtttaggaacttactttcctaagaataccatgtacattttctggggcccactttagatgccagaataattctaagtgcttatctttctgttaatgttttagctcatatatagaatttgaagacattggtgaatattcatagtatttaaaatatatttgcaggtacttcgacctggtgtcctgtggtttctaaggaatttgaatgatccagatttcaatccagtacaggaaatgatccatttgccaatatataggcatctccgaagatttattttgtcagtggtaagaagatgtttccattgttttttttttttgaattaattgtgctaacctatagttttgtttaggtttttttttccagttctcaagcaggctgatagagtatattgaataatatatttatctaagcctgtggtattcagttgtcaagtagctgtgttattggttactttgttaaaataaatatgtaaaaagatatttactaaaaggaagatacttccttgttccatagtagtataattcaggggtccctagcccccatgttttggctgggtactggtgcatgtcccgttaggaatggccgcacagcaggagatgggcagcggtcaagcaagcattaccacctgagctccacctcctgtcagatcagccttggcgttagattctcatgggagcgggaaccctattgggaactgcgagtgcgagggatccagattgtgtgctcattatgagaatctaatgcctgatgatctgaagcagaacagtttcatcctgaaatcccgttgaaaactgttttccatgaaactggtccctgatgccaaaatggttggggaccactggtatgattgattgctaaattacggttgtctgaattacgtttaatttgcattgaagcaatggagacttactactggcttgtaaattaaactcttaacagaagcatgtcaaagtttccccacccagaagaagaaattacatagttaaatctaatttctttcttttttttttttttgagatggagttttggtctgtcacccatgttagagtgcggtggtatgatcttggctcactgcaaccttcacctccctgtttcaagcaattgttgtgactcagcctcccaagtagctgggattacaggcgcccaccaccaagctcagctaatttttgtatttttagtagatgcggggtttcactatgttggccaggttggtctcgaactcctgacatagtgattcgcccacctcagcctcccaaagtgctgggattacctcacccagccgtaaatctaagtttttctaaaataaaattcttaaagtaacattatgtcctttgaaagcttttgtagccattaacatggggcaagtcttagctggttacaagtgatttattaagttgcaggcatttctgcttcctcattttaagtttccagctcattccttaggtagcaagtggtgattatcctttgtggcttccgttttagcatttgtgtcctagatgggaggtccttacaggaagaggggcaggcatcttaggaaaacatttttatacaaaatgactcaaagataatgtgtagagtgggaaccgcttgggctttgagtagacacaggcctggactgcatattgcttgagtgtgctcagaagtctgcctgtcttgcacaggagtgattgactcttatagtggtgtcataccctgtttccttctgcagattgtctttggctccattgtcctcctgatgctttggcttcctatacgtataattaagagtgtgctgcctaattttcttccatacaatgtcatgctctacaggtaagttttaaaaatttagaatagctttactaatttatctctattagggatttgatgttcagattacattaaacatttaaaacatttcttatagttactggaaatcatctgacaattaaattttgctttattttacctttatttttattattttttaaattaaatttaatgtttaaaaaattttctggaccttttccactttgcataaattttgccttattttagatcagataaacattagtacttacattttgtaaaggaagatgtttattttttctgcgcataaagtatgcatttgcacaccattgaaatgttttaccatacctaatgagagtgtattagcatcatctttattttgaaaagcacattataaagaataaagccagagttgcacatttaattattaaaaatagggtacaaggcttgtagatggaacatcttttttgctttaaaaacttaagtgggctaaggccaggcgtggtggctcacgcctgtaatcccagcactttgggaagccgaggcaggcggatcacctgagattgggagtttgagaccagcgtgaccaacatggagaaaccctgtctctactaaaaatacaaaaaaattagccatgcgtggtggcgcatgcctgtaatcccaactactcgggaggctgaggcaggagaatcgcttgaacccaggaggcagaggttgcggtgagccgagatcgtgccattgcactcccacttgggcaacaagagtgaaactgcatccccccccccccaaaaaaaaaagccatccggaaacctcccactaccagtaatctttaccactcatcctatatgctctttagggatttgtattatccccacagtcattatcccaattgcaggcaaattggattatttcctcaagtttacttctaatgagtctttaaagtattgccaattctaatttcttaaaatctcttactaatctaactcgatttgccacttacttaatttaggccttcctcttgctctccattcatccgcaacacctctgcctctagattttctagaacttggattattttacccctgtgtttaaaagttggcagcacttcctctgtaatctatgtgatatatacaccatttagaatgagatgcaagacttggcataatctcatgttgctttttcagtgtcttgtctcagcattgactgacttcaattcttttaattgtgctacactgccattgaggctcccctgattacttagctgtttgtctttttctctctgtttacaatgacttgcttgtccacgtttgagtggcaagcatttgatattctttttaaaatccagattaaggtttttaaattttattttattttttatgagaaagagtctcgctctgtcacccaggctgtagtgcagtggtatgatcatggctcactgcagcctcaacctcctgggctcaagtgatcttcccacttcagcgtcccgggtagctgagactacaggcgcaagccaccacacctgcctaatttttgtattttttggggagaccgggttttaccatgttgcctgtgctggtcttgaattcctgagcttgaaccatctgcctgcctcagcctcccaaaatgttaggattacaggcatgagccactgtgcctggccatcattccatcctttaaaattgtcttcatcgttgtatttctttttatagcatttgttacattactttacaaatatgtattgttttatcccagatggcagaaatcatgtcttatttaggtctttttctctctgtctctctttttttaatttaaaaaaatattttgtggagacagggtctgactatattgcccaggctggtcttgaattcctggcctcaagcaatccttccactttggtcgcccaaagtgctgggattataggtgtgagccactgcgcccagcctcttatttggatcttaatgctttgcataggaacatgattgttcaaaaataaaaggtttactctacacatagtaaaatctcaaatttgtattttattaaattagaattggaaaatacttatatcctgattatttaaagtggcagaaaaaatgccagtaagggtatagaaagtgggcaggatggggttacaatttaggaatagtgactggtaaagacctgagggggtgacagttgaggaaagccctgaaggagttgagagagtgagccacgtggatccctgaaggcagaatattcttgcagaaagtaggtgcagtggcacccaggtctgtttgaggatctgcagggaggcaagtttgtctgtagtaggaggaggaaggcaaagaattggccctgaagtcagaaaggtcatggagagccacctcctagagagtcttacacgacataagcactttggcttttgcttgagtgaattgaggagctcttggaaagctttgagcaaaggagtgatctaacttaggtttaaagaggatcattctgactgctgtgatgagaggaaactgggttggagtggctaggtcagaaacaggaagccagctgggaggataatgcaatgatcctggtgagaggtgagggtggcagagatgaaggggaggtagcagtggaggccttgagaaatttttaggatattgttaaggtacagtcaaaaggattctctagctgtttggatgtgaggtgtcaaaggaaggagtgaccttttgtgtaacatgctactaatatagcaagtgaggagagaaccaagacctacccatcagtttagcaaaatgaaagtctttggtgacccttatcagaaacaatttggtggagtttgtggggaaagcctcactgagttggagagagaatgaaaggagaggtaataaagacagtaagtttattagattcttaagaagttgcgttgtaatcccattaaatagtagtcatatgcaaaatacaattcacattataaatcctgcctctttcagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctgtgagtatgggcagctgactccttggacatgcatgtcatttgtgactatggaataacctttctggaaaaagtatgttccatggcccactcaagaaaaattagttttaataagagacaatttagtaatatttgcaattgcatataatacttctaaatgaaatttttttttcttattgtccatcctttcatggagaatatatacatctttttgccctcttatagaagtttgctgctggtccagctttcatggagtaaatgtcttttttttttttagtgcattaaaaacaaaccagtttacctttatttagaccaactaacttacctttatttagtgctcataacctgggaaatgggttcttctcaaatttgatttctcaatcttctagtgaacatgttgcatttttttccccaagctttatatactctatatttatttaaaagttgaatctttaaaagtttttcagtttggcatcttgtaggtatcttaaaggtgaagtacagatttggttatatttgcttgaacatctgtcgtcctctaactgcttcctcccccagtctcatttctgacctaactgatttatagcttggaggttttacaaatttatagcttgtagctacatgttgcagtagtcatctgtagagaagataagaagtttttcttttcctcctgtagatccttaacaatattgtacattgtaagtatgtacttacaccttgtgcttgtaagtacttacctcttgtacttacaagtgtacttgtaagtatcttgtacattgtacttttttctttcagttactgatttcttctcagatactggctgaagaaaacgtaaaataggttgaatttatgggatatcctacaagttcattaacattagaaaggtttgatttaaagtgggtacaaacatttagaccaaaattaggtaataatgtggtgcacaaattctgtattatacattttctacccttagtagtaaatatgaagaaaatgagtgtcatgtctgccattttattgtgacctgaagtgagacttgttactgatgtaatttttgcacagggatcttcattcttatttattgggagaccaggaagaaaatgaaaacagtgcaaatcaacaagttaacaataatcagcatgctcgaaataacaacgctattcctgtggtgggagaaggccttcatgcagcccaccaagccatactccagcagggagggcctgttggctttcagccttaccgccgacctttaaattttccactcagggtaggtgctatacagacttaatcacatatagaggtttttttggtttttttgttctccaaattgctgttgagaattggtgctattagtatgcagtcctctgtgtagacatgttccacattttattaccctcattatgtaacgtaaatgattaggtaagtttatcaaattttagagataagtcaaagagttgggattccctgggctcttgctccctatttaagaggaaaagactctagagtaattaagaaactaacattattgatacatttcaacagtgtgtcaggaactagaatgggcatttggatgttttctcatttaatctccactcaaatactgcaaagtgtaggcgataatttcatgtttatagctaaggaaactgaaggcaatattggttaagaatgtgcctattacatgttcgttagcaagtgatcaatctttgtgcacctcagaattttgtcagaaatgtaagctgatgactgctatatgattacagtgaagtcatcatttatatcaagtctgttattttaaaatgccctttaataatgacatgggcttgtgagtctgatcattttaaaacttgggcaggttatttaacctctcagcctcacatttctttttttgtaaaaatagtcattattatacctttgtagattactgtgggtcacatgtgttcagtcattcagcaaacatgtcttaagtgtctatgattgatattttcagtgtctgtgaggatatagagagcatacgtggtctttgctcagaaagagcttacagtctactcagatgagaaagacagtggcagatttgagctctcatgctggtgtttacagtgggtgctgtgactccttcaatcaagaaccacttgttcttaatatggacccaaaggaatcttcctagaataggtggtgcctgaactgtcttaaacattgagagacctgtcagagagtgaaaaaaaggaagtgggaagggcattccaggaatatgtcaggactagggcacattaggcatggtgggcttagaattgcagataagagagttgtgttgttttgtttttgagacagggtcttgctctgttgcccaggcttggttgcagtgtgcgatcatggctcactgtagccttaacctcctgggttcaagcgatcctcctacctactcagccgtccgattagctgggaccatgggtgcatgccactacacctggctaatttttatattttttgttgaaatggagttttgctatgtagcccaggctgttctcaaactcctagttcaagcagtctgcctgcctcggcctcccaaagtactggaatacaggtgtaagccactgcggctggcctaattgaatatatttagagggtgaggtgtatgtccaggagaggtgaggaacaaggggagagatgaggggccatgggagtggtgagggataaggtggggaagaggtgagggacaagaggagtggtgggagataacgctcttgaatgggcaggaaccagataatggagcaccttgagcaccctctgcatgagtccacactcactgaattgttcttctgctcctttgtccccttgaggggcatatctctgttcctgattcagtggcttattctagaggactttgctgcataaccttgaggaaagcatgaaggtcatcttttcctttatctcttaatagcagatctcatagtcagctcccgtttttcccccttggtctttactcagctctctcgcctctccgcagacaaaaaaggccttctgagcaacagttactttctggccagatcagagacagactcaaaaaatgacttttcacacagttacagctgacaaagcctcagagtctcctgggttttgttatctgtccttttcgggcttcccaccagagctctgccctctggtcttgtggagatccacctggtaagctagcaggcaagctacagttgctgcctttctgctcagggaaactggtttcctcttctctgtgtgatcactttttatctgcacttctgtattagtctgttttcacactgctaataaataatctgagactgggtaatttataaaggaacgaggtttaattgactcatagcattcacatggctggggaggcctcacaatcatggtggaaggtgaatgatgagcaaagtcatgtcttacatggcagcaggcaagggagcttgtgcagagggactcccatttataaaaccgtcagatctggtgggacttaattcactaccaggagaacagtatgggggaaactgccccatgattcagttatctccacctggcccttcccttgacacctggggattattacaattcaaggtgagatttgagtggggacacagtcacaccatatcagcttctcagtacaggagcactagtttatatggctatttacatttcaatttaattaaaattaaataaagttaaaaatttcattactcatttacactaaccacatatcaaatgctcagtagccacatgtggcctagtggctactgcattgagcagtgcagatctagacatttctgtcattatagaacattttaattggatagcactgttatttgattaaaaggtgaatgtttttaatttgtaatgttttaataacaagggaaaatttaaggtgaatgttttttttttatgctctctgattaaaacatttgccatttacttgtgggatgtatctgattatgtgagaatggatacttattttcattttggcctaaatcataggtaattttactgaaaataaaaattttatgtgaaattgcaggaaacctggcaacgcaaatatagatgatttctttttaatgggaagattgtgttgattctttgataaaatacattgagcacgtgttctctatttatgcactccttatgttttactttgcagatatttctgttgattgtcttcatgtgtataacattactgattgccagcctcatctgccttactttaccaggtatgagcttgtgctagccttcagctaatagcatcattaaggttatttatttagctatttgacagagtcttgctctgttccccagtctggagggtagtagtatgatcatagcttactgcagccttgaactactgggctcaagcaatccttccacctcagctaggtctatagctctacttaggaattcaaaaagtatagtaccatattaggaagacaatctgtggaaaaaatatactggaaatttgggtcttactgttctctctagcctattgagaagtaatcatataaagtaagttactaaattatgtaaatggtcttatccaagtgattgttgtgggatgctatagagtttattccgaacaactttttgtatgaggcactcccttagactgctctcaaatccatttttcacattccagcatattcagatagtcttaactttttctaagaaaattaatatggtattctttgattattgtgctttaaaatgttattttgcccactccttattaaaataagcttagttttctgtcttgatgaatgagccaattggaagatagttactctaaattatttgtaatgtttctacatattaaaagtattgacatcacaaataagagaagaaattccccacttttgtcctattatttgcataacagtttcatttggtgataaaaacaatgaaaacattaattccctcaaaagcttttttagacctaaaagaataagtaattggcatgacaaatcagagtgtatgtcccagtagagctcgcctccattgaacttaccttgttttggttgtgatttcatcaaattgtgtactctttagacattgtgatttttgtcttttgtttttttgatgaagacattgatatatcgaatgtgatatctttttcctaatgtgaaaatactaacataacaacatgaagatgacaattctctttacctagccacatgtctcatttatcagcttttctattttcagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatggtatgtgtgtgtaatacaagactgatcttgtatgttaggaatagtgaatatttttccagtcatcttaaatttttttttttggcacatttatttccttactatattgtttcaagagagttgattttttgaattagaagaaatactctttcaagatagtggctttctggttcattcttgttcagagtcctacgttcagatatatgaggtttaaaagaaaaacaggttgggcacaatggcgtatgcctgtaatcccagtactatgggaagctaaggcaggaggattgcttgatcccaggagtttgagaccagcctgggcaacaaagcaagaccccatctgtattttaaaaagtatatgtatataatatatttttactggatcatttagtagcatgtttttctttatacacgtgcatgcacacacctacacatgcttatattacttacttaagggccttactggacactttgtaacattattgctctcagtaacacatatgactcccacaaatgtaggataaaaaaaatactgtaagatgattatctgagtgcagtgatttatgtctgtatgtgtgtaatgttggctgcaactggtaactatgcttaggttactgcttacaccttttcatttgtataatcaactcttaattttttatcgatttatattttgattttgatttcattagaagtttaatatccatttaatattaatgttgaagaaaaatataaaatccatttttatagtgagagattcattatatattatggaggggtataattgctatttaatccataagataatgagacaaccatatttaaaatacagaatccagctaattccagttttcatttgatagtcttccacattattagaaagtgccatatagagaaacaagtattttgtcttccatacacatcatatttagtctcttgttgaaacaggtgtgttttctgaggccacctgaagtaaaagagaggtcatgaggatccaaggccactttaaatcattttttttttggtcagaatttcatcattactcttttataatgtctcctctctgtgtcagctttattttcattttgccatttagtccagttgctagagctgcactatctggtatactagtcaggtggctaaatggctaccatatttgacagatacagggtatttctatcagtatggtaagttctattggaccatgttgttctttgagggagccagtttgatcagctttattaattactttaggattgtgcagagccctccctgtataccagtccacctcaaagttcacagatcagcctgtgtatgggtgggccaccgttggagcaggggccttggccagtcggtagcttttcttgggcaaacagaaacctagtcctaagaactggattgtgagaaaaaaacagcccagccagctgtgtgctttttatgtaagagacttgagtacctgcagattttctggatcctaaaaccagtccccgtggatactgagggatgactgtggttgctctgttaggcatcagtctcaaacctcaaaatggaaatagagtttggctcagaaagatcctctttaatgatgtgggctcctgtttcctaatagatcatgaagactttgatagttgcggtgctgttggctggagttgtccctctccttctggggctcctgtttgagctggtcattgtggctcccctgagggttcccttggatcagactcctcttttttatccatggcaggtaaatgtatgtcttttgctcatgttatttcattaaggatttgagatcagaaaataatcctagccaggcatggggcttacgcctataatctagcactttgggaggctgaggtgggaggactgcttgcacccaggagttcgagaccagcctgggcagcatggcaagacctagtctctataaaaaattggctcatgcgtctggtcccagctgcttgggaggcaaaggtgagaggatcacaggaggttgaggctgaagtgagccatgttcatgacactgcactgtagcctgggcaacagagtaagagcctctgtccaaaaaaaaaaaaaaaaaaaaagacaaaaggaaaaaaatataatttttaattattttaggtgattttaagcagctggtttagaaagactaattttttttttaattctaggaactcttataaaattgtttaatgctctttaatctttcagaatatgcaggtcttataactcctttaaaagtgcttactttataggttaaaatgttactaaccatttagtcttctctaatacttgaaaatacaaattaatagtcattgatttttgttcacctttgaggtagggtgaattgtcttactccttttgacttggaggctttaatacttttgaattattatagcatgttttcccacaaagtcacagattcattaaaaagagtatcctggctgggtgcagcggcttatgcctgcaatcacagcactttgggaggccaaggtgggtggatcacctgagctcaggagttgaagactagcctggacaacatggtgaaatcccatctctacccaaaatacaaaaaattagccaagcgtggtggtgtgggcatgtggtcccagctactcgagaggctgaggtgggaggatctcttgagcctgggaggccgcggttgcagtgagctgagatcatgctactgcactccagcccgggcgacaagagtgagaccctgtctccaaaaaaaaaaaaaaaaccaagagcatcctgagggaacccatgtaagtcacagcaaaggtcttaaagctcatggaaaaagaaatggaacttttctattgtatttagagcctgaggtttttaacatcatagaattaagatctcaagttcttagtaggtattgggggaaaagagctaggtattgacttcagtcattcaaaggctttttagctttgtttttatctgttagtatattgcaatggatttttcagaaaatgaaaattatttggcccgtatttccctttttctgctttccagatggagaacctccacaaacttcatttacccgaaaatttttatttaagtgcttttaatggtgtacccacaccctggattgtatcacccagatgaaaatgaggctagtgcagtaattttcctgaggaatttacacactctgatgggaaagctagacaggtacacaggtgttgtgtggtgtgattaggggaagcacaaggaactgtggcattgtgtaggagagacatttaatctagctttgggagtttcaggtatggtgttccataagagatagtatctaagccaacctaactagtagagaacagagaagtgggtaagaaaggaagaagtatattccaggagggagatgggcagacctggcttgagacaaggcatgcatatgtggggaactgcctcctttctagtctggttcatagactagaataggtgagaaataagtaatacaaagaagtacagaactgacttgtgttttgatttatgactttttaactttttgatggttgaaagcgatacacattcagcagaaactgtactttgagtacttctacagctattctgtttttcactttcagtatagtattcagtaaattgcatgagatagtcactacgtaattataaaattacgtaggcttgttaggcctcagttatactacaaggcaaaaaataaaataggttttgtgttagaagtttttgcccaactataggctaatgtaaatgttccgagcgcattgtgataggctgggctaagctatgatgttcggtaggttagatgtattaaatgcatttttgacttacagtgttttcaattacagatgggtttatctggacctaacatcattgtaagttgaggaggatctaattaagcatatgttatgcctttctgtaagagccgtattccagagtagtcaaatagtatctgtaattgaaggaaagagctaccttttttttttttttttacagaaaaatgccagcaaataaaggtagagagattaacacgattagaaaaatactattttgcaatacctaacaaaataattgattatagcaaggattgttaatggatgttgaacccaacagatgaaaggttgatcagtcttcagttgctattgctgtgtaacaagttatcccgcaactttgcagcttaaaacaaccattttaattttgtccatagagtctgtgggtcagatattaagacagggcatatcactttgcctctgctttgtgctatctgggactcagctgggaagattcaatggctgggaatgatttgacagttatggatggaatcatttggctggaaacacacaactagtggaggggtcaggctgataataccctaacccagtcagtgatcacttaacagtgtgagagttgatgcttgttgttggttgctacccatctggggctgttgactggagctcctatatgtgcctgggctgcttcatagctaagtaacctcaaggtatttgggcttcttacgttgtagttcagggaaatgagtgaccccacaaacaagaagctgcatcatctttaatgaccccatgtcagaaggcctacaacatcacttttcagtacattttactgggtataagcaagtaacaaatgttggctaagattcaagggaagaggacatagaccccctaccacatgatgggaaaataatttgcaggtatgttacattgcagtgtgaaagtggttatttgaatggtggcaaagtgtcaccttatggattactttatggctcaaagggaaacacacaactagtggaggggtcaggctgacaataccctaacccagtcagtgatcaagcaaagtactgctgcaaatgggacaaacagatactatctgccttttaatgttacgcagcatgagccctggaaaaggccagagcatcccgtggcatcaaggagccatcttggcactgttagccaggccttagtgttctcctgttggacataaacaatttgacagaacatcaacatcatacactgtcactctgtgatcaagatagaggaagacaaaagcaagaccctctgcaatcatgtctgaacacagacagaacaggagcattattcaaaccacagaaatgaccaaacattcccctttactggctaacatgattggttactgcctcattaccaattacagttttagcttctgccactttttctagataagatttatttattaagataaccattcacagattactctgctttctaatagcatctgatacagaccaaattcctgcttcttaaatcctcccccaaatccctaacataagctgaaatcctgtaataacccctttctagcactcttactgaggggccccaagttctccatgatgtgttactcccttgctgcaatgagtaataaatgcaacttgttctagttatacttgtatttttggtggtctttacagtactcagcattacttctgaaatcatcatcaccttagagaattctttggtactatcaaagtttaaaaatgcttatatattatgactcagcagtttggcttttcagaatctactgtgaggcatgagcaaggctgtttctgcaaatacatcattttttatagcaaaaaatgagaagtgatctagatgtccaccaatagagaatgcccaaataaaatgtggaatatcaatgcagcaattgaaaaaatgaagtagagatatttgttttgatatcgatagctcccagacgtgtttctgagttgggggaaagcacaagctgtagacagataatgtgcagcgtgctatccttaatgttttgcattaaacccccaagtttttgaaggaacagtttgctttttcttaattcatgactttaagctacttgcctttcctgcagcaagtggctgcagctccgtgggatagtgggccagttggaattctagcagagcagctagtgtggtgtgtcctgtctggcaggagaggactgcaaagcagtgggtttttggagaacgcgaatcacagtgatcttggacctccttgggtaaacattaatctcatttgggtgtctgctggactcccagaaggccaagagaaagctgaattggtgggttgttgcatcttccctgcctgtgagaaaaagcagggaggctttcttcatgttcctcagtaggagactgttggagggctatcccaaaggtctgaagacgtaaaagatccttttgaagccctttaggatattctcagccaggcccaagcctccttgaggctgcagaggaaattataacaagtgctttatatgcaggaggcttagcagccgcagaaaggaagttaaggcagagcagtcagaacacatgccagtttgacagcactgcttgcagagccatgagcttccagagagaagaggaaatacacggacgccgagtgcagtatgttcacacgcacatacaaacagcagctctaaagcagaacgcagttgttgtggagctgtatgacatagatttcagacaaatctagtagtgaaaaaagatgtggacagtcaccactgggcttggcttggaggcttggaagatgaatgcaaagcactgggcaaaacggaagaggaaattgagaaagagaaatgttttggaggaaacatctaggagacttagcgtactgataacgggggttccagaaggaacaaatgtgaggcagcattgatacaaaaacaggagaaaatttaactgaattgaagaaagatctgattctgtagtttgaaggggctcatgagatttggtaagattgagatccaagataaaaacacgtaattgggtatatcttattagacacggggaaatcaaaacaagcttcaaaaaactgcattgtcattggactttttttctgtagcactgaaaaccataagatcagagaatttatagacgactgggtaaaagggacaaaagccaagcttcctctacccagacaaaaaatcatttagctgttcacctatcagggtgaagattgatatttgagggtattcaagaattcagtgtatgtatcaacctctcaccccatttgaagaagatccttagaataaccaatcaaaccagtaaagaaatgggaacattggcctcaagatggtagacagtgaagaggagaattaacaatctgagcaaagtccatatgaaaatgatactacatactttctatgggatatagatgtatagatgcagctgaatgcatggggaaaaacatggatggtatgtaccaaaagctaatagtggttattgctggggagggatcaggatttaaggtagtgatcacagaggactcccgtcttttctgtaaagattttggttttatgtaagaatcagtctaaatgttacatgtggtttctttttttttttttaataccgttttttgttgttgttgttttaaataagctagatagagaccaggttataaagggttttgtgtgccttgctaaggacttcagggttgttaagcagggaagttacgttcatgatctgatttgcatttaaagagatacttggtggtggtggggaagggggctgtggggagggaggaagtagtcatcactctgtctggtggagagctggagggtgggcaggccaagagtccgttgcaccatgaggaggaacctagtaacagttccccagtagaaccacaaatgcttcaagctagaagctatctgtgagcctttagaatggtttcttaggccaaactttgctccacagtcttaatttgacataaatcagctcacttgaaaccaatgaaatagcctaaagatagtttgaaataaaatcttggcatttattttatttgctttttgagatatccattaatgaccagactttctctaactcttgggaaaacaatatagatttttaaaagatagaagaacaatttttgatggaaacattgaatttgagctgttgaagaaaaaaaattctctgggttttcagtacgttagtcttttgtaaaattgttgccaatcctatagaacttctattttgatgtgaaataatgtaagaaaattatacagcctctctgctgtgtttattgttaaaaaacaacagaaatatgttaaatggtttttaattccctaggactgggcacttggagtcctgcatgccaaaatcattgcagctataacattgatgggtcctcagtggtggttgaaaactgtaattgaacaggtaagcaaaatcagttttcagagaaagacattctggaattggttgtgtttatgtttggcagctataactcttatttcttatcttcctaccttgctgagttttctacattttttttgatgggcatatataacctttttttttttttttaaagacagcagtttagttttaccactgtaggggaggaaaataatttgttctcaacccttgttttttttagttaaaatggaaccctttaataaaagacaacagaaaaacaaaagtttattaaagtacatatttcatatatacatggagatacccagggaatgagtaatttcaaagaggtggctttgaattccaacgaatcttcaacaaagaataataaatttttagagaagtgacaagatgaaggaaaaggactttgagtctctaggggtggcaagtgaggggaagcaaaaaattggcagatgcggctccttagtaaagcttggcagtgttgattcctctggtgccatctagaggcccagaaaggcccaaagctctcttcagtgggtaatctttgtccttcatggtgtagggaagtggggtgggctaccttttgtctttatacatttatattctgcttctaggcaatagagggaggacggaaagttttcctgcatctattctttctcagttgcattcaactcaaaacaatccttatgcctaagaggcatatttttagggtggcatattgtggttttctatactcccatgaattttcatcaaccacgtttaagccatcctttatctgaaggttaaccagtagcttacggtatctagaaccctgttcatagtggagacaaaaatgaaaatacgtgctttttttctggtgaaggttgatattaatgtttctaagcctgtagtagatttggagtgggggaaaggttattgctcgaggtaataaaagaagacagaggaaaaaacattacaaaaggagagctgttttggcttcatctagctacatagtacctaagactattattgtattacagaactgccagataatttgattgttgtgggaataccttggaaaaggtagactgtgctttagcactccgataataagactagaaagtatggtaattcatttaaggaaaatttctatccaaaatggccaacataacagattttgctgctactttacgctttagctatatggcaaatgtacttgtggggacccctcttatccttaggccagtgccacataagtaagacataacagttctgcagcagtaaagtacacctctttttgctgtatgagaagtaaagacagtagttagccaagcatgctcaagaaaatctgttcaaaaagtgcctgtatttcaagattttgattcttaggagtaggggggttagggagccagcaaattgcagtgtgtttgtgtgtgtctctaaagtatgggctaattctgaagtccaccaggagtgtgatggattgggggcttctggcttcatatcccttcaggatcagagtgcaggccagtacactctagaatggccaggttagcctctggcccttgaaaaaggagcatggagatgggatttattcatactggaggctgtggaacatcattgatcttctaaataatttgttatcttattcattgttttctcttgcgtatgtgcgtgtgtgtctctgtaaatttaagaaaaatggttggaaatggttgagaaacactgggatgccttgcttcattgattaaaatgcatttgggttaactaggtgtctttgggaatggcagcatgcctttaaaaggttaagcatgtttgccattcaaattccgaggtgatggggttgagttatgctacattcagtcacagctaagagaggtttaagtgctgctggtgaggcaagaggagaagaaaataacagccttctaagccttgtttctgtctgcactccatctaaattttctgttcccagggttttcccatttccatccattctttcctctgcattactcttgtagaattttctggataagatgatggaaatattctagtaattcttggacttgctttttttatattcactatagaattctttcatactaaatttttaaataccttttgatttgttaaaatttgatttatgcaagcttttcagaaacgcttcctgcttcagtgttttctcatcatactcagataaaatgaatgcaatattgtataataacacaatattacatattacgtatctctttcataagatgtatgaagttacttcaagtaatgtggtcttgaatgaataccactgaatgtcatctggtattgtatagtgcaagtagagtataaattattctagattagtgtcttatttcatcacttagcagagctaactgcagagcgttagtgggtaaatacatttcttcagaaactcgtgggcactatgcttatgttgatataccagaatttgccttgactttagaagaagtaaccagtttgactatttttgggttggcagattcagttgtgtggagattgctgtattaacttggaggaatttgtcttgtatctttgttctaattgctttttgtaatgtttcaggtttacgcaaatggcatccggaacattgaccttcactatattgttcgtaaactggcagctcccgtgatctctgtgctgttgctttccctgtgtgtaccttatgtcatagcttctggtgttgttcctttactaggtacgtaatgctggttgtggagccttgaaggagcacttttattaacattggacattctctttacccctagtaaaaaggatgtctcactccatatgctttatttgtaaatgtgaatccagctaagacaatgatttcaaaataccacttttcttagatttgactattctgggtaagattagaggatcataaagctctttgatacagttcttttctctaccagaagataaaacttgaaatttacatgctgtacaaaataggcaggatcagatttccttcaggttgtcttcttctgactagaagtgctgtgatcatataaaattaagtaacagtgttgttgtatttaagttttaaagaaatattctttggcataaaagatccaaagaggagatgctaatgggcaacacgtttatactgaaatacactgtcttgttgattgtgtagtgaagactcctcatagctccttaaacccaacatattttcaaaattataagcagagacttttccttcccaaatctttttcttctccagaattccgtctctcagcagcaaacattatcatccaacaaattgcataagtcagaaaccttgaaggctatccatgtcaccttattctgtcctccatgtccctctggtctccaagtgtcccattcttccctgaagaatctggtctctcgtctctggagcctttgctcctgacttttgttgagtcattcgtctcctaccctaactttggcaccttcctatctggtttcccagccttgaacctgccatcactaattccttctccacactgggcacaatgacctttcaaaagaatgaatctcattgtacctctttggtgaacatttttttcattggttcctctgtggcctttaatgcagtccaaccttttggcatagtttacaaggctcctccttttgctttgatgtgggcttcagtttgacctcactccatgtcatatactctgagttttgattaaacaaccatggaatggcctcttatcaaacacacaatgtcctctccataactgtctccacattttcatttgtcttatccatctgccagaaatgaccccgtcctccctttaaccgtgagagaggagcttaaaaaaaacacacaaccaaacttgcagtgtaacatgtatacttgtatgttaccttactaggtcaagaaatagaacttttccagccctttggaagccctttgtgtgtgtgcccttctttaccttttgccactggtttgacttctaatagtctcattgcttcttagacagtaaagatattagccatgtgcagtagctacttgggaggctgaggtgggaggttgcttgaagccaggaattgaagaccagtctgagcaacatggcgagacccaacctctaaaaaaaataaaaataaattatctgggagtggtggcgcacacctgtaatctcagctgccctgcaggctgatgcaggaggattgcttgaacccaggagttcagggctaacctcaggttgtgacactccaatctagcccaggcaacaggccaagaccctgtctcaaaaaaaaaaaattgctcaacacaggtttgtatagagagaggctgagcaatgtatccctcagtctgcaggatggcatgggaaacagggaacagttaagctgagggcccacagtgtgcaaactgcatcatttcctggttccttctaagtagaaacttcaaggcttttatttggtttgaattgtgactatgccaagtatcataaataccatattaaaatgcaaatatatatttcctgcaaaatatatttcaaagcccattgctttttagttttttttttttttttttttttttttgagagacggagtctcgctcttttgcccaggctggagtacagtggtgcagtctcggctcgctgcaacctccacctcctgggttcaagcgattttcctgcctcagcctcttgagtagctgggactactggcatgcgccaccatgcccagctaatttttgtctttttgttagagacagggtttcaccatgttggccaggctggtcttgaacttctgacctcagataatccacccccctcggccgcccagagtgctgggattacaggcatgagctaccacacccagcgcattgcttattagttgaatacgtctttaaaattaaattattttgactctttagaacaatctctttactggttttgtctagagtaggaatgccctattttcttttttattctaattagcatatattatgttctgcccattaatagtatatagacttaagaatttggatttccaacccagtcattcatgttttcatttttaaaaattttattgtgagcatttctggaaagactttggaagggaaaaagagtggcaaatgaaaaatgttggtacctgttttgccctgtttagatgctttatgtaattcttacatgttattcttagggtagctttttaatatgttttgtcaactctgttttagaaatgggaaattgaggttcatagagattgagaatcttaccccaaagtctggtttttaaggagtaagagcagcattcagatttcaaactcagctccagagcttatgcacagcacactattgtggtgtttggaataatccacctgacggtattaattttctgaattcctcgaaagtacttgctctgattttaaagccccccagtcccctctgccaaagaagtattaaaactcatgagttaaatatagaaaaataaatacatgtgtgttctaaaagtttgaggatttttttattatataagcacagttttggttttgcttctttaaactgtggtgcagtagaaatgtatcaatgacaccactgcttgtggaacatgagaagtcatctcgtccagttcctttttttttttttttttgaggcagggtctcactctgttgtccaggttggagtgcagtggcttgattgatctcggctccctgcaacctccacctctcaggttcaagcgattctcccaccccagcctcctgagtagctgggactacaggtgcaacgccaccacacctggctaatttttgtattttttggtagagacagggttttaccatgttggccaggctgctctagaactcctgacctcaagtgatccgcccgccttggcctcccaaagtgctgggattacaggcgcgagctactatgcctggcctccttgttttacaaatgagaaagttgggggtcagaaagggctcatgacctacacagattgtagaaagttaacagacctggggcttagaaagcttgtctgccccagtccattcttctaggggaaggacatgtttacgtttcatgtcactgttatttcacatacactgaaagtttttcttttttggttttctaggtgttactgcggaaatgcaaaacttagtccatcggcggatttatccatttttactgatggtcgtggtattgatggcaattttgtccttccaagtccgccagtttaagcgcctttatgaacatattaaaaatgacaagtaagtctggcgttctgttcgtctcttgtttaagtgttttcacttcttaatttatgtatctgatgtgacaaatcataggagggaaacatgctcagattctggatatacttggaggtgggattagcaaggtttgctgacagattgtgacatgtgaaggagagtggaatcaaggacttagttggcccaaacacagggaatatggagttgtcatttatggagctggaaaagactgggtgaaactgttttggagagggaggttttttttttttggtggtggtttttttttttttttttttgagacggagtctcgctctgttgccaggctggagtgcagtggtgcgaacttggctcactgcaacctccacctcccaggttcaagcgattctcctgcctcagcctcccaagtagctgggattacaggtgtgcaccaccatgctcagctaatttttgtatttttagtagagacagggtttcaccatgttggctaggattgtgtcgatctcctaacctcgtgatccacctgccttggcctcccaaagtgttgggattacaggtgtgagccactgcacccagccaagagattttttaatgtccattccaaatagtttttcagtctgttttcaaatgttctggtctgacagtatattaaacagttttagataaaaataagaagcctgcattagaaactagcagtgcctgcataagcccctcttgcttatagagggccactaggttactctgaggttgcacagagaggcttgagggttactgcaaaaatgttgtgggactctctgttttgaggaaaccattgaaaactctgtcacttgatctcagtgagagattgaggaaagccaaggaaaacaccttcctgggataatatttgacctttatgtccgaactgtaggctgaatcatctgcttcaatgggttctagcagagaaagtgagtttatggtttatccatctcagtcggccaagagagtcccagtttatacctgctgcctttgtgtcattaacactacccccttttacttgtgcttgtccccccttgcacaacaaattatagagttaccttatttattctgaggagtaagatttttgagaatgaaatttatagtgttcaagacttctccaaagcatttactgacagtaaaaaatacaagtacacttaggcagtcagagtacaaaggactgtcaactgaaagaaggggaaggggtattttcaatgatgaaaatcaacttcttagcactcaactttttggcagaggagtaaatactgcaaacagaatgacaagcaagacgtgccctcagggaactttctacctgcttctttctttatgctggatgcctgcctttctgcaccctgcccttctcagcctttgccaggggtctagacgttcccattgacctcttctttctcatgctctatcttcttctgctttttcctgtagcccagtgtcctctttcctcttttcccatctgttcctttatgcagaaaggtgttgaactgtagacttaagtgagggcatgtcttgtcagctgttgtatatgtactctttagcacagggtttggtctgtgggaggtgctaagagtgagtgagtgtgtgtgtgtgtgtgtgtgtgtgagagtgtatgtgtgtgtgtggtgggcttgagtatgagagagtgagtggtggtggaagagagggagttgggttcagagtctcctttctctgccactgaattactctttggacttgtacaatttaacttggtttctgtatgctttttatttacttactttgtcattgccataatgctgaccatatttttagtgtatcttgctatttagtcattactgtgtgccaggtagtgctgtgtatattttagtagatattgctcagccttcactgtttaaaatatttacaaaattctcaaagttttaaaatcagtggttggttggggaacagtggggtaaggaatggctaacttcaagaaaagaaggtaagacaaaagaaaaggaataaaacagtgacattatggataaagatgcagtaagattagcgtacttttaaaaaagtgacatattaagctactggacataaactgccaaaatatttccttaggcttgtgtgcatttacagaaaagtgatagataaaagtcaaggtagagaaggtactggtgaaaagtaagagttcccacagtgagcccttacaacatgctaagcctttgtcaccgggctgcatacactttccctttcttaaaacaatgctgcagcgtgggactgtcggtctcatttcactgatgagtaaatggaggaaagggacgaaggaaagctacctgacagcctgtcatgtgcaggtttcactctccctcagtctccttcactcaactctgtgggcttttactggacattctccctgatctgcatctctgcctccaaatgggtgcccttcacacttgtgcccagccacctacagcttgttgctttccagctttgtccctgctgtcctcttgggatcagcctgcaagccatctgctcacattaagtaaggcaggccttcagtgagccttcgatgcagctgtcgcccttccctggcattggagatgtctgtctccttgagtaggatctcctgccctgtcactccaactacagtaacatctgccttgtttctgcagccctgtggcctttgccattgccttctcctttcatcacatacataagttaggaacacttgccattctgttgttgaaccatattctcccacctcctgtcactcatactcactcactgcaatgctgtcttccctttgacttcactgaaatttctcctttgatttctcctttcttctctgtaactagaacttccagttttactttcatcccttcctactttttttttttttttttttttgagacggagtcacactctgtcacccagactggagtgcagtggcacaatttcagttcactgcaacctctacctcccaggtttcagcagttcttctgcctcagcctctctagtagctgggaccacacacacccagctaattttgtatttttagtagagatggggtttcaccatgttggccaggctggtctgaaactcctgacctcaggtgatccactcgcctcggcctccctacgtgctgggattacaggcgtgagccaccacgcccagccccttcctagctttctgatggtcatgtttttagtctgtctccttagatctgcccactaagttgttttataaaatctgaaccttaacagataaatccactgcataagtttactgtatccctcctggcctccacaggtctgagtttctgagaccccctaaaccactgactgaagcatgtcctccattgcacagcattggaggccttccagcctgtgctgcttctgcagcttcctacaaacccatacctaggtagatgtgtcagcctttacaggtgttcactcgggactccctttgacttgcccaaccattgacgagttttaagtaggagttagatttaaaaagacatatgaatgttttactctgtacattcatagaagagagtaaccaccttgtttttgcaacctaggtaccttgtgggtcaacgactcgtgaactacgaacggaaatctggcaaacaaggctcatctccaccacctccacagtcatcccaagaataaagtagttgtctcaacaacttgaccttcccctttacatgtccttttttgtggacttctctctttggagatttttcccagtgatctctcagcgttgtttttaagttaaatgtatttgacttgtgttctcagcattcagagagcagcggtgtaagattctgctgttctccctggatcttctgacattactgctgtctgagatttgtatatgtgtaaatacaagttccttgataccctaaaaccttggattaaacagaatgtgcattgtacatctttaaacaaaatgtatattaatttattaaatctagttgtcactttattttggacctgctgtgatctcgacaggaaacgtgccacagagcagtagtgcgcaggcaagacttttcagtgacgccttgtggaacgcagttcatgatgtcctagcagctctcactaagggaactgtacattctttctttcttggctattcagaccttaccaagaacgttaaaggaaacaagtagaaatcagcagtggagtgtctgtggtaagaaaacatgaactttatgcttcactgttagttgtttgtggaagttattttgtataacaccaaagctgttgtacatttcctactgcctgatttttttcatgtgtctgtgtttgtaatattgtatagtatcttgtgctaggtgaggaaattatttttaattttgataatttaatattcctagtgtgatcagcattgggagttgggtttcagtggggcatgtctatacttagagaaaaaaagtccaaatgaagattttcatgagtcagcccccccgcccgcccccaccccacacccacatcctctcttttccacacacaactatctgtttattttttgtagcagtggccgaaagtcctgcaaggtcataaatctttcagagtgacatcaccaactgtactgcatcttactggatttaggacttctgagatgcttgtgaagtatagatgtggttgtggtcttagattgacagcattagagaagactggttagaacatctggtctcgctggttagtgcctcgttggctgaggactaggtgtgcatttctcctagcttttcatcaggaaatcccaaagtttccaaagctttttgtttacagaataaaacttcaaataaaaccaattcattatttgtccagaaggaagcttggctgagctggccttttaacataggaatgtatttcgttggaaacattctgaaaaatctcagagaactgaacccttacaaactttgttttccctcataaccaaagcttcaggttagaagtttagaaaaatagaatggttgggtacatgatctaaatgtttaatgctaaaggtatatcgtaagggtagtgtttgtttttgaacgataatttagaagttctcatagaaagcgtataacataggtcttcagaaactataaaagaattttcatatagtattaaaatccatagactaaaatctgagaattttttaacatatgcaagtcagccaaacataagctaccaaaataaagagcaatgtgttctggctgttttatacttcaacaattttttccctaagtggtaagcaattactttaaaacatatttttaaaaacatcggtatcgggagctgcggtggctccggccggttgtcctggcacacaaggaggcgaggctatgcgttcgaggccaacctaggcaaaattgg

SEQ ID NO: 35965 - DNA, 2743 bp, Homo sapiens
atagtctccatcggccattttgtgcgagaagccgcagcgccgcctcttctctcgcgccctcgcctcttcctccgcctcctccttcgcctcttcctgcctcctcccggcttccgccgccgccactccagcctaatcccaaccccagggcgaagcgttttcttatttatttccgttttctcgccactacagcctcctgacaaggtgatccgggcgggccccgcaggaattttatcccctcaccggcctcacactagtatcgcatgtccactatccagaacctccaatctttcggtaagatcccgtcgccgccgcctccctcccttgcccggcgcgcatctcggccttttgcccgcctggccaccgcccctaggggccccctttctgcccttcccgcacccctagtggggctttgtctcggcgcccagaaaatggcgacggggcccctggcgaccccttccccgaggacagcgccggactccgagccctcctctcggagccccggccgcgggccctgcgccaccccctgccccgtccttgacccggctctcgcctccgcttctgccccttgaaaccttggcgatcctatttcgtggactcctagatcggccctgctacttgcaaagggtatgccgggccagggaaaccagggatcggcgcccgttctctggcagctcctgggggcacttagggaaagatgcggatgcaagcctctgatctgtcactggccagtggttcagtcttctctgcttgcgtagcaatttgttaaattacgcctcttgatatatatgtaatctactttttttttggcaaggcacagttacggttaaatgattaaggtgggcgtattcgaatgtttatgttttcatcagaatgtaatcgagatgacgcacatttttatagcggctacaatattaaggttttctaaatctttttctcattagaggaccatattgaacgataacattatttatctataacagcgtttttctacaatggacatagctgttcaaatgtttctctttttgtgagagtatcttgggggttttattaatactccacccccatctccattcctaccggcaaaaacagcaaaggcactagaaccttcattgatgactgtctggattggtagtataatgtatttctggaaagtacttcttaaaaaatatttttctactttggattttttttttttttttatccattcgcagacccctttgctgatgcaactaagggtgacgacttactcccggcagggactgaggattacattcatataagaatccagcaacggaacggcagaaagacactgactactgttcagggcattgcagatgattatgacaaaaagaaacttgtgaaagctttcaaaaaggtaaagggattaggaagaaaggattagagttactgatgcacacctctgaactggattatgattcacacctttatatcggcgtggatgaaaataactagaccaagaaagttgttctcatttttgtaattaacatgtaaatatttagttattctcccagtgtggtctctcattttaaaagaagattcgcgttgcttttaaataaatttaaatgtgaaatatttagttcttgatgttacacataaaatcatttcctggtttacaaattaatttggaaggattgtggattataggagacaaaatctgtttctctaaatatgatctagcttactgaaatggctaattctgttcatacggtgaaataaaacctcatagtagttgactaaattttgttgtatatttatgcacttttccagaaatttgcctgtaatggtactgtgattgaacatcctgaatacggagaggttattcagcttcaaggtgaccaaagaaaaaacatctgccagtttctcttggaggtgagtgattgggtgctttatgtgtaaccttgagattgcttttaaaattgtatttaaaggcaacatgatttgttttctactaagtaaaaaatcatacgaatgaaggaaattaggtgaaataaagacatggtagttatttggaaagcaaagacctttatctggtttattttgtcattagagtattctgatcatttctttatatacacacacaggctatttcttggcatgtaaagtattcaaatacgtgttgaattgttggctatcagcagtgcatgccacagacaacagtgttgcagtaagctgttgatagtgattctttttaattactcttccatgttttcttaatgaatttttatatttctcagagttattttgctaaattagattttattttacaggttggcattgtaaaggaggaacagcttaaggttcatggattctaaaatgaacctaaatacgtggagaatttcttgaatagttttgttctctaaacccggtttggctgccttgtgaaatgattccctgcagtaaacggacttttcatttatttaatcattcaaacttccattcacatctgcatgattacagaaaacatggggtatgtagactagtaacacataagaaaattgcagtaagatggtaacaaaacctcatattgtctttacatgtttccaatggaaaatgttttgagtgtttattgttcagtttattacgtttcacttgattaaatttttttgttgttgtattaaaccatgtacgttgcagcttaacaataaaaaaaaatctatgaatctttgtgagcaattatgctcccaaatctaagcaagtaaaatacacattttgtctttcttaa

SEQ ID NO: 35966 - DNA, 19226 bp, Homo sapiens
tttcccacgctacagggctcacacgtgtctggcctgcgacgcgctctcccttcgccggggtcccagtttcccgcccaggaaacctcggtccctcctccgaggccgccgggccctcctccagagtcccgccagtcccccagagtccaggccagtccccgccgtcacccggtgcgagcccgcgagaggcctagtgcagctggcagccccgccccggcacccgcctgctcttctcgcgggtccggaccgcgagcgcgggggccgacgggtcgccgctgcgccgggccgggatggcggccaccgcgctgctggaggccggcctggcgcgggtgctcttctacccgacgctgctctacaccctgttccgcgggaaggtgccgggtcgggcgcaccgggactggtaccaccgcatcgaccccaccgtgctgctgggcgcgctgccgttgcggagcttgacgcgccaggtgagccgggccggggagcccgggcccctgccccgtccccgccgctccgtccctgtcgggccgctggggtctccaccgtctttgctgagccacctctttgcctcggcagctggtacaggacgagaacgtgcgcggggtgatcaccatgaacgaggagtacgagacgaggttcctgtgcaactcttcacaggtgagggaccgggccgaggggcaggctcgggggcccgctccccctcgcccaccgccctgagcctgggacggctagagaagtgtgggggaggtcaccatgcaccggagccaggtgtctcaagctgctttgcctccggtctgtgcctctaaatggcacctggaggtaggctagaagctgtgaaaggcgtttatttaaaagttcaagttgggccgggcgcggggactcacgcctgtaatcccagcactttgggaggcgggaggaggaggcgggcagatcacttgagcccaggagttcctgaccagcctgggcaacatggcgaggcccccgtccctacaaaaatacaaaaagtagccgggagtggtggcgtgcgcctgtactcccagctacttgggaggctaaggcaggagaatcactttagcccgggaggtggaggttgcagtgagccgacatctcgccattgcattccagcccagccttgggcgacaggagtgaaacaatgtctcaaaaaaaaaaaaaaaaaaagtggaagttgacaaagcctgatttctcctttgtgaacaaatgtaatgtattcttatttcggtaaccaaaatcagaaactaaaattgaaaggcaactttcccatgccttcctgatttcattcattctttctatactttgagctctgagtatgggtcagcattcccagtgttagggattccagatgaaggccctgccaactgtaagacgaaaagcacccccttaacactctcccctccccagatttttcataaaactatccattgaaaactgtagagttcatttggctctgatttgggggaatttttagtcatatattagaaatcatggtggaactccaaagttctctcataacaaagtttaggcctaaaacataactttcattaaatgtgactggcctgtttgtggaatcttccacaatggttattagaagatgttatctacaatctgagctatttgatttttttttaatgttgccctatctttatagcgtttggcatctaatagcactaaacaattatctttctcatttgttttactgatatagcatgatgaagatactattatttcaacctgaggatttttttgaaaccttgaaaatatttgtgacttggccaggcgtggtggctctcacacctgtaatcccagcactttgggaggctgaggtgggtggatcacctgaggtcaggagtttgagatcagcctggccaaaatggtgaaaccccgtctgtactaaaatcacacaaaaaaattagccgggcgtggtggcaggcgcctgtaatcctagctacttgggaggctgaggcaggagaatcgcttgaacccgggaggcagaagttgcagtgggccgagattgcaccactgcacgccagcctgggcgacagagtgagtctccgtctcaaaaaaaaaaaagaattactgatcttcatttagaaccataaagtctctgatactcattattaagaggttaataacaagagtagctggagcatatctgaagtcttaaagcataaagtttgcccagttgccagagaccttatttctatttcttttctttttttttttttttttttgagatggagtctcactcccttgcccaggctggagtgcaatggtgcaatctcagctcactgcaacctctgcctcccagttcaagtgattctcctgcctcagcctcccaagtagctggaattacaggtgcctgccagcatgcctggctaatttttgtattttttatggagatagggttttgccatgctggccaaagtcgtctcgaactcctgacctcaggtgatctgcccaccttggcctctcaaaatctgggattacaggcgtgagccaccacacctggccacctatttcttctaagtgataacattgcactaatgaaggtcagtgcattgttttaattttatttttgtttttgtttttgagacggagtcttgctctgtcgcctaggctggaagtgcagtggcacgatctcggctcactgcaagctccgcctcctgggttcatgccattctcctgcctcagcctcccaagtagctgggactacaggcgcctgccaccatgcccggctaatttttttgtatttttagtagagacggggtttcaccgtgttagccaggatggtctaaatctcctgacctcgtgatccgcccgccttggcctcccaaagtgctgggattacaggcatgagccaccatgcccggcccattgttttaattttaaaatgataaccctattttctaccatatgttccctcaaaaaacagtggtaaaaaagagacttatggacagagaaatagaaagccttggcaaaatattgtaccccaaatctgcagctgaatcactacacaggtgccaaaattatgcaaaaaaattacactggctgggcctggtggctcatgcctgtaatcccagcattttgggaggctgagacaggaggatggcttgaggctaggagattgagaccagcctgggcaacatagcgagacccccatctgcacacacacaaaaataacaaaattagccaggcacagtggcatgcagctgtagtcacagctacttgggaggctgaggtgggaggactgcttgagcttaggagtttgaggctgcaaggagccatgattgcataccactgctctctgacctgggtgacatagcaagatcgtgtctctaaaataaaatatatatatatttttgagatgttgttttgctcttgtctcccaggctggagtacaatggtgcgatctctgctcactgcaacctctccctccagggttaaacaattctcctgcctcagcctccctagtagctgggatcacaggcatccaccaccacgcatggctaatttttgtatttttagtagagacagggtttccccatgttagccaggctggtctcaaactcctgaccttaggtgatctgcccgccttggccttgcaaactgttgggattacaggcgtgagccaccatgcccggccaaaataaaatgttaagacgtttgcagctgaattttttgcagctaaaatgtatatagctaatatcttgcagctaaatattcaagtacccaaagggtagtttaagaacactttacctgctggtgtggtggctcacacctgtaatcccagcactttgggaggctgaggcaggcggatgacctgaggtcaggagttcgagaccagcctggccaacatgatgaaaccccgtctctactaaaaatgcaaaaattagccaggcttggtggcgcgtgcctgtagtcccagctactcgggaggctgaggcaggagaatcgcttgaaactgggaggtggaggttgtggtgagctgagatcacgccactgtactacagcctgggcaacagagcgagactctgtctttaaaaaaaaaaaaaaaaaaaaaaggaacactttaaatcttggacataattctaactcagcagcatagctgttgcttgatgaaaaaccaaccatgtaggccagccattttaaagacatttctgtcctcacctggaatgggaaaaaaaagcatttctgtaagaagtttctattttagaaaacaggcaacagtgtattcccattgtagtaaaccctgaaacttccttgttgctttgctgcttcttgggagccccttatcatcccacccacatagttttttttcattctctttttcatactggtggacctggttccaggagtggaagagactaggagtcgagcagctgcggctcagcacagtagacatgactgggatccccaccttggacaacctccagaagggagtccaatttgctctcaagtaccagtcgctgggccagtgtgtttacgtgcattgtaaggctgggcgctccaggagtgccactatggtggcagcatacctgattcaggtaccaaagttctttctgggctgggcatcgtggtacacacttatgatcccagcactttgggaggcttgagatgggaggatggcttgagcccaggagtttgagaccagcctgggcaacatggcaaaaccgtctctacaaaaaatacaacaagttagctcagtgtggtggtgtgcacctgtagtcccagctacttgggaggctgagatggatcaccggagcccagtaggtagaggctgcagtgagccgtgatttgtgccactgcactgcagcatagccaacagagtgaaactgtctcaaaaaaaaaaaaaaaaaaaaaaagtctttctggtcccatttatagcagatttccagaacttcaatagcatggtctactggtgggccttgttggaaggagctgtgtgcttgatttcaggctgttgggaggtggtttggtatgatggaaagcacctgagccttgtgacagggtaacctggggctctgctgcctgccagtgaggatcagcaaaagtgacttctgccttatgcaacatgttttctcaaactaaatgtattatgaagtttaaataagaaattacatcaagtgctggcctatagcgggcactctaaaaacggagttgcaaaagccattcaaccccagcaaaaggctagacacttgttctaataccatgtcaggaaacaatatcatagataatagtgctgatcattttcagctttatagtactcaagtttcttcaagtattccagagtaaagttctggatattagtttctggaaacaggctccaaactggattctgcctattaatgtgtcataattggcaggtgggatgctttaaaaatatttaggagaaacaaataccctgtagtccatcatcattttgtaacctaagttacaaaatgtctggctcccacagagcattttctaagtcatgtgaatagctaagtctggccttgtgttactgtggactagtgtgtatatagttgagtaatattaaaattttggtcataagggctctgctggaagcagggtctcaggagggtattttgcaccaagtgagaattgaactagcaagttagaaatctgtattttcttggttctgttgagttctaaaccaatgagtatccttaggacatgttaaccctcctatttaaattatgagttacttgtttttctagccatggtgacaagttgcataaaaacatctattgcatactcgttcctagaaattcttgtaaccaaaagcccagctcggagaggacgtggagtaggctgaggcagtcttgaacttaggatctcagcttcccatgtgcaacttcctttttctaggatttggcagagcaagaattgggtagaaagactgactttccacctgacctgttgcatagtattgtgagactggctgactgcagtggttacagtactctcccatttataatacaagcagcatgatttttaatgcctgcaaaatagagtttccaaagaaatgaaatctcagagtcctttagcacctgctcatgggtcaagggcaccttgacacctgcttctttctttctctgctgatttcccaaccctgtacttcaggtgcacaaatggagtccagaggaggctgtaagagccatcgccaagatccggtcatacatccacatcaggcctggccagctggatgttcttaaagagttccacaagcagattactgcacgggcaacaaaggatgggacttttgtcatttcaaagacatgatgtatggggattagaaagaactcaagacactcctgcttgatacagaacaaaaagagcttaacaggaccaacagggcttaagcccagacttgacgtaacagaaatgtgccaataggtaataggtaatttttctttctctgacttgttttgttttcttgaaataacactgttgtgtggctagaaaggaaaagatttagtgtggcttgtattcatgggatacaggacagggatggggctatcatcttttcttgaatagggctaaagaagtattttaacaaaaatctattatgtacctaatattgtgcctaataatatttagcaccacaactcaaaaaacatttagcacttgaaaaaaggagactcacctctggctctttgccactgtcagaatctgaatctcactggccctgtggagtagggatcctatctggagaagtgggagcatgggctgcagtcaggactgctgcagactgagccatgtgatggtacgtaatgagttcccctgagggaatgaaacaccctcaccccttcaaagtcacccctttggaattcaacacagacacacatatcccttcaaaaacttttatttgtatcaacagttcctagctcttgacttagcttagagcttttaaaagagcagacaccttatatatttgagattgaaaaagtttctgctattaatcagaaataatcatttctattttctggcttaccccttggaataagccaaaaataaaaccaaagttacatttcctgacagatggataagaaaacaatagaaggaacatcctgaattctagagttgactcttgctggtgaagtacaccttcagcttagtccattctcctaagtaaagcctgaaggaaaactcttaacacctaattctttgtggaaaaatgatcaactagccatttcacaggctatagaacaaaagtacaattgggcatctttccttatgtcctgggatcaggggtgcttacatttaacattgatcaggtaaagaggagaggctgtgcctaaggtctgagaaaaggcttgctctaagcaagctgtggtgaggcacaggatgactagggaatggcagagaacaggctggcctactgtcagttcaagcaaccagctgagcagcagcagtctaaaaagccccaaacagaacacctccatggattcagggaagggctgaggcactgcctttctagtatgtgccaaaaaaaacataactctgaattggggcccaggggactttgagtttgtatggggagggaaaaggagtgagcagttctcctcccctccccacagccttaggccaacacaaactgcaaattggtaagcagcaccttaatacctcttgtgacagttacggctgaagtggcagggtcaagcttgtaggtgttggcatccccctttttatatcggtcccggaagacatagatgctcccgttacagctggcaatcttccagagggatggggcagagctccaggcctcaggaaggcaaagccgggtgaagctgtctagcaagggattgtagcacaccagggagtccccttcagccacgatgaacaccagatctttatgcacagctgcgtgcatgcggcctgcaaagggcagcacatagggcttcacatggcatttgtctgtctctgtgtcaaagcactggatgagtcgggaaggtttggtaaagaagtccagatcattctcctccccccctagtaagtagatgatcccgttgaggttggcaccagcagcccctgacacagccacctctagctgagttgtctctgtccacacattatcacctacgcgataataaatgactgcgttggagagggtatcttgcagtgtcttgccacccagtgaatatatggcatctttcccgggcacagacaccagggtgtgctggagccggtcccgaggcaaaggagcacaccactcccagtcaacggtggcattgttgcacttccacatgcgccgtgggatggaccctcccaccacatacaagtctccaccatgcttgcaggccgcagtgatctggtggcacaaactgttttggccacttacactgatggagtcatcttctgcacagtgcaaggacacagccaacgagtgggtacgagatgactctttcccaatcaggtaaatgtgcacattctccccaatttcctattggcaaaattaaaattatatgacagctgttaaattctaggctaaggctcagctaagacacatatccttaagatcctggccctcacacttgttcctagctttatcatactactctctaattactgtatggcatccaactctcctctagtcactttctttgaggcaatttatgccgggcggagaatctgttgtattcatccttgtagcttttaaaaaactctcataagctagtgcttcagacaaagggtgattaagattgttaacttgatgacagtagttctcaaggaactttgaaagctcatagattggtggtactggggttacaaagacatccttctccccagctcatatcaacttcaagccagagataacttattcaaaaataaataaataaatacaaaaaattaaaaaaacaagagatggccgggcacagtggctcacacctgtcatctcagcactttgggaggccgaggtgggcagatcacctaagctcaagagttcgagaccagcctgaccaatatggtgaaaccctgtctctactaaaaatacaaaaattagccgggcgtggtggtatgcacctgtagtcccagctactcgggaggctgagacagaagaattgcttgaatttgagaggcggaggttgcagtgagctgagatcatgccattgcactccagcctgggagacggagtaagactctgtctcaaaaacaaacaaacaaaacaaaacaaaaaacagagacgaccattcataatctggccatcaaaaagaggccaggttaggccaggcgcattggctcatgcctgtaatcccaagactctgggaggccaaggtgggtggatcacctgaggtcaggagttcgagaccagtttggccaacatggtgaaacccatctctactaaaaatacaacaattatctgggcgtggtcgtgggcgcctgaaatctcagctactcgggaggctgaggcagaaaaatcgcttgaacccaggaggtagaggttgcagtgagccgagatcgcaccatcgcactctagcctgggcaacaagagcgaaactccatctctctctctctagcctgggcaacaagagcgaaactcccatctctctctctcacacacagacacacaaagaggccaggttaggccaggcacagtggctcacacctgtaatcccagcattttgggaggcagaggcaggcagactatctgagatcaggagttccagaccagcctggccaacatggtgaaaccccatctctactaaaaatacaaaaattaggcgtggtggcagcacctgtaatcccacctacttgggaggctaaggcaggaaaatagcctgaaactgggaagtggaggttgcagcgagctgagattgcaccactgcattccagcctgggcaacaaagtgagaatccgtcttaaaaaaaaaaaaaaaaaggccgggcgcgggggctcatgcctgtaatcccagcactttgggaggcggaggcgggcggatcacgaggtcaggagatcgagagcatcctggctaacacgatgaaaccctgtctctactaaaaatacaaaaattagccgggcgtggtggtgggcacctgtagtcccagctactagggaggctgaggcaggagaatggtgtgaacccgggaggcggagcttgcagtgagccgagattgcgccactgcactccagcctggacgacagagcaagactccatctcaaaaaaaaaaaaaaagaggccaaattaactgatggcaagaatgcatggagagtatgcagtctcaacaattaagagatttgccttaccttcaagcttgtcctgagtgactctgcaaaagcctctctttcctctttattaaagttgatccaggcttctattgcctctgttgggttctgagaacacggaactccatctgtgagagccagaggaaaggcatggtcaatgacaatccgaaagagaaattcagagtaagggactttaaagatgtgaaccactttattagactactgctgggcatgtgtatatgtgtacatgcatacatacacatatacatgaaattaacctaaaattgctttttttttttttttgaggcagggtctcaccctgtcgctcaggcagaagtgcaatggcgcaatcaccatcaccatagcctcaacctcctgggctcaagcaatcctgtttcagcctcccaagtagctgggactacaggtgtgcaccaccacgcctggctaattttcttattttctgtatagacaaggtctcactgttgtccaggctggtctcaaactcctgccatcaagggatcctccctccttggcctcccaaagtgctgggattacaggcatgagccaccatgcctggcgggtcttgcttttttttttttttttttttttttttgagatggagtcttgcactgttgcccaggctggagtgcagtggcgtgatctcggctcactgcaagctccacctcccgggttcacgccattctcctgcctcagcctcccgagtagctgggtctacaggcgcctgccaccatgcccaggtaattttttgtactttcaccatgttagccaggatggccttgatctgacctcgtgatctgcccgcctcggcctcccaaagtgctgggattacaggcgtgagccactgcgcctggcccgtaccttgctcttttttaaagatagtctcatgtgttacatgagccctcaaaaagttgggtaaagactcataaccgttcctctccatggaaatctttagtaaaaggtaaaagatttatacaatctgaagagaaaccagagtatgtgccttgcttttttaaaatcaaaatggatgactcgatattttcccatctgccatggaagcaacctactaagctacagagctcacaccatttttttttttttttttgagatggaatcttgctctgtcgcccaggctggagtgcggtggcgtgatcttggctcactgcaacctctgcctccgggttcaagtgattctcctgcctcagccttcccaagtagctgagactacaggtgcaagccaccatgcccagctaatttttgtattttttgtggagacgggatttcgccatgttggccagggtggtcttgaactcctgacctcaggtgatccacccacctcggcctcccaaagtgttgggattacaggtgtgagccaccatgcctggccaacctcacaccttaagtatggctatatctcacttgcaaggttaggattgtttcctaacgttggcccatcactaaaaaagtttttagtcttagatatcttgccccatcaccaatttacataggtaattagacccactgggacatacgaagtacaggataaattagagtataatacaaatcactcctcactactctgtgtggttaaatgttgtgctttaattttcctgacttcttcctctaacgcactgtgtctctgacagcaattacactgaatctcacctcaatctttctcagcaggttatctcagtaagaatgcaggaataataatgtaaactaacaccaggaagcttgagggttcttttctcctaaactagaacattcactgaacatcatagccaagtaactgggtatggtgtgtcccctccctaaacttacccgagatgatatctgtgagtaagcggtggggcaagtggagaaattcctctgtattctgcagctgggccaggtgggtcttggcacagtgcttggcagccgtatagagctcaggatcactgtgccgatctgccagccacatcacctgaaggcagtttcccacttgcactgtgcgggccaaaaaccgagagcattcctcaaagagagatgtcagctgatacatgtctgacacctcataaatttcctgcaactcctcagctcgaagtttcacagtcccatggtagatataatcaaccaggagctggaaaacagactcgctgacatcctgcagcacaatcacccggttgtgggcctccttcaggttggaagtgaacatggatcggaagaagcagctctgagctgagaggaccagccgatggagctgaaactcccggccttccaccgaaatggtgacatcagcaaagagctcctcctctagacacagtttcatgatgccttgagccacacggcctgaatgtgaccgatctttgaaagtgtagttcacaaagtagttctcatccatggatgctccaggctcctctggtgattccatgctagccaacttctctctctgccagctgtctgcaaagcaacaccatcttgagtaacctgaggaattcacagccatagtctgtgaatccaactgtccaactcagggagggaaaaggaagaagtgagagcaaagtgggtccagattggccttagtcctggccctatccatgatgtccctgacgctatcctttaaccaaatctgggttcgttatccccagtggcgcccctccgctaatgatataaataaaagttccaactctgggtgttttcctgagaaaacacggaataattcctttccataatgttaacaaaagacttgggatttaggtcaatatatgaaagcaaagggctgggagaggcctgtgatcgtaaaagccttactaaccaaataactggggcataaaactagtgaagctcaggggcagtagaatcagacaaaaaggacccctggccccggcctagtggccaggtcctctccttcccagcgcatggagttaagacgctccatatgaagcctagcctgggatatccgtgggtcttacatttgctctcttctgagctgcttcccccacacttccccgctcgctcgaaagactccctatggctgcgtcccagaacttgagtccatccgcccccaggccggggcactgggaggcccatcaccctgtgcaatgtccccgctccaccttgagtcgtcttggaaacggtcgccagggaaaccgttcttcccgctcaggcccgcccgccctcgtcaaaagcttggctcagagagcgggggaggggtgtgtagcgtagaacccaaaacgcccgccccctcccctcctctcacccgcctggttcttcagcgtcctcgccttctctctaggctctgccacaaggagctaggaccacgctcacctcacgatttccctacctgcctgtctcgctttctcacctgcgttccctcctttcatcccggagcccggaacctccgcttccggctccacgtccgcccggaagaagatctgctgcacacttccgtttccggtccgtgcccttggggctccgtgtcctgctgtctttccgtccgctgcctagtctgcatctgagtaacatggcggcggcggcggtagccaggctgtggtggcgcgggatcttgggggcctcggcgctgaccaggggtgagcacgggcagccagctgagaccggggtcaggcgcagcggcgtgcccagtgcagagagctcctcagggctcatcccgcgcgtctgtgccttttatctccctgtgcagggactgggcgaccctccgttctgttgctgccggtgaggcgggagagcgccggggccgacacgcgccgtgagtatgtgcgggcagcgctcttctctgaactatcggcggggccccttagatgcctgtccttgccctaggatgcccttccctacgtcctcctggcaaatcttggagatctgacttgcagtggtcttcaccctgcatgcagaatcgagccctccctgtgcccttaggcctgttatggccctgattgttccttgtccatttcaatcatcccctttttgtctgattaaactgtcagctctttgaaagcaagcaatataacctttaggcctcagagccctgtaataatagtacctagcgttaattgagtgcttaatgtgtgcctggaacctcgctaagcgttttagtgaatgatcttatttcgtcctcacaacagccttatggggtagatagcatcttactcttcttactatagatcaggaaacagtccaaagaattaaactgcccagggtcaaagacctagtgaatgacaaagtaggcctgcctgctgccagaggcagaaacacctaaccattattctgtagcttgtgatgtgtgattgctcagtggtttagggttgcatgaatgagtatgtacatattatgttacagtcaagatacacggactgggagttaggagacctggcatttctcctttcctgggttttctcattgacacacacacacacacacacacacacacacacacacacacacacacctgggcctcagttttctcattgacacacacacacacacacacttttaaggagagagagagtctgtgagggatcttcaagccctgaagttcttagcttgagaacctggtataaacttgcgtgctaaggagctacagagaggcaaaagttcagttcccatcctcaaacagctcttagtctgacaggagaactgagactactgctttagcagaaatgcaggcaatgtgagggaagaactgtggagtaattttgagaagaggtgaacaccccagctgctatagtaagagtctttctgaggaccgtgtagttaaggtggcactttccccaagttttcatcactgtattccctagaagggaaacctttcacatgcacctttctcaaggtgcttcagggagcctttcctggatttgacatcccttacaagcctaagagactgcatgcagggctggcttttgccttctccatttcttttttaaatatgccttttccttccagccactgtcagaccacggaatgatgtggcccacaagcagctctcagcttttggagagtatgtggctgaaatcttgcccaagtatgtccaacaagttcaggtaatacttactaatgttatttgggtctgggtcaagaaagaaccatgttcgcagggcatgtgggagtgggcagacttgtttcaaagaaactacagattcctccatcccaagcttggacttttctctcagcattaaaccaggtgactccagctgaagttagctgttccctcagtagctctttgttccctctcccctcactttcatgtgtgcaggtgtcctgcttcaatgagttagaggtctgtatccatcctgatggcgtcatcccagtgctgactttcctcagggatcacaccaatgcacagttcaaatctctggttgacttgacagcagtggacgtcccaactcggcaaaaccgttttgaggtcagttgggagatctgagaaggttttgggggtaaggatattaatttcagtttgtaacatacaatagaacacagcagttaaactggaacttcagagtcaagtagatctgaagttggatcttggttctgccactaaatggctgtgggacctcagataactcaaatattttgtttaattttttttttttttagacggaatcttgctctgtcgccaggctggagtgcagtggcatgatcttggctcactgcaacctccgtctcccaggttcaagcgattcccctgcctcagccccttgagtagctgggactacaggtgcatgccaccacgcccggctaattttttgtatttttttagtgaagactgggtttcaccatgttggccaggatggtctcaatttcctgacctcgtgatctgcctgccttggcctcccaaagtgctgggattacaggcatgagccaccatgcccggcccttgtttaatctttctgagctttcattttcttaccgggaaaataaatataaagctgtccttatcttatagaatggttataaggatccaatgagatagttcaagtaaattgcttgcacacagtgttttcaatacatttagctattaatattttactgattatctactgtttgccagactctgggatggagagagaaataacatgaagtatttgtcctccaggagtcccctacactctagtgaaggagaaagacacctaaacagcttactgtagtaacatataatacaaaggatattagagggatgctttaagaaagcaggaggggcacttggccctgtctgggaggcttctttgaaaagagagaatgtttgtgctgaatctaaaatatgagtaggagaccaggtagccttgtgagatggaccagggaaatattcctgacaaagtgaatagcatgagcaaacacaggcatgctgacatgctaagctacagctgtggcctgggcctttggaagtagttgtaagcataggagaatcttgaggttttgaggttcagaatagaaggcagggtcacagggcagaactctcccaatcagggactcccatctcagccctccagatccttctgttctccctagattgtctacaacctgttgtctctgcgcttcaactcacggatccgtgtgaagacctacacagatgagctgacgcccattgagtctgctgtctctgtgttcaaggcagccaactggtatgaaagggaggtgagttaccggatatggtggacctgcctctgggccacagttgcagaactggttcagactacgggatgcagtgtagccccttccccctgttgttagtcttgatggattggctgtttgaggtggtctctttcctagatctgggacatgtttggagtcttctttgctaaccaccctgatctaagaaggatcctgacagattatggcttcgagggacatcctttccggaaagactttcctctatctggctatgttgaggtaggagccttggaactgggacagcagcctcagggagggacttgcagagaacccaggggatccctgggaatggcaagaaatacggtctgtggattgtggtggtttaagagcatgggccctggattcagatcctagcttcatttttgtaacctggggcaagttacttggtttgactgtaactcagttttctcatcttaaaatggcaataataatagcactttaatagatttgtggctggcattaaataatgtatgtgtaggctcacgcctgtaatcccagcactttgggaagccaagacaggaggagtgcttgagtccaggagttcgagaacagcctaggcaacatggtgaaacctcttctctacaaaaaaatagaaaaattaacggggcatggtggtgcattcctgtggtcctggctgctcaagaggctgaggtgggaggatcgcttgagcctagaaggcggaggttgcagtgagccgagatcacgccactgctctccagcctgggcaacagagtgagaccctgtctctaaataaataaatgatgtatgaagcctgctgtattgtaaaggctcaattgatgctgtgtgtgtgtgtgtgtgtcagggtctcactcttgtcacctaggatggagtgcagtggtgcgatcatggctcactgcagtcttgaccgcccaggctcaagtaatcctcccacctctcagccctccgagtagctgggactacaggcatgcaccaacatgcccagcaaatttttgtattttttgtagagacggggtttctccatgttgcccaaactggtctcgaattcctgggctcaagtcatctgcccgcctcagcttctcaaaagtgctgggattacaggtgtgagccaccacacctggccagtgttatccattattgtaatgatcattttaatgatcaaggcagccttgacgacacagtctgtccctaaaacctgaaagtagaggattattttaccctgccctgactctctgggaaggcagtgacggggaagacaccagatgcttagccctcaaaaattacctctgaggtgggaccagtaacgtgaataaagaatttcagtggtgctgcaggttatttgcaggaagatagtgtgtaatattatcactcgtgaattttatagcaaagtaactgtttagaaatgcagagatgtggtgctccagccctgctcttttagttcccagtcactcctgctgtgttagtgctttgcatgctcctatttccctcttgggctacttctgggcagggctatctccctcgcttctccctttcaccccactcctgctatctgcctcacctggtttgcctcttcactctagcacctgatgatccttaccttatccatttgatccccaagtaacaagaaaagctgtgtcaaatgtactgctttagatctggactgtgaatatgccaagggcaccgggcctgaggttgtgtatctgccagtttaggtttactcttttcagccaccgactactccctaatcctgggcaaatgcttaccattaccttgtaagagtgtgtgggtgggtgagcagtcagttcggagctcctgatgtgggagtggtgagcaggggaatctgactggtgctggcagggcatgagaggtatcctacattttggaatcacacactctagctggttgggatgtgatctgacgggtaacacaggtatggatggagacttactgacagaggctgggacaggagtcagtaaccgagaggaatgggctggggaagtcaccaatagccttgtgaaaagtaggctcctgtgtagctataataaggacttccttagtgctcaagcctgccttttgctcctgcagttacgttatgatgatgaagtgaagcgggtggtggcagagccggtggagttggcccaagagttccgcaaatttgacctgaacagcccctgggaggctttcccagtctatcgccaacccccggagagtctcaagcttgaagccggagacaagaagcctgatgccaagtagctccagggaacgcatgtggatcctagacagcgccttatctatgattgagtgtccgtgtaaataaattcctacttagactt

SEQ ID NO: 35967 - DNA, 3734 bp, Homo sapiens
gggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcggtgaggcggcatggggcttgcagccttgaggaaataggtccgagtagttggggaaggctccaaggccttaacatagagaacggggaagcgggggctcttagagaggttggggcgagactgtatcgcccatgcaggagtcgagtaaggagctgagttgatgtggcttctctggcgcctcgccttggacgtccccggagcccattcgcaggctggagcgggaaactgaggcgctgagggctggtgtagtggttgggagcctggcgtgtttctgggtgggggaggggccattcctattatgcggcgcatgtgggctcttccacgttgggtgcgcatgtgcggggggtttgctggttcccaactgagcgagcttctcctcctggtgtttctcatcccttttactttctgcgatcccgcagagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggtgagtgtactggttgtgtggattgatgtgaagggacgaaaactacctaaaatttttctcttgcgtgacaggtttaataattgcaaatttttcatgctaggtcttaaattgctttagtttttgggtgaatttaataaacgaggattgctgctgtggtgatttaccaaattaggttgcggtactagatacgaagatcgttacaaataattttggactctggattccagaatcttaccagctctctttacctggtatcacttaagtacacctattaagtactttaaagtactctttgtcctaatgtaccttaccagcttaacgtgaaatttaagataattggtactaagaaaaaaaaaatcactttttcaggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgaggtaggttatacacgtattcttttctttgaccagaattggatacagtggtcttaacagtggaatttcaaggtaaggattcaggcaaggttgtccaagtaaattgccagatttctggttttagttacattgtattcattcagcatgtctgaagatagatgaaagcttagatctttcaatggaaagttctgtctatccaatagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaatgattatatacattttccttaaaacacttgcaaacattttattcagttgtctttagctacaattgctttgctttttaaaccttggcaattgtggcaaaattatattgcccattttgtagcaacttattttgctcccttccccccatttttgttttaatagggactaatgtgggaagaactggctaatttgtcacagtgcttagttacaactgttaatgtgtgacctgctgttggtgtacatgtgggtacagggtgtttttaaatccaacaagatagagtataatatcaatactgctaaatctgcatgtcctctgtgtgactgatagagcgttgctatttcatttttttaagacaaaatgaaagcaaaatatagagttccaatgtattggtgtagataatctagttgggaatacttttaagtctcaccttcccctttaaactaatattcataattggttcatatgtttaaaagactttaatttacaaattaaattgcaaatgggagcattagatttagttttagacttaggtgggtagcaatgccagtaaacttaaattacgtaacttcttgcaaccacgaaacctgtaatacgctgtacagtaacaagtgttggcattatcagttgaactgtaaatacaaaatgcttcttccaattagtctctatgatgattaagtttctaaaatttatctgaacaccattcagaaacttgttttggggaatttgatagttattgatgtgcatctgttaaactgatgacagacataactcatcattccccagaaaccttttttgattacagtatctaacattttgcctcctcttttttggttttgctggttataaaggtttggattggagagggctcactggatcccaatccttggagctggatcattggattcaaatcataatgtggataggatagggaggatgaattaccaggattcatggagcgggatcagattaccaggaacataggagtggattcctgccccaaccaaaccgcattcgtgtggatttttttattcaacttaattggctattccaaagattttttttttcctatttttgacgattggagcccttaagatgcacgatggaattgtgttttgcgttttttggtaaaaggagcaaagcgaggacctggagataaacgctggagcaatctccttggaaggattcagcacgagtagatggtaaacatttaaaggggaaagggggggtttgtttaaaatagtaaatcagtaagtcacttctaaatttaaagaaaacaaaattggagttgaagaataagtaggtttccaattggctattgccgttttctttgaaaaaataaacattttttaaaaaact

SEQ ID NO: 35968 - DNA, 1456 bp, Homo sapiens
ggcagccgaagagttcacaagtgtgaagcctggaagccggcgggtgccgctgtgtaggaaagaagctaaagcacttccagagcctgtccggagctcagaggttcggaagacttatcgaccatggtgagtgtagggtcttggggtcgaacgcgtgccactcgggagccacaggggttggatggggcctcctagacctctgctctctccccaggagcgcgcgtcctgcttgttgctgctgctgctgccgctggtgcacgtctctgcgaccacgccagaaccttgtgagctggacgatgaagatttccgctgcgtctgcaacttctccgaacctcagcccgactggtccgaagccttccagtgtgtgtctgcagtagaggtggagatccatgccggcggtctcaacctagagccgtttctaaagcgcgtcgatgcggacgccgacccgcggcagtatgctgacacggtcaaggctctccgcgtgcggcggctcacagtgggagccgcacaggttcctgctcagctactggtaggcgccctgcgtgtgctagcgtactcccgcctcaaggaactgacgctcgaggacctaaagataaccggcaccatgcctccgctgcctctggaagccacaggacttgcactttccagcttgcgcctacgcaacgtgtcgtgggcgacagggcgttcttggctcgccgagctgcagcagtggctcaagccaggcctcaaggtactgagcattgcccaagcacactcgcctgccttttcctgcgaacaggttcgcgccttcccggcccttaccagcctagacctgtctgacaatcctggactgggcgaacgcggactgatggcggctctctgtccccacaagttcccggccatccagaatctagcgctgcgcaacacaggaatggagacgcccacaggcgtgtgcgccgcactggcggcggcaggtgtgcagccccacagcctagacctcagccacaactcgctgcgcgccaccgtaaaccctagcgctccgagatgcatgtggtccagcgccctgaactccctcaatctgtcgttcgctgggctggaacaggtgcctaaaggactgccagccaagctcagagtgctcgatctcagctgcaacagactgaacagggcgccgcagcctgacgagctgcccgaggtggataacctgacactggacgggaatcccttcctggtccctggaactgccctcccccacgagggctcaatgaactccggcgtggtcccagcctgtgcacgttcgaccctgtcggtgggggtgtcgggaaccctggtgctgctccaaggggcccggggctttgcctaagatccaagacagaataatgaatggactcaaactgccttggcttcaggggagtcccgtcaggacgttgaggacttttcgaccaattcaaccctttgccccacctttattaaaatcttaaac

SEQ ID NO: 35969 - DNA, 7967 bp, Homo sapiens
gtatcactcagaatctggcagccagttccgtcctgacagagttcacagcatatattggtggattcttgtccatagtgcatctgctttaagaattaacgaaagcagtgtcaagacagtaaggtaagtgctgttttaactattgcactggggatgttaactgtttgggacagcgttttttgtaacaggaacaggaaaaattccagagcaattttgccaattgctattcaacagcaaatccacagttctgagcatttagtttcacattttgttaatatgttttccatgatttatagatttgagattttatacagtatatgctgtattgcttggcaagagaagttataaaaagtttcaaggttagaatgagaaaatagttaaagtagacacagtgaaaaaatatagaaattaatatgtttgttatgtatgctagttagttatatatgttagtattggaccctaatactggagcaaagaaaagtcattttaatcagcattcaaaatatcttttaataagcatattgtgacaatttgttataatttacaataaacgttctatgttataaaacatgagctaaaagatttaggaactcttatggattatttatttctgttttgttaatttaaaaaatttgtttcttggatatatgccttaaggaacgagttttttaaaaagttctgggaaatgatttcgtttttgaaaacagcattttctctatagccacaggtatttgaaaaaactgagggtagtacagtgtgattttgcctcatagtggagtcattatatggttgcaaactctcattcaattcagcatccttgtttttactttgccaaaaaatatggaagcatttttcattactatttaatactcacattatagttgccatattttggtgtatagtaaatttaaaatagcttattaataaagcaagacaaatctttacagtatttacattctataacttaaaataactctgggaatatgtcatcacgttctttttagtgctatgcaattattattatggccaagttctgtcagcaaaattaaatgcccccattaaaatcttagagagtaatttactgagaatctggctacatgttaccttatgtcagcaatcaaagtatttctaaaagctgttttataacgttccatctgatctgaaataaagtgccttacaatttcaaattaaaacaaataaaagacgttttcagtttctaaccccaaagatcctgcttatcccaaactactttgatccaaaagcttgtaatcatactttcatagaaagatataatattctcagttatctattagaatgtagatctttcgtcacattaatgatttatctcccagggctaccaactttgcctcagccacaactgttcactctataaaagtctaactcttatattccaattttcccatatctaaattgctgcacctaagacattgaaatgtacttttttgagcctcaccttagaaacatgttcctatgagaagataactgttacacattatttcaaattcatattctcaattgaataatttactagatagttctaacaccagtattaaatccaaactttaaaaacatcacacctctctcccacctccattctgtgaggccactaaaagccagatatgcaaaccatggcatcttcgattttggcatgaagaaagtagagaacttgtgagtaattgagagagactataactctaattgaaaacttggaaaatactatctttctctacctgttgaatctctttccagaaagagaaaccttcagaatgtgtgacattttcctgataaacattagcaattattaaatattactaatattttgtttagtaaatagctaatttatgaaatattagttccagaacacagttttgcaatgtgctttaaaaagtgtagaatgttaagcacaacatgaactagtatgcatgcacaccagcaccaagaattctgttctccttcctcagaaccaacagtaaccagacacttttaaaggaatgtgccttccatttccctcccacatacaagcaaaacctcaggttgcccatattcccgtaaggatcttcttcatgagtcattttaatgatgtcgaatggtagggtagagtatacagttaaaaactgtcttctcattctctttttttgagagatgatctgaagcagtagtctaattcggtggtcaatgaacaccacccagaaacctcttacaggaaggcatttcattaaggaagagcctggagattgactggaacaattaggctgggctcgcccagaagggggcgcacgtgtacgcaatctaacctgaaagctgctcactacatagttgtaaacatacacctttgtcctcatacctaaataaaaatttaaaagacgctgttagatgcactaaaaatagctataaaataacaaaatgcacattttctaatgaatttaatgttgcaaattgaatgtctttttcttgaaagtatatatttttttaattaataaatgtttcatctttatttaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagagtaagtaaaaagctgttcctgtgtttgatgtgtgctcaagtgtttaaatacctgggctgcacaacacagatattgcatctggctccattaaaaaaacaaaatgtcgcccgggcgctgtggctcattcctgtaaatccagcattttgggaggccgaagtgggcggatcaccaggtcaggagttgagaccagcctggccaacatgatgaaaccccatctctactaaaaatacaaaaattagccaggcgtggtgtcgcacttctgtaatcccagctactcaggaggctgagccaggagaattgcttgaacctgggagatagaggttgcagtgagccgagatcgtgccactgtactcaagcctgggcaagacagccagattctgtcttggaaaaaaaaaaaatgtccacaaaatatccctctacttcaaacaaagaataattctagctcaatcatatatccaatatccagcctttctttggtgtatccagataaggaacaattaaggtcacagaatttaatatgtaagtcttcaaactaaaaattccgggccaactcatcctgctgtgttacctcctcatatatatctcttattattttctcctttatggcttagatttgtgtcctacatttattttttgacaagatctagatgagggaggaagaaatgagttcaaaagtggcacagttggcaaactccatagccacaaagaagcccatattgtccctccctccctccctctctctctctttttctttcttccttcctttctttccctttctttctttctttctttctttctttctttctttctttctttctttctttctttctctttctttctttctttctttctttctttctttctttctttctttctttcctttctttctttcttctttctctctttctttctttctttttctttccttctttctttctttcgttttctttctttctttctttctttttttttttgacagggtctcactctgtcgcccagactggagtgaggtggtgcaatctcggctcattgcaacctccaccccccaggctcaggcgattctcccacctcaggccaccaccaccaccaggctaatttttatgtttttagtagagatggggtttcaccatgttaaccaggctgttcttaaaatcctgacctcaactgatccatctgccttggcctcccaaagtactgggattacaggcgtgagccactgtgcctggccccatatagtctcatggtcttccctgacatcaactacttgggactcaccatgttactctgctgtcatgatcatcatctgcctctgttatctctgttatggtgtgtggccatcacagtgctctggaggactgtgaagaagattaaagagaaaaagaaatatgatgggagattctaacatctttttttttttttttttttttagaagaaaaatagtgttacagagctttttttttcttgggtacaatcctgcccctcatttgatatttccacactttctctttctcctctctttatttttcatttatcttctggatgaagtttgatctgatgcatttggactgcttatgcacttatgtggtcttcagggacattcttcaacttaagcagtatagattccaatgggaaattgaaatccaccatttcctaccaggataactctgccattaatctttggcagagcttggtagaagagaaaaaccatgattcacagataaggctttctaaatgaaaaaatcaagcaggaaacattgattcacatataaagtaataatgtctgcaaaataatctattgaatttgaacatctctacatgatgaaaattggttttctggccatgctgaataaaggtattgctgtcagaaaatattacaatatattttatgcatatgatgtttgttaattctgccagtttcatataacctctagtagggttaaacgttttcataaagaagaccatactcgccaactctgaagctccacatgttctttgttgtttctgaaaagcagccaaggtaagggttggtgctgtttgactgtcacacaatacacagtcaggctaacacagctaaacccctcttgttgtttccagtggaaaattcactatgtggccatatgtgattcctcattttaaacatatgtggttaggaggaaggatactctctgacagaccaaaatgctaaaggaatttacgatgcttaagggatgacggagtacattagatttggtgggtagagattattcgtaagagcagggctacttctttctctgaaacaaagaaggatacagaagtaggcacatttgaaggtatacattgcatgagtaaaggatggaagagaggtctatgggagaaaggccaacggcctgtcagtgccaagctgagatagaaaccacagtgcccagtacatagtggtcatttgaaaaggtaacataatagtttcctttctttcttccttatctttgtacatttagtcaggtattctccttgtctttttatgtatcacctcagtttaggttattttgccagataataatcaactatatcaacatttcacattcacttaatacagaaagttcccctcaatgtttttttctaatattagggaatatatagccaaaacaaactgttttctatttcaaacttgcaactctaagcattagcccaatcagagatcttcctagtgtagagtaatttagaaagacagcaaaatcaaaaggatattagtcattatttaggacatactatgtactagtattgtgtgaagtgctctacacaacttaatttaatcttcatgcaacacggtaagatagatgtgttatttctaacaagatcagataagtgttccagtgttgcccacctgggtaagtggcagaggtagaattccaagatgggactatgcccatcttctttccatttttcctcactttctcaaatgttggtaccatagaaaaatccctggaattaactgatgagttattttaaaaagcatgtgtgtttggggttccactgaagtctttgttaactagagtttgaaaatgaaaacaagataaaggacttgaaaatgttaatctaaaatagacataggcaaacatagtttctgtgtatacacaggtcagtcaattcagtaacactcttggtttctattacaaagtaagtcagtgtttcatttgtggcagctttttgaccatggacaaaaataaacaaataaacaaaaacatgagttcagatggtggacatgccatgattaggtttttgccttagaattttgatcattgctatggtgtgtgattgctggaatgatttggtttttgtcttggaatttttatcatggtcatggtatgtggttgctagaaaattctttatagatcatctagttaacccttcttatttttagatgtaaaaccaaagagtacttatactgagattgttcatacaacaatgggatccatttatatttcttcaggttatactatttcaaaaaagttgttagataatatgacacacttattgaatgcctttttaaaaacaacttctagtaataaaataagttctgttatttaaaatattccactgaatatcttgatctaccatgattactctttactaaatgttactgtgccattttggtagcctgaaatatgcctttaatggttgcaaattcaaacatatactatattatgacttttctaaatgggaagaggtcctattttataatatattaaacataaattttttgtattgttttgagccagtgtactgaaaaatgattaatgttttctattctttaatttttagagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatg

SEQ ID NO: 35970 - DNA, 12651 bp, Homo sapiens
gggcggggcggccgcgggtcgcgggcggatgacgcgccggggccggcggaggagcagccacttcctggggccgccggccggggccgctggctgcactcagcgccggagccgggagctagcggccgccgccatgtcccaccagaccggcatccaaggtaacagcgcccggcgcgactcgcagggaaggggcttccgggagagccgggagagccgggagggctgcaggaccggcagggctggagtcgggccgggagctccggaagtcggtctcgcggggcgagccgggcctcggcgcctctccgcgctcctgcttcccgggcgctgccggcctgcgtcctcctccagcccggtccctgctgccgtcacgttgcagattgatccgaaattcgggggagcgaaggaaattggctttcgaggcggcctggttgaagggggcgtgccttccaccgtccccgacagtcgcccaactttcccccttttggtcacgtagggaagagctgggacagtggaggcgactggggcttcagtacgctgtcgagaaccaggcgagttttctttttcatggtccaaaggagaatattacaggactttgattacaaaaagaaccatgccagaatctttctcacatcagtaggggtgcttcccaaaactctcccgcattttctctccaaataggaaaatgagagttatgttctgagaaatctcgagtgtaagcgtgtgttttgatctttttcctagatactccccaagggaaactgatctgtatggttgcatgtaatgcgtgcagacagttcaatatgcagttatatctgacctccattatttcctggtttgaaattgggcagcctgcaggtactcacctcatcaagagtcaaataatatatccccgggttactcgcgatcacttaacgagttctagtgtaaactcaagctcttactgttaatagcgagtctttctcccagatgaacacttaattgtatgttttattcgtaaagatttttgacaccaccgcacacatccccctgcacgcacgcagaagcaaaatagtctcaaatctgaaaactttgttttatttatccgcattaatttcgatatataaatatgtagttattgactctcatgcttgagccttatagcaagcactacctacttacatagtggttcttgctgctaatagacaacacaggaacgaaattagaacgaaattgaagctttaataggaacacaagggttagttattaaatacatatttattcaatgagtttaatctagcttttgagaaatgcaagttagaaaaatataaccagagttaagactgaatgcattttattgtctttttctttaaacaagttaggatatttgatatatactgttgtttttaacgggaaaatacagaaagtgaattgatgaaggagtgtctgtcataagcttgaaactgaattagagaatgaaagcaggttttcaatatttttcaaaagagcaagaaaagtttttcaaaattgtaatttgctcattattgggtttgagtaacttcagtatattcaccccagtgttatttctgcacagaattatgtagctaaaacagattagaattattaacatacttttaaaatgctaatatttatatttcttaattgtatacagtcttcgttattttatgcggtaaagttttataatactgataataaggatgctacatgctccagattttttctttgtattctaattaacttttccaatatagataggaaagtatttatatgtaagtataaaaagtttactttctttatctttttccacagcaagtgaagatgttaaagagatctttgccagagccagaaatggaaagtacagacttctgaaaatatctattgaaaatggttagttaaatattttaaaatattttctgttcctggattagtggctgttgtatttttaaacttactgtgtgttgtcagtgatttgaactattaattaatatgaagcaagttcaaatcttacggtaacttggattcctcatattttgtgcaggtccctatgggcccctaatttcattctgaattatgtgactatcagggaaacagaaagatgttttttgatgtgacttcttcctcttttactttttgtgtctcagtttctgcaccacagtccatttctaatgtcagtgcttccatctctggaatggaaatcactaaacaggtgattatcaaaaaaaaaaaatagttacttgtgaattattcaattaagtttgtttttaaatataaacaaaggatatcaaactcccattttctccatttgattgcaacctttgccacagaaatgatcatttccctttcttgttttgggaaagttctgagaatataacaaactacaaattgattctttaaaaataattctgtaaacagggaatctggttgagtgggagaatcttttaaatcaggcagatttgaatttgaacaattattgttataggtactcagtcataaatgaatatattaaaatattccagtggcctaatttcttaaatatctgaaaatattttgctttggaaaagtaacttgttctttcacaaactggaagtaaatctaatttgttttctattttctgcttatataaaaaataccagaatagtttgtaaaatatgcatttgtttacatacaacattcaataggaatatatgtatattgtaaaacagcatattttaaaaatactgagctaaaatttttaatgccatcacttcctaagtgactagttaaggaactaaaatggaaaagttaatctaactagcatctctacggaaggaaaatggcactacttcctaagttattattttctggttttacttttttgttttgtgaaaatttttaaataaggaaaattccaaagactaaaattgtatcataaatacctatatctcccctttattaataactgctaacattttatcttatttacttcaagcattttagaaaattcagtgtttttctggtataagagcatcccctttaaacaattttgcttctgacctccttaccctggggcaactacaattgggagttctgatacttgtgcagtctgtttttacatgtatccctaaatagcatatagtgctctttgagtttacataaactgcatgataccatcttactctgtatctttcctttttctgaaaatgttccatttgcaattagttttgatagctcaataattcattttaaatctgaacagaatgttatatgactatgccacacattatttttgcattgtcttattgatgaacattgaggctataacttcactgttactgtatagtgctgcagtgaacacctttgtatttatgtataagagattctgtatgcatagtagattaacagttttacttgattctgctgaataccatttcaaagtggctataccagtgtatacatctaggcaaatgtttaaatctgtagcattatggccaaataaaaaggagttaaacatggttttatttaatatttcttactgtacaattcattgttaatgtcagaaattatacttttgaatggtagtttaaatatattttgttgataacttaagctcagacattttggaaaatagaaatgtaatgactgttataggtcattacattatttgaccattcagttcaactgttatgatcatttttatatgtttctttcttaggctgtgtatattttaaacattttaaccatgttcataaaaagttaacagtttttataatactctatgtcataattactttctatgttaccacatttttcttttcaactttttgatgtgaataatagtaactgggaaatgactatatatttatttttctagtcttcatcacactaccacttgatatctcaaaccatttacctatctttctaaaaataatttttcatagagcaacttgtgattggatcatatagtcagccttcagattcctgggataaggattatgattcctttgttttacccctgttggaggacaaacaaccatgctatatattattcaggttagattctcagaatgcccagggatatgaatggatattcattgcatggtctccagatcattctcatgtaagtaacttttttatagtttgtttaacattaaatgctagaaaaatgtttttgaaatttctaggtcaaataaaggttaaaaaacaataattatttcccatagaagggaatgatcatgaggaaaatccttggattgataacggagaatcaggaataatgtgcttagattcgggagttttgcccttgaaatcaaaataattattactgatttaagatttaaaaatttgtggcaatggcaattttttctttcttttttaaggcagaatctcactctgtcacccagaccagcttgctgtggtgcagtttcggctcactgcaacctctgcctcccaggctcaagtgattttcccacctcagcctcttgagtagctgggattacaggcatgtgccaccacgcccagctaatttttatatttttagtagagacggggtttcactgtgttgcccaggctggtctcaaactcgtggccttaagtgatccacccacctcggcctcccaaagtgctgggattacaggtatgagccactgtgtccaacctaatttgtggtaattttaaaatgactccatgggcctctgaaaaatgaaggaaactgcctggccctgagagtaataattgtaataaatctgagaactaattgaacataatattaaattttgttagtattatcatacatttattaatcgctaccattcaagtgatgggcctgcatacaaacaagtattttaggaaagctggtagtagattgactgtatagaacaatagacagaattaatatatgaatatggcccaatatttaaaaaattaatttgaatttttcttattaaaaaataattatttttaaagttatctagatattttctcaaaagatcatcccattcctctttaattccccatgttctatctgaaagaaatactgggtttgaccatgcaggattatgaaattatttgttaattggtagttatctttagtagctttccatagatactagttgactcttgaatttttttttccatctttgtgtccctcctagaatggtatgtgccatcggtaagccgtgaattttgattcttaacaacttaattcgtaatctttgatacagctttgagaagaatgtcactatcaaagttacttcatttcagttttcctcatattttaattttttattcttgaacttatgagtttgaaaaatgaagaatttaaacaatttatatttttttcagctttaaaatgtggccaggcacggtggctcatgcctgtaatccctaaactttgggaagccgaggcgagtggatcaccagaggtcaggagtttgagaccagcttgaccaacatggtgaaagcccgtctgtactaaaaatagaaaaaattagccaagtgtggtggcgcacacctataatcccagctactcgggaggctgaggcaggagaaccacttgaacctgggaggcagaggttgcagtgagctgagatcatgccattccactccagcctgggcaacaagagcaaatctgcgtctcaaaaaacaaaaaaagtgacattgtaaattgaagtccatcttactaaccattgatagtttagatgcccatgttaatgacggttatttgtacacacgtattttagcatattatagtgggtggacttcagctcagttttgtttttaatgtgattcaggatattaatatattcagaatgtgcttgcttttgtaatgttatgttttcatctataaactaagtaaactttcacaactgaataggttcgtcaaaaaatgttgtatgcagcaacaagagcaactctgaagaaggaatttggaggtggccacattaaagatgaagtatttggaacagtaaaggtattatgtttgtatgtggattctatatgttgcaattaaaatgattaaagaggaactcctaggtaatgggtaattgatacgaattcagatggataatctgaaaacatgagaataagagaaatactgtatttcatataatattaaagttagctgtaatgaatatgtaactttgagtttattcatttgtatctatttgacattgacaagtgatattgaaacatactgattcttctaaagtatatggtaaatatatgtatttacacatatatacacaaattgaaacactgaaatatatttttgaacttttttgtttgtttagagcttttctgattcagaaagtcatataatctagtggatagagcacaagactagatgggaatatattgcttcttcaccattaattgtgaagtgggctggtttcttaatttcatgagtctcagtcttctaaaccacaaaattttgatgataggtagacctctttgtagtatttttttcttttgacatgaaaactataataattttccatgaataattacaaagaaattatattaagcattataacatagtattcagaatctgaatatgttgattattggataatcattgggcagttttctccagaaggttaattacagttgtcctatagacttacaggatgaccaggttcagtatttcactttgccagtatgaaactcatacaaaatatttagtaattataaagcttcatataaaatgaacagtgggtactccccttaaaaagttttgaaacttaaaattgaggattaaagaaaagtaaaaagatattaaaattcataatgctatttattttcatttaaaatcttttctgttaatgattttgtttttcctaaagtaacttcactgtcattttacttctagagaattactgattatagtctattctgtacttacaggaagatgtatcattacatggatataaaaaatacttgctgtcacaatcttcccctgccccactgactgcagctgaggaagaactacgacagattaaaatcaatgaggtaagttacaactacaaagtctttgcaagattttaagtgtttgaaaatactgtatttttaattaatagatgtgggaggataactagagattaaagaagttaggtagcttaggtttattccgtttagtttagagataaggctatgtgcttaatgccttttcagaaaaaaaaagttaaaatgaatattaaactttatatgcattttataaatagcttttcctataatcttcatgtcagaatagtaaatcttccttttgaagtacaactgttgtgaactttgtactttgaatattatatagagaaaaagtgtgtgttacccatttagtgcaaagaatgtatctaataaggttgcctgaagcagattattgttttgttggctttctagagagtctacaaattaacttctatgaactctacttgaatagagatatatatggaagattattatttgagtacctgttgagcatattagagtcaataaatttcagccatattattttgtagtttatcattatttttaatgtgttttctacagccattctaacatactggaataactactgtatttctactgggactttacagaaaagaacaagtggctgaaaccactattcattagctgaaaccactgttcattagcctgagtcacagacagtaggaatcagtctggagaatggttgaatatcatttaatattaaactggtagcaaggatctatcatattattttaattcatattatttgagtagggctttttatgtgatttttttttttttttacgagtttgatagtttgttttatttcttgcaatcagagcccagaggatcatattggggtatgcattcgcatatgttctatgatgttttcattaaccaatatcatttatgctgtagaatctccattcatttttttaaaagtaaaatttctattggactttctgttgcaacactgcgaatgagactctctactagctatcatttatcaagtataaaaatcttaaacatgtgcattgaatgctttcttatctttctcctcttccagtacatgcacaccatgttcttagtaaagaaatctcttaagtctggaacttctgcagtagtataacttgttgagctgtgttgtctttgtacactgtttgtactcctttcaattcagtgcatgatgtttgtgttgcattttctgtccaacagaacaaagtaaagttctatacatattgtatgtagattgttgtttataaattctatcaagtaaaattttacaatcagtggtgtaatctgatgacactctaaagaaattgtgccaaaccaaacataaaaacaaacccacccaaaccccactaactgtacactcattcaaatgttcacttccaacattgtcgtaaagatgtgtcatgcactctgcatgttgacaaaatgctagcaggaccgtaaacaaatgtgaaaaataattttaattataggttgggctagggttgaatgatactattttatagaggttgggttttcttatgtttgccataggatactgctaactgctaaacttgtaaattaaatctgtcatacttaggtacagactgacgtgggtgtggacactaagcatcaaacactacaaggagtagcatttcccatttctcgagaagcctttcaggctttggaaaaattgaataatagacagctcaactatgtgcagttggtaagagatgtataatgattattaagtggctgctctttttggtagtttatgactcatatagggtttattattaatggattttacattttaaatagctttctgatttctaaaattcattttgtaaatgttcattgtgaaaaagtcaaaccatccagaactaagttcctcctttatctcttggtctttttattatatgttttaacttaatttccttatatctggttttaatgaacatattttgtttcttattggcaggaaatagatataaaaaatgaaattataattttggccaacacaacaaatacagaactgaaagatttgccaaagaggattcccaaggattcagctcgttaccatttctttctgtataaacattcccatgaaggagactatttagagtccataggtatatgatacattgtttttaacacattactttcagtttgtttattggtgtatcagccctatattcttacttatttcttgcccagagggcttagctgtagttttatgaagtttctgtacttgtttttatgaagtttatatatgtagttttatgaagtttatgtattgatatgctaattatatttgttattatttgaacttacagtttttatttattcaatgcctggatacacatgcagtataagagagcggatgctgtattctagctgcaagagccgtctgctagaaattgtagaaagacaactacaaatggatgtaattagaaaggtagcccacctattttaaaatcttcagtttttgctaaatttttcttttcatttctatgtagtttatgatgtactgtgatttataaatgaaaatatttatttttcttgttatcatcctaaatccttaggatctcctctaagtgcctgggaactacctgtcatgatccccatctctatatatatctgtacttcctagtaagccacatgtggctatttaactttaaataagatttaaagttctgtttcttaattccactagccttatgtcaaattctcattagctaaatgtggctactggctaccgtattggttagtgcagaatttataggacatttccatcagtgcaaaaagtcctattggacagcgctgccagagctgcatacttgtgattatttctactgcatattaataaggaattacagtctccattatgactgaattatgggatggttgggagtctttccagtttgggggaaggaaggaataagcataaacatttgaattttgggaactaagctaccaattttcttaaattttcttaagtacagataaggcatggggaaagatatatattcttgagcccttaaactcataaaaatacaggtccttaaaaactaccagtgtttttaggttctgaacccttcatgctttttaagttcctaagaatcaatcactttatcatgggtagcaccttctatagcagggatcagctgactttctacagaggaccaaatagtaagtaaaggctttgccaagccacatataatctctgtcatatattcttattgttgtttaacaacccttaaaaaatgtaaaacaatcttaccttgggcaagatttggccttcgggccatggtttgtttacctctcttgtagagggctttcaagtgacccaagtgatgaaagggtcatgagtaaatgttccttgaataaatagtgtatcatagcaacttgagaatgtagtggtggcttctacttttaaacattatttaaactggagcactaagaaagaaccaagaaggaagtgaatgtagctgattatatattcaagtaactcatttagccccttcccccaaaagaagaaagtgaaactgtttacatatggtccttgattctgccttactggaaagggtattatttgtgagcattcatatacctgaaaaccagcttgttgcttgtattaggttttgaatgttgtgcttctaattttatcttttacagatcgagatagacaatggggatgagttgactgcagacttcctttatgaagaagtacatcccaagcagcatgcacacaagcaaagttttgcaaaaccaaaaggtcctgcaggaaaaagaggaattcgaagactaattaggggcccagcggaaactgaagctactactgattaaagtcatcacattaaacattgtaatactagttttttaaaagtccagcttttagtacaggagaactgaaatcattccatgttgatataaagtagggaaaaaaattgtactttttggaaaatagcacttttcacttctgtgtgtttttaaaattaatgttatagaagactcatgatttctatttttgagttaaagctagaaaagggttcaacataatgtttaattttgtcacactgttttcatagcgttgattccacacttcaaatacttcttaaaattttatacagttgggccagttctagaaagtctgatgtctcaaagggtaaacttactactttcttgtgggacagaaagaccttaaaatattcatattacttaatgaatatgttaaggaccaggctagagtattttctaagctggaaacttagtgtgccttggaaaaggccgcaagttgcttactccgagtagctgtgctagctctgtcagactgtaggatcatgtctgcaacttttagaaatagtgctttatattgcagcagtcttttatatttgacttttttttaatagcattaaaattgcagatcagctcactctgaaactttaagggtaccagatattttctatactgcaggatttctgatgacattgaaagactttaaacagccttagtaaattatctttctaatgctctgtgaggccaaacatttatgttcagattgaaatttaaattaatatcattcaaaaggaaacaaaaaatgttgagttttaaaaatcaggattgacttttttctccaaaaccatacatttatgggcaaattgtgttctttatcacttccgagcaaatactcagatttaaaattactttaaagtcctggtacttaacaggctaacgtagataaacaccttaataatctcagttaatactgtatttcaaaacacatttaactgttttctaatgctttgcattatcagttacaacctagagagattttgagcctcatatttctttgatacttgaaatagagggagctagaacacttaatgtttaatctgttaaacctgctgcaagagccataactttgaggcattttctaaatgaactgtggggatccaggatttgtaatttcttgatctaaactttatgctgcataaatcacttatcggaaatgcacatttcatagtgtgaagcactcatttctaaaccttattatctaaggtaatatatgcacctttcagaaatttgtgttcgagtaagtaaagcatattagaataattgtgggttgacagatttttaaaatagaatttagagtatttggggttttgtttgtttacaaataatcagactataatatttaaacatgcaaaataactgacaataatgttgcacttgtttactaaagatataagttgttccatgggtgtacacgtagacagacacacatacacccaaattattgcattaagaatcctggagcagaccatagctgaagctgttattttcagtcaggaagactacctgtcatgaaggtataaaataatttagaagtgaatgtttttctgtaccatctatgtgcaattatactctaaattccactacactacattaaagtaaatggacattccagaatatagatgtgattatagtcttaaactaattattattaaaccaatgattgctgaaaatcagtgatgcatttgttatagagtataactcatcgtttacagtatgttttagttggcagtatcatacctagatggtgaataacatattcccagtaaatttatatagcagtgaagaattacatgccttctggtggacattttataagtgcattttatatcacaataaaaattttttctcttt
